United States Patent 7,868,149 (PLANT GENOME SEQUENCE AND USES THEREOF) - sequence listing, part 50

SEQ ID NO: 26747 - DNA, 37451 bp, Oryza sativa
  unsure (1)..(37451): unsure at all n locations
gggaggaaggggaaggggagagccaggaggacggggaggaggcggaggagagggtggcggaggcggcggaggtgggaggaggaaggggagaggtgggtggtggcggcgaggaggaggtgggagagggaggcggcgaggagggcgagggagaggaggaggtggcaggcgaggaggaggagggagtccgccattggtgacctcaccgcgagtgggagctcggtttccggggtggtcgtcgtcgtctattcttcttggatagcgacggtggtcggtggcgacgaacgcggcggtggtggagggggaggaggctttctcaggtgtggacacgtgggcggtgaagattggagcggttgctcttttctcatttttattatttttcaagggaaggtgttactgactttttgctgtagttctacggtggtgtggtgtttggatcaggatttaactttagtcatgtatttaaacactaatttagagtattaaatataaattacttataaaactaattacataaataaaagctaattcgtgagacaaattttttaagcctaattaatccataattagataatgtttactatagcatcacataagctaatcatggattaattaggcttaatagattcgtctcgtgaattagtccaagattatggatgtgttttattaatagtctacgtttaatatttattattagtgtccaaatatccgatgtgatagagacttaaaagttttagtcccatctaaacagggcctacgaatggtaagagcaggtacaatatagcaggtatttcctccgtttcatattataagactttctagcattgtccacattcatatatatgttaacgaatctagacatatatgtgtgcctagattcattaacatctatatgaatgtgggcaatgatagatagtcttatattctgaaacggaggtagtacaatatagctggtgtaagccagcgataatctgtacagtatagctgtctttgttcgtttctccatcaaggaggagatgaaattttggattctcgtggcatgcttttcaaactactaaacagtgtgttttgtgcgaaaactttccaaatgaaagttgctctaaaatgtcagattgatacatttttcaagtttgtaataattaaaactcaattaatcaaacattattaccatctcgttttatgtggaacacttaatctttatctccatcttcattttcaggagattcaaacaccaaaaagtctaaaaaattgagattgacgaagccaccataggtgtctcgctgtcaacgggtacatcgcctatcattgaaagcacaatatttaattcgttcccacccatgagagtcgaacccagaacctaaggtgttatttagacttttgcaaccactagactatatgccatttcgcaacgataatctgtatatgatggtaaaagtggtgatctgtatgaggattgagtggagagatgtatgaggattgagtgaagagagagcaaaaacgggcgactaatttatcgacgtagactcatgggcttcaacgcgagtgaagcagcataagattctactggccaccctgatacacggctgctctattcagttttcacggcagaaaagaacgagtggataggactaacaataaaaatgttagaataaaatattaagaagtaaatatgggtagataagctaatagtaacatattactgtacatgctctctattattaagttaacaatatattattggcgtgaatatttttggagctaatagttggcatactatctcgctctaaacaggaattgggattctgcagtacaacagagtttagtgcagaggaagaacaattgtggctgcatttagatcatttttacatgcatctcactaaattttgtgaattggattgtactccttccatccgacgctaatgacttttcaaataacgtttgactatttattttattaaagagtagtaaattacattttagaccatattttattagcaatgttttattttggatcacccttaaaccaatattttcattttggacttagtaacttttccattttttttgggtttggactatcctccattatggtgaagatatggcttacatatatgatatatggatagagaaatttaatggtgtactgagactgatttgcttgatttttttgatggatgctaaaaaagttatttgctgtgatccaaaaaaaaagatttttttagggtagttcaaaataaaactttgacaataaaagtcttcaacaatattgtatgaatatcattttattttatttatcaagaaaactataatcttaatttacacttttacatatttattatgctaaatttttaaatatgatagtcaaatattataaaaaagtcaacacaatcaagatggaaggagtatattccattacatatgctacagtgcaaaatagttcataatgtgattttaacaagtgcattgtgcgctatcgctatcgttcataatattgtagccacagtgcacctctacagcatatttatatagcgttgtcgagccactggtcccacaaagcaaagaaacattccagtgttggagttgcaagagtttaaatctgatcaacccaaaacaagccatacacatttttctatatctaaagaaggttgaatcgaataaggagaatatgactcgatcctaacaaagatcaatgtcaacgacatatgactcgatgaaaagggtaatttgatctggatttcatcctcactctgatctctcctctcatgagaactgatagctcagctattaaccttaaattatgtaagatctttaaattatagaacgatatacttattagccagctctgatattcgtccacacttttacttagagatgtcaaatttcccagtgctcttgtccatatgattaccaaaaaaaaaagaatgtcaacaatacacagaaacatgattcgcccatcaaattgcctttgtggccattagtgtttcctacgagctagccaattacgtggcaaagccgcgtgtcttttctagttatttataatgtacgcgtagtagctattattcttaaataaaaattcatagaaccataaaaaatacataaattaaaattacatttataagaaactcatatatatatagaagcctgggaagtactccgtatgtcgctgaattgttagttgtattcaaagaaaagagcatgccgcatgccgttgaattggccgtatcgtaggcttttggtcttggtttgcaagtaccagtcgcacgtatgtatcagataatttaatacaccaaaacaaatgtttacttattataccacctgataagtatatcgtcaatataatttattaaaagaaaaaccataatcagcttaataatttgtacttttgcttaaagaaagaaaataatcaaacaagtttactcatcatatggatataaataggattaattagacacatgctattacaaatttgaaggtttggaaaaatatcattactattcaacaaattgtaaagatgtcattacaaatttggagaaactgaatcaatgccactctctacgccagaagcatcattgttgaccacgtttgactcaacggactacctatacatttgtcgacaaattttctcttaaaaatttgtcaaatgtaaatacaatataattgtactgtaattacactgtaacttacaataattacactgtaactgtactataacaacacggtaactataataattacactataatttacatgtaattacactgtaaatataataattacactgtaattacagtataactacactgtaactataatataacttgcatataagtgagatgtaactttagaaaacttatgtttggcactgcccacgtgaaagagggattacgaactcgcaatgtatgtttgtacgatacgtgcggaggtcatcattcatgcatgcatgttcggctatgccctgccgctttatctttgcccttcgtctgtcatctagacatctacgcgtgcatgagccacacctgtggccggcggccggcgaacgtcgaaagaaacaaattaaagcgtcgacataaaagcacgaatcccgagtttcatcaagcggttcaaaaatcgacaaattctgaggaagaaatttgtcaacagatttatagcaaaaccgccacgcattaggcggggttgggcggccggcccagctacggcccgtgccgccctaaccctccgtatccttcttgggccgcctaccaccacatccaattcacaattgggccataaataaccagcccaagtgtccaattttaatcctgcttatgtgatgctttcctgagtcaattcctcgacactgctcacccccgtcccctactatagttaggtgtctaatgtttctctctctcccttctacacaaaataataatcatcttattttggtaatgcgatatcttctcatatatttattttttaaaagatatctatcaaacattgactcatatttgcaaattaatatgtttactagtatctttttagagaatccattatatgtcactgactttgtcacccgtctacgattttaatatatatctttttatgtataatgaattatgtatggcgcaaaaattattactttattttaatatcattttttttgtttgccttaatttattaattatactatatgttcatatgattacaacataaatatggtattttttatgtttagttgttcttattgagacgagcatcttcgtcccatctttattttaatcctgcgtccgccactggagtcgggtcagcaggagcagcacacattttatcccctttctagttcgatttagacctaaccctaccagcgacgacggcgacgtcgtctacggcggccgcggcgacgacaacgtctacggcgatggcacgggctgcggcggctgcgtctacggcggcgacgtcttcggctcggcagcggcgacggcgtctatggagtcagctttagtgcaagagtcagctcttgctgcaaatacacaatatcagcttgtaccttgagctgccagacatatcctgaacagagcacctagagtgggaaattaaatccacataattaacgcaccgaaattgaatccacataattcatagacaatgattaacattacacaaaatggcactgatttacctacttgcaccaaatgtggctacaaaatttacagaacatatatagaaatacataattatgaccaacaagaataacatcacataaagttgtctactatgactacacttctcttctttcaacatcttctttagctgctcacactcattcttagaatcattcagctgctgatatatatatggattgcatctgtctaaggtttggctcaaccaaaccctgcatcctcgacttctcttccttatgctcttctgcctctccccgccattgccgccaaagtttgccgccgccgacgccgcctccaaatcccgccgccgccggagaagcctagggctaggtttatggttcactgggaatgcgccatgcaccgcggtcaaactgattccactcggtccctacatagtcatacataagggcattatggtccatacataaatacggtatgcacaaaaccgagtacaatcgcggatcaggcgtagaacgtggcatgtttctagttttatgcgatttgtaatggcaattttacaatttatcgaatagtaatggcatttttccaaaccttcgaatttataatggcatgtgtctaattaaccctgccatcatggccaaccgaaatgcgcatcctgctactggtcaccgccgcggcaattacagatttacaccggaagggaatagatggtctgggctcctccggatatgattggtagaatacattgcaattggtcatagaggaaaaaagagaaggaagaggaagaaaaaggacaggggctaaaagaaaatatttactggtataatataaaaagtgacatcgcttatactccttccggttgataatacttgtcgttttggataaggacacggtctccaaaaaaaacaattttgaccattatgtttcattataatatgtataaaattgttagcaaatatatgatcttattaaagtacttttaagactaatctatacatgtagtcaccatatttgaaagacaaatattttaaaaatgattcataatcaaagattctaaagtttgacttcagccttgtccaaaacgacatgtattatcagcccggagggagtagctataaattatagttaccctgttaaaaaaaatatatgaactaaaatgatataccttaaagggttagttagatcatatcattataaatttgacagttttaaagaatactaccattattcgtataactgaaatggtaccactacaataatatgaaaattggattcataccatactgtacactaatttaaataggtaaatagtaatgatatattttcaagtaaatttcagaaaactacaaccaaattatcgtaaaacttcatatttataatcttgtattacaaaactacaaatttagcatggaaattttcatagaactagagatttaaaatataatatcccaaaaataaagattgattagcaaatttaataactacaagttttgcatcaatttaagtacaaaactacaacgcctaatagttccaacataataataaggggcaattacatatctgaccctcttttgaaagctaactaccaatttaaccatcttatatcaagtttgctcatttgacccttcatttcaaaactgaagatacggtaggaccctattctatcaaaggcatgtaacggtcttaaaaggagcataaaatttctcttctgcccttgctcttttgaccctattttaccaaagcatttagttagtttagcatagttttgtatggtggcaataatgagaatgatttgtgcacttagtgtaagtttcaccgatttgtgacaagtttgactcagactttggtcaaatttgacctatatttgttatattaaatttttcaaatttgacttcagtttgacaaaatggacttcaatttgatagatgtttgacaaatttaacatagatttgataaaaatatgaataaacttcaataaaattttagactccatcatcctcgccacgtcatgcatcgtcgcagaccgctgatttccgccaatgttgtgccaccatcactgacccgccacccgtacacctcagcaccgccggatttgcagcccgcatgcccagtcacctctacatccactgccaacgcaactctgctgccctggccctgccgccgccaacccgccgctaccagatccaccgcctatacacctcggcgccgccggcgcaaaattacagcctgagctgctaccgccgtgccactgtcgttgtcccgttgccaccggatccgcaaccggcacaccttgacaatgtcggatccgtagcccagatgcctaagcactgccggatccaccaccgtagccagagcttcgctgcctgggcctcgccaccactgctcgtccttgtcatcgtcgggcctctgccgcccctcctcgtctgattcgcccgcctgttaacaaccaaatttggtaatccaagtatcggagatgaagatagaatcgaagcggaattcaagatggagatcgttacggaaacatagcgagaatcggctaaagtccgaatcggctatgatcaggatcagcagagttcgagtcggactaggttggccgattgagccgataccgacaatatgacgtaatgcatgttgtcgggttgagttaatgtgcttcatatggattgccatgcacggatagagtcctgagaaggcaattgtatctattaattatgatatttcatgtaatttccttaaagatatgtttgggcaaaagtctgccgcaaagacttatggtatcttaaaagtttgttagaaataagagtcgtgtccgacacggacatattttgtaatctcaggtataaatagaccccgagccccatgtaatacaacaacacacgttcaatacaatctcgacgcatcgccacccttttactttggttttgtttcgacgagttcttgctttcggattgagctgcatcggtttcgatcttcaactagaggtaaaacttgttatggcggcttgcgttttcgggattagtgcttccatctttatgatactctaatcttgtttatgtagttcgttgagttatcagatattctatataatctcaggcaatattgttatctaaccctcaaatcggctaacatctgttgctaaaaggcagccgatcaggttaaatactattgttgacttagattatataggatatctaccgctctatgaaatatccaacggcttgattgtctagatattgtccttcttttcatacttatagctgcatcagttgagtttgatcttataagttgtcttagaatctcaatctctagcctgcttttggttgccgattagggtagtatcggggtttcaaccgatcttacctgatttagctttatatttcatgtatttgattgatattgaaagtgcatctaggcccctaatgattttggtgattaattacaatgcgattagagaggactaacatttttatttaagcaaatgtgaaggttgttttgtcctcaatgagttagcgtaatacatatcccgccgaatacgttgatgtgatgtaatgcggcaaatgagcaaatggtattttgtacgttttcgtttccttgagttaataggaaagccgcactattaagagggatgatgcattgacatacgaggagtgatcaaagtgctcaaaatctatttttaaaaagtgtttctcctcagtttggtgtgttctggattttttcggagttttccgaaactcattttcggactttccgaaaacacacagaaccagattttcgcttctggaaattttcggatatgtccgaaagtgattttcggactttccgaaaaagactgcgaaagcaaaagtggttttgtatattttcggacttgtccgaatctgatttttggattttccgaaaatcatcagtagagtcaatttcgcttctgtatatttttggacttgtccgaaagttatttttggacttttccgagaacatccagaacgatgttgttggtactagaaattttcggacttgtccgaaaagttttcggaatgtccgaaaaatccttcgttaactttgttgttggtgctgagctggaattttcggacatgtccgaaaatctttcggaatatccgaaaatctgaattattgtgcataacggacagaatctgggctgtggctataaatagccccctcccctcacttgtgagggctgctggttccattccaatcatttgtgcccttggcttgctctttctctagcacttttgagccttgttttcttgttttccctctcacccgtgttcgatttggatttggtgtgtgtgtgagagttgtggattcgagtttgtgggagtgcttgttgttgacttcgtgaagatttgtgagcactttcatcatctccgggagttctttgcttcatttgttactcttggaggttgaggactcctaggcggctaggtgtcgctcccgagccaccgatctacttatggttggccgggagaagtttgtgaaggtcggatctcacctccaaaagggaagagatacccttagtggaaggaggagtgcttagtgcaacctcttgaggaaagggttagctaagacccgactcttagtgagctcctcaacggagagtagaatcccctcaaggattcgaacttcgggaacaacctcgtgagcttcatctttggtgactttacttcctccctctccactagctttgcttgtttgagccgctacaggtctagttgctgtttgtgctagcatattcttgttgtaggcaactagatctaggatttactttgctgtttgtgctgactccgaaaattttcggatatatccaaaaatttcagaaatatccgaaaattagtgcttccgcttttaattgaatttttgaattagcctattcaccctcccccctctaggcctaatttacactttcagatatgctagatcttccctttatattaagatcttattacaataaagtatattaggcttttgtttgatatattttacttgttttaatatcttagtatagagtgatatcggattattagccgatacatgctagatctattggatcggctatgctatgaacatctataatctcattgttagtatatacttcgatctaagtgatttatactgtctcggtatgacgaccgatctatcccaattacttgatttaagtttatatcgacataaggattatatattgttaatatctacagccgatcgagtagatttagtcttttcttatttattcatggttgccgatcgattcacatatgacatcggctcagagataaataatatgtcatcgtcaactagccgatcggctatcatttatggatttaaccacgatttctttgtctttatttcttgttgattgcaggatcaaatcaattggcacgctcacgaacctaaaaggcaagatttttggacctgcactagagttaagcagatctctccggcctcgtgttttttacatcaacaccaccgcagtccaagctccgccacccgggccccgccgccactgttcctccgtcgcgtgcctgcttctgcacggcgaggagagctcctctggagagagagggagagaggggagagggagaggaaaaggaatgggaagtgataaatttggggatagggttaatgtgtgtaatcaggggtattttggtctattagaacacattttttttcttttcttaaatgaaaccagaatggtataatagaaacagggtctaatggcaactccaattttgaaaaacaggatctaataagcaaatttgaaaacgtagggtcagattgttaattagacttcagaatagagtcgaatgaccaattctccctaataataatattgatagagatttaaactctacaatatgctttaattaaatatatagtttttttagtttccactaaatatgcagttttataattattgccttagttttatgtagtttctgtactttttatgaaactagaaaaaatacacgtacgttgcaacgggtaaaaatattttctcattgataaaacagctattaggccattcccagcccaagacactagacatagtttctataaacttcacgtcatcgagaaaatagtactaaagatgctactcttccaatgcatacaccactactcaatacttaaatttaatactacttatctcatgtgatgtcttcgatattgtgtagaaactatgtctcatgcaagatatggtttcttctctttcctcatttattcacttaccacatcatttttcattttagttggcagcttatttaatgctatagacaccatcctagttattggattgggaatagcattagaagctgagcaataaatgaaggatgaacagggaattgcttttttcaatcaattagagtagaaatacacggcgaggcatatctatgtcgtgacgatgctggggattggatctatttccgtaaaaaatttcgtccgtctttttttatttttcacccttttttccttttttccagtccgttttcctttttttttctccgcccgtttcttttccttctttctgtccgattcctttttctttttttatccgtatattttttttctttctttccgtccttttcactctttttcttttttttcacagttttttccgtttgtttttttttcgcttttttttccatctggttttttctcttcacctttttttcgctttttaccctatgctgttttttactttttttaggtctttttaccgggttttttcatatgtttgctgctgttttttagttgtattttctcgcacgcggtaaggatttgtttttttatgtaccatgtttttttatcgcccggctaaacactaggtcgatctgccttcccatgcgttccctcctccaattgattgccaaaaatcaattccccgctacccctcatcattttttctacgattttcccttttaactctgctctaatccactgaatttaatctctatttaaaaaatcaccgtttttatcccgagttttatcacttcgattttaataaaaacggatagaggagatcaagtgtatcaaaaacaactacgcccgctagggaggttgccggatgatctggatcttggctaaggggttgggttttggtttagcatgttaggtgtcttgttttagggtgtttcgtgggtgtgttttttatctgattgatgggcctctgcagtgatcctatgctccagtgttaacttgttcttttaagtcggattttttttctcgttctgttgtgtaagacctctgttatctttggctttgtttaaaagccgggtattatgaatgcctgttataaaaaaaagtgtatcaaaaaccctcaaccaattttgaaagatcgtaaaagattggaccggatttgacgggtatcggttttggcatgtacggacacaacattgtctttgaagattgaagaggacagtcagctatgcgagcaggacatacaactccacttgacaaggaatgaaatgagcttttggtccaaaaccaaagagtaaaatatataacgatccaaaaatatttttacccgttgcaacgcacgggtattttttcagtcagaaaaaaaaaccgaaagcccaaaaaaaaaacttccacgtaagagaaaaactaatcggaaaaaaaacaaaaaaaaacagatttaccgaaattaaaccgaaagtcttaggtattttttattagatatagataataaaagcgaaatggcatgtagcctagtggttacaagagccttattagcacttgaggtcctgggttcgactcccaatgggagcgaattttccaggatttaacggcgttgtgctttcagtggtgggcgacgtacccctcgatagcgaggtgcctatgatgacttcgtcaaactctcaaggatttgccggcccagtcttttcgaagatgctaggggtagtgtttgcgtgcgtgcgttcataggggtgagtgtgcgtgcgttgtctctcaaggacttgccggcccagtcttcgaagatgctaggggtacggtttgcgtgcgtgcatttataggggtgagtgcacgtatgttgtcaatgtctgcgttgtactgtgtaattcttataaaaaaaaggtatagataataaaaaaacaaaagcacttccaatctcgtacgcacgagcgcacggatggacgatcatggggacgtgtctcagatcgatagttacgacctttaaccgttcatcttatttaaaaaaattataaaaaaaattaaaaagataaatcacgtataaagtattattcatgttttatcatttaacaacgataaaaatactaattataaaaaaatttcatataaaacggataattaaacgttggatacggaaacttaggaattgagtctttttgggacggagggagtagaaattacgctcgtggaattatagtttcgattcagttcaagctggcaaggaagcagtacaatagtacaatagggtaggattgggttaatttctcaatctttctgcggtaatgacccggagaatgctagttgtcgggcgtccgatgggagggaagaaaaatcagacgctgcatggtctgccatttgcatgcaaagaatctttccctacgtgctttcatctctcatttcttcaaaagattttttctcataaactatttagctaatgtacgatctgattgcatcactaaattcgttacaattaaatctttacaacaagaccacacatgattatattttgataaaaaaaatattttagttttttattgattttttttaatgttgcatatggtctcttttgatgtttcaaccagtagttttacaatgtttcagctagtctactcataatgttttactatgtacggatcaaatgttgcattggattttgatattatggaacgcgctgttacaacataaaaacccacgtattttggaaacccgctattaagggaattcgttttattttttgttcaaccaaaaatgtttcacctagtgtactcatgatgtttcactatttatagatctaaagttacagtgatctgagatactctattgcaacaaaaaacccacatattttggaaaccctttattaagggaattcgttttatttttttgttccattaaaaaatgtttcgtttagtatactcacaatgtttcactatgtatggatcaaatgttgcagtgaactaaaacattctttcgctatttgctgaaacattgtttttatataaggtgaaacaacacccgatttaaacgagtgaaacattttcgatctacttattgaaacaattccgatatacctggtggaacatcgtgcaacattaaaaaaaatcaataataagctaaaaaatatttcatcagaatatatccatgtgtggtcttatttagaagatttaattgcaacgaatttaatggtgcaatcggatcatgatttggataaataatttaagagaaaaatcagtttgaatttgttttacacgtaaatcggcgttgacgtcatgccgatttttaaagatttggatcgggcgaccgatccctagtcatccccaaatgacccatgcgataacatgtgcatggatttctgagcaacgatatacataattttttttcgacgcacatggaaaatattttaacgcaagcggaagcgaactaaaaatactaccggaaacctatgtatatatatatagtcagattagatcttttatctttttgtgattatgaatttagattgtttatttatttttttttaaataaaaagaggacaatcgaagagagtgccaagagagggggccgggggggggactcgcgcgtccggaaggggatttctcgcgcataatgagaagactgacaccgataaaaaaaatacctcaacgtaaaaaaggaaaaatgacgacaatagataaaacgacggaccaaaataatactacctccgttttttaatagatgacgccgttgactttttctgatatgtttgatcatccgtcttattcaaaaaatttatgtaattataatttattttgttatgagttgttttatcactcatagtactttaagtgtgatttatatcttatacatttgaataaaatttttgaataagacgaatggtaaaacgtatgagananagtnnnnggngtcatctattaaaaaacggagggaatacctacaagccttatgtacttgaatttaatttttattaaaattttcatgattaaccacattctctataatttttttaattttttaaagctcaattgctaattttaataattaatttaaaattaaaactaacttaaaaaccctcttctaaggccctatttgattcagcttaggattattataatctagcttattaggagtaagctgaaacaaacaagtagattattatagcatattattataatctataagccagattattataatctaataagctgctatagaggagcttttttcagattattgagtggctaaagacccactatccctacatacttgagaaaaattacccacctatgccatcaaccgaacagatagctgagagcattatagactttatcctttcaaacccaataatccatgcctccaataatccagacaaacaaataactcacagcttattctatgtcagcttattataattcagcttataataatctggcttaataatctagattataataattataagctgaaacaaacagggcctaaatctgggatcaaatctagcccattcttccttcttcacccccgagccgtcccgcttcctctcctctctcttgagccgtcatccatctgttcgctcgggcccagcagccgccacacttcctctcctacctcttgggccgctaatcccgtgtccgctcaggcccagcagctgtgccagcccatggaaagaaagcggacaagaataaacccgagaaaaaaaaggcgaaaaaaagagaaaaagggcgaaaaaagaaaataaaaaagaaatagtggaaaaaaatttagacggatgaaaataaattcggatgccttgcgtaaaaatgcccgtgcgttgcaatgggtaaaggtgttttttcagtgatacaacaactattagaaaccgagcaataaattaaaacattgggatcactatacattataatcgaagaagttaatgaaagtccttcgttggtttttttggccgctcggcttatctctccttggtccagcacataaacatatctagctcgcataaccgactgcatcttcaacctccggaagatgccacgcatgattgtaagttcaagtgccttaatttggttttggtgattaatgacaaatctaattatatgtgacggagcgtggggctcctcaccgggagaccgcgcaggcccccctttgccggttcggccgggggcgctaagtgaggttcttcgccctcgatctgaggaacgtcagcgagagaggaaatgcacaagacacgggcgacgtagacaggttcgggccgctgagaagcgtaacaccctactcctgtgttctgatggatctgtgagtgaaggaatacagagcgcccgagagcgagagagagttcaggctctagaacccaatcgctagcgtcccaactcttctttcccccccccctttctctagacctgggcctcctttttatctggtccggggtcaccacattggcctcctgctgcctaaggagggatacatgctttttacaatgagggctagtctacagccggaagtgacatctgacaagcagagcacacgcctcctgccccgctcgcccgcttttcccggggacgcccacttcaaccttcatttaatggccagtgacttccttgccatacttgcgctgaagcctggaatggatctgaccgggactgacataccaactccaggagttagcacgccggctccggctagggacgagagccaggaagctctcatcattccgatgggacgaggcgaggcgtgtgacaggccgcctgttgccacctaacccgcgatctgaccggtctgtgaccgtcacacaccgcgaccggtcacggaccggataagcgtgcgctgtgccgcattaaatgcggcgtggcgcgctcgtccaacctgctataaatgcggttaggtgagcccggtgggctcgcctaacgcaccgacgtggcgccaagaccacaggggggcggggcgccccatccctcggggccgaaacgggagcggcccgacccctcggggagacagagggaggggtggccacgtcaccctcgggcccgacccccccgagggggtcaggccacgtgggtgaccgcggctacccaagcctctagtcacgatacccccggccccatgtcaccgacaatatgatactaacatttttatgagcttttgtttgactaatctcatttggatatgaaagtaaaaatgatgagaggtatgtattaaacttcacatattctaactttgtctctcctgtggatccaaaatatagtgtgagctccctcattgatcttgattgattatgtgcatatgtgttcctttatatccatatgtatgcacatcttgagggggaggttactctatattttgtttatttaagatttctatcttgatttgaaatcatctttcatctcatctctccatattgtttatatcggattattatctatcacaaaagagagaaaagattgaaagatcttgaattaaataatttgtgtaattgttgctttggtgatagatgataaaccgatatttatgggattaatctctcttttacataagttttcaacaaggttatttcccgataataagatgtggtagatatgcattctttggtgatggaccttaatcatgacaaggatgaaattcgtggagataaagcgatatgtatcacttcttatctcatcctttttgataggttcatatatatgatttccatgttattgttatataagtgtgagactaatgtttacttgagtcttatcttatttagtctcctttacattgagaacatggagatcatgaaggtatgtgttttttgtttatctttatcattgctacatgccttctccatgtgtataggataaaccctattagttcttcataacttatgcatacacttgtctctcttgtatatttatttgtatgcatatatttagggggagcaaatcctatacatttattgtgcatgttttagatccacgttgttcacctattatttatattggatctttgcatttgagcttgcatacgagtatatgacactttgcgatgttaatgaatactcaacaaacatatccatatctttcatatgcaaccggttagtcaccaagtggaggatgacaaccgatttgttggtactaatgttcccctttgagatgtgcaaaggaataggtctaattgtgatgaggctaatggatgacaccatgggttgatggtcaccaagccaaggacatcgccatgtcgacaagaatgaagtcaagattgtgatgagaagaaagccttaacaaaggatggtcaagacctcggcataaacatggttcaagcgaatggtcatgagtgttgatcttggctcaagcattgaccccaagttggatggcacaagataaaggtataattgaaataagaatgttttcgtagtctttccccggtcttggtgtttggtgtagaccggatttgctagataggcgccgtattatcaagaggggtctatgaagcgagcacgtcgatgatcttgtgccatattagttcatatgcatgtaggtgcatttggtggtcttgtctagctaagtatgatgagttttctcatgtcccaaacaaagagagaagtgggtatgtccaataggagtgagtgacatcttgtgggtatgtccggtggatatcctttggagatgagccatttctccctgaattaagttgtgtttcttggatgaattgttcatgggttggatagccctttgaataagatttccatagagtctaagaacgtcaaattccgagacccgagtcaagagatatcgccgttttactaacagccggttgagctgaaaagtgacctgcggtctgacagaagtatgttgtccggtctgacctcccatcccatggcggtctgaccgctcatcctaattttgaaggaggtctcgtcttggcgatccaaagccgctagagctgcaaccagtcagaccgagcccctggtggtctggtcgagccgtggacggtctgaccggccactacactgcggtcagaccggccaggttgagtgggctcaatgattgcctagccgttacaaagtagtccgatctgaccagccacactatagtggtctgaccggcagagcaaagagttggggatttcaatcccaatggctagttttggtggttgggggtatatatacccactctctagcagcaagggtaaggttttggcactccattgcattatcttgaacccttgaaagtgttctcacacccttgggcacttagtttatctagtgaggtgttagagagtgagttaagccaatccaagtgcattgcttcattgttatagctagtgtggtacttgatcatcctcggcaagcatcctagacttgttactcttggaggttgccacctcctagatggcttgtggaggtgtttcccggtgatctctccgaggagattgtggaggaggcccgacgccgtttgtgagtgatttggagttcaccaccttcgaagtgaaggaataactaccctagtgatcgaggcttgggtagtcctctccgtgggctggctcccaccttgcccaccccttgatgaagggggcgtgcggtggcttcatggttgagcggtggagttggactcgcctcaacggggattaggaaaccggcgagtttctgaacctcggtgaaaaattccttgtctcttgtctcatttatttgttgcatttacatttgagcaaatttacattcatagagacatatttgagcccatatcacttaggtttgcaaaacttaacttagttgcttagttaaccttgtacctcaccttgcctagcaacttaggttagttttgttgaagtgccattaagttttaaaaccgcctattcacccccctctagtcggcctccttgatcctacaatgatgctggagccgatcctcggcatcaaatccagctgaatcctcgatcctacaatgatgccggagccgatcctcggcatcaaatccagctgaatctttctcgatctcctaaaattggttgagggcttttgatctattcgatctcctttttctatttttttcaaaatcaaccggtcgggattgaatacaacgaattaaaaatgaatggaaagaggaaatcatgaggaatataacaaggttagaaaatagattttcgcaatcaattgaaagaggaaacgtacagacgaatcaacatcgtggcggcggctggagaggctttgcccgtgtggagcggatcggactgagagcaataagaaaaggcgatcggatcggattgagagcagaaaaaacggcaatgaagaaaaccggataaaaaaaaggaagcctgagaaaaacttccttatttttcagccctatcccagttcgatacatcccttcgctcggtttgtctctccttggtccggcccataaacaaatctagcttgcataaccgactgcatcttcaacctctagaagatgccacgcatgacgccgaggagcaaatccagctgaatctttctcgatctccccgaaattggttgagggcttttgatctactcgatctcctttttctgtttttttcaaaatcaaccggtcggtattaaatccaatgaattaaaaccaaatggaaagaggaaatcatgaggaatataacaaggtttttttcaaaatcaatcggtcgggattaaatccaacgaattaaaaccaaatggaaagaggaatataacaaggttagaaaatcgattttcgcagtaaattgaatgaggaaacgtacggatgaatgaacatcgtggcggcggctggaggggctttgcccatgtgcggatcggactaaagagcaataagaaaagacgataggatcggattgagagcagaaaaaaatgacgatgaaaaaagccggataaaaaaagtgagcctgaaaaaaactgtttcacatggaaaagaactaatgggacataaaaaaaaggcgaaaaaagagacggaaaaaaaaccggaaaccttgcgtatttttttattaggcatataggtatacagatatatagatatatagatatactagaaaaaaatactcgtgcattgcatcggggcaaaaacgttttttgagtagtacaaccgctagcaatgaagaaacattaggatcgctattcattataattgaaaaagtaaatgaaaattattccttttttgggcctacaacccattatttccttccttttcttttgaattttgatccactcgatctcctctttctgttttcccgaaatcggaaagaattcacaaaatgggataaaaaggccggtcgggcataattggcgaactgtaagccgaattgagaggggaaatgtgagaaaaatgatgagagaggtggagaatcgattttcgcaattaattgaaggagaaaacgcatggggaaacgatcaattggaggagaaaacgcatatggagacggatcgaagtggcggccactatagggtttggtccgacgacggcaacgtacaacagatcggatgagataaaagaccggatgaaaaaagcgaaaaaggaacctagcaaaaaaaatcgaatcgggcaaaaaaaacaacggaaaaaaagaaaccggataaaaacagcaaagaaaaaacaaaccggcaaaaaaaaagacggaccaaaataaaacaacgaaataaaaagaaaccggataaaaacaccaaaaaaaaagacggaccaaaataaaacaacgaaataaaaagaaaataaaaccggaagcaaaaaaaaaacagaaaaaaggattcggcaaaaaaaaaagacggaccccctctctctctcgttaacccaaatctacaaacccctcccccccttcctctctctcgtccgttccggcgccgccgtgtactcgccttccggccgcggccggcgtcgcatatcatttcgcctccctctgtatcatcactccgctccaccccccacgtagaacatctggcgccaactccttctcgtcatgcccatgcggtgaaatcagtttcgtggtaagagtccgtctcaaagttatcgcctttttttcacccctccgtcctctctggttccgattcggtattgatttggattgcttatttatacaagaagggaaaaaaaaccaaggccactcctagctttggcatcgatcggcccggttgtttggggatcttgcgctcagtagcgaagccaccagtatggcgaggtatggcggccgccatacctgcccaccggctgatcgcctcatcgcatcggctgttcgcctcctctcgtcgacagttgactcgtctcctgccgcgtgccgcccgatctccgactccaggtccaggacaccgccggacgccgttgccacgctggacgccgccacagtaatcactccgagacaccagttggttccatctctcgcacattagcaactatatcctgttgaatcagacaatcagttgttacgagtagtaatgttaaactagctcgtaatatctgtagttacccagattgcgccatggaagaggaagaaccatctaataatcgccgacgccgactgcgcccaatttcagaagctacccagattgggaaaaaaataaaaggtgagaatttaatctacccttgttggtactgttatttattcactttaacgtatctcttattttaaatttttatgtttgttagttgtcagtataaagagattttttagcagtagcactgctaatatatcaggaggagatggaaatgaaaatatagaagcaagagatgataatgaaattcagtccattattttattatatatgtatgttttcttatacaaactagagtactagactagtacttagtccgtagtaagttcgccataggtgaatttttatcctggcttcgccactgcttgcgctgcttctgtttgtatctagaggggatcgatcgaatacttgggagactcaaatccacaaatttcgtcagcattgcgtgctgctgctgcaatactgtggtgagtagatgtttaaagctcccatcttttctctctcttgttttctttctgttctgacatcagtagcacccatccaacgctaataatggcctattacaatttacagtttattaacttccagttgactgcagatcagtgtttttttggtctaatggctaagcgaatgaatccatgtcatgggaaactggtccccaagaacaaaagagccatattacagtttgatgacattcctgaggtaaatactagtagaatctagtgtcaatttccattctatgtacgttatataggtccacttatactgactgtgctgtttttctttttatgaatgtgagtatggagttctgtatatatatatatatatatatatattcacctgacttcttcttgatgtataggatgtggtgttcttgataatccggttgctttcgctgataatgctgcgcgtgtcagcatggtgtcgcaaaagtggctacaatcttggaggctctatcctaatttagagttcacctcgaaggcgttgggtttgaataaacgggtgcacaaacaagggaggagggctaaatttgtcaggtgtgttaacaccatcataaggcaccacgctggaacagggattaactcattcaccttgaagcgcaacctcaacaatcacaagtacgcacactatattgaccgttggatttactttgcagtccgatctggtgcaaatgaactgactattgacctaagtccacgatggtatgctcatcctcgtgatgtcaaatacagctttccatcctctaatgttgctgctccagaaccaacctctatagagcatcttaagctttgctttatgaatttgaggcctttaccaacttttagtggcctaagaagcttgaagactcttgatttggcccttgtatgtataaccacagaagatttagagagcttgttgagttatacccctgctctacaacagttgaagctaaggcaatgtccaatgctggaatacttgaagatcactgatgtactagctaagcttgtctacattgatatcgttccctgcttgtggctgaagattttggagatccatgctcaaaatcttgttgcgattaatacttacaatatctgtcacctaaaaatagtactgagtgaagcattagtgttgaagggggcacacattgagttagttctgtcatcagatgttattgagtatgcttttactgatcttgcaccactcatgccagacctcgagtcattgttcctgagtggctgtactgaggttagtgaaaacaatatcacttatttgagatactttacgttctttatcttgactacatttcctatgcagatgattatatccaggagacctccaagcaatagattccattgcctgaagcaattggagttaaaattgcaggatatatcgacgaaatatgatcttctatttcttgctaagtttgttgatgctgctccagtcctagaagctctcgtttttcatgtaagttacttctctctagcacatttagcagcatgaactttagacagtactaaaattaaataactggttctccaagaaatgggataagcagcctcgaggcccttaacttgataactgttgaactgttctgttatattgcagttttaaacaaaatttttgaaaagtaaatgatgccatcagtggaatgcacattaagtgtaaattccagtgttgacactcttcgttgtatatgccatattataggcattttttagaacatcactctataacttacatttgtctagataatatctaatgttaagctatatgatgttggtatgttgatccacttatgccccccaaccccccccccccccaaaaaaaaaaaaaaaatcttatgttcacctttgtccttctgccataaaattttttatcatgtttcctttcttgtcacctctgccaaccccttcagttgaaatcgacataaatttgcccccagatgacagatcctaacacatcatattctctccaccttagctgccatggccacagcctctcaccgttatcaccatgctccttcacccattgctaaaccctaaaccccagacctgctgtgatgtgttgtataacgaatctggctgcctccaaccctataatcaccgccggttgttacagaactagtcaagagtgatcgaccggcagcatggtttccaggaacaagaaaagattccagagctgcttcaggaagcaagaaccaaattggaagtgaaccatgggagcctgaggctcagagcctgagacgctcagtagcttgcaaggccttttatcccttcatgttaactatgaaagagtcacaagaaattggacacgaatatggggcatgaatcatatggcttcctctccaacatcttttccttcccaaatgtttaagggaataagtggaccaacaatcgtttgggggaatagtgggatttattctccttaacccttgtggttgtgtgtacagaaacgtttgtggtgtcattatttcgagccctgtgtgatcttcatgtaatacttatagtagaagctgaaacagtggataggtcatgtctgattaattgagtaatactccttccgttccaaaatataagcatttcttaggttgtttattagcaaatagtaaggttaagtcaaaagattccttttagtcacctcagtggtcaatttttgaattttaaattgcttagattccctttctaagcatccaattgactttggaatcattggaaccatgggaatcagcacagcaatgcttatattgtggtacagaatttgaatcctggaaactcttgtattttggaatgggtggtatattgtggtacataatctgaatcctggaaattcttacattttgaaatgggaaggagtaagaaattaagaattcgaacaatgtacaattgttgcaatgtgataccaaaaccacagccgtgctacacaacttttcagttcatagcagtatgaaattgtggactgctgtagcttttttaggccatttgtgtattctgaatgtgctaatgttcaaatttcaagtccaacttggtttatgagcacatacttttaaactttggtgtctggtttgagactcataattttcctaagcaattcatctttgttgaaactttatgtagctggaagatatagaggagccattttgttacatggaaaaggaagcagagttgagaagtctggagaaacattgtccacataaaaacctcaagttggtcaaaatgactggattttcagcaggccgttcaagccttgagcttgctctgtatttcgtggagaactcaccagcactagaactcctgattcttgatcatcggcttgacagatctgtttgccgaatcacttttggtggtgacttggatgcgaaatgctcgaaaggatatgaacacactatctccaaatatgttagcaatgcgattcctcgccgtgttagattatcatattcctaatgtagcacaaacaagttgcacgtggtgcgagttgcagtgctaggactgctacagtagaaattaaaattgcaacgacagctgtataaattgtaagatgttttggtctctcaatctatgatgtgatcaggtaattaaatgacacatgagtgcagtaaaagtgcaagtatatagtagatcaatggcaatgggcaatgagatgtactacctccatttttttaatagatgacgccgttgactttttctcacatgtttgaccattcgtcttattcaaaaaatttacgtaatcataatttattttgttatgagttgttttatcactcatagtactttaagtgtgatttatatcttatatatttgcataaaatttttaaataagacgaatgattaaangtgtgagaaaaagtcaacggcgtcatctattaaaaaacggagtattaatcttctgcctcctcctgggaaggtgggtgaagccgacgctggttgagaaggtcgtccacgagctcctccggcaggtggacgccgtcgacgaacgctggaccttcaagctggcggttgatggatgggatccagaagtcctcgactagctgcttgagggcggcgaggtcgcggcgcccttggaggaacccagcgcggcagagacggcgagcctcgtcggcgtcgtcgagcagcgtcaggcgaagtgttgccgcgtccgccccatccgcgatgctcagtagccgacgcaccctgccttgtacgtcgtcggcggcgtcgtggctctccagcgccacctccggagccgacgagccgccgatgagcatgtcggcgtagatgctgcccaccagctccctcaacttgttcctgtcgtcgcagagcacgtcgtatctctccaacagctgtgaaaacttgtcgagcccgagaacacaccatcccagtgcgtctcgccgggcaaccaatccatcaaacagtttgcgtgcgtcctggagtggattggatccggtcaccacgacgatcacggaagtccccggatgtgccgccgcctgagctgctagctcgaatgccccctggcgagtggagatgtagtttacgatacgggggtggggcggaagaaaggccggcggcggcggcggcgacggcgcagcggccatgggagcgagggaaagtggcagaaaacggatcgatcgaatgctgcgtgagctggaagagaggcccgcctgtctgctactattcgatgggccgggcccaacaaggaaggttatataggaccagcccaggcgaggttgggtctcctgcctcgtgtttgcatcgcaattgcttttgttatttttcccccctgctttatatctaatgatgtattcgacaaattcctatcaatgagaaatttgctgtatatgccatgttgcattcaacgtctatatatgcgattaaatattcgaaatgtcgcagctgatattttacacggatacacgatacgttgtattttcagaaacatgcatgcatacggggatatgactatatattcaataataaatacaaattttaaaataatataaaagaaagaataaaatgctatgtttttaaatataaagagctggctattcaatttttatcaataggaaaataaccctgtgtgtaagaaaacatattatcttcatagaaaatataactataaagtgtattagtccccccgggctgataatattagtcgttttggataaggataaagtcaaactttaaaatctttgactacaaataatttctaaaatatttatcttaaaaatatgaaaaccacatgtgtagattagtcttaaaaagtacttcaataaaatcatatatttgttgaaatttatatatattttgtaataaaaaatagttgtcaaagttacattttgaagaccgtgcccttgtccaaaacgacaagtattattaactcggagggattaatttttctacgatctttaatattttttcacatcacagtactgttaacgaccaaatttggtaaatttgcattggatttggagttaaagctgaagcggatttgggaggaaatcgataacagaaacagagtatgaatcggcttcagaaccgcatcggctatagtgtgcatcggcagttaccgaatcgaacaaggtaagccgatgtagccgattccggcaaggtgatattggaatcattgtctgattgagttgacgtgcttcatgatgattgccatgtacggatcaagtccgaagaaggcagttgtatctattaattatgaatagtttgttagtttcctttttatttttagaaaagtgtgttcagtgtcctataaagactttatgttttccttttatctttaggaaagtttctttcttatcctacaaggactagtatctaccatgggtataaatatgtacacccgggatcattgtaaactatcttcacgatcaatacaattcggcgcatcgccaccttttaccttttctactttattttatcgtccggcaggacttggcacctgacgtggggctgcatcggtgttcgatctccggctaaggggtaagtccaatgttctgtcagcccaggcaattgtatcgtttatgtcggcgtcgttcaaggctgcatcagtacattcgacctcttggattgctctggtttagatgatatatttgcctacctatttatcatatgtctatgttaatctagtcttagcatatcaatttagctctatcggctgcttcttgttttagggtttctgccggtatcggctaaatcgcgttgctagattagattagcttagacatctaccaccctgaaaactcaatcaacggcttgattgtctagatattatgcttcttttcatacttagtgctgcatcagttaagtttgatctactaagtcgtgcttagaaccataatctctagtctgcttcttgattgccaataagggtttcatcggggtttcagccggtgagttatctagacgttgcatcggctcataagaattgcatatacatataagttggatttagccgatgacaacaaaggttttactgtttaatctaatcttgtggatttcatggcagcggacctttagccgatgtatgctttaacctccagatcagtgcttattctatcatatcaatgttagccgattggtttatactggactatattattgttatattttattatcagtagtcgattgcctatatatcattatttactaaagtgttagaatctacattggacgtatagccgattgctcaaaaccctatcattatcggctggtatcggcatcagctatcggctggaactactccatcggctgttttgtctattatttgcatatcttgtcagttgcaggatcaaactgactggcatacccgcatccaaccaatctttggacctgcacaggagttaagcagatctcccaggccggtgtgttcgattttttcgtcaacaagtacttaattggtttatgtttttatgaacttcgaatatatatctctactattataaaaagtgaagatgtttttgtccaacttattccgtacgtccaattatgagttatgcattctatcaagcatattatgtgcgtacgattttagagttatctcacccatcggcgggcagtccaattcgaatctgcataactcagaccagaaccaaaacctgattagagcaaaataatatacatgaatttctccatgtgcccacatacgtagagtcgatgaccagggactcggatcggtggtccggttgccattactggaagaaagcatcgtggtgtgtgggggaataaaaggcataccagttctcaatacttctcatctcttcatgtgccttcctccgtttcagaatctgaaacatttgtcacggcgcctcctccgcttgcgaaaaaacaaagaaatcaatgtagtggtcgccttgcatctttgtgcctaatgatgggccaacgggagaaaagaaatgggccatggcttggcccaaccacgcaataagtgagcgcacgcctgggattgacggccgatggaaccatattacacggctggaattatctcttggatgatatctaacggctgcattccctcgatgacgtggcttattcctgtagctgctttatagcaataatgataggtagtgggtaccaattactccctccattccaaattgatctacatatagtttttttgaggttatttctaaatgatcttacatatttgtgttcattcattaggtctatttgttatttgtgtattggagtaaatggacattgatgcatgcatccatgcacacaagcatttataacccacatgcaatatcttgatttgctattggctaggaaatagtggggatggtgcatgtattgagtttgttgctagagtaaatatagcatgagagagttattagcttttctgggtcttgatgtacctttgaaatatgtagatcaatttggaatggagggagtatataggaagaaaatatatgattaccccataagccttgttcggtttgaaggagattaaggggaaataatttcacaccacaaaaatggtgattaactgaacatatcccaagttaatgcagtccccaaccttttcttttcctattcgaatttctcattctaggagtggtcctaagatggagggtagatgccataggatggagttcgttgttggtgcctcgcaccatggccatcgtcgtcctccttcaagtaccgcaatggggaggtctagttccatcgatggagcacacacgtcgctggtgcctcggtccttagtcgttgccgccatccttcaagcacctagcgaggagcttcagatctagagatagggcccatcgacgatgcctcgctccacggtcacagctgtagtccttcaagcaccacaacgaggagctccaaatccagggatggagcccgtcgttggtgcctcgctccatggccatcatcctcgtcctccaagcaccgcaacagggagactcagttccaaggacagagcctgtcgctggtgcctcggtcattggccgttgccgccatccttcgagcacctagagaggagctctcgatctagggacatgggtgcctcgctccatggctagcgcaatccttcgagcaccacaacagggaactccaaatttagggacggagctcgtcgttggcgcctcgctacatggctcctgttgttgttctccgagcactaagtgggtagcttcaactctaggcgagttggacatcaccaacctcttgccatcgactagttagcggtgatgtcctcctcccctaggctcttctccacgctccctcaacattgacggcaacgtcatgccccttgatgtcactgcagttgctttcccggcctcaccatctgatgcccggcgctagggaggtggcggtgcacaacacgagtgtcgacgtttgatgtcgcgattctggtatttgcatcgtatagggatcgttggtactaggatatacgcgagactgaggtaaaagagacagagacgaggatttttatacaggttcgggcccctgaattgtcaggtaataaccctacatcctgttggctgaagccattgttgctcttattcaccataatcacaccaatacaatatttggggtagcctatctaactattgtcgacatggcggtctgaaggtctgactcgtagtcgacaacagggtagttttcctcctcgaatccgtgcccggcaagatcagagatagcgctttcgtctctcctaacagtatccggagacaccgtaggggactagccgtgcctatccctgaagtcaatatccggcgtcttgtattggcgtatgttggcttgtatgttgtggcttctgttgttccgtagattatggttggtgttgattgtccgtatcccctctcctcctaggggggccttgtatttatacctataggtgtccccttgtctaagtagaactaggaaaacaatatggatacaatccgagtagtccttgtcgtttccatgtagaactctggttgtctttccttatccggaactcttcctatatccgtaggttgtttccgtatagaacatggtatgtggtaggtcctgccgagatttagtcaactactattaggtatgtggtatccataaccctgacaacaagtacatcggggagcttcttcctcttgttcttgggctaggggaaatcttatcttctccccactgattccacgttgtaacagtgatgtggcacgcgcaaggctgaaaaagggcacaagagcaagacaaattctctctagtggcatttaaaaataggatgtcataaagtttcaaaaagaacccaaaatccatcaactcctcaaccaaattctaatttgaatgcatatctaaaggagagacgcgagggttattttgagaaagcacacgaagacgcccatcatcaatttggcgaagcccgccgaaacagatgtcaaaaagctttaaaaaaaaaaaaaactccaccgcatccacatccaaacgaaataggggcgggagacggcgcgcctccattcatcgctcgccagagttgcccaccccctctcgtctgctccttgcccttgccattcgagggcgatcggtgctccctccgcctccggaccgccgccgccgccgccggagccctctccggggcgtccctgaggtcagattccaccctgtttcggttcaatttggtgggtgcgcgggctcgatcgaggcttttttttctccggtatgtgagtagggtttggttcgaattttcccccattatgtttgggttcggattggcgggtgggcgggcagcacgcggtgaggatagatagcttcagatttgtggatggctcatccgctcatggctagctggcgacgccgcgtcggtggggacgccaccggccaggggccaggggatcaggggatggtggcgcaagcacggccatgagattcatgaactgcgcgaggaccctcccctctggattttttttttgccaaccctgatgacattggtgctttgatccttcacatctcgtacaaacattttcagatgtttattagttgttcatagttcctcccatttagttggcagccaattgccgaactgactgcataatacaactcttatgtactcttggtcgatgttactacagtttgtactatcaacaataatgttaaacacaccagggaacatgttctagaaggatccaccagagtatgcctgcatgatatctctaggtccactttgttttattggaaagaaattagtgtcaagattgcacaatttactaactgcaatgggttcataggctgcacaccatgaatatatacgtcatccctgtttttccgtgcaccaagcaagttaataaaatgtgttgagctagctctgatgtattgtattgtgtctaattagttatgtagtaactagttgctggtccatatctatttgtttttttcccattgcttactagccccaacatttggtgcttgatggacattcaagatagctcttgaattaggattcctggctccttggtttatatttttctccaaatcctctgaataatgtgctgaaatctatcacttgatcctcccagaaagtggcctgctaggtacttgatacttctcaccatccttggattcctacttgaagagtactattgatttgctgcctttaactacttagatagtgccttgaacgaatcatttatcattgtgacattgtagccctggcataactctgtggcactctgctcagtttacatgcattacatgttcattgattgcatacaatgccattctgtagtaacagtgtgtttaattctcctagattatgagagctaactgaatttaatttgatctgcagattgtgtgcgccaatggcgcctcaccacattaatggccttgctgacgttcgtgcagttgcggaaatgtcacctacacttcctaccatgattattagagtaccttgtgagcagtcagccaatattcacaggctactggaatttgttgaggatcgtctggatcacggtgctcacgacttgattaaggcagaggacattccccgacttcgagctatcgcccagggaaaccttacaagtgctgatgctccccagttttgtttgtcattgctcaacgagtcccagatctacctgcgggttcaactgttctcgtcgaagtggatgattgggtgcggccacccatcgactcacgggtagtatcggcagtggctagtgcgtttcatcttccccaggatggggtgctgccttttgatctcaactcaacgacagtggccccagatggtccaggtgcaggtcgtattcatgctgaacttctgatgccaccaggcagcttgcctttaccgcctcctgttgttgtcacagtgtcagggtgtgaaccactgaatgatgcgcgggaactttatcagtacctggaggagtacgtgaatcaagagggctggatagttgatgacacacagcttgcggggcttgcagagctggctgaagctagggacgagttggtaggagctcgcgataagctcactacacttgcatcagatattggagatgatcttttattgggaggagcggtcactgatgatgtaccgttgttatctggggacttcaaagcagctttggccagggtattgaagcttcctgaaggtatggagcttcccaaggactttgaatcacctcttcttgtccctgccattgctgggagggagagaattcatggtgaactcatcaatctccgagctgacctggctgctttgaagcagcatgttgaggagcagtggctcccatgggctaatgatcgtctatcatccgctggagtcatcggagaccagattctactagacatggagtgacacgggctaataatgttcgtctcacatctctgatacattctacaagacatggactgagtcagattctacaagacatggagtgacacgggctaataatgctcgtctcacctctctgatacattctacaagacttggactgagtcgttccgtataggccacacaagaagtgagaaagacgatgtacatttcctgctgatttctaaggatcaaaccatagctgttataggagatctcccagaactgaaacctcaattgctattacatagttctatacttgcagaatgattacgatggatgcccttccaaaatttatgtggcaatagaagatgctttttagtggttagaccgaaaattaataatgttcagtgcgcagaacattctcaccagtcctcatacagacaatgcatggtcatacgcaggtggcactatttctcattacttgtacaacaattgacaatgaggttgatatcaatcatcacgttacatgtataagtgaccctaagggcttcttttgttgcttaccatccatctgagaacaacactgtgcaaacacttgcctaattgccaaagctgaatgaagggatattagcagaatttatttacacactgaaaaagaagtagcattttacatagccttcgctcctaatgaatcggctggggaatgaaatgatacaccccattagttaattctagacaatcagccgccttttacactgctacagcctattacaacactagcacaacatttacagtcgagaagcactttgcttcacccacttattcagaagaaccaaagaaacaatctgtgggattatgagctctatacagatggatggacccatttatttggatcaagagtccgttttgctcttctttgagagggggctaaatgcagcagcaggatccgaagaggcagaaccaccattgggttggcccagactaccagccaccaccgagtcactcaccatgtcgaagtttattcgtgtgttgattctcctggtagggctgcatatttggcaagaaacagagtgaattctgagtgttgtgagcttcacttcttgtgtgtgtgtgtgtgtgtgagagagagagagagactatgtatttcagaggaagttgacatactaatttaggcggctatttatagcagccagatccttggatgggctctgaaaagcttgagtgctttcaccgatgcacgcgtagaaactccgtgaacttggtgaaagcaatgcatccatctgtaattgatacagagaatcatgcgttaaaaagatcatgcacaggcccaaccaaaaaagacacatcggcatgaaatatagtccgctcaagaatttaactataactgagtaaagagaaaattgacaaactaaaacgatcaaagtatagaaatgagaagagaagtgcacaccttagtttgtcgtagaggagagacatacacattatgagaagatgagactttcttcggggacatatctggtaaatttgagaaaggagatgacttgggtgatccaggaatttggcctaagaaagcaggtaatagacataagtcaattataagaggaattaagtggagaattagcaggtttaaactgagaaaacagaatggaggatatactattagtgttcctcttgtcttcaggacgagtactagaaggcattagagccaccagcaaaggtttgaccgtgggaacaaatacttgattataaaaaacaatgatatcaacatgacgtgatccaaatccctgttaatatcaaagaattttcaaaagaaaagaaaaacaaagtaaaaataagaagctaggggaagaactatcagaagaaagaaaaatggcagatactggaattaaaagatacatacaccattgcgatttgtactcccaacaaagatacttctgaaaacttctggtttacattgcggctccctcttataattgttgacgatctccttgaacgtcaatgataattgagaaacc

SEQ ID NO: 26748 - DNA, 1861 bp, Oryza sativa
tcctgcagccccaaaactcaaggagatgtgatgtagtaccttggcaacaccatagaggcagcaaagaatgatttggtcaacgtgtctgttgaaaaataaagctgtctgttggtcaagaatctgcttaaagatattatagacgctcacagtcagctcttcatgtcgtagcctttcacataggtttcttattctaatagcagccaacttcaagatctgcaaagttttaggccagaactaaatattcgataaacatagaaacaatgaaaaaccataaatttaattacaagatggaccatactttggaaaagaagatctggacccctactacagcacatttttcattcccactaacaggattactgacagtggggctgcaaaagatatgagatagtaaaacaatttcttcagaaatcatcaatctctggttagcaaaaaaatagtatatgctcaaactcttcacaaactgaagtaggtgatcacaccttgcgaatgttgcctggagaggatggtattttgctttcaaaatacttaaccctgtttggctttgctttgggggtggtgtctgcgaattgcgctctaccaatgagttcctagattcggtgcataatctctttggtgattgaggataacagttgccatctacaaaaaaccatttgagaaatgaataaccgaacaatgcaacaagcaattaaagaagttttaatttatgaacttcctgtttaaataatgtgtgatcatatttcatatggttatcaaatttgttagtccataaataaacacttaaatgctccatactgcctcaagcattccttgtgcatgacaataaggcgtcaattctactttcaatgcaaaccgacaacagttgatatgaaacaaaataggatacatgctgctgcaaaactgagctcgtggtatccccagttcaagagtaatagatgcatgactatgttcaaggaccaaagtccatactaagctagactgtacagttcagctcataagtctagaggagccagaggtttccttggtaaatggcactttttgttacattatagggacttttaaaatttttagtggcaataccttttcatcacagtcctttctgccacctatatataggctacaatgcagaattgcacatactattacactaacctaaaactaatggacatgatactaatagttactatgaactcatgaaaccttgtggtgacaaaaatggtggtgatgacaattatgattaccaatatacaagtaggactaaaagtctacacctaaccaatgttaaggtaagtaacagaaaatattttgcaatccgattgataagagaaaatgtaatagcaatgcactgtgcaaccaaactgataaaacatctgctacctagcctaagacaagatgtgcaatcagttgatatttgataatataatgttcaaagcaacgttcaaccagcttaccagaaggtgatcaaatctatccataccaagtaccttcccaataagaacagtagttttggaaatgagagtagttgattacaaaaacattaaatttaagaatgattgagaaagcacctgggccagcagaaggccatctttttgagggagtaggtggcaagccatcagggtgaatactctgccgtgctactatgccatcaagagatggcattggttcagccaaaagaccaaggctgtttatttctgtagaaagtgatggcctggcaacaaccagtgaattatataacgatgaacctttctcccatgacatgctttccaatagctgtcttctaatgaatttaaatgccttttcaattctcttggaagggtttcttcatgtctcacaaagttctcaattattttgctcaaatcaa

SEQ ID NO: 26749 - DNA, 4168 bp, Oryza sativa
  unsure (1)..(4168): unsure at all n locations
aaaggaactcttcaagcttagaggaaggtttatcgggcaatgaagatatcacatcacgtagccacttagcagttgtcatggcagaagtaactggtgtcatctgcacaatcttgattgagcccccattggcaggtgatgaaggggaactaggggcagccaacatattctttattgtctttgtaggagaggctagtgtttcaaacacacgctgcaaaaagagaaaagggaatctgtaatgtaaaaaaagaaaacaatgtgtagttaactaaaaagattatgaatcatcacagatacctttgagcagccaaaattagcggaactaccagaagagttttcagcattgagtacatagtcattgctggtcaaaaacatttccaaatcaagctccccttggcagccggtggtactacttagcttctccagtttttccaaatttgactgaaaaatctcatcatcgacaagatctttgaaatacatcaggccatctaccaccataacaatgaaacaagacttagataattgaatgtaagacagagcatgcatgcaggaacacatgagagagaacacgggtgtttgaggtcatgcctgtatctattttatccaaattcactgttttgaactctgaagcatttattgctttcctgctaaaaaagacctctatcactttgtaagattttcccatcatttctttcaagcggtcttcagaggtatgatagttgtgacataacgatggaagaagatccacgcctttctcagtttgtttgactgaaattaaacaaaaggactgtaattataatctgtgcagatgccaaataaagtaagacagttaaagaaataatttggaataaagttgagaaatattacttaagtgagaagaaccttcaattgtgaagctcctaaatttagcaggtacgtgaattaaaagtatggcctgtaatgaatcatttttttgacaagttagctccagaaagcacaagggctagtggtggttgaagtagccagttaaccacaagtacaagattgcatagctaaaggataaaaataatgaaacggaataaagagaaaagcaaactcaccaatatggcaactagtccatggatgcaggataccaggtccttaaacagttcgggtgattttgagcgaagaattaagaagagcagccacccaaaacggatataatcaggaatatttgtagttgatccaggctcctgatcagtacttgggctcaagaatagctcattaaatgctttgcaatagaacctaggatattgtgaaattgtgggtaaattttgcactaccatataaagcaaacaaacaaatctcaacaatatgaacctatgtatcagttgtaatttgtggcaaaattctaataaactcgtgagcttcaaatccccatgcaaaagaacggttctgttataaaactgcaatcaggtacaaggcacatatgttgcttaccggcttgcatctgccaatagatttactaaattctccaattgcttcagctggaatcacaattgaaacaacaatgaagaaaacaaacaggttatgcacatctgaaaaagaaaaatgtgaatctgttcaatgcgggggcttggcgtgaacccacctctagccgagcttcccaatctgacccataacggcttcccaaaacctggtcgatccttgaagcaagccgctgtgattccttgaagaaatcatcatacctgcacaccaaacaaaggtaaaaaaaaaaaaaaaacaatccagtgtcaacaaggccctaaaacttgctagactacagttcaaaaaccattataacatagcatgacccacttgagcttgcaacccttcaagatctcccagagcctaacgccggaggaacccgccttggtctccttcagcttggagacgcagtacagcacgaacgcgaagcacagcttctcagcatcctcgggctgcaagaatccaaactttaggggggggggacaaaagatagcctcaaattcgccgcaaaagacagagcagccctcaccgatttgctcccgaacgacggcgacgcgaggagcgcgcccttcccctcctccagcaccgccgcggcctcgccggcgacgccctcgtccactcccagctcctgcaccaaaacccatcgaaccatgagacctcaaacgctcgacgattcccaccagcggccaaccaaagatctaaccaccacctcaccttgcagagatccgcgagacgagcctccacggcggcgggaggctgcgacgccatgaaagagctacaacacgcacacccacccacgcgcactcagtggcatcacacggaggggccaagaggcagcacggcggcgaggccctccactgctccggcgagctagggtttgggggatttggggatcgaggaggaggtggaggaagagagagaaggaagaagggcaggagtgcgaatttatttgtctggagggggttttagggaaaactgccgttgtccgttgcgctgtgcagatcgtttgatgctttcggtgttattatatgtttttttagggggtgagatgtaaatttgagcgctattgattaattccccctccgttaaagtagcggtgggattggggggcaacggctaaaagcgcgggaaaggaagtcggtttcttccccgttgcgcgccataagctggccaatgaggagacgccacctggaaataaattttgtgtagttacaaacttacaatgcatccatcaccgtcagatcttgatcacgaatatcaacgccattggatcttatatacggtggaacccattagtacatcaggagttcaaaaccacgaaaaccttataataaaatgagtaaatttcatatctattatgatatgagcgaacagatttggcacgagaaacataatcacaaccattgtggttgaagttttactaattcacaccgttaactaaattgatatactcttgttttgaaattttaaaaagctttatatacacgattagatataatatttatatgatgaataaataacttataaattagataaaataattaataatgtggtttgtgaaactttatagttataatagctaggggttatgtatcacgtgccaaaacccattagttttgtatatttggggttatctaaaatttactcttttattaataatcaataggaaggagtaaagagaaccattgaattcccactcaaggggtgacaaaattcactaaaaactaaccacataatcgcgttttgcgcgacttttgatcctgtttattgtatatggtctattagtttaccttagctcttaataaggttttgataaaaagttaatttgtttatgaagtatctattgttctagccaactataaatatagctactaatacctccgtttcaggttataagactttctagcattgcccacattcatatagaggttaatgaatctaggcacatatatatgtttagattcattaacatctaaataaatgtgagcaatgctagaaagtcttacattgtaaaactgatggagtatatgtttataagaggaatcactagaagcatcatctttcttctctttatttcctttctttttgtatgtatcatatgtttagtaggagatgccagaaacctccaaaaaaaattccatatatttagcccatttatgattttttttaatacatgctctcttcgatccaaagaccattatttatccaagctctttatcagacggctaacatatttttgatgatatagcacatcctcgtataagaaggcttgctgctttcactatataagataagattcagtcacgtaacatctaatcccaatataataaaataataatgataaatattttaaaaattaaaattgaaacataatataagatatggtcaaacttgaaatgatcttcaaaactaatattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 26750 - DNA, 308 bp, Oryza sativa
cgccgatttccacgaggaagttggggaggccgaggttgcgcaggcaggccgcgaccgcatcgacggcatagcccttggcaatgccggaaaaatcgagcgcgacgtcggcggtgcgccgggcgcggtcgccattgagttcgatgcaggtccagggcgcgaccgaggcggtggcgctgccgccagcgagcgccgggccgaagccccagcgcgcgacgatgccgccgatcgcggggtcgaaggcgccgttcgacaggcgggccatggcaaggcccgcgcgcagcacgcccatcatcgcgggcggcaggcgg

SEQ ID NO: 26751 - DNA, 755 bp, Oryza sativa
tcctgcagccccgactcgttcccgtccggaaatcatcacaggtaaacaccttgcctgaaatcgtgttgatccaaatagctctgatcaattgtctaacctttgtcagtggatacattaggaccaatgattggtgatgaagaagaaattccccgtatacaagcagctgaagactcgcacccttctatcttagtcaagtggtgggacgatgacaggcaacctcaaggaatcataataaacaaacaaaaagaagatgaggaagtatgcttgctgaaaaaggcactcagccaggccactcgcattgtgaatgtaagtccatttacgcatagctttaattgttccccttcatattttgctgaaaacgccggtaaattcttattgcagagaatccatctcaggaatgaggcaaagaccacgacacttgagaaattagttccccatcttggaactcttgaagccaccaaaagccagttacatgaggtcagagagctcgcgaggaaaactgagcatgatctgaggaatagaatctctgagcttcaaaaatctaactatgaattgagtggttcatccaaaggtaaataccatatccgtctgacatagaaaatcaaccaagggaggagcaggccatgggcatggcggatgagggggagagagtcggtataattgttgatgaaatggagagggaagattcggataatgaggaagccgacgatgacgcatcatccgatgaggaaggtgatgtaatggccactgattgg

SEQ ID NO: 26752 - DNA, 743 bp, Oryza sativa
agcatggggaactagttatcattaccttcaacatcttttaaggccaagtccctctgctttgctagttcggccttgtccttctccagagcttcgacctgcctctctaggtcggaaatcctggcggcttgcactgaaatgctcttcggttaatcgatatgacaaggaaggtttcacgaatatgtcagacggatatggtatttacctttggatgaaccactcaattcatagttagatttttgaagctcagagattctattcctcagatcatgctcagttttcctcgcgagctctctgacctcatgtaactggcttttggtggcttcaagagttccaagatggggaactaatttctcaagtgtcgtggtctttgcctcattcctgagatggattctctgcaataagaatttaccggcgttttcagcaaaatatgaaggggaacaattaaagctatgcgtaaatggacttacattcacaatgcgagtggcctggctgagtgcctttttcagcaagcatacttcctcatcttctttttgtttgtttattatgattccttgaggttgcctgtcatcgtcccaccacttgactaagatagaagggtgcgagtcttcagctgcttgtatacggggaatttcttcttcatcaccaatcattggtcctaatgtatccactgacaaaggttagacaattgatcagagttatgtggatcaacacgatttcaagcaaggtgtttacctgtgatgatt

SEQ ID NO: 26753 - DNA, 1532 bp, Oryza sativa
cccactgtctttctttgatataatggttcatctccctgttcatctggtgaagcaaacaaaactatgtggcccggcttttctaagggaaatgtggccgtttgaaaggtacatgggagttctaaagtcgtacgttcgtaacagagctaaacccgaggggagcatcattgaaggttacacgaccaaggaggctattgagttctgtgtcaattacatgttcgatgccgatcctatcggagttccagcgtctcgtcacgagggaaggttgtcaggtgttggcacaatcggaaggaaaagaattaggcccgatcaagcgtcgtacgcgcaggctcattacgctgtgctccaacatatggcagaagttggcccatactttgaggagcacttagcgaaaatccgagatgagaacttggggcgatctgatgcatggattaacagagaacataattctcggttcaacgaatgattcaagaatcgtgtgacaatgtccacggatgtcccaaatgagatagtacagttgttggggatgggaccgtcttggaccatagacacatggcaaggatacgatataaatggatacacattttataccgtcaaacaagatgacaaaagcacagtgcaaaacagcggcgtccgtatagatgcattccaggatcaagttgggtcaaacacatactacggccgcattgaggagatctgggagctaaactacgtcaagttcacggttcctttgttccgctgccgttaggtgaatctacgcactggtgtcaaagccgacaaggaaggtttcactttagtagatctatctaaggtgggatacgccgatgaaccatttgtacttgcgaaacaggtcgagcagatattctacataaaagacccttcaaacaagaagatgcacatcgtgagggatggaaagcgccgaattgtaggagttgacaacgccgtcgatgaagaagaatacaaccataatcttcatgtaagacctcacattgaccttgacgatgatccccaagagcctgtggcatatgctcgttcagatcataccgaaggcataaccttgtgactgatgcatttgtacttatctattgtaatgaatgaagtattttgttttattgcaaagacttgatatgtgtagtcattaatatggctaattttgttttattacaaatgaccaaaataaaagttgtagatcgtgatgagaggatcaactttgttgttaaccatatttcaatttgaaatcatttagtatttacaaatgctattaattagatttgtcatattgtcgaaatcaatttcaagctgttgggaaaaaaattatatagaataatgaccaaaataaaattattagatcttgaaaggctctacaactttgttgttgaccatatttccatttgaaatcttttactatccgaaaatgtattatgactaataaaatgaattattacacagttgctatatattttacactcacaacaaatgaaagatggaaaatgagtcatcggtgacgggctccagactaaagcccgattgagatg

SEQ ID NO: 26754 - DNA, 15396 bp, Oryza sativa
aactttgtttccaacagcttgaaattgattttgacaatatgacaaatataagcatcatttgtaaatactaaatgatttcaaatggaaatatggtcaacaacaaagttgatcctctcatcaagatctacaacttttattttggttacttcttcatctgacaaagtgatagctatattattcacaaaaatcatatttctctcatctggtttataaatatcaacacagatatgtcaattttgtaaacattggcactatcactttgtcggatgaagaagtgaccaaaataaatgttgtagatcttgattagctgtacaagttagctgtctatggctttcccatttaaagtcatgtaatatttacaaatgctgtttatatttgtcatattgtcaaaaccaattttaagctgttagaaacaaagttatatagataaatgaccaaaataaaagttgtagatcttgatgagaggatcaattttgttgttgaccatatttcgatttgaaatcatttactatccgaaaatgtgttatgactaataaaatgaattattatacagcagctatatattttgtactcacaaatataaagacttatctgggaaatggaaaaatagtcatcggtgacgggccttagttcaagcccgatagagattaatctatctctatcgggcattatcttagggcctgtcacagatgagtcatccgtgacgggcctgaatgtcatctcaatcgggcattagtatggagcctgtcaccgatgagtcatctgtgacgggctctacggcaaagcccgattgagatgactcatcactctaatataactagggtttctcagatcggatcgaaaatttttctaagtcccgctacagtttcccgcctccttagaaccctagcgccgccgccaactcctccttcaccgccgtcgtcctccctcgccgccaccaccaccgagaccgccgccaccgccaccgagcccgccgccaccgccgccgagcccgccgccaccgccaccgagcccgccgcctccaccgagcccgccaccaccgccaccgagcccgctgcctccaccgagcccgccgccaccgccaccgagcctctacaccgaccgacgtcggccttcctcgtcgtcgccgcttgcctcttcaccgacacgaacagcagcccccaccgaggccggcgacgtccttcctcatcgtcgtcacctactcctcaccgacgcccgacgccgcccgcccgacgccgacctccccgatcggcgtctacaccgaccggcgccgccgccgtgaactcctccttcaccgagcccgccgcctgcaccgagcccgccgccacctccaccgaccggcgacgccctccaccgagcccgccgccgccaccaccgagccccccccccccggccgacctcatgtgagtcctccatcgcgcctccctctgctacctgcatgtgtttgataatgaaaatgtggatgttgggatgaaatgtggatgttgggatgaatttagtgatagatgattttagtgattgatgacttgatgatgaatagatggaatgtggtgcattaatgaatttagtgatagatgattttagtgatagatgattttagggattgatgatatgtggtgaacgaatgattttagtgattgatgacatgatgatgaatagatggaatgtggttcattaatgaatttagtgatagatgattttagtgatagatgattttagggattgatgatatatggtaaacggatgattttttgattgatgacatgatgatgaatagatggaatgtggtgcattaatcaatttagtgatagatgcatgatatgtggatgaatagatggtatgaggtgaatttatgattttaggatttgatgatatgtttaatttatttatatgtgccattcaattcattctatcgttgtgatatgcgcaatttagtttatttatatatttcatttatttttataagtgacattcaattcattgtaatagattgtagcactcaattgtgtttttttttgtttttttggaaaaaagtagacaatgtctcagcaaggcgaaccaatgtcgacgacaactagtgggtcctcaagggcacgtactcctaggacagggaacaaaattcctaaggaacggttccgcataacagcggtagacgccgtagggttgccgacatctccaaggaaaatattgagccgatttaggtctatctgcggggtcatagggaggcagaaattcattattctgcaagacgacttcaagctcgtgccggccgtagagaaggacattgcttggctaacgttcaaggagagctttgattatcctgcggagcatgaggaccgtctcaggcgggctgctttcaaggttatgggcactgcttggaagaacttcaagactaagctagtcggcgagttcgtctacaacccggcaaatccagatccaagagagaaatttccttggatcacggaacaggtctggtcggaattccatgcgaagaagtcgacccccgagtccagagctagaagcgaggcatatcgcttgctccagactaggaaccagcatccgcaccggcttggtaccgccggatatgccggtaaggaagaggaatggcagcgtgaggatgaagaagcgaaggaatcgtggtacaccgctcgtgtttggcgatatcccacaccctcgggctaggaactgggccagggctaggtaccagaaacatgatgatggcacaatcttcatgccaaatgtagaagatcaacgagtatacgaagctatagtaagtgtctaatcaaactagatgttcgcattgtttcccatcgtgcagtttatttgaccccactaaattgtaatgcagaaggagttggttgccgagcaacaagcctcgcaagaggcctgctctcaaagacgcgaggacgacctcctcacgaaagcgttgggcaacaaggaacaccgtggacggacacggggcgttgggtcttctgttccctggaagtatggatttccagactacgcgtggcagtacaagaagcggacttccaacaaggcgaagaaagatgcacgccttgaagccaagatccgggagtcgatacgagctgagctgacatctgaattcgacgaaaagctcgagtcgatgagggccaagattaggtaagagatccgagaagagcaacagatcccccaggctgccgctactgctgcgcacaaagagttaggaagtcccaccgaaaaacgcagcagttgcgcatcaactgagttggcggaaaatccaacatcggtcgacagcgccatcgaccacataacggtaaccgtgaacttactcaatacatgaaagacgtaacgaatccatatgatatataatattctaaaaaaattgattaatctatcgcaggaaccaacgagctgcaccctcacagttagggtgatgccgatcttcactgttccagcagccgagggacttgcgtacaagccgaccccagagacaagagtgcatggagcgcaactcagggccgactgtgcaaaagttcaagtcgactcggtgaagcctgaatacgagctgttccctctgaagtatccaccgaacgacgaggtcctctcactaggaaatgcccgtggtaccttcatccaatggcctaaggacctcattgagatcagggttacagcgaggccaaccactgcaccaggcggtcgtccaccaaagagacccgcctctgctccttcagcccctcctgctcaagatcgtcatgcacaatcttacgatgtgcagttgcagtacgacacggatttcggggaggaccgaacggaggccgacagcaaggcgattcatgaacccccaccgatgaagaagagcaggaaggcacactcttcccctcagagaattactctcgataaacccgaagcaaaggggagaggaaggggaggaaaggtgcaggcctcgcttctagctccaagaaagctagatctgggcaagggccaggaagagactaagggcaaagaggtcaagaagaaatacgtcactccacaggagttccaactaggcatgccattggttggagatgacgtgcttgccgcaatgggcaccgcttgcaaggaccttcacttatactacatggagaaatctaacgccaggaagccaagtaaagctaccaatatccttggacagcacgatggaaagcctttccttggtccaacaaattatatcgtggtcgacttcaaggatcttttcgacctctacaggctctgagtggtggacacaagcctccttaagtgctactccttgtaagtattgtcgcccaactcattctggtaataacaatcggtttaacttgcttacaagatcgttgatcctgtgtgtaggttaagttggcaatggtgtcagaagcatgcaccggaagttgccttccttgatccacaagtggtcactatcacaaatctccagaataaccgtcaaggaatggtcaactacatctacgacaccttgtggtcccgccgagacaagaagtacattatgtgtgcctataatcaatagtaagtgtgttaactaaatatacacaacagcatgacacattccttgagtacttaattaactttcactatattaatgccgcagtgcccattggatcattctggtcataacacctaaatggagtacatgtcattacctgaactccagaattgataagaacgcatatgattggaccccaattcaactagcgatagatgaagcgtgggcccaatacgtgcaaagaggaggcctcaggaagacaggacatgacaccctcatccacaaaaaagacttctcggtgaagcaacaaataggtgaccagtgcggattccatgtgtgccacaatatgcgacttctgtatagagaaaaggtgaagactttggctgagtttgaggtcggtggtctcaattgtgatagactaactacattttagtacttatatatgatcgatcaactaatctggaattatgacaatgtagggcacaataaccaagtctctgactaccagctttgaggaggttcgcgaggagatagccagcttcatcctccgcgaaataattaatcccaaaggaatgtttaggcttaaactaaaatgatgaataatgttgaacttctatgtttaggcaatgatgaacacttattatgcaactgtggtgatgtaactgtgatgcttatatttatgtatatatttcatatgtttatgttaagacttgctaaataaatatttgatccaattaactcggttttgcaggtgaaatatgataaatatttgaatggatgtgaaatatgtgaatggatgtgaaatatgagatggctgtgaatgtgtggttgtgtgaaatatgttgatgtctgtgtatgtgaatgcatatgtatgaatgggtgatgctggggagttggggatattggatatctgcgtttgtttctgtcatctttgcagcgggcatggctagcaaaggcctgaggctagccaaaaaacaaaatttattttttttgtggattatagtcatctgtgacgggccataactaaatgcccgattgagatgagatcatctgtgacgggctctagtttaggcccgattgaggtcactagtcatctgtgacgggctctagtttaggcccgattgaggtcagcagtcatctgtgacgggctctaatttaggcccgattgaggtcatcagtcatctatgacgggctatagtttaggctcgattgagatgagtatcatctgtgatgggctctagtttaggcccgataaaggttagtagtcatctgtgacgggcgctagttgtggcctgatagagataggtcatctgtaacgggctatagtttgactggtcgtctgggtcaaagctatcggtgacgggctttacttagggcccgattgagatatattcattcgtgacggctgtttgcccgattgagataactcttcacatcagtgacttctagcctgtgacggacgctgtgcccgattgagatgagggtatccgttctagtgagtgtcttttttttatttactagcagtatgtacttgtcatggcagaaaaacacacatatcacattgaactataattagtaggcactgatcttccgaataccgattctttttttttcataagctatatactgaaatagaccagtagtatatatctaaacctgaaatgcgtgggtgcataattaattattatggagctacatacatgcacgatatggtcattgcattgcatatactgcaaatatcctcgatcgatctattctgccaataaagaggatgaactgaatgtttcaaaaacgaaagaaaacgaagatggtttcattactgtcaggatttcagcatcatttcctcagtcggccgttcgcatcaaaaacatatatatgtactaaaaagcaagaaccaatcgtcatggatttcaggagatcggcacagccatcgtctgggatcccgattgttcgatcggagcaagtgcaagcacaccatattgcggactctagcgacgactagcgtcactagcctctccgaggtgtgcatatgcaccatacgactgcctgggcaaagaagataagattgatatgatatacacgacataagaaataattaagtagtactaaccacatgcattgtcgctttcgaaaaggctttgcgggagatcgacgagtgattgatgccgcctgggttagttcaactattgctgcatcgcaccgtcgactagtcccgtcccgtcgcgccgttgccttggaggacgatgacctgcaattccgccgcacgatgttgccgatcggtcgacaccgccgccgcgccgcgcgtgcaggtcgccacgccgatggatcacgccgtcacctgcaacgcagccatggatcgacgatgaatctcgctgctgtcgcggaatcgacgatgaatcgccgccgccttctccgagttctggtatatcgcggtctctcccagtgacctgattttcgtatccgatgcactggtgggaccgaggaattatgcgagctcatgtcattccggtttctgtgattaaggggtacgtaattttttttctagttaaaaagttaaacgggtccgctcgttaatccgatatcaggatccatcgaagctaatcacagatcgacggtggataagagcaggtgtacatacttccaggtgtatacttccaggtgtatagaaccattttcatatatatatatatatatatatatatatatatatatatatatatatatatatatatatatatataaagtttggtaagatagatgaaataaccttgtccttgaagatatcccttcagtgctctcataatcaagtagtgtaatgtctttcacttagtttgccattgtactaattcataggatgcaacagcatggttggacgtgttcatctcttgattatgaatattttgtccatgtgctccaaagcgttaagcattggtacgaaatttttcgttgttttttttttcttgtgttggattgggtttgtgctacattgggttttgtgatctatgggcctgtacacatcagtttatggctttgtgctatcacaaatggttagatgggtttcagcttatccaatttcctggtaaaacagcttctactcttattggcaaatgttgctttaatatagtgtatgtatggtggcctctcacagtcacaacatagtacggctaccaaatatcaaatgagtgtggaattggggaaaagaagaaagagacaggtggtgcaatgactaaagcaagaagaaaattagacaaccaactgcattatcagacaatttttcttgctttgtggggtctaaaatagtactgaacgaacttgatttctttgagagagactgcagcattttgagtgcttttttatataattacaaatgcaaatatatatcacacacacaaacacacttgcctcctgtttattgcatccagaaatgaaagtaaaaaaaaatattaggaacagttaaaaatcaggcagccaaagaacacagtaacagcatatactatctgctccccaattgattgattgcacctagatccaatatcatccaaataaacaaaagagcacaaggtcaaatctttagccaccaagatcccatcagccacaaatcgatccatctccaagctcaaaatcccaattctttccaagaaagatttttctcggaggccatgtcgaccgccggcggcggcggcggcggccggcgggtcaccatcaggtccatctcctgcaggggcgtcaaggcgttcgtccccttccagaagccgccgctctacgccgccgtgtcgctcgccggccgccgggagaagacgagcggcgaccccgacggcggggagaacccggactgggacgccgcctcttcgccttcgacctccccgccgccgcggatggtatgctgcagttcgaggtgaaggcgcaggtgccgctgctcgggagcaagctcgtcggcaaggtgtccgtgccgctggcagacctcgccgtcgccgcggcgacggcgcggcggcggcgccgaggcacgtgagctaccaggtgtgcgcccccgacggcaaggcgaacggcaagctcagcttcaccttcgccgtcaccggcggcggcgcgtaccagcagccgcaggtggatcatccaactccaatctcctcctcttgctgcgcgccaccgccgacgtcgacgacgacgacgacgtcgggtgcgccgtatccgcctccggcgatggcaagctacccgccgctgccatcgctgtccgcgacaccgtcagcttcactgtacccaccgccgccgccgagcagctaccctcctcctccaccgccgccgccgccgccgcctcacgtgacgcaaagcttcgcaccaaacagcagctacccgccgccgcctcctccgtcgcagtacatcgccggctacccgccgccaccaccgagcaacttctacccgccaccgccggcaggctacccggcgcccagtttcccctctccgacgagcacctacccgccaccgccgccgccggagtcagcctcatcgcagtatccaccaccactgccaagatcggcgccatgctgcgatcgctcggtggaccgtgcgctgccgtcgtacatgtcgccgcgtccgccgccgcccggcgcgccgtgctaccccccgccggcggcgtggttgccggatcaagaagcggcgggagcgccgtacagcttgtacccccaacccgggactcgctacttgtagatgatgaattctgctaaattgatttgagctttgcgtatatcacaaattcacaagttgaattgaattctgcttttcatcaaaagaaaaggaaagagttggattcgatctgtaaattaactgtgaatgctttaatcgccaggacgggaacaatgaattgatcttgtggatttgtgagcatgtcgggttgttttgagcaagatcaattgtgaatgtttagtttgtttctggatttttttcttcttctccatgttaagctgtaaaaatctcttcttgtgtaaaggaaaagtcatcatcctttcgacggagctgctgcatatgggcttattgtaatgctgtgtatgggtagatgatttttttttttcaaaaacaagattattatataaaattttctgtaaaaaagccaaataaatctagtttttaaggttatagtcttaatttctattcaaactactagactgtgcgtcctcgttgctaaactgtttaagacaattagatgacctaacttctactctctcttttttcacgtgtgtttattccctaaccagttgtgttgcttactacatgatcttggaataagttcaacggaggactctcaacttgatagcgagaaatgtatacccctaaacttatacaaaccgtgcactcaaggtcatgtggcaatatatatgagtggtttcgctgacgtggcatcctaatcaacaaaaaaattaaaaaagtacgtgggacccatatgtcagctgtaatttttttttcttctcctcttctcttttctctcttctcttcttcagcgagggaggccgacggctggcgggcgagcacggcggcgggcctgtgtggcagcggagcggcggcgggcggcgagcggagcgcggcggatgagttcgccgtcgtgcctcccgccggctcctgcgtctccgccacccacactgtctaccactacgaggcggcggtcagagcaacccccgtccttgtcgtgcttcttcccttcgtcggaagcgagcggaaggcgaagcaggtaggcgacagcggcagagcagcgacgggcgagcgcgatagcggggcggctggcaaaaggcgagcacggccgcaggcggcgaactggtggtttgctgccagatagtgccgccacggcggaaggcgagtggaaggtggtgacgcagctgtgcagggcatcgtgacaccatcgcaggagagcgagctcgtcattgccaaaacaggcgacgtcatcgcctcaacctactacatgagagcgtgggagcgcgacgccggcgcagaggcggacgcgttgctagaggagctgtggaacgtgaaggccaagctcgagctcgccgagacgaaggcggtggcggcgggcgcgctggcggagaaggcgcgagatgcgtacgagcgtgacagggaggacatgaggtgcacagtgcgccgtgctccaccgctacccgcacctcgacctggccaggatcgtcgtcgcgcaaccgggcgataacgccggtgccagtcggcctcctctctctctctctccctcctccggtctcgctttgtctctccccactcccccaccgcgcttgcccgccgccgctccgcttcctcgcaggcccgccgccgcgctctcccgccgcccgcccatcactgctccgcccgtcggccgctggcctccctcactgaagaagagaagagagaagagagaaaagagaagagagaagagagaaaagaaggagaagaagaaaaaagatgtgcagctgacatgtgggcccccacgtacttttttttttctgactaggatgccacgtgagcgaaaccacccatatatactgccttaggaccttaagtacacagtttgtatgagtttaggggtacatatttcggctttgttcggttacgcccagattcaatccgggccgggaatgacaagtatagtaagaaatttatgatagatacaataagagactaggatttattccagaccgggaaccaatttactcatgatagatacaacaaaacatccgaattagttccacaactcttgactagtgggttgattcctggtctcttattgtccctatcatgagtaaattggttcccagctcggaataaatcccggtctatcattgtatctatcataaatttcttactacacttatcattactagcccggattaaatccgggtgtaaccaaacaaggccttttagaaaaatctcgcccttaagtcaagggacctccggtgaacttatttctacaatcttctctccgaacacaccctaaccagcagaggaacctgaaaattactcctctatattaggccgctatgtctgactaggtgaacctcggcagaggatggaaccaagtggcccattagaggcccaaaactcctggccttgctgccctgggttgaattggtcaaggccctacataggtcccacccttttttttccttgacagtagctctgtaagcaccaggtagccacaaagacctagggtgtgtttggttggatagatgagcctggatgtggatgggagatggccgctcgagtttttgtagtgtttggttggagggccgggtagatggggtagcctggaatagggaatattctctcaatatgctggatgagtgcatccggctgatttggctggatgaagccatccagttttggattgggtgatgtgttctattccgattggctgtggttggtttgatttcctgttaagcaagctccaaataattttttctcctaaaccgtttatctaatttatgatttgattacaccattatattttttataattaaatctttaaaataagatctcggatgattatattttgttaaaaaatatatatatgacaaatgggtcccattaacttttggcttttcccatccatgctatatccctccaatcaaataagaaattggatcgtcatatccatacaaaccaaacaaaaaattggattgtcatatccatacaaaccaaacaaaaaattggatcgctatatccaacaaaatatggatggccatatcctatccatacatgaccgtgaaccaaacacacccctagttaatactcgttgacttttttctgtacatacagttttacatatttcacaaaagtttttgaataaaacgaatggtataacatgtttaaaaaagttaacggcgtcaaatattttaaagacggatggagtatgtcacgtaggataaagaacaaaatcactgtccaaattatcgagggacatgattaacactggttttgagagtagtgggtggctttgtaccatattttacgattgatgctaatgaaagttgacccacagcgaggtatctcaagcggactttatcaactaagggagtgacgaccttatctggtaaattaggcccaatataggcccaaaatttctggcccttgctgcctttgggctcaacacttgaaggcctcctcctcctccttcaatgtagaatccaaccgaggccatggagcagcccaaaacggtgcaatggcgtgagcaacagacacattgacttttttaaaaaaaaaaacacagtgtaaatgtagacgctaataacacggtcacactcatcgtccttgtgaacacaaacacgtaaatcctacccctataaacatctccagaagattagaccgacatatcttgatattaacgaagtcaccacgtacacgttgtttaatcatcttgcttagttagtcatcagttaagggatgacagcactagtaatcgacaattactcgatcggtaggaagtgcaggaggagtagaccagttaattaactggagctcgtggttatgctttttactagttgacaaaaaatttggtcggtctcggtcaaacgatggcacagcacgggcgcagtttgtagctgcatctaggccactggtggtgagtagtggttgctggagctgaaggagcatcatccaccaccatggccatgtggggagcaggagctgaaggagagcacgcacgcctatcactatcatagcattgtacgcacacgcgcgcgagcgattcctgttcagatttccatgactaaaatatatcatatatgatcttttattgctactttctttgttttttgttttatgtcctaagttgtttgatttttttttctttgttaaattttttataagtttgagcaagtttatagctatagtaatactttaaatacaaaacaaacattatatcaaaatatatttaatattaaatttaataaaactagtttgacggtgtcgtataattttctctataaattagatcaaacttaaaagaattttgactaaaaaaattcaaacaactattttatgacggggcagtaatcgagaagtatcgtacctatccatggagtgcaaaacaatggcacggtccatgtgtcgtgtcgtactaatatccagtctattcgtgtaagcgcacgcgcacaaactccaccgatggatgaatggatggatgcatatccatcaatctgttgtctaatctcgcagcatcagcagtgcgctcctccggcttaccgctggttgtctcttctccagagaggcagagaccagagtttcaactttcaacctcacagggggcattttaaacatcgtcgtcacgagtctaaaccaaatcaggatggtttctctggtgcagaaatgaaccaaatggtttatcataagtttctcaagggtgcagaaatgaaccaaatagtttatcataattttctcaagggtggtacgaatgaatgaattaatgactactataatacgggatatctctttggaacacattacaatatattaaaaagaataaaaataaggtcttaatttgtaggggctatattcggtggacacacttaccaacggccctgattatagatcttaaggatcaagactctaaataacgaatttaggagagagatgcgttagttaattacatgtatctatacatcttgtattataaaacaacctaaaaagaaaaagcagtcgtgcctttagaatgaagggagtaattgactttgactatctgaacgtgcacatgttaaatcctgcattcctcttccgttaattagcccgaaaccaagaagggaaaggtagagagataaacgtatacgtgttgctcgctgattggtcgcctatcctctctgggacaaaccccgttctgaccgctaccttgtccccagttaaaccctttcccaccattgaccatgaatgcggtacacgtggcaagcaatccacaccttgcattgtccccttcatccttggttaattaccctggcactggattaattaccttaacctgagagtaacatcacagtacgtgtgtagtaaaatactcctgtgaaggatggatataccagcaaaatcttgtcagctggcattttatcttatcctgttctgatatgatgactagcatacactgtaggagcatatttttcttactattccgctggcattaattactgtaagtacaagttatatactccaactatttttatataaggaatattataaagttacaaattcaaaactaattactcaaactatgaatatatatatttggtatgtaaaaattgttccaatagaattatatttttaatgatatttcgattttataatacaccttatagaaagaaaaggagggagtatacgtaaccaatgcaacgaaaaataatttcaggataaggtctttacatttctacctttaattagtggtccaaactccaaagcaaacctgagtgattataaattaaggaaagaaaaccaagttagtaattttgaagttatatattaaatttcaaaattggtgtagttttatactccacaactcaacaagcaatactcctaaataaaaaatccaagcaaagtagatctacctagctagcttaatcatataagcttcacctggttttttgtttgcacatcatgtaagaaatcatgcatatgagtgtctctttagtctatatatacatagagatctcatataattacatactggctaccaagataatatcacagatctgtatataatactccagcatggcctttctactgattgactatgcggatagtacagctaattagacgatgtgctagctgttgtatattgcacaagttgatactctcctctgacgttagtaggagtacactataacctacacttaattaattaattaattaaaattaaaaaaatgtgggtgatggagcagataatggtggctggaagc

SEQ ID NO: 26755 - DNA, 2809 bp, Oryza sativa
taattgattaacactctcacaccgacatatataggaagtgctatgagaagatgcccgatagtacagtgataaagggggtgtggttttaatcctaaagtttcgtattcaattttcaacatgctcatatttttttatgaaaaatgtcaattttttttcaatctgatccttatataggacatgtttaggagtttttaatagctacatccattgaatcccaattctctcatattgcctaaattttactttaggtcgtaaaatctaatggttgaaaaatctagaaatgaacgattatatagaagaaaaaaaaccataagttcttcaaaacccttttttttttcttatcagttggctacttaccatctacttcgtgtgatctacaattcctttaaacaagaccttaattacattttacaccctgagcccacctgccatcgatggctagctcataacttagctaatgtcccaccgctagcaatagtagctacttgctcaatttcctactgataataatgaaggagttcaaggcaagcaaaggagaagtcttaccctgcatctagagtaccaactttgaccagcttattagcacactcaattagtgcacatgattcccggttttttcccgtcaaacaaacaccaccacactcaagtcgccacgtgtaaatattagtcaatactcgttattgaaaccggacatattatattaaatgacacgggagattacaactctgccatcataataaacagataaaaagaatatcaaaatagagcaaagagcctcggcgtcttgaaaattcacatgaaattaatacgatcgcatgagactacccacaatgttaaccagctccgacgaaaataaaaactaatactataccaatattaatatatagcacctcctctaatttcacaaagtttcatatcaaaactcaccggcggtgggccctagatccaattgtcattgcataacaaaatatagcaataggccctctctagctcacacttactccattagtctcaacattgacaggctgtggactgggacccacctgccggcattctcatctctctcacacacacacaccaaattctaatcaaaataaaagcaaaggggatcatgatagtgtcacggctttgaccggctactgccattagataagccctaatcaaagtggattagtgcttaattagagtgtgtgattagcgcgccggatttggatctgaatcggagccgggagctaggatcagtgagctggaagtataatgcccccaatttctcaatctttttttaacctcggagaacgtgctctcctctttcttttaattttctttttctcttttcaattcaatcttgccttttaattttgaccccggtcaaactgctcccatctcgacatctctcatggaaacaaacgcacgcgtcacatgccacacatgcgtttcagtgtacagtaactgaccgaaataattactgacttaacaacaactgtcaaaagttactactaattaccttagctaacaaagatacttagcactaatcaggaacaagatgacgtaatgcgtagaggcatattcgaatctttcactgttttgatccgcttggaacaccggttaataacggcataacgcgtaatatacgccatagtgatttggacttttttttttctacgtacttttttcttttctttttggcctaacgaccgtcatgatgagcatttttgactggatttgtattcgaattcgatttattccgtctgactttgcttgggtaaaacggcacctgaaaattcgtgcgtgcgtgcgtgccttgaattatgcacagcatttgcagtttgaccaaggcttgtgctacgtgcggtttagctgcagagatctcggtgtgagtgagtgtgtgcactgaacgatccaaatatttttgaatggtttatgccaagtggaatttgaatttgctatgaaaattatggtattcatgcctacaaaattgtttgtaatcagttttggaaatttggataccactgtattgctggactcgatgggcgcgcacacaggatgtgaaatgtggggaggaagcagtttaaagtttaaacaaaccagaaactgaaaaaaggggaaagcaaaagtgagttgaaattttgcctgccaccacgcagccttgcttttttttttcttcttttcttttttctgatcagaatgcaacgaaaaaccatgtacaaattagcaccaaaacttttctgtaattacaaatgcggacacagctgcagtcgaagctgcagctgaatcatcatcgcctaaactgaactcggatcgagcttaatcttaatcacccccgttaattaccctcccggagactaattaattgattttagcctagccggagcacgccaccgcgccgccattgccgcagacgagggtggtggtggtggtggcggcggcggcctctcgccggcggcggctgccgagcctgccgaggaaggggaggcctcgacctttggaggatcttctggtggtggtggcggtggcggcggcggtggcggtgtcaccggcggcggcggcgacgacttcttggatggtgtccagcttgggcgaccaccgccgcgccttgctgtagccgacgagctcctcgtactccttctccagcttcttgtccccgcgcagcacgggggggttggtggcggcggcggcgaggtcggcgaccttgtcgtcggcggcgaggaggaagtcgtcggagaacttgatctggagcgtgccggacgcggtgcggaggagctcgaacggccgctgctgctgcttcttggcggcggaggcggaggaggcg

SEQ ID NO: 26756 - DNA, 22631 bp, Oryza sativa
aggtgagggtggggcccacgtgggggtggcaggtttgacactttgaccggcattttttttcttttttcttttttctttttttgcgcggcgtttggatctagctagttcctcagtcgtcacactaccagcttggctttcccactttttttattttcctttttctctttttatatatactactgtataaatataaaaaatacatatagagatattcaaaagatgcgggtgtgtcagaatgtggggcccggtgttcagtccacgtgcctgcgacggtgccagccagtgtgtgtgaccgtggatccatttcgaggcgacgtacgctcgtgcatccatccactcgtgcgtgccaacgtgacaactactactcctcttctaccgtgcaaattttaatggcgcgatcgagttggcaaattgcgcctagtaatcgaggtgagttcgtggatgtttggagcacgtttggttagtgtgagggagtatttttgtaccggattaaagtaataatgttgcgtagctttaggaaccgggactgatgtgtgacgagcgatttctagcgtttggttagagtgattttgcatggagttcttgaaatctggtatagtgcgacaaatgatttttatcctcctgttagagcatagtaatattttcgtgtgtctctagaaaccgactaatgttcgtattgttgtgaagctcttgaaatctactatagtgcgacaaatgattctagtcgattaaagtgatattgttgaggagatattgaaatatgctatagtacgacaaatgattatggccttcagctagagtgatattgtcgcgtacctctagaaatagactaaaggatgcattcagaagtcaatgttcttatttcccactccctcgttttctacgcgcgctactctttctaaactgctaaacattgtgtttcttgaacaaaaaactatagaaagttgtgtaaaaatcttatttattcttttttaacattatttacttaacatttaattaatcatatgttaataagctatctatttttcatgcacgtgggagaggttcccaaccccttctccagaacacatcctaaagtgatattgttgtggaggtcttgaaatctgctgtagtgcgataaatgattctagcctctagctagagtagtgatatcatcgtgtagcactaaaaactgaccaaagttacattgttgttgagcgcttgaaatctgctataatgcgacaaacgattctagcctttggctagagtaatattgtcgtgcagctctaaaccttttttttttgatagtttgtggtcaagaaaaacatttgagttgcatttgtgtcacggaattaagtcatggatgcattgggaaaacacaatgtgtttgtcggtaatcctacctaatatgtggtgagcatttttggtgtcagattaaagtaaatcttgtcatggagctctacgaaccgaccgaactgtgaagagcgatttttggcatttgattaaagtaatttgtcatggagctcttgaattctgttgtagggcgacaaatgaatttttgttgtggatgtgatcttgaaatatgctaatgtgcgataaatgattctagcctccggctagagtgatattatcatgtacttatagaaacagattaaagtaatattgttgtggaggccttgaaatctgctatagtaaaaaatctagcctctggctagagtgatattgtcgtgtagctctaaaaactgactaaagttatattattgtggagctcttgaagtttgctatagtgtgaaaaatgattctaacctctagctatagtaatattattgtgtagctctaaaaatcgactaaaataatattgctgtggagctcttgaaattttttaatagtgcgataatgattctagtctctcgttagagtaatatttacatgtacctctagaaaccgactaaagtaatattgttattgaggccttgaaatctaccataatgtgaccaatggttctagcctctggctaaagcgctgaagtaatattatatatagagctcttgaaatttgctatagagcgataaatcatttaagcctctagctagactgataatatcatgtacttctagaaactggctaaagcaatattattgtgtggagcttttaatatctactattaaaaaaattagcgaccggcaatttcgttgtgggatcatgaaataattttagcaacgggccaaaattatattggaatagaacactggatcactaagaaacattttttatggcacactgaactttgccaaagagaggcgcctctagctagttaatttgatcaagaaaatattgaagtaacacttgttccatgaaattaaaaactgtagcgctcggttcaaagtattattatcgtttaatgtttggaagactcaagtgtgtgacaagttcaaagtaataaggtcatgtggcactttattaccaaaaaaaaaatcaatggtgtgtggccaagaaaatattaaagttgtatttgcgccaataaatcaagtttctgataaaaatatatcctcgtcaattgtccagctagtttgcctaaattgtgctaagcatttttggaatttggttaaagtattattgtcgtggagctctagaaatgaaaatgtgacgagcgattcaatatttggttaaagttattttgttgtcgagctcttaacccgctatagtacgacaaatgattatatccactagccatagtaatattgtcgtagagcacatgatcatcaacaaactttttatggcctactaaactttgccaacaagcaaagtcgctagattgatcaagaaatgttgaagttaaactttgccaacattagagttctctgttcatcaagggaccagaaagatgaactatactcgttttctcacaatatttagacaaaaaaaaatataaccatttgtttactcttctcaattcttgttggaacaacctctcactcctatgatatgcatagatacaaatgaacaatcagccccctacaaaatttttgccggaaaagtcccctacaaaattacagtgacataaaaaaaaaaggacgatcaacatggataataaactaaggaggcacgtacgtatgtaaatgctaaagtttcattttgtttagcatagcaatgcaattcaataggcggttgacatactgattctggacttgtttagatcaattttttcacccagtcacatcgaaagtttggactcgctaaatgataccaaacttttacattagaataataaagctaccaatagttaacctgatcaccaaatgatcaatgccttctagaacaactcagaccctcttctagaacgaacagaagcacaattcaagcaagaactactaccacaaaggtccaagaaagcggtgcaaaatttggttttggatttgaatttgtcgacgcatgatgttcaaccgtagtccgatcgtcactactacactcctctgcagtccggccgcatgcatgcatcttctgcagctagccagctctgaatttctctgatcatcatcatgcatgcatattatcatatcatcagatcgatcaccctccttccaaaacatgcattcatcatcaacagtaaaagactactactcctcctaaaagttaatttgtttgttaggtttggtgttgtggcgttggaccaacaacaacaacaacaacaaagccagcagcaaacacagcagcaacaatcatgtgtgtcgttaggttcggtactatctgtcaaaggatcgagtccaagctagcgtttgcatggaccagagactgctgctgctgctatcgatcaaccacacaagtgttgaaagttccaaccaaacccactgtctctaggcttaacacttgctgttgtcagctagttggtcccatggaaactacattgtcttaatttgggtgcagtttttagccacaggttcagtcattttggaacagctagtagtgattttgtccgctatttcgcctgtttatccaatgggtggaacagtggttttcaggggggaacagtgatttgctctgagatttctatagctcttttagacttggagtaattgttctaattatttatccctccttccctggccgccattgccgcgccttatcgccatcctctcccttcttcccaccctattgtttcgcttatttgtggaataaggcaaacggcatatttgcaaacgaaaaataatttatgtgtggaataagtcaaacggcatagttgcaaacgaaaaataatttatgaataaaacttttatggtcaattgtcctcgccattaataccaaccacaacccaccaccatttagcggccatacaccaaacatcacacgtttgtacatgccccaacacaagttttaagacatggagaccacagtcgtaaatcctctcatagaaatcctaacaaaaagtgcacatacacttactatcacaggggtttaatcctggttgggtccaccatcatacttttgttctttccctggtaattaatacatccccatttcatattataagtcgtttgatttttttcctaatcaaactttgttaaatttgactagatttacaaaaaaattaacaatatataaaatattaaagtaatatattttgataatatgtttgttttgtgttgaaaatactactatatttttctataaacttagtcaaactttaaaagtttaattataaaaagtcaaatgatttataatatgagatggaggaagtacgtaggaatagtgttatgtcacaagtattttgacgataaaactctagtagcaattacaaaatagaagcagcaaaattgtctagagtattaaagttttcatccggtttcgttcgcattcctaaaggttgccgtgatatctgaatttcgtccacccaaacagatctcggatcatgactccacacctttaatctaagtttcaaaccctcctttttgcttcaaccgatcgacctgtggacgtacgaaaaacagaaggccctttacttcatgtgcactactcgagtgattccttttttcggaacgaattgaatgaacataattcgagtcaaaaagcaaattaaccaaaccaaaaagcgaacgcacgcagtgtcgtcctatcgaaatgcacgggtgacaacactggagtatagtagtggcagtactcttttccatgatctttattagagaatgatatactccctccgtaatgtttgacaccgttgactttttagcacatgtttgaccgttcgtcttattcaaaaacttttgtaaaatatgtaaaattatatgtctacatgaaaatatatttaacaatgaatcaaatgataggaaaagaattaataattacttaaattttttgaataagacgaacggtcaaacatttgctaaaaagtcaatggcgtcaaatatttcgaaacggatggagtatttttttttgcctatcatttacatccaattgaatatatgtaagcttttaggacccctttaaaatacaggattgagaaaacacaggaatagaacaaaacataggaatagaatgtcatgattattggattcctatgggattttcaaacacgggaaagtcttcaaaccatcgtttgattaacatacaggaaaaatactggaattttagacacacgtagagaaaatcatgaggtgagacctcatgttattttcctctaaaattgttctagcaaggttaattccatagtaattttaaagggattagtaggaaataatccttagattcaaaagactctataggataaaattctatagaattcctatagtttttcctttgtttcaaaggggctcttaaaattgagaacttgacctttcaaacaacccaatgtaaaatttactttcataaaaatttaaacttaaaatttcaaaatgctactcaggtgacggcaactattacgctacctactctttcgctgcaactgcacgcctgcctcgagacctccttctctccctctcctccggcgcggtggccggccgggcggcgctttgacccacactgcccggccacggcgaggcgtagatgctacgtaggagcaggagtagggtaggagctagctgggccggccatggcgctccttttgcagcagctgggagcagtgcatcgagacccggagacccacgagagctacggtatctgtgtctgtgtgtgtgttttttaacgtacgtgcgcgtagcacaaggctgccgagtaatacccagatgagaagaccatgatgccatctctctctctcacacagagtagggtgcgttcgtttccggtgctttggaactcattccctccataccgaaaacaagcggttcattatcacgtaattaattaagttttagtgtttttttaaaaaatagatcaatatgattttttaatcaactttcgtatagattgttttttttaaaaaaaacacatcgtttaacaatttaaaaagcgtgcgcgtaaaaaacgagaggggagagttgggaacaccctcttgcgaacagagccaagagcaggtaaactagcagcctataaatcagctttaaaagtatatcgagatgataaaaaaagagagagaagcatgtggctacagatttatagccaactgtagtacggactttaagacacaatgtgtgtatgacagatgtgaccagatattaatagtgtagtttttatttataggtaactattatatgaattgactattaaattgactatagataatttagagttagtagttggctatactattaaacttgctccgagtttaacactccctccgtcccattttaagtatagttgtgggtttctatgtaatgttgatcgtccaccttatttaaatatatttatgattaatatttttattatgacatatgataaaacataaatagtattttatgtgtgactttaaaaaaaacaaatcataaatatttaaataagatggacggtcaaacgttagacatgaaaacccacgactgtacttaaaataagatgaaaggagtatatagtagcgtagctataagccaactgtaaaattatgtggagaagaaggaatttaaaaattgaaaaagggttagagtaaggataatagcaagcataagtcaaaaattgaaaagggttagagtaaggataatagtgagtataagtcaactatacttatgtggaggagagagttaaaaaaataaatgagagttcacttaacacgtgctcctggataaatacactaaatacataagtgagaaaaggagagaggagaagaaaaattgaaggctctattatttaacttgtacttggctttgatggaagagctgactattcacatacttcaacatgaatatattaaatgtataggcgagagatatagagaggagaagaaaaatagagataactttataacttatctactatacatgttaactctattattatttccgttctaaaatataacaactagtattatctatgaacgtggacacacatttatctaatatgagctatttaaagatggagtgaggccgtgtttagttgttttggcaaaaaaaaattgacatatacggacacacatttgaagtattaaacatagactaataacaaaacaaattacagattccgcttgtgaactgcaagacgaatctattaagtctaattaatccgtcattagcaaatgtttactatatcaccacattggcaaatcatggtgtaattaggcttaaaagattcgtctcgcaatttacatgcaaactgtgtaattgatttttttatcacatttaatgctttatacatatatccagacatttgatgtgatgtttttagttaaatttttttttatctaaaccaggcctgagaatgaaacaggaggttcgatttttacccgggtcaagtggcgaagaattccaggtagtacaggtagtactgctttttactgcggtgaaaggagcaaagcttctgcgtctgcttggcgttggtctacgtctaacgtgagcgtgcgtgcgcctgttggtcgtcgtccgaatggcctggtctccaacctcctttttcgttcaacgcctttgttggtcccccggcccctctcttcctcttcttcatcgatcaccaccttttcttttttctttcttcccctaaagattatatttgcgcgcagctgatgcagtgcactgcagcagggagagcagctgtggcactggcagtggctggctgctgctctttggtttgggtttgcctgcctagacgaacctctgcaccgtcgtggtccacctctgtcttgttaagtactcccttgattctcatacggctcgtttggttggagggagtttttaggagagattgggaatttaaagggatgatgttattaagggcctctttgaatcaaagaatttatgtaggaattttataggatttaaatcctataggaaattttcctatttggccctttgattcaaaggattgaagctttccaaatcctatgaaattcctatggaatggcacattgcatgtggattttggaggaaatttagcaagagctccaacctcttggaaaatttccttttagtctatctctctcattcgattcctgtgtttttcctgcgctccaatcaaacgaccattcctatgtttttcctgtgttttgcaatcctctattttacacttcaattcctgtcagaatcctatgtttttcctattcctccgttttttctaccctgtgattcaaaggggccctaagtgttttgttttgtcgaaacaagatttcggctatactaaaaagaggtggctatcaagctagaaaagtggatgggtttggagacgaagaattttatacaggttcaggcctttttattcaagaagtaataccctactcctgtccggggatgattccgccgagtatattattgattgtataatctaggtcaaaaaaccgtgccccgagaggcatccggacccctccttatataggggagggggtccgctttacaaaatacagtccatatcctaaaagaacatggaattacagataaaatacaatcgtaaccgactaggatctcgggtatttccttgacatacaagtttagaatctaacccgagtcctcatgaaggtattctgtctttattcggtatcatgtacccagctggaatatgaccgccatgtagatatagggtatccataatctctacagtaacccccgagacctttgcagtcgacgaaatagccatctcagaacaaaaaacaataatccgagtgcttcaattcaacctgctccagcctgccgagtgctaaaatcaaagactgtgaagggcgaaaagaaaacatggtgcatcgagtagatgcacctaattaggtgtagcccccgactatgtggttagttgaaaaactaaacatgtagtcaagaaccgagtggttttacaaccaaacattatatagcaaagcatgtgtggtagtcagtaaaacacccagccgtctgcttcttagctgcaatacatcgagaaaaaaatatgaaaaggcccgagtgataaacactcaaaaggtcctcaaatagacatatttgacaggaatccgagtaaaaactctaaagacaacccatcaaatatgataaaaaatcatggtaatcaacgagtctaatagcctaggctatggccctcatcataaccaaaatgtgcatataacatgctaagagaatgactattaataaaccagtcatctcaaatcaacccaaacaacttttgcagcctaataaagctgacaaaaatggtataacacctttctgtcgggcacctttttatttgcagcataataattccaaagaattatcgaaccgcgttaaaaaggattttagcagcatcgggccacatcattgtgagcacaaattgccaaagcaaaaagcacctaagtccctagggatcacaacgggccacgctgattataatattgggctgaagtactgtacagacccaggcccattagtactcccgataccctaacaaagcaccgaagtccaagcatcgcttcgtcttccccaccgagactctcgccatttccccactccttgctacagtagcaaaccgcaccgtcgaaactagggttcatcaatccgtcccaatccattctcaaaaaatcccacgaaacttctccgcgtgtccaccgcaccaattcctcattcccctccagctatatcttggaccaaatctaaccatgcaactcgcatccatggcggaggagagagaaagtttcgagagtcagtgggctccctccgatgtaacggaagagaatctgaaagaaatggtggtgcacggcgttcttccgacgaaggaaatcatcgggtggcgaccagcgttcggcaaagcattcccgacccccgacacacacgagattgtggtattctctcacttcttctatggcggattttctcttccaacctcaagattcttccggggaattctgaacttctatggaattagcttgcatcatctgaatccaaactccatagtgcatatcgccaattttgttcatgcttgcgaagcttttctgggcattaggcctcatttcgccttgtttcgccgcatcttcttcctcaaaccctagccaaacaagagcaaactgtgcgttgttgggggtgctggtttccaactcaggggaacactaagccaaaaatatttctccatgcccttcaagacctcaaacaaaggctggcacgccaactggttctatgttcaaaatcctaaaccagcccttcccgagtactcttgtctccctccagtctaccaagatacatggaattcattgcctacaggagatgaggcagcccaggctgtagaactaatggagcgcatgataaagctgaaagagcaaggtttgcagggagaacagatcacttggcacttcataaaaagccgattagctccaatcaaagagaggtcccgcacagcttttgagtttgacggcaaacatgatccaaatcgtgaagatccagactctcttaactttaagattatgaaggaaaggatgtacaagatcttctcgaatgctatcgtcgtcagctattcgcacttgctgctagtcatgccattcaatgctttcaatcctcctccaccgatatgtaatcaaacatttcaacttttcacagaatatagtcttgtctttttgttgaatcaattaacaatgaatgatattacgaccaggaatttgctttgatgaaatcggaccccccagtcgtccaatgccgatcaccccaccgccaaaccggtcaagggagcgggggtcccaagacccgttctgaagcccggccaaatacttccaatccagccagatttacgcaaaaggaagttggtgtcaagtgacgacgaaagcgatactgctagaaagcctggagaccgagaggcaaccaagaaactgccaaagcaggctactccaaggaagaaaacatccagttgtcctgtgccaaagatcaggaagtcttccaggtacaaatcatataacgatctctcttgcattgatgtgcacccagtgcagaaataatactgaccagccagatttacgcaaaaggaagttggtgtcaagtgatgacgaaagcgatactgctagaaagcctggagaccgagaggcaaccaagaaactgccaaagcaggctactccaaggaagaaaacatccagttgtcctgtgccaaagatcaggaagtcttccaggtacaaatcatataacgatctctcttgcattgatgtgcacccagtgcagaaataatactgacaaccaaacttgcaggaaaccatctgatatagatccttctggaaaagactctgacccgactagcagggaaacaaacttaaaaggaatcgagccaactgacgaggatcagccgagtcacagccagccagcaaccgataatgtaggatctggtgatcaacccccgactgagaatgagtcggccgaagctggagccggagttaatcaggagcccccgactaaaaaccagtcggacactaggccaagccaagagattccagaagttggagctcgggcagacagccctcgtagacaagacgccagcaacgacccgatgccagggtctcccattaaggtgcaagagtcgactcgttcccgtccggaaatcatcacaggtaaacaccttgcctgaaatcgtgttgatccaaataactctgatcaattgtctaacctttgtcagtggatacattaggaccaatgattggtgatgaagaagaaattccccgtatacaagcagctgaagactcgcacccttctatcttagtcaagtggtgggacgatgacaggcaacctcaaggaatcataataaacaaacaaaaagaagatgaggaagtatgcttgctgaaaaaggcactcagccaggccactcgcattgtgaatgtaagtccatttacgcatagctttaattgttccccttcatattttgctgaaaacgccggtaaattcttattgcagagaatccatctcaggaatgaggcaaagaccacgacacttgagaaattagttccccatcttggaactcttgaagccaccaaaagccagttacatgaggtcagagagctcgcgaggaaaactgagcatgatctgaggaatagaatctctgagcttcaaaaatctaactatgaattgagtggttcatccaaaggtaaataccatatccgtctgacatattcgtgaaaccttccttgtcatatcgattaaccgaagagcatttcagtgcaagccgccaggatttccgacctagagaggcaggtcgaagctctggagaaggacaaggccgaactagcaaagcagagggacttggccttaaaagatgttgaaggtaatgataactagttccccatgctcttatagccacctgttgatacaaatttattcgtgcaaatcgcaaaatcaagtcccaggcacagtttgatgtcttaatcaataagatcaataggcttgaaggggccagggataaagtcgctaatgccgctaccctactcatccaagccatgttcttcaataacgccggttcgagtacacttgacgcttccgagatcttcgacaagctgagagtcgctccggatacttacttcaagaatattagggaggttggatgtatgggagcaagcatggcgttagctatgaccaaatctttataccccaaaatcgatattgacgccgttgatgggtttgcagacgggacaagcgaagaaacagccctcaacctcatcaatgatgcgcaaaaagccgctgacaagattgctgctgacatagttgagagattccaggatggcgaccttcggccgactgggtctgataattccgacgatgaaaaaactgacactgattgatgttatattgtaattgtgattctgatgatgatgatgacgatgatggaggtacaatttgtacaatactgataaatttatgctgtgcatgatatttcaaacttagctcctgatttcttaaaagtttttgtcaaaccttgttgagcctaaaactcgcaaaagttgttaaaaaactttcagtcctcattgactaagccaaaaaatcaaacagagcaatgataaatcaagtaagcgaattgaattgataaagatcacactccattatcatagtagcccccgactgacaactcaagaaaaggcttgatgttagcagtcgaagaggaaaatacagaagtgatgcctaagcataaaaacaacgaaggtgttcaatattccaagaattgttgacaagagtaccatcttcacgcttgagtcggtaagaacctggccgagtgactttagcgattatgaatggtccttcccataagggagataacttgtgccgatcctatgtagtttgaattctcctcagaaccaggtcgccaactaaaaaggctcgcgatcgaacattccgattatgataacggcgtaacccttgtaaataccgagctgactggattagggctgcttcacgggcttcttccagtcggttgatgtcatccactcgatcctcttcatggcgctcttcccggaagttacgaaatcggagggattcaaactctacctcactcggcagcattgcttctgcgccataaaccaagaagaacggcgactggccagtagcccgactgggggtggtgcgtaaagaccaaagtacagacggcagctgttctacccacttgccagcatagggacgcagtcggtcgaaaactcgtgctttgatcccttgaagtaccatgccattggcgcgttcgacttgcccgttactcatggggtgtgccacagaggcgtaacaaattttaatgccaaagtcttcacaaaaatctttaaatattccgcccgtaaattgagtgccgttatccgtaatgatacgattcggtactccaaaccgatgtacaatattgatgaagaaatctctagctttgtctgcggtgatggtgacgaccggtttggttttaatccacttggaaaacttttccacagctacaaagagatgagtataacccccgactgcctttttgaatggaccgaccatatcaagcccccaaaccacgaacggccaagacaacgggatggtttgtaactcctgagctggtaagtgagtttgtcgggcaaagaattgacaaccttcacatgttcgcacaattttgtcggcgtcggaaacagctgtgggccagaaaaaaccctgccgataagccttgccaacaatggttcgtgcagcagcgtgattaccgcagatgcctgaatgaatgtcttttagcaattgtcttccctcttccaaagatacacagcgttgcaggattcctgatggacttttcttgtacaactcggtctcatgaatgacatagagtctgctgcgcctggagatctgcttggcttcatttttgtcttgagggagttcttgtttggttagaaattttatgagaggttctctccagtcggcttcaatcatgcttacgccttgagtatccatggcttcaattgtttcttttctgggcacggttggttcgtaaagatgttcgacgaacacatctgaaggagccgcttcctgttttgaaccaaaattggccagcctgtctgctgcctcattattatgtcggaggacatgggtgagcttgagtccgtcgaatttatcttccaacttgcgtacctcttgtcgataagcggtcatattgtcatctagacaggaccattctttcatgacttgattaacgaccaactgagaatctcctcggacgattagtcggcgaatgcctaaagagacggcaatccttaatccatggagcaacgcctcgtattccaccacgttatgggacgcagaaaaatgtatccacaatacgtagctcaatctttctccagtcagggaaattaaaacaaccccagctccagtgcctgtaagcctcttcgacccatcaaaatgcatagtccaatattccatcttttcctctggcatgttttcttgacactcggtccactcggcgaggaagtcagctaaagcttatgacttgatcgaagttcgtggcttgaaagatatgtccaaagatgtcaattctaaggcccacttcgctatccgtccgtttgctttgtggttatgaagtatatccccgagtggaaacaatgtgaccaccggaccgagtgaccttgaaaatagtgagacaatttcctaacggtaattaagacgccatataataaattttgaacctgaggatatctcgtcttggagtcggccaaaacctcgctaacgaagtatattggtcattggactttttgaacatggccttcctcttcacgtttgacaaccaggaccgtgctcacaaccttagaggtcgccgacacgtataacagcagcggctcttgtggatgtggcgaggccaaaactggtgtagtgagaaattttttgaagtcttcaaaggctttttgtgcttcgggtccccactggaaattgtcagttttcttcagcaacttgaagaagggcatcccccgttcaccgagtcgcgaaacgaaccggctgagcgccgccatgcaatcagtcagcttttggacatctttttgtgagcttggcggtttcatgttgagcatggcgttgattttctccgggttggcctgtatgcctctttgagataccataaatccgagcaacttccctgacggtactccgaagatgcacttttcagggtttagtttcatcctgaaagcacgaatgcttgcaaaagtttcttctaaatccgcgatcaggtcatacttctgcttggtcttgacgactacatcatcaacataagcttcaacaatgcgaccgatctgagttgaaaaacatctttgaatcatgcgttgataggttgctcatgcgttcttcaatccaaaggacatggtgatgtagcagtaggacccaaagggcgttataaacgaggtcttcaagtagtcggattctttcagtcggatctgatgatatcccgaatagcagtccaagaaactgagtagctcgtagccggccattgagtcaaccacctggtcaatgcgaggtaacccgaaaggatctttagggcaagacttgttgaggtcggtgtaatcgacacacatgcgccattgcccagtcttcttccgaaccagaactgggttagccagccagtcgggatggaggacttctttaatgaagcctgctgctaacagtttggctaattcctctttgatcgcatccttcctatcttgtgcaaagcggcggagtcgttgtttgatgggtttggcgtcttccttgacatgtaaagagtgctcaatcacctctctgggaataccaggcatatcggatggtttccacgcaaaaatatctttattattctgaagaaaggtgatgagagcgctttcctatttacaatctaactcagcgcctattacagcagttttggtaggatcggagggatctagtggaatcttcttagttttgtcgtcgccttcttcggtctttgacagcttggtcgtaggcacctctccttcgcttgccgtagtggcagccaatcggatctcttcgcgagcgagagtgatctcgtgggtttgggctatttcgcaactttctttgtcacatgtgacggcttgcttgatgtcgctccgtagtgatatgactcctcgaggaccaggcatcttcatcatcatgtaggtgtaatgtgggacggccatgaatttggctagagccggtcgtccaagtatagcatggtacgttgtctcgaaatcggcaacttcaaaacaaacgttttctgtgcgaaagttttcccgagtgccgaaggtaaccggaagagtgatctggccgagtggtgtagcggataatcctaggatgacaccatggaagggtgcattactcggctttaattccgttcgaggaatctgcatatcgtccagagtcttggcgaaaaggatgttgagtgcactgctaccatcgatgagggttctttggagcttgacgttacgaaccactgggtatagtaccagggggtaccgccccgggtggaccactcggtcgggatgatccgagcggtcgaacttaattgctatctctgaccaccgaaggtattggggcgtgttaggctgaaccgcattgatctcccgttctgttagcttctgctttctcttagattcataagccaggggtccgccaaagatgtgaattagttctttgcgatgatcttgaaaaccaagtgggacatcgtcttcaccatctttcttctttgatgtgccttggtctccgtctgagggcttacgtgcgttcttgacgtattgctctacaaactgtttgtagacgaagcaatctttcgccacgtgattggagttgggatgatgcggacattgggagttcattatcttgtcgaaggtgttgacgcgggaacgttgtcgggaagatggagaggttgttgccacaagctcttcgggcttacgcttgcgatccttgtggttgttacttccactccctcctgcggtcggctgcatcggatcccatataagaagctcgctctttacccgatcattcaaacattttgtgggcggcgctcctgctctattgttgcgtagcaatacaagcctgctcatgctgcttcggcggcgctttttcgccttctcttcgctctggacaggagccctaatggacacggggagggagcaggcgaagcgtatccttttttggcttccaagtggtgcccgactgcttggacgccgtaatagcatcttcggctttggcatactcattggctttttcaaacatctgcttgaccgtcttgggaggtttgtgtccgaacttgccgactaggtcctcgtggcgaatgcctttagtaaaggcggcaatgatgacgtcatcggtgatgtcggagatcttgttgcgttgctcagagaagcgtcgaatgtaatctcgaagagattctccagacttctgaatgatgttgtagagatcgaagtgtgtaccaggccgttcaaaagtgccttggaagttggcgatgaagtggtcgcgtagctctgcccatgatccgatcgtgccgcggggtagcccgtgaagccatgaccgggcagaatccgctagggccacaggtagataattcgccatggctttgctgtctcctcctgctacgcggattgcgagaccatagacggtgagccaagactcagggttggtggtgccgtcatatttctcgattccggtcgacttaaagccagctggccaatccactcgacgcagatcgcttgtgaaggcagcaactccgtccacatcgtcgtcgtagcgatccggtgaatgatggcctcttgctgcgcggtgctggttgatggtgtcacgaagatcgatggggcgccttcgatgtggggagtgtggtcgttcaactcgacgctccctgtatcgttcgggaggcgaacgaacagaccgttcatcatgtcccctgctcctgcgactagatctggcgccgtcaatgctgaggcttggctggtgatagtcctgagatcgaaggtgagggactcggctaccagtcggggtgcgggcgcttgcggagttggctggaaacgaagcaacgatcatggtcttcgtttgattcaagatgtttacaacatgatcagcttgattgagtacgtcttccttgaggagggtgtcgaggagagtgattgctgcaaccgcgttctgctgggggtgcgaaaaaccgctgttccatcgacgtcttgttgcccaatgagctctctcgctcgtcgcccaaattccaaggcgcgctgccgtcgatcttcaccctcctttgcaatccgttcgcgatcttgttgctcacgctgtagtcgttctcgctcctgttgctgtcgctcttcctccagttggcgacgttcagtttcttgccatgcgcgctcttggtccacttctcgggctcggcgttgttcctccgtttcgttgtcagccacgaatacgccgaagaagagaggcgtgtagttatcctcatagctgtcgtcgaagttgtcgaagtcgtcgtggtcgtagtggtagccgaagtcgtcgtagtcgaggatctcggttggtcgagaactgacaccgggggagctaaggtagccatccaactcttccgtcgagactgtcccaaggggttggagtataacgccaacctccctggatctagatcggatcggggccgaagccggagctcgcctagatcttcgagcaggagatgtcttggctgtgaagacagcggccaaatcatcaggaagttttatcaggattgagggataggacccgtcatcttgatctggtcgcggaggagtagattagatctcgtccgagtggtttgaagccgactcgggagagatgatcttggagtaggcctcggccgagttcggaataccgaacggcgcggggacctgatctctccccgactagttcgaatccgagttaggagagagatcttgccgaagtcgttggtgatgaagttgaggctgccgaaccggaacgcctgtccgggagggaaggcgaagtcgtcgatgccagaaacggaacccatcgcacttagccggtaaaaacttgacgctacccctacctggcgcgccaactgtcgaaacaagatttcggcaatactaaaagggggtggctatcaagctaggaaagtggatgggtttggagacgaagaattttatacaggttcaggccttcttattcaagaagtaataccctactcctgtccggggatgattccgccgagtgtattattgattgtataatctaggtcaaaaaaccgtgccccgataagcatccggacccctccttatataggggaaggggtccgctttacaaaatacagtccatatcctaaaagaacatggaattacagataaaatataatcgtaaccgactaggatctcgggtatttccttgacatacaagtttagaatctaacccgagtcctcatgaagatattctgtctttattcggtatcctgtacccagctagaatatgaccgccatgtagatatagggtatccataatctccacatgtttatttaggagacatgagaattttggtgggatggggatggggatgtggaattgaggaaggaactccctccttttcaatacctgggtaggggcaggtgattgggagggaattcctcctttactttgtctatgcaaatctcaactatccatttttattaatgacataatctccaactaaactccctatcagtttccatcactccaaccaaacaagatactgggattaaaaatcaaattcccatcttaatctcatcataaattcccttgtgtaaactctcaatccccttccctcgagttaccaaacaagccgataagacttagaattattttatattttgatttttcaaagtaaatgggtcataccttgtagttttcatgtatatatctgaaatttaaatgatttaccggaacccaaatacacattcaatactcatcgattgcattatatacacttacaccttcatcggttggcttatgttgttgcgtttcagcataagcagactgatgtttatcggtataagcgtttccatcgtttggcttataaagagtaatggctgattagtggatcttctgtggcatggtgatcgttgagaggtagggttcgagagaggggagtggggaatcgaggttggtctcctagcgatgtggccgtagaaaggtgtcgggaaggattggtcccactaccaatggctgatgcataatcagcccaataagctaaccgatggacttttgctgaaaatctgcctctgcaacattgaaccgatgagagtgttctttgatctttgttacattacatgtagttttggtcatggtgataaaagtaatatatctaactcttttggatggatagaatatattactaaattttcatgcgtgtgtgctataattgggatcaaaatgcttataaacgaccagaaacaatattgtttctatgaaaaattagaggatataaattctatgtatatagctaggattcaaatctggcgataatggtaccacttttacagaaaccaatctgaaaattccgtcaccattttcatctcctaggttgctagccagctgcttatggttgatggaccagatgtatagttactgagctctaaattggctatagtattgtattatcctttttaatggtaaatagtctgaaggctgagattttcttttggctgtggtttataggccataatatgtgaccaaagcaatgaaaaataattctacaataggatttttatgcttatactttcagcggtttaaaagtcagggatgaaaagtgaaaaacgatgggaaaaacatcaagagtaatataaaatcgactttgaaaattcaaattagactatgattctcatgtatccatatgcacatttgtggtacccgaattcgaatttcgctgctctaataatggaagattggttcaggatttgatgggtttataagtcatttctattaaaaaaaaacaaggtcgcaagatacggtcttaatatgttggaccttagcaatttaaattcgtactattcgtgaaggtttctttaaataatgtccaaatttggtagaaatttattcaaaaattaatcttgtgaaattttcccttaaatacccaatcgagtctccctctccaaacgacttaaacttgcttcacacactttttcccaattttatatatcatcttaaccttgctgccatattctttactggttaacggataaatggatgaataggcatgttctccgaactaattaacagtacgatttaaagaatgctttctatatataaatgtattgcaaaactgttttaaagtccaattttcaacataattcatacactgatagagaaaccatctttggtcggtcgaccccaatccacaatagtcccggttccattaaaaaccgggacaaaatgatttttagtcccggttaataagaggaagatctttagtcccggttgttgttaccaaccgggactaaaaatcatctttagtcccggttggtttatttttagtcccggttgattccatgtcaggccgtgtcagggccctatgatctttagtcccggttagtaacaccaattagtcccggttggtgttagtttttagtcccggttggtgttactaaccgggaataaaaatcaaaacacactatataatccatataccgatcctcttttcccgtccacacaacaaactcctccctctatctctttttttcctctcta

SEQ ID NO: 26757 - DNA, 5720 bp, Oryza sativa
agggcaggaggggaggcggcagtggctgccggccagatttttttttcttctttttttttgagatgtgaacagtgatgtatttttgtgtgagatgtgaatctgtgatgaattttttagaaccctgtgatgtaatttttttaagagtttgtgatgtatttggagatgatttgtttgaggatttggagatgttctgtaatatgtgatgatttggatatgggaggggatggtgtgaaatcaatattcaatattaaaagcagaaaaaaaaagaaaaaatgttaccaaccgggactaaagattaatttttagtcccggttatttgaaccgggactaaagatagcgatctttagtcccggattcgtagtcccagttggaaaaccgggactacagggggttacgaaccgggactaaaaaacatttctccaccagtgataatagttcactcatttatttggccatcattattacaaatcattctgagattcagccatccagcacaaaagaacaacatgaagatatatgcgccaataagcggcaagcatatattgatatataatggttaatttttttttgatttgatagccagccatcaccaatagcaatgctgcgttgaatgtactcccttgctcacagtccaacaacagcgtcacacatacgtacgtacacgaatgcgtgtgcgcaaatacccttttacaatgtcattcaaatatatataaaaccgtgcctagaccttgagcttcacaacccctgcatgcgtccctgcgtacacacggaatctgattaaaatttactactccctttttgaaatcctcttttcaaataaggattccaactactcgatctaggagcttgctcctccccatggcagcaactctctactaccctctaggacaaacacatcacaatgcacaaaaaacaaaactcagagagagagagagaaggtgatacggagtaataaactgaaagtactgaaaatctgaaatacattccgggtgtgttggcatgtgtgtgtgcacacggttgtttgttttgttttattttgttttgtttgagtccttgcttgtttgtttttaccaatgcttatgaatccattttttttgtttctgtttgcatgcttctcttgaggggtgcaagggcatgtgatgtgtgcccacaatgcaagtttgaactcatcagagagaagggaaaagttaattggatagtgttgctttgatttggggttaattaaactattgagatggtacagagatggataggggtagagatatggcatagtccctagagagaattttctatctaccaagtggcactagctagtttagctttatccaggttatatacagtacatactagaagaatcatctttaattactccctcccggttgataatacttatcgttttggataagggcacggtcttcaaaacgtagctttgacaactattttctattataatatatatagaaatatcaagaaatatatgattttattgaagtacttttcaagactaatctacacatatgggtttcatatttttaagataaatattttagaaattatttatagtcaaagattttaaagtttgactttacccttgtttaaaacaactaatattatcatcccgaagggagtagaatattaatatgcgttagtattatgcatcatgcccatgtttaaggaggtaaaaggaatgaaagacactagcatttcatttgaagagaaccttttgtttttttcctcttcaaatacagctccattattaactattcagcttatcaaattgcaaccaaaatttaaattctaaatgttaattttagagttgattgtcatatactttttttgttgcattttattttttacgtcgataagaatatattggggatgttctgagatgttggatgcaacagtggtaatgcgtaatgcgtaaaacttagctatgcaatagaagtaacgatctatagtaattacattatgattgagttgaaataagaaactatagagagtaaattcacgagcaaaatgtagagaagatttttaagtaaatacatttatgaaagtaaattcaataaagtctaaaagtaatttacatcaatcataaaactaacttagcacaaaataaaagtaaattgttacaatattagaagtaaactcattgtagggagaaaaatatggtctatctaaaaattaaattgaaagcccacaaattatagaattgatgactaaaaacaataaatattttatataataatttaatcaaatctaagagtaatttatatatatataacaaaagtaacttacatatataataaaagtaatttacaaacataaatattttttcatcgtaatataatcatgtaagatcttgttgtaaagattttaattgcaacgaacacaatggtgtaatcagattgtagatcggataagtaatttgagagaaaattttataagaaggaaaaaaatacatgcatgtctatatagatgtgtagtatttctctgatgtatgtggtgtctcccgttaagactaaatagataggcctctcagtttagattttacgtttcttttttgttcacaaaaagaatagagctttatttctttttttagaccatggcttggagatgtgtcctgccaagcaccgtaaaatcggcacaaagaattcctagtatagtactactaccaactaccctctccattctataaaaaataaatctaatacatgatatgaatcttattattacgaatctggacagcgactatccaaatatatatgtatctgatcaattattcatatgctaaaagatatttgagatgttctacgagagatgaattgaggagacatgagagacaatttgcttcgtacagttgtccaaagataaaaacaatattaagacgatacgtacgataacgtagcttcatgagataaaagagaactaattaatcatattaactatatttaacaaggggatatataaatacaaacaatatgcatatatattgcagtagcattaatttctgcataaagcactgccacacatgcatgtatatatactaataaaatggaaaatcatccgccctctcgttttcattttccctttctgatcccggcacttagcttagccacacaaagcaagcagaaatcctagctcattaattcgtccaatcacaatcaaattaactatgtaggcagcaacaacatgccaacatgaatgcaacgagaaacacacacatagggactggagagatctctagtgatacatacacgcacatagaaaatgacggtgaagctaagctagtgatcacagccaatcaaaccaaccaaccaatcgatctatcgaattcgaagtcaattacaagcagcccagggcatagtttggtcaaaggacggcagttcataacgcatcaggagtcaatttattagtatccatcatccatggccatgcaaaaatattgcatatcgatcgatcacacacagttgcagactattcgttggcactgacagctcagtctactctcgtagtctgaccaatgacatgtatcaatcgatcatgaggtgtttagatgaggggtgtaaattttggacgtatcacatcaggaattatatagggtatgacatgaggtgctcagacactaataaaatattacctccgtctcaaaatataacaatttttggctacgaatctggacacacagttgtctaaattcataactaaaaacgcttatattttgggacggagggagtaactaattatagaatccgttagtaaactgcgagacgaatttattaagcctaattaatccgtcattagcaaatatttaccgtagcaccatattatcaaatcatggagcaattaggcttaaaaaaatttgtctcgtaaattagttgcaatctgtgcacttagttattttttaagcctatatttaacactttatatagatgcttaaacgttcgatgtgatcaggtgtaaaattttgggatgggacctaaacatccccgaatgcaacgtgcttttactggatggacgacggatccaccggctgctagaagagtaggacgacgtagatttgttttgttaattattctaactttggtcgccgtcgtcttcttcttcctcctcggtccatggcatgtgcttggactacgtttcaaattaagcttgcaagttgcaactccatctatctctctctagatttctctgtgcctctttttgagagtctatcggtgggtctaacaagtcaaagaaaaaccaaaatttaaatatttaaagttaattttaagatatttttcaacataatttctttttaattagcgttggcttttaactcgctacgaacaaatatataaaatttttacctataaattataaattaatttttgtttcctaataagccagcaaccgatgaggctctgaaagtctccaggttggttgcaattgtacagggttcaacatggatgatatatgataatagtattagttacctaaaattgaccactgttatggagttatcgacttatcgttgtgtgtgttggtctcttgcaatcagcagcagttctttaattttttcttgatgcctgctgatatctctagaacaacaatagccgtaacactgacttgttcgactatttttcctgatacctcggcattgaattaggagttgttcaaacaaaattagttgaagttaagagcagatttcacaaaattgcactttgatataaactatggtaaagtcgattcaagcatatagtattacaagactctcgctttattgacaaatctatcacaaaaggttttgtatcaatatttatgccgtatttttccccctagtttttaaatattacaccttaaatccatactaccaccgttttttatatataacgccattgattttttacatcatgtctgaccattcgtcttattagaaaaattaagtaaatatattttcttttgtcgtcacttgatttatcactaaagaaactttaaacactacttataatttttaagatttgtataaaatttttaaacatgacgaatagttataaattgttgcaaaagtcaacgttgtcatataagtattaaaaaaatgaagggagtagtatatttctgtctctagatcaatcctaaacataatggtcaataaaaatgctcacttacggagcaaaagcaacgatattgtatccaatcaattgttttataaacccaaacaacgtctcgactatataaaaaagtcagtagggcagttatataaagcctcactgtttgacacgttttaagatgcattgtaccaactcctaaaatactgatattcttagagtgacattccttattaatttttgcatgccacaaaatgcaaagttgtaggcacaaaagcagtagcaaacagcctctgtggtcagacaatgtggcccatttgggctttggcctaccactacaaggccagagtttttggctggaccagccaacaacaatttgggcttttttggcccattctagcagggctatccagcgaattttttttatttttaatttttttttttaaaagttttacaaaaataattttccattttaaaaattgacggaagtggtcgcctaccgccctctgggagggcgatttttaaaaatcgccatcccagagggcggcgaaaatgacgtggcagacggccgttcgctctcgggcgacggccgtcaacgaaatttgcaggcggcccccttgccgccatccgctaggg

SEQ ID NO: 26758 - DNA, 21148 bp, Oryza sativa
  unsure (1)..(21148): unsure at all n locations
ccgcctgcaaatgggcggcgagggggcatggaattttgcaggcggcccccttgccgccctgggggagggcgatttttgcctcccccctataaagcccagtcccccctctctgaaatttcattatattcactaaaaatccaaaaaaaacgaaagagagagaggggagggcagcagaaggggagcggcgaagccctgctggttcgctcacttcatcacaggtttgctcccatacatcttttgcatttgtactaatatgttatgtttgagtatatatgttgcgttttagttttagttccatatattttagcatatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgttttcatcaggcacaatgtcaaataaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatcagttgtagtgagtcgtgcaacagaaggttatttttgggaactaatgccgatggacagcactgctgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggccatgggcatggcggatgagggggagagagtcggtataattgttgatgaaatggagagggaagattcggataatgaggaagcggacgatgacgcatcatccgatgaggaaggtgatgtaatggccactgattgggcaaatgaggacttctctggacttgttatatcagagggtgatcatgtaccctgggagtataaggagaacgaggtaattgacggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaactattaggcacatcgagaacaaattcaagtacaccataagctatgcaaaggcctggagagccaaacaaaagattattgagatgaggtatggcacatttgaaacttcttatgataatttgcctcgtttgttagccaccattgcccagaggaataataatacttactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttgtacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaatccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatcttggtatggcataatgacaaccaatttggcagaggtgtacaactgggtaatgcgaggagttcggatacttccattggttgctattgttgaattcatccttcacggcacgcaagcgtactttagtgatcgatacaagaaaattggtccgtccatggccgataacaacatagtgtttggcaacgtagtgacaaagtacatggaagataaaatcaaaaaggcacggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttacattccagatccatctaagttaagggtgaaaaagggtcgacgccaaactagacgcatcagaaatgatattgatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctatcgatttaggaaataaaatgctgttgtgatgtgatgagtgttcggactaaatacttgtatcgtgtaatttcaattgaatgttgttgtaatgagtacctccgactattgttgtactagtagtattgcgaactattcggtgttgtatcataatgttatcgtgatgagtgttcggactaattactcatatcgtgtaactgcagttattgttgtaatcagaaatattccgtatggtgacacttttgtttgtttgtactcttgtttaatatgtgttagtaattcgcttatgaacatttattacttatgttgaactaattatttatatgtttctgatcaatctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcatatttcaactcaactttgctttgtgttgtacttatgtttgaagtttgctctatacaggttgcgtgcggcaggccttctaccactttgtaggcttgttgaggcggcggcggacaaccgtgacccagcgaagcggtgggatgcagaccggtcactccttgccgctctggtagaccgctggagacctgagacgcacacgttccaccttccctgtggggagatggctccgacactgcaggacgtgtcgtacctgctcgggctaccgctggcgggagcaccagttggtcccgtggacggtgtttttgggtggaaggaggatatcactgcgcgcttcgagcaggtgatgcgccttccacacctaggaccggccaacacccttcctccgtgctctacagtcgggcctagcaaggcttggttgctccagttcactgtaagtaaataagttgttattatcatacatgcttatttgcgatcaacagagtgttttgtactaacatttcattcttaattgtaggcggaccttctgcaccctgacgctaatgataactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtcttcttttttttcttcacataacatgtctaattccgatcatgtttattccagcgtcgttacgctcacgtccaggtgagacgaggttacccggacttcgtgttcgagtttgaccgtctccagccgagcgacgtcatttgggagccgtacacagaagaggccgtcgctgcgagagcaccgctaggactttcgtcgttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccatgtcgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggcgatcaacgagctcttcccacacacggaggagaactaccgtgactaccttcgctggtaccttcctcgcactcgtgcgcgtgtgaccttcactccagacgccccagagccgcacgttgccgctgtgacggacgcgtatcccacgcaccgtgaccgagactacttcgtgggggtacgtcgaatttgtattagttcttacaattatttcatttatcttgcataatataggacaactactgaattttttatttccatcttgcataggctgatgctgcacgggatatcagtgccgatatcaccgcagtccaagtgaggttgaacagaggtttgcacttgactgacgttgagcagaggatgaccttcgaccggatgcaggagaagatgcgtgcggtcatgcgcatcttctcctgtcgcagcgccgtggacgtcgtacctccagctggtccggtacaaccacggcctcgcgcgcctaccgtcggagcaggacctcgacctacggtacctgtttcgcacggtactgctcagcccagaggtttcttaagttttgtttctgtttttgtacaaaaacatcaccccgtcgtaacttgatgttccattctcgcaggacctcgtttgccttcgagcgcccctagcttcggagcagtgcgacctacagcaccggtttcgcacggtacagttcagcccagagattagttcatttttgtttcagcttttgcacgaatatgtcaccatgttttaacggcacgtttcctcatcgcaggacctcgtctgccttcgagcgcgttcgcaggcacgaccggcgcttccgcgagctccgcaggggcgttcgccacctcttcgggcgcgttcgccagctcttcctctcacggagcgtcgatccctcgcccacacggtactttactttttattaatactattaaatacctgtatgaaactgatggtccttgtccagcaggatttgcagccgggatcttcggtactggggcctcttcgtctcacgccggtaggactggtcctactagccagttctacgacgacaacttgcacggtgcacaccaccacgacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcgttcatatggtgctagaacaacttatgctcatgacaacacactttcggcgcttcacggtagtgtcagatccagtagcgcgcacagtccacaacagcacacatgaaaagcggcagctcgagttgtcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcgccattccttgagcgtctcaactggcgaagcgatccttttgctggttggtttccaccatggtgtgaccgtcctttgtgcgatagtggggatagatgcatactcaagtcttccctcatgatacaaactcggggcaggagattcttccaatgcgcgaactttgatcaggtatgcttcatctattcgaagttcaaatggataaaaaaaaactaacttcttcgtacacaattgtaacatcttacgcagacatatcgtccaatgtgcaacttcatcgagtgggtagacatggagaacccacaaaacgacggaacccgtgcttacccacgtagtgaaacaagatcggactacctaaggtggaaggatgagcatgaacgtcgaattgctgctgaggctttagaatggcacgtaaatcccctaggactccccatgtggcgtgagcgtccggagtgtcgttgtggtgaccgttgtcaggtcataaggtccgtaaggcaccgaactcgaggacaaaggtgtttcgtgtgtccaaacattgtcgacgatgatttcgtggtaattacaactattcttttcatcactcctcagtactatcattaacttaactatcccaaaatggatgtacataggaggatgtaaggaaatgtcaattcgtacaatggattgacacagtcagagttacttcaagtggcgggccgataacgcaacctgaaccgaccatacagttcattcatgcttggatggagtacgaacgtcgggtggaaattgcaagcttagactggaggaacaatccattagggttacctaaatggtccgagcgtccaaagtgtgggtgcagagatcgctggcaggtggctacatcctttgctgaacaaacattttgaaggagatattttgtctgccccaatgtagacaacgatttcgttgtatgtctaaccatttacaaaatccgctatgatttgcacaaaattactacccaaactgaataacattactatttttacagggcaatccaaggatgggtggatttactcgatggatcgacaatgtcactccatcatatcatggccagaagataacagagtcagaaacacaagtagagtatcaacgattgaaggaccacgagaatgcaatgcattctgaccgacctagaaggtgccgataggttaccgcatgcttgatttgtcgagatcgacaaatttgtaccgtgtatcgatggcacttcttatctattttatcattacaatgtttaattatggtggtgattttttgtatgcgtaagactaagggcctatttggattgctaccaaaaacatgccctaccttaccaaattttgaatagtacttgtttttgatttcgattgaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaaataggccctaaaaaataataaaattgtattttaccagtcttggagattttaatcttgtatagttttcaatataaaaagatttgataactattgatatttatacaaaaatataaagcacagtataaattcgccctcccccagggcggcaagggggccgcctgcaaaattccaggccccccgccgcccatttgcaggcggccccccgcacagtacaaaatcgccctagcggagggcggcaagggggccgcctgcaaatttcgttgacggccgtcgcccgagagcgaacggccgtctgccacgtcactttcgccgccctctgggatggcgatttttaaaaatcgccctcccagagggcggtaggcgaccacttctgtcaattttcaaaatgaaaattatttttgtaaaacttttaataaaaaaattaaaaataaaaaaaattcactatcaagctgtgtatacatctgatgagtcctgttactttctcaaatgactcgcaactgagacaaattctgtaagttcatatatattacatctcatgtttctcaaggaaattaacacagtggtcaatcatctggaacttcagctttcatgaaaatacaccatcatcgtcatccagccactgcttaccgctgtatgtcatctcccggtcctagatcgtcgatcgctgggcgttgtttgtggtggtcagtcacagactggtacgccattgccagagctagagcctgctccccaatgcacggatcaaaatgacaggtcatcaactcatcatcactgttcttcatgtcaacacataaaatgtttatgtcctgagacgagaaagaacttacaacgtggtcatggtcaggaggagcgtatatgcccgtcgtcacggtggttcttctccgcgtgccgccttctggtgggttcttgatgctcttcaagcctgtcggcaccacagccaccggcatccccacaaggtttccaagacagacgagctcccagtcggtcacattgccgatgaatgcatcgaccgtgaagctctccctgacttctctgatcagtttaccccgtgctcgttgtgcctgttcatcgatcaaagaacaagaatataagttatggtgactcgcgatcctatagacaggtacactccttcagatatggttagtagagcacctgtatatagtcgactgcggggattaaccgtgcgcggcgaagctccactggccattggtcctgagcttcatagtcgtcgtcgtgtcgctcgcgttgccagttgtcgaaatgcgcaagcatgtcaacatccatggtgatgttcagtatggattggaccgattgaacggtgtagttcagcttgaaaggcactagcttaacacccttagcggaaagaacatgaacaacctgtagcaatgatcaaatcgaaggatcagatcaggaatgggtaacagataaccaggctgatgcacgtaaaaaagctctcaattacctccatctcagcactgtcaagatatccaacagtgagttgtctgatgtcaacatgaaagggatcctcgatagcaacttcacgagatgatggatcgccggcatccttgccgcgaattgcgtcaagtacaactgcgcaatctatcgcgcttctgcagaaaggaccaagtttatcctgccatttagaccaagatactaattgtttaaaagattgatttggatatgactgggaaagcgtaagacttttgaatggaaataccaagctctctgaaatgctcatgacgcccgtccgtgcaactgttccaaatgttgtgcgcaaagcagttactccacatctagcggcaggatatgttatggaacctgcagtttctgaacctattgcaaaaggaaccattcctagtgcaatgaaaaaacttcgctgagtacttgaccatatatacttcatctccttacacatgtaaacatgttgtataaattaacctgcagaggtgctagctgctggccctgctgatgaaccagtagaaaactcctcaatgttccaggggtttcttgttctccccccaaaccatatatcatcataggcgagcgagcctgttacaagttttgctacaaggactgccccagttgacttcaatctgaaggaggacggcatacacataaggagacgtaattagaattgatcacatgactcacacataactgagaagaaacaaaccttttgtagacagaggcttcgacatcaagaatttggttttcaaaagttcttgagccccaggtagttttgtattctggtactgcaattatatccttaaggccatacggaatgccatgtaagggacctaatatcaatatttgtcaatgcaatctttacttttgagcataatgttttatatgtaacacattttcttctagtacgactcacctaaagagtaccctactaatggtataactgagagattttttaaaggcaaacaaaggagagaactccccctttgtaacacacacatggattcaactaaaaaaataccagttgtttaacatttcgttccacaggttctcaggctaataaaagtgattgcatcgcaaaatatgaagcttcaatggtgcataataataaaaaaatgtagggtaatttccacgagcatcaattatgacaggaagctgctatggccataatatattaccaacaaaaggagagaaacaagatcaagactagattgtattgcagtaacagatatatcactgagcatttcaagaagatttactgcataccaagatattttccttgctccagcaagtcatcagcttctttcgcttgtttgtatgctaaatcatcagtgatagtaataacggattcgattataggaccatacctataaacatacaaggagttacatgattaaaaacaatacttctgagcctctcataagtccatctgaaagactgaaacaaatgaggaagacagaaaaaggggtctaacctctttaatctccttaagaacacagcagtaagttcacgcgatgtgacttgctttgtccttataagctccccgagctcaattatctgatatgaagatcagaagtttgaaataaatatatatgaagtttgtaaccaatgtataataacaattgttaaaaaataaactgaccgacataaaagcaatatcttcatctttactagggcgatgtactgaagatgtatggggatattgaaagcttttgttctcactgattttgctttcatcgctccatgatgatttaaagaccaatgcagacgggttatgcaatccaccattctctaacgccaccaatttccggttgtctctaaatgcaggtacattaaattcttttgcaccatcttccatctcccgaagctaacagaacagatagaagtgtagataaaaaagatattaatgcaactacttggttgtgaaaacttcaaataacattttgatagtacttttgaatcgttgaaaaaatcagcatcgaagtacttcatggaagccttcaatgcaatcacaccagtaattggttcttttctggaaacatcttttgcagaaacagcctcctttgtatcctgaaaatgaacagacaaattgctaaaaaaaaaattgtcgcaatgaaaataaactgaatattaaaaggagagcaatcttgccttccagatcttgtggtatttggaaacaagagtatatgaatggctcttcccacaggttggccagggtaaccatgtgcattttgttggccacgcctgtgtttaaaacaaaagcaaataaataaccatagtaataatttgcaacctaataatctatacaattgacatttggcaaagtgaatcccttaagaactaagtaacaggaaaagatgcagagttaagaaaaaaaatcaggagttcatatgaatatgaataactagttctgggcttctggccaaaggccattcctgaacacctctatgccattagtcaaacaatagtctcgaaagatcacacacctagtcagaaattccagcacacaagtgaaattaaataattaatctacttggtaggtaaagccacctatcttagtcagattatcactgtcctcacagcccaccgttttctttgaccgacaggatcatagaggtaaacccaaaactaggacagccaaaagttcagagaagaacactgaataccgatcctcaggtggtggggatgcaaagctagctagaggaatccaagaagagggggaggcgatacggtatacgagcgcgtaccatgtcggcgatgctcctcgcgacgccgccgccgccggttcttggcggtgctcctgctcctgctcccggtgcggcggcagaggaggagaggagagagacgaggaggaggtgggggagggggagggggaggagagggcgacgtggctcccgcatggctgacacctggcgggaaggcggggagggagacaacgagggatttggttgcaggaggagaagagcagagtggagaagacgaaagggtttcatgacttcatgcttggttgatgattgtacatttgtactactactactactccacgagtctctcgctttctccttgtttgtttattttgttggagatttggggtttgattttgtcgcatcttatattgcgtgggtgacagtttgtttatgattcactaagaggcataatcctattgaaaaccatggtcctattgatttttttttgacctttttaatttttaattttattagtattcatttccatttttcaaaaaaaaactgagcgtcgtttagccacgccagcacagagttatttggccacgccaaaaggtttagatttgaaaatatttttttaaatgactattaataaaattaaaaaaattaaaaaaaaaattgatcatattatactttcgatatcctgtaaaacatttttttatagaaagctacaattattttttttgttaaaattatcggctattggctaggcgttttagataactacaaacaatagcatatgattttattataaaacataacttatatcgtttattacaaaagggatccatttgtcctgcacgtatgcaatgtgtcggagggataagctccaactgtcatgggaaaccacgatcttggatcgtggaggggtttaaggcattcaaacatgctcgggagtaaaggacgcgaacaagtactcctatatatgtttatatgtttggacctcctgaaagatgataccctattcctatttgataaaaatgtccatataaagttaggagctctcaagctagcaaacctagttcatgttgattattgaaaaactaaccccttctaatcagttttgattgggcttttatacccaccatctctcactattagccgagagaaatgatatactgttgtaacatattcatgtcgaaaataagtgaaatagtaaggagagagaatatgaacagacgactaaattgtcgtcggccctccaagacgagccaaagctactgcatctaatttctccctgcatgtgacttgtgattggatggtgagcttcccaagacaacatgcagcagcagcaattggattacgcatgcaagcaaaatgtgatcatattatagtagtacatcttattattgtacaaaataattttaactcaaaccgtatttgaggcggcatgttttagagttatcagctggctgtatcattgaacttgctcttagcctattttctaacctttgagcttcgagccagtttcagtcgcctatgcagcctttctatgggactccacaccgaatccacctataaaggctcattgttttcaccgtagtctcaatgacactaacttcgttatctttatggagctttctaaaatagtgtatcgctttgatcaagtaaattagtgcttaaagggcttgttcggttgcttagtacaacggctgctaggcaacccaaggcagctgatcgcaagttgttttgctgcatctacaagcagctgcttggctgctaagaagggcgaacaaaccagtatgtagttttgtacttttgttgacttaaacagcaaagtgattagtattgtgataggttttctactgtttagattattatatacttgtaataaatatgtacttggcttgcacatttttaatatcctttgttctaagaggcaatcacaaatttgccaatggtttgaatcgttattacaatactgccgctagaaaattgcaaaaatatcaccagaactgatactcaagtggcattcttacaaaattaaaaaaaccaatggcaaatttgtaaaatgccctttttttctaaaaatagaagcaaactaaaaatttttaaaacccacaatagaagcaaaataaaaaaattaaaacccacatggaatccacatgacactgaaacaatatattccaccttgtttatctatctctcccatcatttggtcttggtagcggtggttgtggtggaggtgcgcgggtagttaggaggtgaggagacactaactagtgtgcgatgtgcccggctggcggcagaggaggcccagtagtcggcggagacgcgcctacaatccaggagtcgatgtcacccgctcttcccaccatcgtgagggcttgctcatagtgccgcttcttgcaccagcaagcagtagaagacaccacggggagcggtgtagactggcagaagtagtggttgtgccggttgcgaagcggcgcatagatttggaggctaggtggagtatggcaggagcggaggaggcccgcggtaccaaggcaatgccatgctccctagacctccctgctttcatcgagcccgcgcttcccctcatcgcattgctgacgacaatgactcctagcttccatctctctcctttctccccctatctttccctctctgttctctcctatcttcttggtgttgaggcctgaggcactcacgatggtgtgatgacaacctatgaggattggactagcagcgaccgacctgagcttccacatctccaccaccggtcaggctcgatggtgtagccgccaccgccacccaactcctcttcgttggtcgcctcccttctcctcatcagtcgcgtggcttggaggtttggacagagatgggaggagatagggggagagagggaagaagacttgtttcactgatatgtgggatctacatacctttttactttatgtttttattttttcctctggtgctttgggactatatttgtatcggttttaaaagatgaaaggatgcgttatatatatggtattgcggtttaaactcgactttaagataaggaacctaaagtgaacttattcaaagaaaagggaaaacataccgtaacattggggggcgcctagctggcgcgtatgcgccgctagcgcgcaccttccccatctaaccacctatactagtattagttaacattacttaacactaataacaataattaggaaagattttaaagatttttttggagatatttttactaacagattgaaaatttttcaagttagaaactttcgatttaagatttaaattttaaagttaaattttgaagacattcaactcagatttgaaaacattcaactcagatttaaaaacattcaactcagattcgaaaactttcaagtccagatttaaaagttttgaaaactttcaactcagattcgaaaacttttaactcgagattcgaaaacattcaagtccaaattttaaaattttgaaactttcaacttgagatttgaaaattttaaagttaagatttaaaaatacaaaaataggaaactaatataaactaattacgattttttttattcgtacggcaaggaaaaacaaacggtgaaaaaaaaatgaaaaaagaagaaacgcgggcgtaaaaaaaaagaaaaaaaaagagagaagcgcaagcgcacgtgcatgggacttgtgggccggcgtgcgcgccggaaacgctcacacgcgaattagcctttccggtaacattgcagcctatgacaaatcgttcatgggccgattcatcgtaggcccaactgacccattccagtccgggcccacctccactccccgagggataaacaccacgtgttcacactcgccccaccccccgagggacagcctggcacaactccccaccgtccgatccagatccgaccgctcacatcgccccagccacgtcacctccacctccacctccacctccacgcggccacgtgtcccccgcctccccaaactttttgggaagatggcatttgcgagagaagatggcaaatagtaaaaaatccccgcttctcctcctcccatctcgccgcacgccgccgccaataaaacgacgcgacgcggcgcggcgcggcgcgacccgatgcgacgcgacgcggcgaggagagggagacgagctgagcagcggcgacatggcgagggggagcaggaggaaggggtgggcgcgcggggcggtggcgttcgcggcggtggcggcggcggtggcggtggggaggcggtacgggtgggacggggaggcggcggtggcggcgttccgggggcggagggacgcgctgggcccctgggcggcgcccgcgtacgtcgcggcgcacgcgctcacgctggcgctgtgcccgccctacgccatcctgttcgagggcgccgcggcgctcctcttcggcttcctcccgggtgtcgcctgcgtcttctccgccaaggtgctcggcgcctcgctctccttctggatcgggaggtacgggacgagttcctcctcctcctctttcttcgcttccgtttcggttgctcgtagcgctcgtggtggatgttgagcagggatttgtagacgtcgagatctagacataccgtgttcagttcgtgcgtgccctgatttgattcctgtttcgcacgatcgagaagatctgacaagaattgtgatgagagtcgtatgatcggagatgggttggaggaaaaaaaataggctggcatttgtgctttctcgtgtccttcgaggaggaacgttgcgagattctttgcttgtctgtgtagaattgttggaatttttttgctttatatggaatctggttatgatgttagagaaatactgcggccgaaggaagactgatttgtttgcacttttttttggggtgaaaggtggttggtaggttcaagaactgaaaattgcaaataaaattggaaactctcatccttagtctgttaaactgtataagaatatataaattcaggagctgctgggatgaaaagctaatcagctatgcaatcttgtgtgtacaagcgtacttttgtacactggtgatagttaatggagtagtaatgctaagtgaacttgaacatgagattcaggaggacaatttaatggttttgggaacagaaaccaagagtacgctgtaacttagcatatggcccattgattgattctggttgaaatttcctgtttggaacaaaggagttccattgaaatgctaggggatatggcctgttctgttcccaggatacattgtcatttatctttgatatcatacgatatctttgatatcatatgtttagttgcaccttgtttataactacagaacaatactaggttgatactttaatctttgatatcatacatctttggtaagattaaataagaaaatggatcctttgtgatataaacatgtgattgtcacacgtaactttaattagaataaacctttgtggtgaggaggcctctaatttggcagcccaacatctgagagctctcccgatcaacatnnnnnnnnnnnnnnnnnnnnnnnnnnactgtcacaattatattgttgccatgctatgtataaatgatggatcaatgcttattgtttataatactaactttttagtcatattgcacttgattggtttgtataattgaattttttcataatcaaattctgaatcattgcgctccaatattgcttacatcattccttcaaacaatccaataaacaattacttagaaaacggctccaattgaacatgttaattctgagtaagttaataaactaaccaaacctgaaagttatcttaaccatagatagtagaggtcaggttggttgttgagcagcctgaagagctacaacttcacggaaaggaccttgagaggtataactgcagcttgcctaagaactttcaaatatatgtagtgctggcaaagttccaccttttttggtaactttgtggctgctcatagacatgagagaagcaaactatctctcactaaggcaatgaatgcgattagtatcgaagagccaccctgtcaaggagcaagtcaagcaaaaaaaacaaagggttaaaagtcccaaatgaacaagtttaagacaagaagcggaagaatttttccctgatcaactctacgcggtcatgctgaccatattaaggttgtgtttacaaaaggttacaaataattcgcagaatatgttcccttacaattccaatagcccccttcttgttctgggaaaagttcttacccttatttttcttaaccttgtggtccatctggcacttgtaagccttgttttgcttcacttgctcctggcatctatagatgctgtcatctcagtgatctcttcgatcctaatcgcatccattagttagtgagagatacctgcttctgtcaattggcatatatgagcagccacaaaatcactcaagatggtggcaactttgccaacacaacacatgtatgaatgctctccagaaggctgcagtcatactgtcaaggtcctccccatggagttgtatctcttcaagttgctccaagaccgacctgccctctactaaattatacttaagataactttcagatatggttagtttactatgttcaattgaaccattttaaagagagttgtttggatagttttagaggaatgctgatgaagcaatatttgagcatattaaattcagaatttgattacatacatgaaaaaaaatccaaattgtataaaccaaggaagtaaaagagacaagaacttctgctgccttataaacaaataagcactgatattatttatacaactagcatggcaacaatataattgtgataacacataacaagtattactacaggttatgttgattgggagggctattggtagctaggggaaatcctcgcaggttcctttagctccatgtgtttggcctttgaggccagctcggcccaatggcctaaagcagcccaaagggcctcatgtcagaaatcccgatggatcggtggatagaactttaaacaaacacaaaacacatactatagatgattcgaaaaacaaggatgaatttttctgtttacaaccagaattaaccgcctagagcgattttcacgttgtgcctaatgccacgtccatccccacaacgcatgtcgtttgtctcaatcatggtgagagatgcgggcagccatgagctagcctcgaatgccctccaccaaaactaacatgcacgacatctacacaatctacacatctacgcacgacatctcatcgagatgaatgacgtgcgccatggggatggacgcggcattaagcgtggtttgagaatcactctaggccgttatttccttgtaagaatctggctttaaatgcagcacaaaagttcttccttgttttttggatcatctacagttcgcgtgtgctgtgtttgttcgaagttttatccgtcgatccatcgggatttctgatagggagcaataccacccacatgaagtggctgtagttgtcgacggtcagaaggaagtatatgctgtttgtttattgccataacatttagcactaacatgatttttgcagcaaatccagacattctcatgttttgcgaagtacgtaaactttttcgggttcacttgttcctctgtccatggaagttgaatagcccattatggacatttttgacacttttgctttttatttggatcaataaatgaggtcaaatttcagctaataagaaataataatctctttactctagcccatcctaatcacactatgcaggaatctagacatctagatataaggcccactatatgttgataacttgatattatgatctgctttattttgcagattgatcatcaatatgtcctggatacttttttttttctggttaaacaaagaaagtaaaatcccattttacatgttttgaataagtgaacttggcaactaaaaattagtgttatagtttgctttgtgatgccatgcaagtgggttcttgcagttatgctggttccatattgaatattgatacagttaaaagtggccatgcagtcagcatcttcaattatactgatgctctttcaggcacaataacatcattacgtcaacccgtctagtgtataacgctgtaatgggatttggatgtacatcctattatttgtcctggatcacaatttttttacctagataaagaaagtaatttccccatctttgtgtggttaggtaaattgttttataggtcagttcatttctcagttgtccatcatcttctatatggctgtacccatgggtttgtgctgttatcattcatgcatcatatattttcccttgcaatattgtttttaaaatacttactatttcttggttagtacctttagtcttggctctctttgctaatgtatcttcttaaaattttcagggcaattttcagactctttacttcagcaatggattggctaaagagtaacaagtacttccatattgtggttaaaggggttgaacgtgatggctggaaatttgtgctacttgctagattctctcgggccgcagg

SEQ ID NO: 26759 - DNA, 7173 bp, Oryza sativa
  unsure (1)..(7173): unsure at all n locations
tggtcaatgactatagtaaactatgttgtctgtttcatgccattgttttgggggcatttagcagatgcgcagtcagctactgtcttgtttctgccatcaagcttttctttttctgacacatgcagatgtttcaccttgcaaacatggtagaagttcatatgctgtacatctaagttgggtagttacggtggtctaggattttcttgttaaattatatctaaggaaaccggttttgatttccttccctacttgtactgaacccatatatgacttggtagaattcagtgttctaatggaccagaattcagaactgtttctgctgttgcaatgtagaacagctgtatcacacctttttatatatatatactcttctttagccacaatccaaagcaaattatgcagtgaactccaagaatgttgcacaggatactcagtcttctgactttggttgcactcctgtctcaacacagtatttaacccatgttctgcttcactgtatttttgtccaacaattccatgacatgaagctctccactgtcctgtgttgttaccttcttctccttggtctctttgctccagaaatcatatcagatagccctcctcttcaggatgtatgccctatggcaccccagggtgagaggaaactcttcatgaatggtttcttctgcaagagcccaagcaccataatggcctctgatttcaagacattgctgctcaaccatgccggggacctggacaacatggtccggtcatcggcgaacatcatcaccgccaccgagttccctggcctgaacacccttggcatttcaatggcgcggaccgacatcgcggtcagcggggcggtgcttccccattcccacccaagagcttcagagatgatgtttgttcacagtggaagtgtggtggcaggcttctttgacaccaaggggaagctgtttcagaagacccttgctgagggggatgtcttcatcttccccagaggtctggtccatttcatcatgaactatggttttggccttgcgacaactttttcggtactcaacagtcagaaccctggtgttgttgggatcacccatgcgatgtttgcgccagattcagaggtagctgaagggctgatggccaggatgttgagtttcagagatatgggaatggatgacagtagtagtgttgattcaccatggttttactgatcatattgggttattcaatatagtagtagatacaacatggatgaaattgctagatggatgatgttttctagtttctatctgacgatttcagtcagtttggtgtataacagtgtttgtactatgtgatgcagttgattcatttctctagctgttgtggtcctgagtatgaaagatcagcatctcaccacacaaggattaagaccaaaattttttatatattatccccctacaggtggctaaaacatagatcttatgccttatctctatctgtctgccatctcatttgttcttcacaacttgtgaaggcaattgggcgcgatgggtacaggtagtgcctacccatacccatgcccatgagattatctgtgcccgtgggtatacccattactacatgacaggtaagaatgattgctcatgcccattgcccgcgggcgccttatgcccgcgggcgtgcccgtttacccgccacaacaaaagcagctgacaaaaagtctacaagcttctaagttcgaatcgaacttaaaacatcaaatattctccgcctcggtgtcgtgtctctcctctggcggcgatagagtaaggggagagaaataataagggaaataaaagggaaattgtaaaaaacaaagaacgtggcttatgtttctagtggattttgctcctagcctacatgtaagttcgatttcgcaggtaaatgggcaaagcaggcatgggtagtgattacccatacccatgcccatttacccatcgggcatagcttttgacccaataagatactcatgggtataaaatggagaacaaacccaaccctaatggggtttttacccacgggtaaacggtcaaacgggcacaattgccatcactattcactcacaagcccaattgcagtgtccagtctgatgtcaattgtgacgtgaaaagtgcgtcaagcaacagccaagccatcctccttgcttcatcatcaccaggcaagtttggcatgctctggacaagtagccttcctttgccttttgctttactcggtggaactcaacaccatttgtttagtgtaattagtactgccttttgcttcttgaaagtgaggagcttctctttctttttccatgccttccttttcacccttgaaaactcctctctctgattaagccaggcaacttgggcacctggctagttatatactccatccatctatttcaaaatataaggcatattttatttcgttaggaccaataataactttgttatagtataattttgtgatatgaaatagaatttattatattcgtatttaaaaatatttagttatgtgcttttaataacataaataatatcccaatagagtaataattgttggttaagcctcgtcataacgagataaaatataccttacatttgtaacagaggaagtatatgccacacactgctttgtgagatggtgctgtaactgatgttgttaatcattgagggtcactgtgctatattgctgatttgctgccacacatgaatgtgtggataacttgttaggtgatcaattgtcttgggagatagaagataacatcaattttgagtccctcatgttcttgtcaagcgatttatttttaatttctgtttgatcagttacagtaaaagtgggtcttgtgtggaaggtggtcacctggagaaacttgtggacttcatgtctctgcttttcattttagtagatgacttggttcctccatctttttcagggatgaattcttcatcattgacatcttggggtgcaaattttggaggattttgaaacgtcggttttgcttccaggacatatttcctcgctgatagtgattttccatgattaatggcttttcttgttttcacaagcaaaaaattgaggaagattgaaatgaagaccgtagtattaaataatatatattgatcaagaattaaacaacagaagaccagattattgaagagcttactaattaaatgatggatgagaaacatttctaggcttgaccaactctccaaagatcaaccaaaggtgtgcaattttttttctcttaagtagtaagaatggaaagcacattaaaacataaaatattgaacctaagtgttatttttaataaaaatattttaaataaaaaaatatgattgatgttcaggaactagcagtctccaagttgatcctgcaaacaggaatttgtcagtttatatgtggttctgtcgtaattgctatagaatcatcaacatcgttattaatgtaaatacagtcagagtacgctacttcgcattgcaataatttatttattaaaaatacgcaagatttggattagtcaagtacttggttttcccacaaagtcaagctgaaacttctttatcatgagatttagatggcaaaaggagtatgatactacataatcttgaccaagataactgtatatgaaaaatatgtttcattatctgatctcggtaataaacaactaaaaaattgacatcaagtttggattatccggcacacttggcagaatttgagacaattttttcttgggagaatttgagacaagttcataaccggatcaggatcagatagaatagttgttgaaatagttaaatggaactaaagttaaaaaaaaaagctcagatttttattgttcaacagtgcatttacagccatgaattgcaaaaagtattattttgcgtaatcccctctttatcatgcacttcacagaatacaatggaataaaattgaaggaacagaaagaacagatattccaaaaagtaaaaaccaaagacaactactctagttgctatgtgggccaggagggtaccatcatgctcatcatcttctagaaccctaatatgttggcagtgctcattggttgtggacataggacatgaggttgttcttgtttgttggtcaccaccatgtgcagtgctccaatatcaggtgtgttcttcaggtccgcaattcagtaccagccacaaaaagtgcaatttctttcttgcaatgggcatgatttttcttgttcttggccaaacatttgtgatatttttgacctgattaggcctccatgaaactctctacatgttactagatacaaactgattttatcaaattggctactctaagtattacaaagtattatctgggagaagatctgtacaaaggggggcattggattattcttccagagcaaaaaaccgatgaaattatctggccaagcctggccacaatcaagcaatacctactttgatctaatccctctacatttccaatatgtatgtcatcatacttgtcatatgtatagaactttgtatgtactaaacatggccgtgcgaaaactttggttttgattccagataactagaaattctccttgtggaagtcgaatttcgtgctcgtctttctcgagaaatcttgagcgagctcacgcagttccttcgtcagcaccggcgcgccacagtagaacacccctgtaatgtcaaagaagaatcaaatttagtgtaaaaattcagaattccaatagtgcatgaagacatgataggattggattgagatgatagcatcatgcctgataatgatacagttaggtaagggagcacttcttgaaaacatggcacaggcatatcttgggaatctttttgtgcatatgaactgaactttatgggtgaagaattttaggatacctgactatgtattgtttaatgtatagctcgagcctaaagggactgtatgccaagcggttgtaactatcatcaagtaacaatgattggtcaatccataaattatatagtactaatatgattcctattcaacctaacaaacttctccccaatccacaaactaagtgcataaataaacaaatctcaaaagtctgatgttgctaatgctatgcatgtattgcttgtcaaaagcttcgacgaagaagtatttagtattcctttacttattagctgaaactaccaggaagcactaacttctattttttttagagaaaaaatgttactcaacattcattgcaatctaattatcagtgacaactaacagtgattgatctgtccccattccctaatctcaccagcaggttcctgttcaaccttgataactgctgcacccagtccatcactacttccaattgaacactcaacctcaaaactctgatcatgcttgtccccatcagctagatccccagaagcaacttatgccaaccccaatgcagctcaaaaccagctcagcctactatatcaagaagtctaatttcccaaagcatgtagtatagatttaaaatttcccctactcgctcgaaaaaaaaattatcggttggggattaaaaaataaaaatatcccgacccgacttttcacagtcttcaatatgcaaatttgatttaaaacttgtaaagtctctaacccggcattttacggttttcaagatgcaattttaattgaaacccaattttttacggttttcgagatgcgactctgatcgaaacttaacggaatgttgggagaactagacaacaacaacaacaacgatgatgatgatgacgacgacgatgatggtggtggtggtggagcttaccgacgcgttggtcgcggtggttgagggcgatgcgcttgtagacgttgcgccagttggggcgggcgaagtgggtcttgacgcgggtgccggagacgacgtcgacgccgtgcttggcgtggttgagcgactggagcatagcgatgagcgccgaccgggcgtccccttcctcgtacacgctggtgcagtagttgtgcagctcgatcacccccttcttgtccgtctccgccacctcgtccatcaccccccggaaccactcgaacgacccctgctcccgcgtcacccagtagaagtaggcgcgccgcgtcttgaacgccgccgacgacgacgacaccgagttatcgttgccgtcgccgtcctcgaggtcgccgtccagctgcctcatgttgtttatgatgtccttgatgatggagatcatcggggtggcgccgatcccgaggccgacgaggaggacgatgtcgtactgcttgtagtcctgcgccggtgcgccgtacggcccgtcgataagcaccttggggaagctgcagtaggaaaaaaaattgattttcttaaaattttattaattaagctaaattattaccatattatgatattatctttgattaattttgataaggaaattgaaatggtacggttttgtagacggatacttcactgttgttcagctagaaaaaaaatgggaatctttagtcctacattttacatttctaggatggagatagaacatgagcagagaatatgtgtttgttctctagtcaccaaaaagatttcattgtttttccctacaagacaagaaatattccattcttgttctacaaagagaaaaacaaaatcaatggaatatatggcttggcaaaaacatccccccttcaccttatcctcaactaagggccgtcttccacaacacagaaaaaactctatttatcttctcttccacactcatatcatcattattcagttagttgcaacctacttaacttactagtactaccaccatctcaccaaattaattaccattacaccgactaattaaattatcaccaccctatctacaaatgtcaaagatcatgctctgcagaacagcaaaggtcaacccctactacacaagaactacatatacacacacatgatgaggataacaaacacaagtgtcaccaacagaagggacacaataattaaacaagccatgtgaaagcatgctttgtactactactattactactacattttgctcatgcctgatgcaagagatgatctcattctcacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 26760 - DNA, 525 bp, Oryza sativa
aatctcgctctaaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagactcactcgtggctgcaaccctgcttactcaaaatctattcacacatggttacgttttggggaaattatgaggggatctctcag

SEQ ID NO: 26761 - DNA, 590 bp, Oryza sativa
aaactaattaaactagataattaattagcggagggagcaattaaattaaatgaattaaaatcgtgctagtagcttacggctcggttgtcggtggcgacgccggagatgacgaacatgaggtagaaggtgatgatgaactcgaggacgagcgactgcacgtcggagccggcggggagcgtgccggggaagtgctcgtggcggccgccgaacatgagccggagcgtgccggcggcgagggtggcgcccagcatctgcgccgccgcgtacgccggcacctgccgccaagggaacctccggcacgtcgcgaacgccagcgtcaccgcggggttgaagtgcgcgccggagatgtgccccacggcgtacaccatcaccatcaccgccagcccccacacgatcgccacccccgggaacgtgatctgcccgttcttgctctggttgatcgtcaccgccccgcaccccgcgaagatcaagaagtatgtcccaaagatctccgcgatgatctacaccatgatcgatcaatgcggcgcccgccattgtcaagatcaagaactctcaagatcaggaggaagaagaagacatgaaatgatgat

SEQ ID NO: 26762 - DNA, 465 bp, Oryza sativa
ctcatgtcattgcttaggagcttgtttcagaccatacaaagacttcaacaatttcacactttgccttcttgaccttcaactacaaacccatcaggttgatccatatagatctcctcatctagctctccattaagaaaagctgtcttaacgccatttgatgaacgagaagaccatatgaagctgctagggaaagtagcacacgaattgtggtcaatctagcaacaggtgagtaagtgtcaaagaaatcttcgccttcttttttagtatagcccttacaacaagccgagccttgtacttttcaatagtaccatcaggcctgagcttcttcttgaacacccacttgcaccccacatgtttacacccataggccgctctgtcacctcccaagtcccgttagcgataatggaatccatttcactacggacaacctccttccaatagtctgcatcaggagatgcgtatgct

SEQ ID NO: 26763 - DNA, 2047 bp, Oryza sativa
tagaatattaatttttggttgagtaggagaaaaaaccgtgtgaaagttctgaattacccatgggcccacatgctaggcttgccatctctctatccttctctctctcgtacatggaatccgcatataagcctctactatctttttccccatctacttcctctattcctctcactctcgcaggaggcaaaggtgagagagtgtctcggtgaccggcgacggcgaggcgagctagatgctggttgggaatggtggatcgtggaaggagatgagctcctactcgacatcatctgtcatagtccactcggcatcggcgcgctcctatgggtgtggcgcatccacacggttcacgctgcagcatgtaagcagcgagggagggggggcccaaaccatgcaccgacatgggagtaagcagagtcatggagaggatgggctccattccccccgggtgtgcgactgtgatgaagatagtcagagggtgacgatccagctcccgacaatgggtcttgaaagcagggacgccacaagtggtggagacctaagatcgcgtgcgaaggacgactcttaccacaacccacaggcgccatgcaaggaggagcttggggcggtgaccggccagaggcgcaggtggtggtagacgagcagaacgggaccaaagtggagctgcacctactcagatagtcagatccaatggttcacctattccaactagttgccgatgaaggtaggcttgttattgtgtgcttggcgatgcaatgaactaggcgtgcaagagctcctctccttccacagcaggcagcatgtgggttcatgtgcgagagagagatagggatagagagatggcaaacctaacatgtgggcccagtggtaatttcataattttcacatgatttctctcttattcaatcaaaaattaatattctaatggttgcggttcccatgagctaatttccacgcttccaaagtgtcttcccctaaaaatcacttcgtgtggtgttctacaactaaaaacgcgaagtcacaataccctctagcaaaattttccaattccttttcgtcacgagtgagaatctccttatttgacataacttatcaaattaataagtatcacaaaatataaaatgtcctaggatttttgaagaggtttaggtaaacaagaaaaaatatactataatatctctcgttaaatacttaaatgaggaatatgtaacgagtgaaggtggttggagataaggatggatgaaaattaattaaataagatgtgattatatgaaagaagtaattaaccctattttcttatattatatgacaaattcatgataagatctattttaaggctgtgttcggaataatttgttcccaacatgcaatttgattttttaagcaactttcctatagatttttttttgcaaaaaaagtaccgtttagcagtttgaaaagcacgcgcgcggaatacgattgggaggggttgggaacccagggttccaaacacagcctaatttgtgatgagtgatatctcggttcaattaggatgtggcctatgttacccatgagcgttgtgtgcccttgatttatatgagcaagagtagaatctcttataagccctccaaccataccacttcctttttttaaggaaatcatgccattttcggattaaccattttatacgaagcgagaatgaaagtgtaaatgaggtgctatacggatggttggtttgcggttctggaggatgggttgtccatcccaccatatcgtttttgggttaaccatttacacgaaatgatgatgaaagtgtatgtgaacatgtctgtcgaatgaaagtataagtgggtctacctgttggatgggctcaatactacttccaagttaatcatttgactcgaagtgagaataaaagtgtagggggtgctatgtgtcagtgttggaattaatagatgggctaaggcccattcgaagattaattctttgggaaatcacaaaagcccacctcatgggatggcatgcatgtggagtttagtaccaccttgcttattctagaagagggaggcct

SEQ ID NO: 26764 - DNA, 503 bp, Oryza sativa
cctcgcaagcctcacaaggctgctaaagagagaaacttggcacctctagaactcttacactcagatctctgtaaaatgaatggggtgttgacgaagggtggaaaacgatatttcatgacgttgattgatgatgctactagattttgctatgtgtacttgttgaaaacgaaagacgaggctctagactattttaaaatttataaggcaaaagttgaaatcaacttgacagaaagataaaaagacttaggtctgatcgtggtggagagtttttctcaaacgagtttgacttattctgtgaggaacatggcattatacatgagaggacgcctccctattctcctgagtctaataagattgctgaaaggaagaaccgcacactgaccgacttggtgaatgccatgttggacaccgcaggactacctaaggcatggtgggggagacattgttgacctcgaatcatgtgttaaacagagttcctaacagaaataaggacaaaacaccat

SEQ ID NO: 26765 - DNA, 1623 bp, Oryza sativa
tcaagagcatgaaccggatgaactcctccacctaacctctatctagctaaccaccaagaaccctaattaattactactgccagtactactactgctactttctgttcgagatcgatatcgagatgcttgatcgatgcaccgcatcgcatttaaaagggaagagatggatgaactactatttgtgacgtacacatatatagtagtaatttaattagcgttagttcgttgtcgtctcggctacgtgccacaaggcctcctttgtaacgcaggaattttataggaattctgtgacgtgtgtttttagatgtggggattcctataaaattcgtgtggaacttctctgcctcctatatatgtagaacttaaaaaatctatgtatatgtgtgtgtggaatagtatgttttggaccacgtgataaaattgcagagtgtttccttgcagattatggttttcttttaaataggtgagtatgataagttcccccctctatccatgcttatgaagttcagtatttcgacatctaaattatcaagaaaaaaaaggacatgtttgaaataagaagggaacttaattttgtttgaaatagggaatgagcttaatttggccatgtacatagcaagtgacaaaagacatgtgtcttccatgtaatcgaggagaaaaaatagtaccaatgaaatggaaccatggtcaaccggtgtgcttggaaaaaaagcgtaccggaattacttataaaatgagccttttgctagcatttctgcatttggctttgatgtggtgtcttttcttggactaggagcagtagcatttcgaagaaatctatgatatgtggtagcaatagttgaaagatgttaaaattgattagatcttgcatggtctttgacagtatatattctcacggattcatggtgcttaaatagaaacccgtgtagaaaggtagaaaatcaagcagtgctgctgaatgtttcacatctccgattttggtttcataagatcaatttcaggttcagtgagtttggatgggctttaatttgtgttaggctcttgtttggatgggcgtggatggaccaaggctaagacccatccagtgatccagagagactttagggagcccaaatccaggcccaatccccaccaaaatgaacttccaatgaacaaaacatgacttctttttggaaaaagtacacccaaggtccctcaacttgtcatcgagttacaatatcggtcctcgaaccacaaaaccggatataacgcatccctcaacttacaaaaccagtgtaaactaggtcccaagacggttttgagtccggttttatcccatgtggcagctgactcagcgtggaacccacgtgggccccatgcgtcagcctcttcttccctcccctctccacctctcttcctctctcctctcttttccaatctccacgggcggcgcgcggggagtagctgcacgggcggcggccggcgggcgcaggcggcgtggggaggagccgcgcgcgggcggcaggcggcaggcggcggcgggcggtgcacgagctcctcgccggacgaacgctagaccggctccgccatgtcggccgcgaggaggtggcgcgcctcgtcggctcgctcagtcggagtgccgcc

SEQ ID NO: 26766 - DNA, 1189 bp, Oryza sativa
tgggcctgatgtatccactcaaatcttcatcaggtacaacctctagaggggcttggccacagagcatgctcaccaccgaagacattcttggcctctgaacaggtgatgtgtttgtgcatagaagagctacattgagcatcctaagtgcttcttcttgagagtagtgagaaccaagacgctggtcaacgatttccagtagtctcccttcctgcttcaatctttcagcctgtgggcagaaaataaatccagttagtagattcgtgtttaaaatgtgtagcaggactatcagcagtttacttggtgatattaacatgcaatgcaaggctaaatttcttgggtaattcgcctttcagatgtgaaacactttcagttagcactaggcaattctttcttctggcatgaagaatattggtttgtttgtgggctaatcctgatcaagagaaaattgtttatgggcacacctagttcattgttagcctttgtttgacagaatctcagtagctactagacagactgattatccattgttatccgttgggtgagtaccaagaaacttggtcttatttcattggctatagcagaatagctgccattcaaatgatcgattttggaactaatgttgttggtttatgttacaattgacctttattcctatcataacataattttgaacagccaatccaaatcatcaattactcagcatattatcagcctaaaatgtgacagagctctccaaagttaagcaaactgactttataaaagataacatatctatgacagaaattcgtcccataagatcatacccaattctatggggctggacggctggttatgaattcgagtcctaaaagacaaaagcagtaacagaaaaaaagaagctaaaatagcatacccagtcagaagatggagatattcgtcatctgacatgctacttgtattgctcattccactaacaatctctaatgtcaccactccaaaactgtatacatctgctttacatgtcaagcaacctctcgtggcatactcaggtgccatgtatccactggttcaaataaagaacggtatcagatgttggataataaagatttttacaatatacaataatagaaaatgaaaggtgaagtagccaataaaaatatagaatgacagcttacactgttccagctatccgagtgctcatacgcccacg

SEQ ID NO: 26767 - DNA, 558 bp, Oryza sativa
gtgagtcctgaacaatcaaacagctaagttgtttcctaagatcctcccacaagatcaacactccaaaatgcccaatccttgtatcgcgctccaaccacccattcgtgcatccactctcttcgcgctccgtcgcacgcgcgccggctccccttttgccgcccaccttccaaccctgctcccttcgccgccaccaaagtcgtcgtcccattgctcatacgcctctacccatcgcaccgatccacactgccaccgatgacgatttcctccgctcatcccctaaccaccgccccatccctcccaagtcaaggtacacggatgttcgcgcaagggataatttcaggttgacgtggcatattcgccaaggtgtagtttgttagagttttgtgtcgaatatgtgtacgtagtcggttgcaatttaggacttggagttgtaataggtgtttggactagagtaagagtcagattttatcttggttgtaaccgcaagacgacaatagcataggtatggatacgactgaccgacggcctagccgatggagggtcgtgaatacccggata

SEQ ID NO: 26768 - DNA, 95 bp, Oryza sativa
ctgaggcagaggctcgccgtggagatggacgatgtggtcgtcgtcttcggcggggggatcggcgttgaggtcacgcaaggacggcggagctggat

SEQ ID NO: 26769 - DNA, 423 bp, Oryza sativa
tttgagtggcaggaggccacgtttgaatacttaccagggaaggattggcttgaccgcgtgtgaaatcgctggcgacgtgttggcgccaatccgggcacgacgcgcggtggcggcgagggtgaaaacggcgactcgggggtgaatggtttgaattgtgagaggggataccaccgtctatcttcaatccaaccgtgtggaaagaattggcgcgattcatcccgggtagaagcgaaatcgcactcgacagcggcttggattggagcgcacggcgtcgagcgacgatttcttgcggcggtagtcatcccggctttgtcgtcgtcaagattggtgcggcggcggcggtctgagggcgtcggacgggcgacggcgcgccaaggcggtcgggcacgcgcaagcggtcccgaggccgacgcgtggcgacac

SEQ ID NO: 26770 - DNA, 895 bp, Oryza sativa
tccagggtttatttactagtagtagtagtcagcagcgcaagttcgattagttggcggagtggtgattgacgatttattaggttatttttgcttgtttctggctttctgcagttcggacgacttaccttgtgattactgattagcaagtgtgttagtatcagtatgttgggtggtgtctcttgtgaggaagtgagtttaaccagagtattcttaagatgaccaagctcaccaaacatacccagtgttttgtattatattgtctatgcttgcatttttgtttacttgattcaaatgccactctgtgcgtgtgacctaagcaaaacaatgtttactgcctatgttcaatttcatgcatcctcacatcactaaagtgaacttaggggcttccagatctagcagagtgcatcattttatttagtgaatgtgtttgtggacagcacgtgttttttcattatcattattttgtgtccttgtatgctgatggtgtttctctgatgcggcagatgggggtgtggctctgcagtttgagagcggctactttgtggagacgctcgtggaaggggacaagcttggcgtcacgccacacaccattagggtgtcccctgttgagggtggagagctccttgcagtggactcggcacatagcaacattgtgcgaataactccgccactgtccgagtgtatgttttcttcttgccatcctcagctcagcgcttccttggttattttaaatatgaatgtaatatatgacatggaacattttttggtgtgtcatccagcggactgtttttaggagtgatcagagtttgttccttctttccccaaaggcatgaaactttaaaattagctttgttaaacatatcagtggctaataagcatatatgcaaatattttt

SEQ ID NO: 26771 - DNA, 630 bp, Oryza sativa
atctttaccactggttggcaccatctgttgtcccagttatacaaccggaacggtgaattcggaataaatatcgctatctttagtcccggttcaatcgatctttagtcccggttggtgtgatgtggtcccggctagagggttttttccttcttttttttcttctctctctttttcactgttcttttgctatttgcccaaatcatctcagatcaaacattcatcattcacggtaatatagttcatcccaaatcattcacaacaacacatattgaatcacacggtaaggacaaaagaaaaaaaaatccaaaagcagcgccggcctccaccgcctaccgctgcactagccttcgcaccggccgcctcccccttcggatccggcggtggccggctgcctcccctcccagatgcgcagccgcccggccgccgcggtgcgaggccgccgccgccgctgccgcctaggggaggaagagaatgaggagaggaggaggaagaggaagagatggggtgaagaggaggaagagataaggtgagggtggaggagatagaacttattaactgatccgtctcctcctcctcgatctcacgcatgcctcagcccctccgccgcgcatgccaatctttttttccggt

SEQ ID NO: 26772 - DNA, 293 bp, Oryza sativa
tgagaactccaacgagtatctcctggtctttgaaggcattgctcttgatttaacccagttccagtttgaagcatcccacaacctaatgccttgcatatttgttcataatttatttctctaatcatgtctcttctcttagatgatccacccaccacattcaacaaagtagatatcatagtaaagaaattactaatgcctttatgtttttctcacaatggctacaacaactaattgaagttggtgagcaaaacagtgaacataataagctgaactactttccctcatgatcaatg

SEQ ID NO: 26773 - DNA, 671 bp, Oryza sativa
gcggtagttaaatgccacgccatgtttgctagcaaggcactatcttggcaaccacaacatccacacagattgatagccaaatggaggacatgaaaatgccatatcttactggtgggtgtcaactgagtacagcttctacagggcattgcctagttccatctttaaccataaacatcagaattcaagatacaaatcacacatgagcagctctttcctttcacctatatgttgtttggcctcagaatagggaaacctacctcctgttcctttcataatctgtccacatcttcttcgcaatataatctctcaaagcatcacccatgctacattggttgttcagttcttcgacatcattgccataagcatcatccccactgggtaaaactacagttctacgggatgaaactggcattgcctggttaaatgcccacccatcatcatcatcatcatctttttggccctgcattatattgtgcagcaccactgctgctgctgggattttcgcttgagtttctatctgatagaatgttgcgacatttaaaattgggaacctcatcttcaatagcgctgtggcacgctttatgttgttgcgcagctttgagtgacgaaggttgaacaactccttgtagtcacttggctgacaattgctctgctcctcctcttcaatatgg

SEQ ID NO: 26774 - DNA, 575 bp, Oryza sativa
cagcacagatgatgcagaacatagcggcatttacacatcagtagaacacacagtgaatcgatcctatctctcaactaattgatggatacatccgtagccgcatgaagcacaaatgcacaatggattgctgttagctattcaaatgattggagaagtatgtgctcttttacctgaggatcggaaacggaaccggaaccttcaacttggccggaaaacaagggcgaagtagccgaggccgcccaagtcgccgccggcggggggatggcgacggagccgggacggaagaagcagcccttctagccgacgggaagagcgcgcaggcgaggagaggaggatctcggaggcagcgaggtcaccggacccgaccgacgggcgagcgattcgacggcgacgagggcacgcaagcggaagcggcagcggcgacggcgacggcgacggcaacggcgaggaaacccttgccgagttgactagccttgtctggaattctggatgggccgccagataattaccaggcccacataaacttgtgggtcttaacagaggtccattaaaaagcttaaggaataagttcactt

SEQ ID NO: 26775 - DNA, 1002 bp, Oryza sativa
tttttattctgaattttaattaatctcgtattgggttcttatatggactcttctttcattccttatatttcattcgaatttcagttatttttaaattgtatttttacttggactcttcttttctttttttccgattaatgtgggaatttctagcccccacagtaaacgtggtgcctccattcaaagccgcgtaattacgcggctagcacccatataaaattatatactttttaatatgattttacttaaaatttattaactagttatcttgttgtcttaagattttgaaagaccaaacctaatcatcctcgtgtttctaattttatagtttttaaatgtcacatagttgctaccccttacttctgtcagattattctttattagcttgctcgatctaccactatttctattcattctccttggaacctttaaaaaatggatctaaaacttatagtttgagtttattgtccagttgggcttctattttataatttccataagtcccgtcaaatgctgatctaccactatttctattcattctccttggaacctttaaaaaatggatccaaaaacttatagtttgagtttattgtccagttgagcttcttttttataatttccataagtcccgtcaaatgctgccattatactcctctacaaccgtccaatgcatcttctctttattgcattgctattttaaaaatcgaacataattatcattttggttcattttttttactttctagaagttccgccaaaacgttagcgactttgtcactgtacttctctatggcctgcccgctgccgcccttctttattgtcatcgcgattttaaaatcaaacatgattattattggggtttatttttttattttttggaagcctgaacctttaaaaattgaaccttatagtttttagagtttattgtctcgttaggtttcatttttataatttctagaaatcccgtcaaacgctgccactatacttctctatggctcgtcc

SEQ ID NO: 26776 - DNA, 216 bp, Oryza sativa
catggttatctgtgtgcaactgcaataacactttgataaatccaatacacctttgtgatggtttctgatgccatgtcaggttgctgttgcgttggagaaggcagcattgtcagatgattattttgtcaagaggaagctgtatccaaatgtggatttttactctggcttaatatataggtacatcagtgggaaagctgtttttctcttttctctcct

SEQ ID NO: 26777 - DNA, 651 bp, Oryza sativa
tatatgatccatttcgtttactacatcacataattaacctataagtgtatgtataacagtacatatatcgcacaccacatcctctcactatatataaactacaccaagcacaacagggataatattgcagctagctctagctacaaattaaacttaaagcatgcagcatatacatatagatatataagtacatatatatatcatcatatgctacgtttttattcgatcgttgaccacattgatctatataatatagatactgcatgcaaattataaatgcatgtaacgtagctaattaagctatagagcttgattaattaggcttggcggcggcgggaggtgtaaggtccggtgaacctccggccgccggagccggcctggcgctggcagttgaagtagacggcggcgacgggcgcgccgaggttgtagcggcgggcgaaggcgcgggtggtgaagttgtggcgcaccgccggcgcgtacaccgtctccctccccagctgccggaacagcaccagcaccatcctgtggatccccgtcgtcgggttcgggctctcgtagcacaccacctccctccctgcatccgtatcgcaaagcaaccgcgcctctcagatcatatatatcgccaattcattaaatattttatatataacg

SEQ ID NO: 26778 - DNA, 645 bp, Oryza sativa
ctaaccatctactattagtagtaataatttactactgctcggggtggactaacccctgaatgatggggacggtttttctaggattatgttctagggaccagtactgacttgtcggatgcgggttctatagctggaaactacaaagggatctgttgtaatcgtgccttctgttgtttattatatttgtagttacctaaaatgcacttaaccagttcttcattgagctatagtacagcacatcgtggtcctgaattgtagaagtggtacgtggcatgctatttgtcgcaccctagcaaactcatcagctcgagactagcgcctttcggcctacctggacgaatttttatacctttctgtcaacaacccaagggatatgtcacgccatcgcccatcgatgatcagctgacggccaccgatcgtgaaggcgagaggtacaggataaatactatccgtgatggctgcgtctgcattttttttttgtttagcattgttcgggtgactatttatggcagcgggccagctgctccaccgagctgaagcctcgtcaccgcccacgtacggtgcggcgattggctgggcttgcgctcgccggagacgctcctgatttaaattaatcgaatgatgaggagattttgttccagctaa

SEQ ID NO: 26779 - DNA, 602 bp, Oryza sativa
tacgcatgcatgcgtccatgccatctccttcatctgctcgatcgatcactctcagatagattgattgattttactatctcgatcgagttggtcgccaattcgccatggccagcagcctcattaaccttcttctcacggaggtggccggcatcgtcagcattgttctcctcccccttcttgtggggctaaattcttaccgccgccgttccggccacccggggctccgcttttttttttgggcggcctcacaccttttcttcccgttgtgttcttacgcgtgttccgccgccgccaattggaacgccgcgcgcgtcccgttcttcttcgcttgaaccggtttcctccaaatgctgcgcaacaccatgaacaccgcccgttcgtccccgtcacacaatcggaaacggcagcggcagcagcaagttcaggccctccgtcaaccacctggcaagaatggcctgggtggcgttcctaattgacagcagcaacggcaccgccggaagcccacagctcaccggggtgctcctggggctgtgggtgctcaccctcgccaagctcgtccaccgcctcgttgccgccgagctcgccaagaactcgttcgccgt

SEQ ID NO: 26780 - DNA, 23975 bp, Oryza sativa
tttataaaaagtgcaaactaagttccattaatagttttgactccggttttatccgacgtggcagctgactcaatgtgggacccacgtgggccccatacatcagggtgaccacgtcaccatctctttcccctcttctttcccttcctcctctctctctcccaattttctcatgcgggctggctggtgcggcgggggaagagctgcgcgcgggcggcgagcgacggaggaggagcggcgggggagcagcttggaggccggcgacgggccgcggggtggacgcatgcgctgcggcggttggctcagagtagaacaggaattggtaggcgcggtcgccgtagtacttctccagggactgcacggcgaccttccccgccatctggccttcttcgagacctcattcttctcgggcttcccgtccacctccatggtgacgggccgcgccgcctcttcaggcttctcgatctccatcgccgcgccgggattgctgctgcttgtctcaggcttggcattgctcctgctcttggttttggttttggagagcacggcagagacaaaatccatgcgcagattggcatcctcttccactgttttgtttggtaggcaagcaagcaaattacaatccattcctggttcctctccttaaaaaccaaaccaagcgggcctatgtttactgaagattagtctttaacaggggcctatgtcaattccttgccgtcatcaaacagacagacaaacaaacaacacgatgatgatgagttctgtcttgacggctgcttccttccaatctcctcgcaatttcatcaaactacaagtacagctaaggcctcagcagcgacgcctgcaacaccaacaacagcttctgattgttggcagcaacggggcaataacaataggaaacatgagtttgtgccgggattgctgctgcttgtctcaggcttggccttgctcctgctcttggtcttgattctggagagcacggcagagacaaaatccaagagcagcggcttggccggcgccatggcgtcgatgatgctgccgccactgcgagagatggcgtggcctcggctgcgtttccggctaatccgtcgcagctaagaagctcgccgacggctgccacggggcgcttccacctctgcgcccatcgccgtagcgccggcctgcgcccaacccactgccgctgcgtcgccacgccaccccgccgcccgtcgccggccacccagctgctcccccgcccgcgccgctcttccgccaccgcaccggccggcccgcatgagaaaactgagaaagagagagagaggaagggagagaaaagaggaagagatgatgacgtggtcaccctgacgtgtggggcccacgtgggtcccacgctgagtcagctgccacattagataaaaccggagtcgaaaccgctgagggacctagtttacactggtattgtaagttgagagacaccggatatctggttttgctgtttagggatgattttgtaacttgatgacaagttgagggaccttcagtgtaaaactaataatatagccgactgatgggtctaaaaatattcatattagcatttaattaactaataactgtggtatgtatataataagagagctatttgtgtgtcccttcttaatgtttttattctaatttttcttcttttgaagctttcccgtccactcatttatcttgagaagtgagcagccattgtgagtttaacagaaactagtcatgcgccgctagtgttgcattggagcttgtgtggagccggcgactaattagtcgaccgctcacactctctttctactcatttcttccctaactctgtactttattcagtttggactcagtatagccagcaaaaattacctattactagaaaggcttcgcgcgctatgtggcgcggccactaaattacgggaaacagaagaatgtaagattagagaagcaattcttttagggactgcctatacattatgcgatagattttctagcctcctatcatgcaaatttttcaagccataggataaatttaatctcatctatttaaatttagggagtaactattaaaaaaaaagtttgcatgtatttacattgtaagttccaaattacatatgtaattttagtgtatttatgatgtaagtcataaaattacatatgtaattttagtatatttatgatgtaagtcacaaaattacatatgtaattataatgtaagcacgatgtaattagtaagcgtggatcataagcaaagtagcagtagaaaacactgctcaaatgcaaggaagaaaaacaggcgtgtgtttcgaaattgaacggtaaatatgtgagaccaaaaaaacgcaacaacaaagtccacagaacgcaacaacaaaagctcggtccatctcaaagtccacagccgtgcatgactttgctcaatccaaatgcagcacgaattgtaaacagagatgaatggccaaaaaagtgaaagatttagcaccctattttctgtcaacagagcactagcgattccgatatcaaaatatggttattttgccgctggacaccatacacattaattaaaatattaatttccggttgaatatgagagataaatagcgtgaaaaggtcaaaaatgccccctgggcacacttatcatattctttctcttcctccttatttccccttctaccggcagccccctccttgcaccgcctctggtgtgccatctcgttgatgtcactagcttcctccccgcgccaggcgctccacaccggcaaactcctctgaaacctcctcacccatgtagatctcgagttgccgctagggaaccatctccataggctattttcctgtcgtcgcacgcggcccttcacttcttgcacaaccgtcgccgttgttcctcccatggatttggagggagagccatagctttgccccctgctctgctccacccaagggtggtccacctcaccgccggctactaggtcccctcgtccacccccaatgactccgtgtcaaccaccttcatgtagacgaccggccatatcttgccaagctccgtccgttgttcactctaccttcttctctaggatggaggtcatcgagcgcccgacgcctagcacttgttccctcgagcgtctacaccatcgggagccttcgtctccaccaaggccattgggaggcttcgtttgaagtggggtgtttgcagaaaggggaaataaggagcaagaggaaagaatatgacaagtgggcctagggatattgaaagtgcatctaggcccctaatgattttgatgattgattacaatgcgattagagaggactaacacttttattcaagcaaatgtgaaggttgttatgtcctcgacatgttgtaatgagatgcataccccatgaatgcgacatcacgatgcaatgcggcagtgatcaaatggcatattatatcttttaccttgcattgtgtcataggaatgccgtactattaagagggataccacatgcatataattggtagaacactagtgctcaaaatgcttcatctttgtgtgagttgaaaaacctaagccaaaatttcaatcccgagttgtttcacttgtcacaacacttacaccgggtttctttgcaagtttttcaacatctcttgaaggttttggaccatgttttatgttgggtttgatagcccacgaaactagctttccataaagtccaagatcttcgaaatcggagttcggagtaaaaagttattgcagttttacttgagcaacatcagactatctgatttgaaatcagactatccgatttttcacataacttcactctctgtctttgtttggaaaatcctttcgagtgagtttttctatgtgtcggtgtatccgatgttggatcagatgtccgatgatacagagactccgaaatttcatggaacttgagtctctgtttgaggacgaagtttttgcttcaaaaatatcagatactccgatttaacatcagatagtccgatgtctcggaaagtccgaaatttcatggaacttcgttgtctgtttctcgttgcgttggaggtttaaaatatcggactatccaatcttgtatcggactatccgacatgggctgaaagattcccctccaacggtcactttttgggggatccataaataccccccacctaaccctttttctagggttacccaactcatttcattctcattcattttgggttgagcttggtgctaaggtgctttggatctttgagctctttctccctctctcaaatccctcctcgttctttgtgtggtggatcttggtggttgtagatttggtgtttgagggcctagtgtgtgtttcactcgatcttgagcactagggtttgaccaagagttgtgtggtgtcttttactcttggaggttgaggactcctaaacggctaggtgtcactcccgagccaccgatctacgtgtggttggccgggagaagtttgtgaaggccggatctcgcctccgcaaggaaagagataccccttagtggaaggaggagtgcttagtgtaacctcttgaggaaagggttagcaaagacccggctcttagtgagcgtctcaacggagagtagaatcccctcaagaatttgaactccaggaacaacttcgtgaacttcatcattggtgatctcccttcatcctccttttagctttgcttaattgtgccgctatagatctagtcactgtttgtgctttactcttgtttgtatgatagatctacttgttgtgcttcattggtggatcagacagtctgatccaacatcagactatctgatattttcggatagtctgactgtggatcagactttccaatcttatttcagttttagcttccgcataaagttttaaattagcctattcactccccctctaggcctaattgaccctttcagacatttttatattttcatgttgtttttctctcctattcaatcggaatttaatattttaatacatgcggtgtccagcagcaattaaacatattttgagagtgtcttcccaaaatatcaacttttgccgtgtccgggagctaaaaccacgaagtcacggtgtcctacaacaaaatttgtcacattgggccggtacgttgaggtggatatttttgtctggtttgaatagttgagggatgtattttatctggtttcgtagtttagcgaggcaaatcacactttggtgatagtttgggtaaattcgacataataataataataataaataattcatattgagagtttttccctttgcgaatttccgtgaagtgaaaaaaaaattagcacataaaagaaagttgaaatttaaacaacaatatgcacaaaggcgctgcacctatgctgtgaacaaaataatatgtccaacaactttatcaaatactagaataatttatcatgaacacttaagacttaacatgattaattaatttgagatctatagtggcccagcatgagaccgaggttttatggcccacttttagataatcatttctaatgggacacctaaaacattattgatatttttgaacaagtttcaatatgatctccatggtgaagcatctaggcccccgttgttaattttggtaattaatgacaagcactaattgtggactaaccgttgctattgagatatattttaagttaggtccacgtcatgtgtgcgcatggatgactatcgatggattaaaatttgatggcgcgaagcgaagaaaagaaaacggtaaaactagtgttttaattttaaaattgatcgaggtgaagggcgatcaaatttgctagtttatttgttagtttcgccgtactatcaagggggtaatgatctagcaaagagatgattaaattgccacattaggtcattgcattttcacttgtgctcacattttcatcacacacacacacacaaacactttacctttcactgggctcggcatgaccaggggcagtcagaccggccacattgtggcggtctgaccggcgtgccttggccggtctgaccggcgccacaacggcggtctgaccggagcataaggccagtctgaccgacggcacatgcacggtcaaaccggccccctggaggccgggatggtgttgctcgaggtggctgatacagagccgacggagccgtattcggtcagatcgagccgaggccggtcggctcggtctgaccggccaggccgatggggccctctgacagcgctacaacggctagttttctagccgtttgtcgcaaccgagaaaatttgcattttcccgaacgctagtgtattaatccccgtcccaggaaaagccggggtacaccacacaaacatgatataaaagacacatctttattatatcgataatatttaccttattacaaatgcacttcaggcctgacaataacaaataaacagcagcggactagcgggcctatggctccatcttcacaggcgctcaactagggtataagccaggactctacctaagacatctcctccaaagcttctcttactgaagaggggaaagatagagcaagaatgaatacaaccacagtactcagcaagccacaccgggagatgcatgattaatgcaagggagtacaaggggtaataatataggggttaagttttgcagtaaacagcatttaaaagtcacttagttgcccaaagctattttataaagacgatcctagagctatatagtattattaatcaaggccgtgaacccgcacgaacctgccttaacccaaggcctacgatgattcagaccgaactggcaacccaacctgggtcccagctcgtcccaagccaacacaggccaaccattccacattttagttgttaagcaagttttaggaattaaaccactaacttgggtacattgctaggcttgcccataaccgagggcgcggctattcgaatagattatactctgataagaggtgtacatctttacccacaagacacatctttactcagcattccacggccgtggaacccgtcgtaaaggatgtgacataacccctttacccatcctagccgtgacaaaagcaccgacccaacctcgcctatggccggaatcccgagacaggtaggtaagattgagcccctagcagcaggacaccggccctgtgccatgacatctcgactaccgagccgcagcccgtgtagccttcatttggcctcgagatgtccatcgagccccgacttcatccatctccatccgtgtactcttgctaggactagactgagcaccgagttaagccttacccattagacatgtggttagtacggtagtgctttgcaacagaggctcgaagactggtccttatagtggccgaggtgctactagcagaaccatgcacctcgtgcccagcctaaaaccattttgggagttttgaatagagggggggggaggtgtgtgttcaattccatcacaagccaaccattccacagtgtccaaatgatatgagaactcccaaagtctaaagttataaaaccacctagtgttgcctaattaatcagcgaagcatctacctaaattcatactagtggaaccgttaatagagtacccactagttggggttttgtttatcctaaggtgaacaaggtaagaataacaatagcaataataataaggtcataacaaaggtaaataggcgtggctaaataaaacagtgataacgcgggaatttaagtaaagcagtaatgcaataatttaaatcaaaataattttataaactgagattcaatatgctcaagggtgatgcgacttgccttgctcagagagaacggccttccgaaccttcggcgacgaccacaaagtacgctttggaaacctccggaacgacagaagctacgcgaagcacataagcaaagctacaagcctaaaaagaagcaataacaatacataaaaagaaagcacatgattctttaggttataacaaacattaagagacttgaacgggtcgattcggggttcgtatgatcaagatatgatcatccgaagtttaatgttgttatatgaagatttacggattattatgattaggttttgcaactataaaacatgtgcaagcgctagcctggaaaagacaggaaggctgcgctgttgacatgcggaccccacatgtcaacctaagggaccacggtagaccgagtacacagagacagtctacgggtcgacggaagcggaccccgtgtgtcaaccgaggcgagtggccaacaaacggactccactagacaccacgcgggctgcacatgtaaaaaccacgtggctatcgagcgggcacactaacacggtcaccacacgcacacatgaacgactaccgacactggtacatgggtaccggggtcgacaaccacacgacgggcatggggcgacaccgaaaggacgaggacggggcagcgagaggacggatccttaccaccacgcgacgaggcgtgggaacgacaacgacgaacgggcgcggcggagacggctcggggacgatggaggcgaccggcgagggaacgacgtcggcggtgatccttggacgaaggcgagacacggccggcgcaacacttgacgacgcggagccgaggacgaagatgacgacggggctgcagcaaccttgacaaaacgctggtgaagcatctaggcccccggtgttaattttggtaattaatgacaagcactaattatggactaaccgttgtctttgagctatacattttaagttaggtccacgtcatatgtgcgcatggatgattatcgatggattaaaattgacggcgcaaagcaaagggaaagaagacggtaaaactagcactttaatttagaattgatcgaggtgtagggcgatcaaatttgctagtttaattttagtttcgccgtactattaagagatatgtgcgcatggatgattatcgatggattaaaattgacggtgcaaagcaaagggaaagaagacggtaaaactagcgctttaatttagaattgatcgaggtgtagggtgatcaaatttgctagtttaattttagtttcgccgtactattaagaggggtaatgacctagcaaagagatgattttaattgccacattaggtcattgcattttcatttgtgctctctttttcattacacacacattcacttgcaaattcactgggttcggcctgaccaggggcggtcagaccggccacatagtggcggtctgaccggcttgccctggccggtctgaccggccccgcgagcggtctgaccagcggcactttcccggtcagactggccccctagaggctgagatgatgctgctcgggatggccgatacagagccgacagagccgtagtcggtcagaccgagctgatggcggtctgaccgagctgaggccggtctgaccggccaccccatgtcggtctaaccggttaggccgatggggccctctgacagcacttcaatggctagttttctagccgttgcagagtagcacggtctgaccggccacataccttcggtcagaccggcagagcacaaagttgggggatttcgccaccaacggctagttttggtgggtgggagtataaatactcccccaccagcagcaagggggctctcttggcacccaattcaattgcatacaccccttgcacctctctcacactcacttgagctttgtgttcatccatctagtgtgttagagggttgtttagccaagagtcaagtgcatttgcttccattgtagagctagtatggcacttgatcatctccacaccgggtcattgcttgttactcttggaggttgccgcctcctagacggcttgtggaggagttgcccagtgacctctccgagaagattgtggaggaggcccggcgccggtttgtgagtggtttggagttcaccaccttcgaagtgaagaaagaactaccccgagtgatcgaggcttgggtagtcctctccgtgggccggctcccgccttgcccaccccttgacgaagggggcgtgcggtggcttcgtggttgagtggtggagttgggctcgcctcaacggggagtaagaaaccggcgagtttccgaacctcggtgaaaagtctcttgtctcattgtctcatttgattgtcgcatttacatttgtgcaaatttactttcctagagatatagttgagccactatcaccctaggtttgcaaaacataacttagttgcttagttagagttcaccctcaccaagcctagcaacttaggttagatttgattaggtgttatttaatttttaaatcgcctattcaccccccctctagtcgacatctcgatcttacaagtggtatcagagcttggtctctcttgattgggcttcaccacctagagagaagatgtcgaacgaggtgaaccatgtagggaaggctcccatgtttaatggcacaaactactccacttggaaaattaaaatgtctactcacctaaaagctatgagcttccatatttggagtattgtggatgtaggctttgctatcaccgacacacccttgacggagattgatcaccgcaaccttcaactcaatgcccaagccatgaatgccttgttcaactctttgagccaagaggagttcaatagagtgagcaaccttgagaccgcatatgagatttggaacaagttggcggagatccatgagggtacaagtgagtacaaggataccaagcttcatttcctcaagatccaatatgagacattctccatgttgcctcatgagagtgtgaatgacatgtatgggaggcttaatgtcattgtgaatgatctcaaggggcttggggcaaactacaccgatcttgaggttgcccaaaagatgcttagagccctaccggagaagtatgagacccttgtcaccatgctcatcaactgcgacatgtcaagaatgacacccgcaagcctcttggggaagatcaacaccaatgacatgtacaagttgaagaagaaggagatggaggaagcctcaccctccaagaagtgcattgctctccaagccgaagttgaagacaagagcaagagcaaggtgaatgaagtcaatgaggacttggaggaagagatggtccttcttgctagaaagttcaatgatctcttgggaaggagaatggagagaggaagggactccaactcaaataggagaagaaatagaagacccaacaagactctctccaacttgaggtgttttgagtgtggtgagaagggacactttgcttccaagtgcccttccaaggatgatgatggagacaagtcatccaagaagaagagtggaggctacaagctcatgaagaagcttaagaaggaagggaagaagatcgaggctttcatcggggaatgggactcaaatgaggagagctccacctcatccgggtccgaggaagaaggtggtgatgatgcaagctccaagaagaagaagatggccgttgttgccatcaaggaggctccatcactcttcgctccactttgtctcatggcaaagagctcctctaaggtaacatctcttagtgatagtgagagtgatgatgattgtgatgatgtttcctatgatgaacttgtgagtatatttgaggagcttcatgcttatagtgaaaaggagattgtcaagttcaaggccctaaagaaggatcatgcttctttagaggtcttgtatgaggagctaaagacctctcatgagagactcaccatttctcatgagaagcttaaggaagctcatgacaacctcctttccactactcaacatggagctctcattgatgttagcatatcttgtgatttgcttgatgatagtgctacttgccatattgcttatgttgcatcatctagcatttctaccttttgtgatgatcttgtggatatgcctaactctagctctagctcttgtatttctatttgtgatgcctcacttgttgttgagaacaatgagcttaaggagcaagtggccaagctcaacaagagtttggagaggtgcttcaagggtaagaacactcttgacaaaattttgagtgagcaacggtgcatccttaacaaggagggacttggattcattccaaataagggtaagaaaccttctcaccgtgccactcgttttgtcaagagcaatggtaagtattgctccaagtgccgtgaggttgggcatttggtgaatggttgccccggtggtaagccttctaagacatgcatgtttgattctcattatatgcttaggaaggctcatgatggtagcattgttgctagatatgtgggttctcctatactcggtggtaaaaagaatgccatttgggtgcccaaagttttggtctctaacctccaaggacccaaacaagtttgggtacctaaaagagcttgatcttctcttgtaggtgaactaccgcaccgatggaagccattgggtgcttgatagtggatgcactcaacatatgactggtgatagggctatgttcaccacatttgaagtaggagggaaagaacaagagaaagtgacttttggagacaatagcaaaggaaaggtaattgggttaggtaaaattgctatctccaatgatttgtcaattgataatgtctctcttgttaaatctctaaatttcaatttgctttcggttgctcaaatttgtgatcttggcttgtcatgtgctttcttcccgcaagaggttattgtttctagccttcttgacaagtcttgtgtgttcaaaggttttagatatggaaatctttatttggttgatgtcaattcagtgaagcaaatttgaaaacttgtttagttgcaaaaacttcattgggttggctttggcataggaggctagcccatgttggcatgaatcaattgagcaaactttcaaaacgtgatctagttgtggtcttgaaagatgtgaagtttgagaaagataagctttgtagtgcttgtcaagccggcaagcaagttgcatgttctcatcctactaaaagtatcatatctacatctagaccattggagctcttgcatatgattttgtttggcccaccaacctataagagcattggtggtaatagtcattggcttgtgattgttgatgattattctcgctatacttgggagttctttttgcatgataagtctattgttgccgagcttttcaaaaagtttgcaaaaagggcccaaaatgaatttagttgcactcttgtgaaaattagaagtgacaatggttccgagtttaagaataccaatatcgaggactattgtgatgatcttggtattaaacacgaactttccgctacctactcacctcaacaaaatggtgtagtggagagaaaaaatcgtacattgattgagatggcaaggactatgcttaatgaatatggtgtttccgattccttttgggcggaagccataaacatcgcttgccatgcaaccaataggctttatttgcatcgtctcttgaaaaagacttcctgtgagctaattgttgggaggaagcctaatgttgcctattttcgagtttttggttgcaagtgttatatttatcgaaagagtgttagactaaccaaatttgaaagtcggtgtgataaagggtttcttctaggttatgcctcaaatagcaaggcataccgggtctacaacaagaacaaaggtattgtgtaagaaaccgccgatgttcaatttgatgagactaatggctcctaagaagggcacgagaatttggatgatgtaggtgatgaaggcttgagagagctatgaagaacatgtcaataggagatgtcaagcctattgaagtggaagacaaaccatccacctccactcaagatgagccatctacttccgctacgccaagtcaagctcaagttgaagtggaggaggagaaggcacaagatccacctatgccaccaaggatacacaccgctctttccaaggatcacccaattgaccaagtgttgggtgacattagtaagggtgttcaaactcgatctcgtgtcgcttcgatttgtgaacattacttgtttgtttcttgtcttgagccaaaacatgtagatgaagctctttgtgatccggattggatgaatgccatgcatgaagagctcaacaactttgcaagaaacaaggtgtggactttggttgatagacctagagaccacaatgtcattgggacaaagtgggtctttaggatcaaacaagatgagaacgggttggtggtgagaaacaaagcaaggttggtggcacaaggtttcacacaattgaaggtttggactttggtgaaacttttgcccctgtggcaagacttgaggctattcgcatccttcttacatttgcatcatgctttgatataaaactatttcaaatggatgtgaaaagtgcttttctaaatggtgaaattgccgaacttgtctttgtttaacaacctcccggttttgaagatcctaaaaatcctaaccatgtttataaactctcaaaagttctttatggtttaaaacaagctcctagggcttggtatgaaagattgagagattttcttttgtcaaaggatttcaaaattggaaaagttgacaccacccttttcacaaaaatcattggtgatgatttctttttgtgtcaaatttatgttgatgacatcatattcggttctactaatgaggtattttgcaaggaatttggtgatatgatgtttagggaatttgagatgtccatgattggagagttgagcttcttccttggacttcaaatcaagcaactcaagaatgggacgttcgtgagccaaaccaagtacatcaaggatctactcaagaggtttggcttggaggatgcgaagcccatcaagacacctatggcaaccaacgggcatcttgaccttgatgagggaggtaaaccggtagatttaaagctttatcgttccatgattggtagcttgctttaccttaccgcatctaggccggatatcatgtttagtgtttgcatgtgtgcatggtttcaagccgctcctaaggagtgtcacttagtggccgtgaaaaggattctaagatatttaaagcattcctctactattggcttgtggtacccaaaaggtactaagtttaaccttgttggctattccgattcggattatgccggttgcaaagtggatagaaagagcacatccggtagttgccaaatgcttggtagatcccttgtgtcatggtcatccaagaaacaaaactctgtagccctctctaccgccaaggcggaatatgtttcggcgggtagttgttgtgcccaattgctttggatgaaacaaacattgtggactatagcatatccttcaccaaaaccccactcctatgtgacaatgatagtgccataaaaatagccaataacccggtccaacattctagaaccaagcatactgacatacgccatcacttcctaagagaccatgttgccaagtgtgacatagtcattagccacataagaaccgaggatcaactagccgacgtatttactaagtctcttgataaaacccgcttttgcaagttgaggaatgagttaaatgtcatatatttctctaatgtggcttgagatggtgcaccatggttgcttctttttgcattatgtatatttgctctcatttgctttatgtatatttgctctcatttgctcttatgctttggatttgttgccatttggttcttcattgcgaaaatggagcatgtcacattaagggggagttttgcactcttgcatgtgctctacttccctttatatgtgagcaaatcaactagtggtgctagtagtattttcaaaatgcctaagtcaacataagtcaaaacttttgcaaaatcaatgtaatttgaaaactatctcttggaaaatgtttcaaaaggtttcctatatgttttctaagcctcacattgcaagaaaaatgatttctgaatgaaaatgtcattttggccctcttttgaagaaactagattcttagttttggccaaaatgagaattatccccaaaatgagattgagaaggaatttgagaaaagtttcaaaacaaagttggtagataagaagttttgaaatgtttttggtattcaaacctatttcaaaaaccaaatcatttaaaagttatttgaaaatcaaattcgcccaaaaacccgtatagaccataaaaggtcacctcctagcacttaagtgagttttgttgcaaatcatcataatcttcaaatattatgggtggttagcaatatttaaactcacacatttcaaaaattgctccaaaaatcaatttttttattgaattttattgtgtgggggttgtcggcttgtgcaagggctgtgcacagccgccagggggcctggcagtctgaccgacgctatatgcgtggtttgactatccaggtgcagcggtctgaccggccacatagggccggttgtcacatcctgatttttgtttcgggatttataaattatttaataaattattattagaatttatattaaacgttcattaatttacaagtgaacttaaatatgggaaataaaatttccttaatttaaagcatggatggatttaatttgtattaaattctccatgattaattatactctctgcaatattctcggatttttcggagctcaattcctaattttaatcatacaaagagcatttcagtaattacccacatattaaattaatcattaaatggtctaattataatttttaagtactttgagtgtccaagtattttcaggatttttcttgaaattatttgagcattggaagtatttttaacaattcaaagatcatttaagtgattattttaattggaaaagtaataaaattctcctcccttgtcttaggctgaatcggcccattcctttccttcctcttctctccctcctcgcgcgcgtgttgtgcatcccacgccggcccaacccgagcctgcatcctctcttcttctctcagccaaagtccggttttgctccctcttcaaatcaggctgagaaaagaaaagcccggcaagaagtctactttccttccccgcgctactgttcatcttccagctctggactgagccagagccgagccgtgccgtgcctgttggctgttgccgccgatccccttccaaaatccaacctctccgttgctcttattttcgaattggttgcgggaatggaatcctctcaatctcctcttccttgtccccaagaaatccccaaaagtttatatggaaatcctttccaatttcgcggttcaacctttcctttttccggcgaagatctaaactttcccgagtttttcccgtcgttgtgggctcgatcctggccttccatggctatatataggacccccttgtcctcctctttcgtttgccccctctcccgtgatctcccgtgcctcgtagcaccgccgccacgtgctccaccccgccatcgtcgccggccgagctccatccgcgtcgcgccgccgcctccgtcgtcgccgccggtcgccgtcaccaccgttaggtgcgcgggagggtggagaagcccggccgcctgacccccgaagccgccgaccaccgcagctccggtgccaccgccgaccgaagccgccgctagacccgtcgccggccgtcgtcgttcgtcgtttggttcgagggtgagtaccgttgggttcgtctcgtcgtcctctacgtgttcatatcctccaaagtcgcagccgaccatccaatctccggcgaggtcgccatcttgtccggccattgatgaggtcatcatgacgtcatcatcgtttttctttttcctgtttttctaatagattaaatcttcggaaattcataactaaatcatcgtaactcggttttgagtggttcaagttgctaaattcatctaaaatcatgatctacatgttaaaaatatccacatgtactgtttatgcttgtttttgtactgtttatttagtttttattagtctttctcttcgttttgcgtgttagcttgtcgtttccgtcgttgcgaaggttcgtgagtgcgtcgggagtgttcagaagattaattgaagactgattattgcaaggcaagtcacacagatcccaaacaaccctttgagcatgttgatcccgtttaaagctattgtttctattcaactattgcatttattttcgaatgtcattgggtggaattaacctattgtttgttataacccttttgttcttgattactttattccttgataccttgggttattataacttgactagttgggctttatatattggttcagctagatattagttatgattgcttagccatgcttagaaacattaacacactattgggataacttatgactcactattatttaattatggcttaatgatagttcacgatggtcaatcgtgattggttaattaattacttgccaactaaaacttgataatggtgggttgtgagcacatggttttgagagttgtgctcatggcaattaaggaccggttcgcgagctactgttgtgaaacattaaccgtgccaaccacaagctagcgtgggcaacggctttaccttttgtatagcatggttcattgcggagcaccagactgagaagtggcggagataagcccacgggggtcgctggggagtccatgccttgttttataagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagccgggtatggttgttcaggatggttgggcctgtgcaacatgggtgtgttgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgttgagtatatcatatgctcattcttgcaataatcaatcaacctcagttgaagaaaaaggatccagaaggagaagacgtttggcttataccccagttgagctgcctgtgggagtggagctgaagccatcgctagaccgttaattccgctgctgtttttctttttttttaagtatgtaacgttattattatgatggatttgtatattaaattgtcagtttatgtacctcggctgattcctggacgaggattttatgcacaaattagttcgaaaattattagtgaatttccgggcgtgacaccggtctgaccggccggcaggtgggcccaggacttttgtcctttttcttctcccttcttcccctacccgacctaatctcctcccattcaaccatcttcttccccaactcgaaaaaaactcatctctcctctcccaaaccctagccacctccctccatcaaatccattcggtttgaccgcggatttctctccggttacaccgtaagtgattctcctccgcttcctctctctattccatggattagtttgtgtttttgttgagtttttgatccatggcatggaactctaggtgaagcacgaggtgttcttcgatttgcaccaatagagggtagtttcttggtttgattcaactcctccaaccggtaaatcactctccctcttgtgcattctctcaaatcaatctatttcaccctagggctatgggtagttattccaatcttgatgaaataggtccaaccctttgatgttctagttccactcttgtgcaatattgttctagcaatttttagactcaaatgagtagatgtgaaaatttttggatgcttgaacttgtgggaggaggtctgcccggagacacaggcggtctgactgtgggtcagccgccggtctgaccggcgtgtgcgcgcggtttgaccggccgtcagtcgtcggtctgaccggccaccggcaggcggtctgaccggcctgatatcgtcggtctgaccgccctactggctgtggtctgaccacccctccacaggatataggcaaattttcacctctccaaattgtttctagaattattgctaatatctatcatcctttgctctttgacagtgatgcctccccgcactcgccatgatcgtcgtgcacccactccgaatcccgtgagtgagcctgaggaatcgagcggagatgagtacgctcaaagtgatgaagaggttgaggccaatgttgagggggatagtgaggaggaaagtggagatgatgtcagtagaagtggagaggatgaggatgaaggaagtgatgatatatgcacattgatccctccatccagtttgttgtgaacatgaggaatccatcacaatataccatcttgaggcaccatgatcagtttttgaggcctcgggacaccccggatccccgttttcacaccgctttccagaagagtgtgtatgagcaagtttatgcagggaaagcttttgcagagcataaggggatttcttggagagacatcaatgtccagagtttgaggggttgcaggatctcttcaagactgttagcattgatcggattgttactctcaagcaagactacaatgaagatttgatccggcagttttatgctacagtgtgggtggctggagacaatagtgagatgaagtggatgtccgacaccctccagtgttctatctctaggaggcaattccggcggctcctcaatattcgcttgaactttgaagatgacttgcatgaggagcacactcacaatccgctctccatagactacctctctcagttttatgaagatggagtgcggtacacacatgggaaggttgccggcttgaggaccatccccagtgtggttaacaggattgtgagagctaccatcctccctcgccttggcaacaatgatgacattatgggggcggattggcacgtcatcgatgccatcattcagggccgtcagttcgacattgtgtctcttatgatgcaagagattgccatctccaaggggaccttcacttagggaatctattatgccccttacatcatgaggttgattcaagacaagcttggggctgctgggcaaaatttgaagaagcacaagcagtacaagccccgcctttagcttggagctccccgtgctcctagggcggcgccctcctctcatcctggagctagctcaagctcagcacctcctcctcctcctgggtattatccaaatgctttcatccttccacttcatctttttaccgggagtaaaaagataccaaccgggactaaagatcataaaatgctatgggcttttcaaccggggctaaatatgatttttagtcccggtttttttaatgaaccggaactattgtgaattttggccgaccagacaaagatggtttctccagtagtgaaagacagatagcgtatggagacagtcgatggacagagcaatatattgtgctagcggccgaagtggacggggacggtgagatgagtggaggctgcgccggctgttagagcggacgcaacaggtgtatgacggcggaccggaggcggcgttggctagcgacgcggaagccctttcctacgggagcagcgtctcgtcccacgtgcgaagacaagattggaattggaggcgcctcgcccagggtttcccaaaccaccagggccagagttaccatggtaaccgcgccgtggcaaaccgtacgaaaactgtataaaatttatcaaaattttaaattatttttaaaatttatttgaatttaaggagattgccgtggttttctttttacaggaccctccggtaaccctggtctcgcctaagccttcccttcttctggcttcatttctctatggtttcggaggcacagaagaattagggactggtttgggtagctgttggagcccataaatcccaggtaattaatatataattgctctaaggtccaagagaactacaaactaaacattgaattaagcataacagccacaacacatcaaagaggcttactaattaccattaacctgtatacaaaacagaaggttgtaaatttgctttattagttacgaaataatttcagaacattttacactggtacactccaacaatgaaatgcactcacccaacatctaaactactctcccccactgatggaaagtatatcggatatggtttgtgtggcatatattactgctgaaaactccctcccaagtaggcctacaacaataaaagaaagaagattagtctatgcttgccgatgacaatggtttgaaggttgacaaattaagcaatgaattttacaatcccataggaaagtatactacagttatcctgcattcagtcaaaattataacacctcttggggagctctgttatctctctgtcatatcaagttatcaacagcggtgaaaggaacaaccacgcagttgtgatgctaaaataacttttcttgctcaaattttaaggtgctagtgctagtaaaagtgttttccgcatttaagagaagaaaatggatgggcatatagttggattggaaaactttaactatggggtaatttactctacatatttgagaaaactaattaagtagcatatagaaagagctagtttacccaattaatgcatttaaactgactattcattgatgcaaataggtggcattaattgtctggacaaagattctttttatagttcaaggtgaatcaccgggatacataagagccacatctatcctaccatcactccttagtgggctataggaaatcatctctattttcaacggcaaatactttgcgactattctgagctcatagctagtaattcagttttaaaagacagatagctgaatataattatgaaaacttcaataattccatcaaaataggtattgcagaaggcctggatgactaaaattaagataataagttataactcacaatagagaaggatgatagggaaaaggaagggaaaaaatatcctgcagacaaatatacaccatattagcatgcaacccaaaattgagcatattaaccattcaatgatctatcagctaagagaattaaaagtgtaaagaaggatctaatccatttggtccaatgatatatagcaatgctaggataagtatagcagtcgtacaacaaaaatactgaaaatggcatgtagatagtagagtatcgaagcaaatcggatcttcctgcatataaatcatccatttaacttaaaatctagttctattagtgccaaatctaagtcatctagaaactacattaagaactaagtgggcagtgagagcaaacacacaaagaaaaatgctaatcagtaagtgactaaaagcctacctaatgcttgaaatacaaagagcttcaaaacacatattgtctgtacattatctataagagctcctctgacgttacatagcatgcaatttgaaatgtcccatttgaatgatatgactttatgtagaattgcaacacatttttttgctatgacttgtccacataatagaaaaatggtaacataagcatatgctatttttatttcgatgctgaatttgaaaaatagaacatatcagtcggctagttcgtacaattgcttccatgtaggaaaatataatatgtcaaacagtagtgaagtattatcaatgcaaaacagctttaagttcagttaaccaataaatttgaaagcagcaacagtaccaaaacacatatgtcctgacagtataagttggcgatctgccttagtatggatttgtgccctcacacgtgcttttttgcaaacacctagaacattgtccctctgtaaaaagcacattatgcatatcctccctgcagcaagtttagaaaataaattgttgattcaatattaagatgcaaaattaggatcaggggatattcatagatcgatccagatttttatttaatgatggata

SEQ ID NO: 26781 - DNA, 7384 bp, Oryza sativa
cagcgcctaacgatggagacagatacgccctggacgcttcaggagttgggatccggaaggctcaaatgattcgcatgatatgggtaaataccacatctcgagctcgagctcgcagaccatcgagatgatgctatgtattgatgctgccaatatggcaatcgatgtgggacgaactgccattgatgggccgatgacgatggaggaaaaaacctgcgagggcgcaagaagagtgagaagaagagaaggggagggaaagagaggggcacgcacgccatgccctcactccgttgcgtgaggcggggaaccggcgcccggctgcgtgcgccgatgcgtcgccgtccgcccgtgagagggctacagcagcgtggcggcggatgaggccatatgcgagcgggccgcgagcgctgctagggttttggctgtgtggggatatgttgggaagatcttgaccgtctgttgtcctctcatcgatctgatggtggtggaagaaccggcaccgtaggccaggtggacgactggatcgatcccaatgcggcatcgaacggcgccatggtaggtgaaactcggacgtgattaaccggaagaacggggtgtttttggaaaaaaaaaccaatgacgtggcgcccaaattttccagcactcccacgacgtttagagagattaatattttggagatgctcaatgtaacctgcaaatttttttttagaaaacttaaccgtcctcccacagctataaaacatcaaatatgtgtcggcactataggtgccggaagtgctaaaaccagcacctataagccttttcccacttccatgggttgaaatcgcaaaaaacggctctaaataagaaccgacacctattctataggtgttggttttcttaaaaaaccgatacctttaatatattataggtgtcggtaaattaaaaaccgacacttatgaattgagccgagccggtgggcccctccagcatgaggcgatcgataaggttcaactccctcggtccctcctcatccatgcatccactcgcgtcctctctctctctccatccctttcctctctctccctcccttctctcccgcggttggcggctagccggcggaggtggcagcggcggccgcaccctcccctccgccagatccgacggaaggggaggcggaggccgcggccggcggaagggcgatgcggtggcggcgagcggcaggaggatggcggttggaggccgcgaatcgatctcttcccctccccttcttgtccctcctcctttgtgttttgtattatttcctctgtaatttgttgaatatgatctagatgtgttcatggatttgatgcattttagttcatgtgttcatggatttgatgcaattttgggatttaggtattatttgggatcggcttgacggcttgatgcatcggccgatctttttttggttcgtgtgcgtctcaaaggtgctggttttgaagccggcatctttaatctcctgtgatttgtgtcgccttcatggtgccgattaggaaaaccggcactgaagggggtttcccaaccagcaccgaatccctattttgtagtagtgccaagagatatgtactagaaatacctagggatattctagctagctctacaagatggtgagctaaacgacctgagttcaaagtctcatattttctaattatttaatattaggccattctctaatattcgcgtttatagatatctgtacgtgcaccttaattaattggagatgctgaacgtaaccggcaatttatttcgagaaaacttgatcgatcagtgaaaattatgtttctttttttggcctttggtctctggtgaccctattgacagcctgttaaaacctattttaactatcacgaaaaaaaaccgtattgtaatagtggtgacgaaaacaaaacatgcatcaaagattcttaaatcagctggttccgtggttcgtgcactcataaggcacgcaaactagctggtcgcgcggccactttctcataagggcatgtacaacccacagacggtgggtcgtctgcagaaactcgaaattctcatacagatagatataaagacagctcatacaacccacaaacagaggggccatctgtaagctgtttaatgctttgcatgtagcttagatcaactataaatgtatttgtatgtaccattgtgtggctaattgatagaataaatatgaagattaaataatagaaacgcgattacaataatttttagaaaccatatatataataattatattatatatagttacaatgctttttgtctaattttctttgtttccgtagcgttgccatatgtgctcgattagatccttcttaagttgcctatgtgttggtcgagctttgatagccgaatttctacgaagtgcctctgcaaagcttggattagggtcatcatttgtacgcacttctggtgggatcactatcgtcgcacttggattttcattcaaatccaagacatccctaactgagtccttctcatcttcaactatcatattgtgaaggataacacaagcttgcataatgttgataacgtctccttgcttccataagcgtgctggtcgacgaacaatatcaaagcgtgattgcagaacaccaaatgcacactcgacatctttcctcaccccttcttgcctcaacgaaaatgttttatcttccgctgattgaggggcattaactgtcttcacgaatactgcccattctggatatattttatcggcaagatagtaacccatgtcatattgatttccaattacagtatagtgtaccgtaggagattccccttttattgcttgaattaacagtggtgacttgtttaaaacgttaatgtcattctgagaccccgcggtaccaaagaaagcatgccatatacgaagattttttgatgccactgcttcaaggatcatagtaggaacaccttgtttaccacttgtaaactgacccgcccaacctttcggacaattcttccatggccaatgcatgtaatcgatgcttcccatgcacccaggaaaaccacgagcctcattttcttgtaagatttattcaagttcatcgcttcttggaggccgtagatattcgtcaccaaatgtttcaatcacaccttcagcgaattttcccaaaatctccaaacaagtgcttgcagctattttcaagacctcatcaagttgatcagccgaggttccataagctaacatcctgatggccgctgtacacttttgaagtggtgaatgactatttctaccaatagcatcgactctttgggtgaaataaggggaccaatcgctaagtgcatgcacgatacgcaggaacaatggcttattcatcctaaatctcctacggaacatgtcatcggtgtagataggatttgcggaaaaataattagcagatttgcggaaaaataattagcaacaagatcatcatgaccttgttctcgattccttggtatgtacctccttggtccactctgtcgacgtcggcgatgtacagtcgatgcttcgatgcttctctgtccatgtcggccttgaatccctctgctactatttcttcaaaaatatcatcctctacgattaagtcttccacggtgaacacctcttcaaactcttcggcatcttcgacttcatcttcttcgtgcggctccattcaaagagttacgatacaccttgtttgatgcaagtgtttggatggtggagtagtgtacagaggagcgcacagaacaacgatgttttatagaataaaaaaatatgaccattcatatttacaaaaactgatcggcaccactaaactgatcaactactagcattcaagctacattcaaattcagcatttacatttacattcaagtggcacattcaagctactaaaaagatcaacgtcgcactacagcggctaaactgatcaactgatcaactccagcaccacttaaaagatgaccattcacatttacattcaagttcagcattgaatttcagaaaactgatcaactccggcaccactaaaaagatgaccattccattcacattcaagttcacacacacaattcagaaaatcatgcgcagtttcagttcacattcaagttcacaaagcacagtttcagttcacacacacagtttcagtttcagttcacactaaaaatatcatcctctgcgatcagtttcagttcacacacacagtgtcaagttcacaaagcactgtcattaccatttagaaaatcatgcgcagtttcacatttaattggatttcagaatttaattaccaggatacctgaaactgaaactaccaggataccataatttcagaatttacattatggcctatagagcaaaactgagtaagggagaactgaacatatatgggtactgaataagcagaaaactgaatttggctgaggttcatatatggctgggtactgagtaagggaaaacacggcaaaactaccagtatactgaacattgatactgaacatatatggctgaggttcatatatggctactgaatatgcagaaaactgaatttcagaaaaaaaaagcatgaatgagcagaaaactgaacatatatggctgaggttcatatatggctactacaagtgctaaatttaacaagtttgtcacagaatttcagaatttaacaagtttgtcacagaatactaaataagcagaaacttcatatcttcataccagaactggctgaggttcatatatggctactacaagtgctaaatttcagaactacaagtgctaaatttcagaactacacagataagaaataccttctcaaacagtttcaggaaaaagggccttcataagacacttcatcatcatagctcgctgtgccttttcctcatcggacattgaacttgtatcctgtgaaacgaggttgttataagtctccatcatctttgtctctttatcaagcttctttccttctttgtactcttgtgctgtaaggtgggcaatttttgtggcctctagcttctcagaagctatcttctcttgcctgtccaatagcttcatacgcttctcattgtttgcctcctaaaatttactgtatctatcaaatttgtctagctcaataggagaatcctttgagtgaccatcatcactactgctggaaccctttaacttgccatttttagcagctagagctgcctttttagctgccttctgaccaattggtcgttgtggcatctgatcacaagtgtcctcattttcctcagattctccttccagatggaatgctttccttttacgtgcattcttcaggttttcattatatgttttccactttggcacatctcggcaaattttccaaacctctgtcagcatataaggtccaaccacgtctttgcattctttgttgtcatccacatagaacttgtgtgctgcatcaagccacatttcagccgaatatccacttgtaaatactctacgagccttagcgtaagcacattcaaagaggtctgtccatttattaatcttgttccatctatccttgcattgcttcgcatttcttcttcgaagtggaggggtagttttgttgtacgtttcgacaacctcaccccaatattggacaccacccttatccgcaccacaggtaaagtcggttgaatgttctaaccaagcgctcatcactctaacatcctcgtccggagtccacatgatcctcttctcggttctaacactgtcattgccatgtaatatttccacttcgggcggtgaactaccattgtgtgcctgattcagaggactcatgtgaataactgcaccaaccaaatgagagttctgtgcttcatttccaaaatagctcatgaaaccaccaggtggacgtacatcttggtccctgcaggaaattgcaattaacatgaaattttccatggtccatctacaaataaaattcagatgcagtagtagtactattgtggctgtatttatgaagggttagaaggtaaaattagcttaaaatgatttcggcacagaagcttaacatgaaattagcttaaaatatgaaattagcttaaaatgatcagttgacacagaagcttgatgggtatttttactctttaagaacaactaacaaagagtacaatatgttggacacagaagcttgatgggctcatttttatgataatcatttatcagttgaatatctaacaaagagttcaatgaatcacttctggacattgttaaaatatggtataaaagggatccaggtacaacagtatgggatttacagattcacaatgcttaatatcaactacaaaattatctagattcacaatgcctaatatcaactacaaaatcagcaatgaaacaaggatttaccatgatccaggagatgagggatcaccgccggccgcatcaaaccaaggttgagacgatgcatggggaccaattgagctggtgaagtcacctccgacagaaccatcaatggagaaagccgggacggtcgtcgctgccgctactgacccgcgaccgtgtccgcgagaacggggcggcggtggtagcccgacagcgtgaccaaaagaaccccgaccgaatgagggagccgccgccgccgccccgacacctagggttcggcctggggccgtcgccgccgcatccaatgtcctcgatccattccttctccaagctgcgccgggcgtggacatcccgccgcaccaactccggcgagaataccagatggggggcgagcagatggcggccgcgcagatgggcgggcgaagaaatttggggcaagtcgcgagcagagcgcgggagaacagcgcgcgtggttgcctgggaaatttgtgggcgagcgcggccgcacgcgggatccgttcgcccgtcgcctggggatgacggcgctctacagcgcgtgggctcgcgtcgactccacctgggagaacgggatgaactcgtcgcgtcgggaggcgccgggctgcccgtctctgcgcgtgcacgggttttttttgcaaaatcaccaacacacagacggggcgaggagacgggttgtacatgccctaagtcataaagcctgcatgcagcccagctgacctgctgctgtacacgtggtagagagaaacgaccacggtcctcctgttcacaaggttttacacgaaaaactgtaaacagcgcacgattcctctctacacaatcaattaatgttaattacccttttcatatatacagaccatcgtccataatttaccttttttacacatgctaaactaccaaaatgggcatgcaaatatgcggactaattaatcatgacatcagcctcatttcaggttcacagcttgccatgcaaaacatgcagagttatatttattaacattaaagaatattcagtgaaaaaaacattactcaatctattgtactgtttgaactcatgac

SEQ ID NO: 26782 - DNA, 11801 bp, Oryza sativa
ttattcaaaaaatttatgcaaatgtataaattataaatcacactttaagtattatgagtgataaaacaactcataacaaaataaattataattacgtaaattttttgaataagatgaatggtcaaacatatgagaaaaagtcaacggcgtcatctattaaaaacggaagtagtattaccatgtcaactggacacaaaatgaagaacatatacaccaatttgatcgcagtgaccaattctaacgactatatatcgatataatcgtatacaaatacaattgtatatatggaaatagagatatgagttgtataaaatctatatttaataaaaaatctagcctaaaaaatccgctatatttttatttttaatccctttgacgaattatacaaaagatgctctcaattcttttgtcgatctcacgccaagccacatatatgagttcaaagctgaagttaacacgataggtagcctcgtgctttttctgaggcgacaaatatcgtctccattggtctgtcagtaacaaaaaccctctaattaacaccctttcatcttgtactttaatttcacctcttcacacaaactgtatatgctgtcttttacttgacttgtagtgcaaccttccactgtcacacatgacgcctccatctgcaatggcatcttaattaatcatcagtaactccaatttccaaatagcacgtacgcatgcatgcgtccatgccatctccttcatctgctcgatcgatcactctcagatagattgattgattttactatctcgatcgagttggtcgccaattcgccatggccagcagcctcatcaacctcctcctcacggaggtggcggccatcgtcagcatcgtcctcctcgccctcctcgtcgtgctcagctcctaccgccgccgctccggccacccggcgctccgcctcttcgtctgggcggcctccacgctcttcctcccgctcgtctcctacgccgtctccgccgccgccaagtgggacgccgcgcgcgtcccgctcctcctcgcctggaccgtcttcctccagatgctgcgcaacaccatcgacaccgcccgctcgtcctcgtccacgatcggcaacggcagcggcagcagcaagttcaggccctccgtcgagcagctggcgaggatgggctgggtggcgttcctcattgtcagcagcgacggcaccgccgggagcccacagctcaccggggtgctcctgtggctgtgggtgctcagcctcgccaagctcgtccaccgcctcgttgccgccgagctcgccaagaactcgttcgccgtcggccttaacgcctacctcatctccgactacatgaagcagctgtacgggcaagaccaaggagaccacgacgtgcaagctcctccgttgttggtgatgggcgaggagaagctgcaaatcgaggcgaggccacaggggtaccgcattggccggacatcgccgccgccattgtgcgtcgacgccgggcatgtggtcaccatggaccggatatgccggctgttctcctccggcgatccactcgtcgcttctaacccgcagatcaaggacacatgcctctcgttcgccctgttcaagctgcagctccggcggttcgtcgggtgccccatcgccgaggcgggctctcgccgttcggtggcgttcgtgctcgacggcctcctcggcgagagccacgagcgggtgttccgggtgatcgagaccgagctgtccttcctcgccgacttcctctactccaagctcaccgtcttctacgcgagcgggtggtggttcccggtgctcaactcgatgctcgtgttcgccacgtgggtcagctgcctcgccgccggcggcgccatcgtgcacgacatgacgtgccacggcacgacgctcgccagcaactacgacaacctgagggagtacctgcagaaccacgacaccgtgttccacatcatcgtcggcctcgacgtgctcgtcaccgtctccttcatcgtcgccatcgtgttcacggaggggtgggagatcgctacctacgtccgctccgactggatcaaggtgtccgccatctgcgagtacgcgcgccggccgtcatggcgcaagtcgccatggactcgccgcaacgtcggccgagttctcccgctcaagccaatgcagcgctgggacgatcggttcgggcagacgtccatcctgcagctccgtccgtgctactgtggctgcgtctcccggcaggttgaccggatcgccaagtcgtcggccactgtgccggcggcggtgaagacggccgtcgtggacacgctaaggacgaaccaaggaaacctgggaaacggcgtgctctcgttgcagcggaacggcgtcgccgacaagctcgcctgggcgtgccaccacgccggcgacgagagaagcgtctccgagcagatcctggtatggcatgtggcgaccaggcttctcgagatcatgcgatcagaaggcgctcacgggagacacgacgacggagacggcgacggcggcggagacagcgacacggtggtcgtcgcgacacggctgtcgcggtactgcgcctacctggtggcgctgaagccggagctcctgccggaccacccggcctggacggaggagctgtacgagggcgtggtggaggaggtgtcgagggtgctcgcgcggttcgcaggggcggtggtgcggtacgagcgcgcggcgacgtgcctcggcgggagcacgaacgcgacgctgaggaaggcggccaagctcgggcggcagctggcggaggagctcggcggcgacgaggagttgccctggagggtgcttgccgatttctgggcggagctcgtcgtctacctcgcgccgtcggagaacgtcacggcgcattccaaggcgctccgccgtggcggcgagttcatcaccgtgctgtgggcgttgctcggccacgccggcattgttagccggccggacactgacgtctgactgacagtgtgagtgtggtttatggcgaacacatggttttctttccgcttttgtcattgtgtataccaaactgtcgacatgagatgtgtttgccaaactgtcgacaatttatttctgatttgcaatagtaaaacagtttccaatcctttacgaacaagaagcagaggttctttttatgaacaccgaatgatgttgcatgatcttctttaaaaaaaaaaatctataggcataaacatgaaggaattttgctagacatctccagccaggtggcttgaaaggcaaggccggaatctgtcatcacataagcaaaagcttctctggtcagaaaaccaggttgttgcacgctgcattgcgcagctgcaatgcaatcttgagacagaatcatgtgccgagtcgaaaagcaacgcaatgcaagctacctgttcagccagactaggtggctagcttttatcaccaggcagggggcatctttatctttcaggttgtctgtattgcctatatttttttttatacccaagtccctaattcaagggcaatgtttatctcttggtgcagaattctaatatctcagaagagctgggcttaccctttgatgtggatttgaggatatcagaagatactatgaggtatcaaattttgtagcataaattttgatagcttcacatacctcccaaaaatttgacaaagttggccctttcatcattgataaggacgttgagaaaatcctggactaggagaacagcacaatgaagcaagttgaatcggagatggatttaaatcttccgggtggatgtccacccgtttattgcatgcatgccaactaaatggttttgaaaaaaatttaaaaaatttgacaagatagattaatgcataatatataggcaataaataaaatgtaacgagtttacatatatttgcagaaaatttgtaattttgttaaaacttgtagaaaatgtttttgaacttgcatctttgtggaatgatatattccatgcttgtggatgctatagcaaactaggcagtgacccaaacaaaaataatcctctggtacttgtggaccttgttaggtcattcacagggcacatacgtaacgtgtgacaatgttggttcacatagacaaattgcttgcgtgtaggagagaggggagtggggaccgctccttcaccggcttcgcgtgaccatagttggtcactagaacctcccactcttgcagcagttctcgatcagaaaaagtggtcatctgcgcgtggagagagagagagagagagaatgggggaaacaaaagtgtctgactgaagagaaaagccggataggggtgcggaggtggtgaagtggcgacgagtctgaccccaacgaaggtgccctcgccggggacctcgtttgcccacgcctcccacctgcttcgatccgcgccggagaggggagaggagtaagggcgctgagcgaggaaaccggaggggagatgaaggggcgatggtgcctgaagcagtgaggggaggggcgtcatcggcttgatctgccccatccggccacgctgccagcgagctcgtcgcccgcaccaccaggtcctcctcgaccgccaccgctgcgtggatttggggtagccaaggaaggaggccacaaggggagagaaagagtggtggtggccggagcgggcgagggaggggcggttgtggtgggcggcggggtggctcgatcttccttgcattgccacgcggtcgtgccagcggggagctcctcaaccgccgccaagggaggaggccgaagggaagagagggaagggcggttcagtggtggtggctagagtggtgaaagggggagaggagagcgtcggtttcgaggaaagggagagtgagagagagaagggggaaggtggaggaaaaaaagggaaaactatttttgtggaccccacttgaggttacaacattgtgaaccttgtgtctttcaccattccttagcctacgagggatgtgaggtccggcaaacacatatgccacattgctatttctattgcccttattgatcattcagtacaagttgatgtagcaagatcagaaaatgctgtccaagcagatatggaggtagagtttcatcgtagcaagcagcggttcggatttttgaaatggggttcaacacttcaactgcttttagtaatatgcttagcttgtcgttccacctttaataaaaaaaaagcttgttgttccacctggatctggaattttgcatcaggtgaaccttgaatatctgggcagacttgtgtttaacaatggtggtgggatcctttgccctgattagcagaattgccgtacttactttgatacaggatttaaaaacttcatatgatattacatgttaaaactttgtttggttaatctcactaacaaggggattggaggagaattaattccacacctatccccctcaatttcctttgatcccttcttcatgggattaaccgcacaagacttaacatgggtatatggctgcattactatatattaagacgatatataataattttgtactttgacttttaacaataaccgtaggtagacttttagctgatcttaataatcatgaaaagagattgaaaaattaaaattgcccaaaaagctcttagatttattctagaatcaaataatacatttatgtaactacccacttttatttgcttcaaacaaaagctattcttgttactctcttcttttaccttttaactctaaggagtacatatgagaaccgatagctggccaaacaggtggcctggcccaatgcggcatgagtccactggcaacacaacccgctttagtacaattcgttaggcacgacacctgtagcaggctatgctatgtcggcctatgtgccaaggccacggcccaagaatagctcaagaagacaccgtgttgtgctgggccatcacagcacgactactgttacggctcgtgggtcaatgacaggcccaactgtacatatgacctatggaaattgaaatttgaggtggaaaaataaaaagcgaaaaagaaatagtgaaggtggaaaaataggaaaagtagtaaaaaggatggaaaataatgagtaaacatatggaggaaatgggaaaaggtaagggaaaataggaaaaatatgactaataaaaataggaaaaaatggaaaattaggaaatatatacagaaaaaatagatgggccagacaggtcgtgctcgtgcttgcccgtagacaaccgtgccatgccagcacaacccacaggccagtgtgccgtgccatgtcgtgtcgtgggctggtacaatacagtcatactctagtcatactctggcctagcttggcatgacccatttggccagttatatgttattgataagtgtggtgatggaagtgaaccattatcttcttttaaagaggtataaatcgcgttgtagaaatggacttacgcacaaactatgacagatggccttggccggtgtttctgatgggtgagttgatggtataaaggcagaagctgcaatgcttggccatgggcagccaatgagcatagtattgtcagggcttgtcggtttcaagttagagtgacaaggaagctgaggaatacagatttggtcctagcagggacatttaactttttgccactcgcagtatataacctgtgggttctcatgtgtctataatacgtgggatcaatgacaaatctttaattgcgacttgtaagagtggcaaataattaattattcctaactcgggaatgtttacttcaggctgataggaaacatggtgttttgtcggttaatttgctgaattttacgggggaggcatgagtgaattatcactgcaggttgatagggctacaatcgcaaacatgggattcgaatccaattgtaatgctgggagctgctatagttgccaaaatggcttgcgaattaggccttgaggtcaagccatggattaagacaagtctcacaccaggttctggacttgtgaagaactatggttgtactacttgcttaggaaattctggagaacttgatatgtatctgctgcaattgataacaatgatattagagtaaattttataaaactacatgtactttacacgatcttatcataaaactacagatttagtatctttgtttattacaaaactacagatactttacacaatatatcacaaaactacagatttaagaacttgtttcacaaaactatatatttagtgtcttcatttattacaaaatacagagttagtgttttcatttatcacagaactacacatttagtatcttcatttatcacaaaactatagatttagtgtctccattatcacaaaactataggtttcaacaatgctaaaatatgtagtttgtgataataaagacattaaacctttagttttgtgataaatgaagatattaaatctatagttttataaaacaagtttttaaatatgtagttttgtgacaaattgtacaaaccaggaattgaagaggagtgtgcacatgtgtacgtttgtactatatttctaaaaagaagaaatatgccaggttttttacgtaatgtcgtgatatcttttgtatgggggtgtataatcgggcaatcactcgtctggaaaaatgttttatttatcagtgtgaaacacgcaatcctcgctccgatgatgctccccaagtgcatctgaaatcctataatatttaagtttttcatcggtgcctttctatttatcacaaatactgtagtaatttgaggacctatttgtccattaaacagcaaacaattaattacaggtgctccaagcaaacaacttttaaccccaaatctaatgcattgtcactatacatgtacacttgtgctacaataaagtcaaagcgaaaaccacatatataaatctattatgtacaaaaacatgatacttgagtactattgtactcaaccaaagtttatcttatgagcgctggagaaatgtttagccgccctgaccatctcgccagccgcatcataccctgcgcggccaccggcggagccagagctcgccaccacctttgagcccaatcgcgcgaaccaagacgccacggccaaccacaaactggagccggatttcctcttcttgcctcccatgactaaacagttactacaaaaacgactgtgtgatcgatgaactgaaccacaaactggagccggatttcctctgctagtttgtttcaactttgatgagctactgtgtcgttgtgtttcttgtgctgttctgttggaagagtttgcagctggaggcttttatatagcattggaggcttggagcagaggtatgcatatgctgggacctgggtcctataagctttcttggcagccaagctgcaaatgaggagagagagtcagagagtccacggttgtgccgtgttctgcattttgtgccgtgttgtgcattgatgtcactctcgcttgacctgaaacatggtcatggtcattgtattcctcatcagtttaaatttaacccaaagcaggaaacgtgtactttgaattttgtgtattaccccctgtacatcttgacataagtcgacgttttttttttccttgtctttattgatacaatcatatatacaagctgtttttattttaatcttctggcaacatgctaatcatggcatgcttaggaatgttcctggatagctgcttttgaagaagaagctatttatcagacagtgatagggaagttagttacatggtcgtttcatcaccgtggcaccttcttcagagaaactcaccgattcctatagagctcacatgctttgaccttttctttttcatattgtaaaccttacatcgatttcttagcatgcttgatttgtgacgaagctacactactagtgtggttttttttttgtttgtttgcattggtcggacaagacagaaacgtaagaggagactgcttagagcactaacaatagtagacactatatgtgtatcatgtctatactattaatttaatgacatagatactactgtacaaactatttgcccaatacaacatttcttacgtgtgggaccaaataatacaaactatttgcccaatacaacatttctacgagtgggaccaaataataagatcttcccagtacatcatttctacccagacaagaaatacgagtctctaattatggaccaagactattcactacgccggaccaggtcatctctgacgggcccaaaccctcacctttaacgggtttggtcttggtcagtgattagtggtcactgatgacaaaatcacctgtgacggatgaaacacccgtcacagataacccatctctgaccggtatataagtcatctctgatgggttaaaacttgtcacccgtcacagatgagtcatttgataatatgagtcacagataagtcatttgataataagatgagtagttgattaaaaagtcaacgacgtcatacattaaaatatggagggagtataacaatattaatagcttgtcttaattatgacatattgtatcttattaatttctatatgtaacgcatgaaatcccaattgtatcttgattgttgcctaatcaaatccccattgattctatttatagtaggtaatctgaataataaattcaaaatttgcagagaaaaaatgaatggtaattgaaattcaaaattggtgcaaaatcatcataggtggctaggctaagtaatctaccaacgaaaatgatttctcatagataattggttgcccgctagcaaaaagatccattttcccggcctatgttatctagtcacaagcggcgcggctggcctcctatgagaaaatgttcttgttgcccgcgttatgccaatttataatagtgagcaccatccacttccccttccctttcttgtgaagggatgaccatgctcactagatctagcagccacggcctccctggtggagaatttgatcctcggagccgagaatgaacgcaaggggctagcatatatataggaggctcctcgttaatgaagatgtcgaccacactggtggatttgaggacgtgccaacctccgcagccacaagcccgctcctcgatctaccccttcctccctcccccccccccaaccaccactctctctatatgaaacgtatagttctttttttagaagcttagggcggccatagtaatcggtggatccaggccatggcagctgacggacccgagggtgaggaggcaacagtttctaccgatggatctgttggctcgatgtgatctttgttgaattcaagttaatatacgatttgttgatttatggtgaattattttgttgtgagttgatgcatagttgtggataatttgttggcttgttatgaagatttgttgatacatagtagtggaggattatttgagttgatgtatatatagttgtaggttgcgttgtacgatgatgttgcttatctgttgaattgagtttaaatttaatgattctagttggtgtgtaatagctgttgcaagagaaaatttgctgaggcttgagcccatggctgtactcagtttagaatgcattttctcaggcagggtcagcggcagcgcaatagttcctgggtaaacaaaatcgtttgccataagtcaatatttcggatttaagagcccaattcacatcttcacctggctctttctattttattcgaagtagaaacttcaggacctatttgaccggcccttaatcgaacacttctttttacaaattaacaacgaccttatgaatcctaaatatatacacatatgtgtgctacagtaattgaacagataataattctattatgtacaaagtacaaacatgataacatgcaccattaacagttaaccaaagtttatcttgtgagaactggagaaatgtttagccgccccaaccatcccgccggccgcatcatacccggcgtggccgcccgagccggagcccgcggccgccgcctttgaggcgcccaagcacgcgaaccaagacgccgacgaccagaaaccagagccggatttcttcttgcctcccatggctaataatcaaattaacacgaggggaattaacaaagctagctcaactagtacgtaagtgacagtgtgtatgtcttattaatgctcgcttaaatagcttagctacttgatgagcaccgatcgaactgactacggaatgtttttcttttgctgaaggagttgcagttactggaggctttatataggatgcatgcgagcagctgaggtaattaagctggaagctgcacacttgcttcgtgcttaattacttgcttggcgaccaagctgcaagtgagagaatcagagagagacctgcagtgttctgacttctgactctgaggatcgagagatgatcttgaattataatgtcgctatcacttgacctgaaacttggtcatggtcagttaatactcggtatatatttagtttcacttaaatcaggaaacgtgtacaattcaaattatgcactcttgtgcacaccttggcatcgatggacacgttcgaggcaagagcttgctgaccaagacatgcagacatgcatgcactaggaatggaccaggatagctatctgctgcttgttcaagaagaggagctgtagtgctgtactaatataattaacgacgatatcaaagagtgatagtactgtgataggaacgttagttgtttccttgattttaaaagcatatataaataggcaggcatcagcatcaccgtggcagcttcttcagagaaactcacccgattgataaaatgtttcacatgcttaactgcggttttcttggtatgatgacactacgtatattatatatatatgtgatagctagctaggtagatagtcaaagagaatacagtttatttgcatcatatccactc

SEQ ID NO: 26783 - DNA, 13720 bp, Oryza sativa
gaagaagtcaaaataaagcgtggtttactattgacttagtattagcaaggagagccagttaaccacgacagcttttccatgatgggcagctctccgaaactttcctacacctgagagaattaagtaactttagcccaatcattttatttgcttcgtacactgacaacacatattgtaaagtttttcagaaacaagcagtaaaataggatacttacgtacctctgacccaaaatagttgtcattttgagtttttctttgtaagatttgaccattcctcttattcaaaaacttatggaattattatttatattttgtgacttgctttattatcaaaagtactttaatatgacttatcctatttttatatttgcactaattttttaaataaaatgaatggtcaaacgttgcaagtaaaaagtcaaagcgaccactaatttgggacatagatagtagaaattaccaaacgatcgtgcttcctaaactgatcagttgattggtgttcatgcccagaataattacgagtactaagaatatgacattcgattaaatttgagaatatacatgacttggacgggtgataggacgatgatgggatagtgttttccccgatgcaagtagccatgtccggtcaccaaggacggaacatgttgatgtatattcaagcaccctacgtacttccacttgctaggcatgggatggcttatcttagtaccgagtgaagttgtggttatctatgcccattcgtcattcgtgtgggatgtttcccttggaggtacccatgcgtgcataggttggtagggggtatctcccacgatggtaatcctaacttagtcacacgcacatgcccacggctaagttatcgagggcctatgcgtggtttaggtggttggggctgagcttgagaaaggatatgttatgagcttgaatcacttgaaggtcacacctatgtgcgtgtgaagcatttgatcgagtaagactattcgaatagccgtgttcatggttacaggatgatcacttgatgtattagtcagtttatgttagcatcaaacctgggataaatggtgggtattagtcacggttaatcttggtggataagtggctaatggttgcttgagcaagggtggtccatggacgatgtttagagcctgttgtgctcatttgttgttcacattcagatttatatacttgttgtacataaatttcagattgtgttattttgcaaattcttatagttttaacttattacttgctcaacaaaacttgctttgtgcaaaatctgaacccttatggtcctttgatatacaagcttatatattcctttgtaatattatatattgtgtaagtcttgcggagtactatttgtacccatgttgctatttttaggtaaggataccggtgactttgatgtgtcctactactatccagccaagggtggcgagggtagtgagtagctgagttggttgccttgtgggctattggctgaccatgggttgagacttctgccactatatttgtgatgtatgaagggcttatgaaccctattgtgtaatatttaccttgttgtgtgtttaattttattaaatacttgttatgctatcaattgcttgcagacgaaagtgccaggctagtcgctttttcctgggaactagctaagcatgagtaagtgttttgagtaattgagatgatcgtggaatatagcgtttgaataagtcctttgagatatataacacatttggtcgccaccttcgaatggtttgatggggcatatctttggtcgaaatcaactaacaagctattccatcgaatatctctcttactcactactcgatatcgtggttaatatattgaaaggtgtcaactacgatcatggatacactgaggatgagtgactatttatgcgagtatggatcccactaatccaaatgcgtgtggtggtcacgttggacactagactgagagaagttgatttgctctctctctctctctctctgaaaagaaacattgacatatatgtttcttttttttagtttctggcctaacattggaaggagtctttcttggaagcaaataagtttatgataaaaaaatatttatcatcttttttccttaaatccttccatatgtaaacttgatttagcatctatatctctcatacatcattactcacttttcatcaaattgtggagcaaaactatctttggaagcatttatcctatatcactttcttttctccataaatgttgcaaaatggttgattccgtcgctctcacacacaaatagttgtttttcaatagttcttgtagtctaactttgggagttactccattggcagttggcacactgtttctgcaaattttgggcatgggaaatctttttaaaggtttgcttttaatggagaaactgatcatcccccctcccccctctctttctgccttttatgtcgccctatatataagggtaccaattaattccaacttttttattttatgtagttgcaattttgttttagtactgaagtgcaattaggtttataaatttttatctataagaaattttattggccctatatttcacacttttccccataaattatgaaaagggtcatttggcctatatcggtttcatatatgttcacttatcatacaagttggcaataagagaaatttcatgatctttacttaatgataccatattttttaacataaaatttggtatctctgttcttgaagtgttgatagacaccatttttacaccaaaaatgttacctacgcatggatcatatataaaatcactcttggaagaatgttttctttgaagcattgttttttttaaaaaaaaagatatgtgatttgtcctacatcacaataagggagatttgatagaaggaaataaaatagacgcccctaattaaatgagttatggttgggactgagaggtgtttggagggaaaaatagcgctactctatttttttagacaaatttaaatagtattagggactgagggagtagtttacttgctccctctgaaaaaaacacatatgtttctcattttttaagtttctggatcaactttggaaggaggctttctttgggtgcaaataagtttattgataaaaaaatatttatcctatactgcttacttttttctataaatccttccatacataaagtagatttagcatctatctgtttcatacgttactcacttcagttccatcaaattgtggagctaaattatctttggaagcatttatcctatatcactttcttttctccatatatcttgcaaaatggttggatttatttttctctctcacacacagacagttacttttccaataattataatagtctaactttggaagttagtatctttagcagcactttacttcattggcacacttactgtttccataaattttgggcatgggagatcttttcaaaggtttacttttaatggagaaactgatcacttacccactttttctcccttccatgtcgttttatgtagtagcccattttacagatttgaaatttatatagtcacaatttagttttagtactgatgtgcaataaggtttataactttttgtctataagaaattttgctcgtctatatttcactcttttcttcataaatcatgaaaaaggtcatttggcatatatctctttcatacatgttcacttttcatacaagtttgcaatacgagaaattttacgatctttacttagaggtggcatattttctaacgtaaagtttggtacctttgtacttgaggttctgacagacaccatttttacactaaaaatggtacttactcatggatcattatataaagagtgaagtatattagcggtctctaaacttctgccggtgtatcatctaggtccccgaacttctaaaatacatttttaggtccctgaacttgccatgtgcgttatataggtccaaacggattctaacccactcgatgcgctgacgtggcaatgccacagtgacacctacgtgttagtggaatccacatgtcaagcatatatacaaaataaaattaaaaaccatattttctcctattaggtagacagaaaaaatataaaaattctaaggtagagaggagaaaatatgtttttctacttatatttttttctatgtggctgacacgtgtgtccaactaacacgtatgaactatcatggcatgccacatcagcgcatggaaggggttggagctcgtttggactcatatgacactccaaaacaagttcgagaatccgaaaatgcattttgagagtttcgggatctagatgacacacccacataagtttaaggaccgctcgtgcacttcactcttatataaaatcactcttggaagaattttttttaagcattgtttttttacagaagatatatgatttctcctacatcacaataagggagatggagggtaagaaaacaaaatagatgccccttaaatgagttatggttgagagtgaaagttggttggagggaaaaatagtactgctctcttttttggacaaatttgaatagtagaagtgcacttatcagggacggagggagtagttgacttcgctctctctcaatccctctaaaaaaaccacacacaagttctctctttttttaagtaaactagaaaaatgcccgtgcgttgcaacgggtgaaggctattttaatcatattattgttatatggtttaggtaaggtgaaattcactatgtcaactcgcttggatgtattattttttaaaatcatgagctgcgattaggagtctgatagtctcaaattaacatgcgtgtttttttaaagagatttcttatacgactctttctgtatttccaaaaacgaatgaacttaagaatcaactcaaatacagacatgtatttcaaaaagcgaatgaacttaaaaaccaacttatacacggatgacgtaccaaagtactagcaaaaacatatttgattttttataatagcagagagtagagatataatctagttaaggtaaaattcattgtgagaattcgcttggatatatagttttctagaaaatcatgagttgcaattaggagtccgatcatctcaagttagcatgcgagttttttttaaaaaagagatttcttatatgactccttctgtatttccaaaaaggaacgaacttaaaacctgactcaaatacagatatgtattttcaaaagcaaacgaacttaaaaactgactcatacgcagatgacgtaccaaagtactggcaaaaacatcttcaatttttataatagtaaagatttcacaaaactacatatactttgaccaaattatcacaaaactacacatttagagtgatatatcacaaaactacaaatttaacactaaatttcacatagaactacagatttaaggtagagtatcgtaaaactatagatttagcaataaaattatcacaaaactacaggttcagtgataatttaatcataaaacttacacgtgtataactcaaacataacactagtgctaaggatttaaactctaaaatatgtagttttgtgataactttgttattaaatctgtagttttgcgatactccaccttaactctatagttttgtgataaatttagtgctaaatatgtagttttgtgatacatcactataaattgtgataatttgatcaaagtatatatagttttgtgaaatttactatatttttttttcagtttctggactaactttggaaggaggctttctttgggagcaaataagtttattgatagaaataaatttaccctatacttcttacttttttccttaaatccttccatacataaagtagatttagcatctatctctttcatgcgttacacacttttcatcaaattgtggagcgaaattatctttggaagtatttgtcctatatctcttttctctccataaatcttgcaaaacggttggatttatttttatctctctcgcacacagatagacttttcaataattctagtagtctaactttggaagttaagcatctttagcagcacttaacttcattagcacacttactgtttccataaattttgggcatgtgagatcttttcaaaagtttacttttaatgaagaaactgatcacttccccacttttcctgtctttcatgtcgtcctatataaaggcacaacttaagctgtcatctatcaccaattcatagcttccaacattttcatttcattcgtaatcaggttttccacagggagatggcaatgaaggtgtatgggctgccaatgtcgaccaatgtagcccgcgtactggtgtgtttggaggaagctggggaacaatatgaagttgttccgattgatttctcaattgctgagcacaagagcccagagcatacttcacgtaatgtaagttattcttacaacttgttctctccattttttttccatcaattttcatggacaaaataacttccatttgtctgaacttttggatcaatcgactatgttgatttttcatgattccattctctctttttccccctcatacagccatttggtcaagtcccagctcttcaggatggtgatttaattctttttggtgagatttttttttcttcccaccatgcaaagtcttttttttcggagatgtttttttttcgcgagggaatgttttatttcttgcatttaccaaaatagttatgaaaaaaattaataagatagatcaatttatgatatcgcatatgtatctatcatcttatcaaaatattttttaaaaaaatattcataactattagataacaatgcaaagaaagaagacattccctcgaggggaaaaaatgctttcactacttttttttcgttcttgattatttttaatccatacaattttacactgtttcaacagagtcacgtgcaatttcgaagtacgtgcttcgtaagaacaactctgaactcctgaaggagcacaacctttctgacgctgccaaggttgatgtgtggctggaagctgagtcacaccatttcgatgagcccatgtccgtggtcatctaccaatgcctcatcctccctgtgtatttcggtggacaaaccgatgcgaaggttgtggaagagaatctggagaagctcaagaagacatttcaggtgtatgaagagcgtctgtgcaagttcaggtacttagctggagacttcctgagccttgcggatctgagccatttcccaactgcgtactacctgctggccacccctcatgctgctatgctcgatgagttccctcttgtgaaggcttggatcgatggcatgttggccaggccgtctgtcaagaaggtcatagagatgatgaaggcaactgcctagaaaaaaaataaatcgtgttgcttgttgtgatgatccttgtgatctctctaaaatgatgttgtctgagaggaagtgattgaataaaaacatggagcaggaattatgtttgggcggtttgcttcataagtacatgaatgtgttgctttgtgaatcgaaactccatggatttaagctaaataattagtttaacaactcaattccccaattctaacattcccagtgaatatgatggctgttcgaaggagcatctattaattgcacttgtttggatgttaaaaaaaaactattttagcaatcatactatcttgccgtactaaagatttatctccgcaatgatttgttttcaatggcgctagacctagtattaccgttgttttacaagtggtggcatatgagagcaatctttggtgtgcagtcggtgtcaaagcgctccatgaacttctatttaggtcagttggctcagctgctgacttgctgtgttttcttgcacgggtactatataaacaggatagcttcgattctcgatgtacctatatggcacaataaaccatgtggcttcatctattctttaccaaatcttgttttatcatggatgctatcaaatttaatacaattgataacctttttacttgctgtccagtggatcttggtgtgtgctcgctgtgtccttcctctgacatgaacagagctggtcttatatgtaaattgcatcagacatacctttaccctgtatctcaaattgcatcatgatgttcatcacagcagcaggatcccaaattgcataagacttgtctttgactcggtgtaaattcaacttctctgcattgtctcaatttgtacccaaaagcttttgttctatcttcagtgagtcaaattgcctgttctttctggttaatggatgaatgaattaaccggcacgattcttgaactcctaaccagtactattttttgagaaaaactttctatatacgaatttcttataatactgttttaaatccaattttctactttatagattcatttgtaccatcaaataattatcccaaatcattcatctattcagccattcattacaaaataattcatataattatcacaaaagaacacacaagctcttcatatttttcagtctttgtgaaccgttctcatccaaaacgcctgcatattattcccacctttgcaatggggtgttttgagttgacaaaggatttgtgcgatcagattagcaagatgatagcgaagtactggtggagcaaccaggagaaggacaataagatgcattggttaagttggaataaattgacattgccaaaaaatatggggggcttaggtttcagggacatttacatcttcaacctagcgatgctagccaagcaaggatggagattgattcaggaccctgactctctgtgctcaagggttcttagagctaaatacttccctctgggggactgtttccggccaaagcagacatcaaatgtttcctatacttggagaagcatacagaagggtctcagagtgttgcaaaatgggatgatatggaggatgggagatggatcgaagattaacatctgggcggatccctggatcccgaggggatggtcaaggaaacctatgacacccagaggcgctaaccttgtgacaaaagtggaggaactgattgacccttatactggaacttgggatgaagatttgctgtcacaaactttttgggaagaggacgtcgcagctattaaatccattcctgtgcatgttgaaatggaggatgttttggcgtggcactttgatgcgagaggatgcttcacggtcaaatcagcttacaaggtgcaaagggagatggagagaagagctagcagaaacggatgccctggggtctcaaattgggagagtggggatgatgatttttggaagaagctctggaaactgggtgttccaggaaagatcaaacacttcttgtggagaatgtgccacaacacgctggcgttgcgtgctaacctgcagcatcgaggtatggatgtcgatactagatgtgtgatgtgtggccggtataatgaagatgctggacatcttttctttaagtgcaagccagtgaagaaagtttggcaagctttaaacctagaagagttgagatccatgctagagcagcaaacgtcaggaaagaatgtgttacaatcaatttactgtcgcccggaaattgaacgaacaagtgccatagtttgcctttggcagtggtggaaagagaggaatgaagtaagagaaggaggaataccaaggagcccagctgagctctcacacctgattatgtcacaggcaggagagtttgttaggatgaatgtaaaggaaaaaagccccagaacaggagagtgtgcagtttggagacggccacccctgaactttgtgaaaatcaacaccgacggagcatacagtagtaacatgaagcagggaggatggggttttgtgatcagggatcagactggcgcagtccttcaggcaggagctggtccggcagcttatctacaagacgccttccatgctgaagttgttgcctgtgctgctgcaatcaagactgcgagtgaaaggggtatgtccagaattgagctagaaacagactcaatgatgcttcggtatgcgattcaggataattcctttaacctttcatccttaggaggagtgattcttgagattaaacatataattttgagctgttttcattccttctctgttagctactcgccccggagttgtaataaggtggcacatgagcttgccgcgtatggttgtaatctccagaccgtgtcttcctgggcaggctgcccgcctggtctggaacggctggtatccagcgattctgctggtttggtaatataaatctctcggtttccctcaaaaaaaaacgcctgcatatttcattcctcacttttcagagaagccacaaccacaaaccagcagcgtgaataatgtttattacggagtaatcactatttccatcagctgacaactttcgatactgaattactgatactcgttcagtctcctgcatacacattacagataagtactgtagtatttttgcatctatgtcatttctcaattactcctagtgccctccattgctgagcggtggaaccttttttttttttttagagaactctgagcggccaatctatccatcgttgtcctctgcgccagatttgggtgccactcgacttttgggtggtggatctatcacgaacagtagtaaccttctgatttgccttccttgaacctctgccagcttcaacttaattatttgtttctttccaaaccagcctccctatagatcagtagctgcaataaaattgtaaacattagccatgtgaaaagtatatcagaaaatttatcttcatatgtagcttcataatattgtataaatttacaatatccaccaacataaaattgtagaaattaatcaaaattactggtaccaggatggcatgtatgtgtaaacagtgtaattttcatttctattatttatacaagctctagttgaataatacaggttacctcatagcaggtagcaccgtggtagagcagattcttgactggaattcattcaacatggcaagggaatacgcgatgcagtgagatccaaacaacgacagtatgaggttcacttcaatctgattcttgtctgtgttttcccactgttgtagttcactgttaggaaaaccacatcggaggcctatcagctggtgcagaactcaagtacatgatactgatttgaacaaagttttgaagtttgaattggaccagttgaaacctttaactccaaatggctataagattgaaccattcaacgagttaccttactttggttgatcttttcgctatctgttaacattcacttcatagtttcatgtgctacttttgacctcattattctctagcaattcaccacgtcacacagagagacctggccgtggtcctctccaccaagatttctccatactgtgcggcatgctagcattagcaagtcatgcacccccaatggcccttccagtgagatttagtgtacgggttgaattttcagaaatcagttcaaaccatggaaccagtatgcctcagcaccctttttcttcccaaaaccggtaagcaggagctttattcatgaaatagcactacagtcatctcagagcgaactcatgcttcaaggcacgtcaatgctcatccggcactgggccacaaacaactgacagattagcttccctctgaaacaaaccgaaacaaaaacccagcacatcctctcaggtacaggcagcccgcatgcttgacagttagcctgcaaatattttagcaaaataactaaatgccctgctccgaatactcgaatagaataaaatatattatcatattgcctaacataaattaaccatatcttttctatatggaatattcaccttaatttgattttatgtgtggctatctatttagattttgttgtttcttaatattgagaagttcaaggataacttacaaaacttacaataagagtagatggggtgggaatagattgttcttgaggcacccatgaatagatatgcatggacgtagtctcttgaaaagaataatgcagtgtgcattggccaatcagactgcccccttctgtagaatatgacagatcagattgatggtacagtggcgatgaccaatgacaaaagcatcaaacagatatctctggtactacctgtagtatctatagagcaggctggcatagtgttatttgctaaaatgtttcagtggcaccatactaattatgtgtcatatattcctcacttgtgaaagctgacaaaagctgacaatatgctgactggacacgatataactaggaactggtaaaacagaaattttccttggtatgacacctactgcctagtgtctggcccaaggtaccaggtcaattttccacttgcagatttttgtctataactgccactgaattgctatttacattatggtcctgcttcaccaaaatatagcctacaaagccacctattttcactgaggaaaattgaactccgaagtaaagcatcacgatctgcagtaagaccttcccatttttcaggtgcaattttgtgggacatcatccaatgtctcgctgtaattttgtgatgcagctctgcagcgtgaccattggaagtcattatgctggtatcatcttggtttcaacacatgactcatatggatttcaagtttccaaccactatggaaatagtagtggtaaccacatagcgaagttgtgttcaagttgctcaacaagttccttaggtgttacaaggcatatggttagccttcccattcagctaatcaaaaagtcgccatcattcttcattcctggtgtacacaccagagctgatggattaagacagcatgaagttatgtaatataggaaaaagcagaaaatcatggttagcactcctaaatagagatgtaagaaaactaactgaaatcttctttatgctatgctaattcatactttggtagtttgggcacatatgaagaacttgtcaaacatgtagagatggctgccgaattaagctgtctttataagttttgctgattcttgggcctgcatatcaatagacaaccacagtaatgagaaaaacaactcaagactagcacaataacaacatttagaataggaaacaccgaaacagcaatgtaaattgcaaattgcatacaggctagtcatcttattatcataaaattctgaaattatgttttcatgtaaaatcacataggataaatcagaatttcttttattacaatggaaatctctcacttagacagccacaccacaatagtagtggcatatttacaattagacattttaatggagttttcaagtacaatgattaaaatgattaaactttctaatatgcatgagcaaagggaacaaagctaaaaaatgttatacaaagacagcttctgcatcaatttttttgcacacaaacacatgtggtacgtgtgaacaggttgcgttatcatgtcagttacacaaattgcagtaaaattcagaagcacatagtacgtgagtaagaagggctctacaacaaccaccttactccagtggtgttagtagcgtggtgtacagtacagggccacaggggtacatctgaatcctcagaactttcgctagtatgccaattacataaccatattgtataaatatactcaaacaggagtcaagagaagccaatggaagaaaaaacaaaggccatattgtcatcccactgtggcaatccaaccattgaggcatctggctatcacagccagctaaccgcatcaagccatcgaaaagatccctaatttcccatctatccgtcattctgaagcatggaa

SEQ ID NO: 26784 - DNA, 952 bp, Oryza sativa
acccaaatcaagccacacaaacccaaggaaagtataatactaataataagaagggctctactgctgcaacgaaaattgtgtggtgatcatttttgaacttcgtaattcaaaatttcaaatggtaacatttcatagggttgtaatttaaatcacatttttttctagtacggcagtctaaatgaaatatatgtgaaaaagttaaggttagatagtttacaatatagggaaaaaatgcacaacagaaccagcacttctgtgataccataacagaaggggaacatgaataattcctactggcattgacactgagttagataatctaatagatgccaaaagtactgcaacaaactttttatatctcagtttttcttttatcctctgactttccagtaaaaacaattagtacttacttttcatatcctttacaaagtcagctataagctgcagatatccattccagttgatcttcttcatgagattctgccaatggacccagctcttcatcaaacgataacttagatgatgagtggtaaccttcatccttcatgtgtttagctagccttctcagctgtgcatttatattttctgcttcaggatgctgctgttcgccaactacaaacacatgaactcggctgttaagctcaacccagctacatccaggatctttgttaactcctcgaagtctcatcaaatgcctcaccctttcaacatcattccattttctctgggaagcatagatgtttgacagcaatatatatgctgaggaatctccggtacctaactccatcaaccgttcaccagcatatgctccgacatcaaaatctcgcaaagagcgacatgctcctagtactatacgccacaaacatgttccgtggtcaatagtaatggactctatgaaatcctttgcttccttaagcatccctgctcggctaagaatatcaaccatgcaagc

SEQ ID NO: 26785 - DNA, 4745 bp, Oryza sativa
atgcatctgctcccccatcagcaaacccaatggcacactaactgcgctgaaaactgctgtggcaacaaactcgcttttctcagaagggcactcttcgagcattagtcggaagagatcgaatgcctcctcggagcatttctctgcagcataacctgccaccatggtggaccaggaaaatgagttgcgctgaggcattccgtcgaacactctgcgagcatcagaaacaatgcccagcttacagtacatgttgagcaggctggtgcacacgtacacattggatacggcagaggggatcttgcaagcgagagcgtgggccgcggtgccggcgggcgcggaggccgcacgggcggcggcggtgaaggcggcagcgaaggaatggggcgacggaaggacggtggaggaggagagcatggagcggaagcgggagagcgcgtcgagcgggcggtggccggagagcgggttgaggagggagttccaggaggtgacgtcgcgggcggcgggagggatatcgtcgaacaccgcgaaggcggcggcgaggaggggccgggggagcgaggagtagaagttgatgagggagttggcgacgggcgcgtgggaggcggcgccggacttgagcgcccaggcgtggagggcctcgccgtggcgagggcaggaggcgcgccggcggaggagctcgatgaactgcgtgtgcgacattcgccgcgccgacgagggcgccgcggctgccatgctggacgcggcggaagaaaattacgcagttttttgttttttatcgactcgcaacagacaatgctacatattgacagagcattaaaaaaattacaatattacaaccttgtaagctcgtaatcagaaaaaaaaaataatctccacctacacactgacagctccaatacatagacccaggagaaagctagtatcagaccgaccgccgctagaccaacaaaagactatagtcgggatcgtccaaaactaacacagaactgtactctatttacaactttaggattaagggaaagagtgtaaaaaagaagataaaaccgttctccctctagaccattcgacatggtcaacttataagttagggcgtcatatacttggccaaacgggcggcacggcccgttaaggcacggctcctgtaacaggccgtgccgtgctcgtgccggcccacatgctaaggcctcggcctaagcacggctcaggaagaccacgggcacggcacgagcccaaatataacacacgggccggtgtaggcccattagcacgtttggcccacaaaatttgaatatgagaccgaaaactaaataaaaaatgtgaaaaaaaaatatgaaaaaggaaaattaaagggaaaaaaggaaaatatgtgaaaatattagaaaaatgacgaaaagtagtgggaaatagaaaataatatatggaaaaattgggagaaaatgagaaaaaatcggagaaaatagacaaaatatatgaaaaaaatagggaaaattttggtgggccaacgggtcgtgctcgtacttgagctgtgccggcccatgggcttagacatcagccaagcacggcacggcccacgagcgggtgtgccgtgtcgtgcctgggctggctacagtggtgtcgtgcctagatcggctgcagtggtgccgtgctcgggtcggcacgccttggcccggcccatttggccagcactatagcaccgacacaagaggaccggaatttacagctagcttgctccagttgtctaggaagtttcggcgaggggttacctagacgacgtctccagagagtggatcaacagaagcatcgccgccgccgtccatcgcggtctcaaatgagaaccgagactgggtttcacctggcagacgtcatagggatgttgggacgacacgacaactccctcaagagggaatccgacgctcgaaaacgcctccgttgccagcccagccaagatcgggctaagttttcacccatagtagtaaagaaaatttatctatttgaactttcaaattttaatatgaaatattatgggaaatgtaaatcgaaagtgcagtttcgtcttacggcacgacgcccgctaaaatcgtccgatgaaagtatcacatacgcgggtacgtagtactaaatttatctccacgtttttgatcttagagtcaaatgtgagttttcgtaactatgtagtactagtatatttaaaatttttggtgacttatatatttcaaaccatatattattttttaaggtctgttctactcaaaatatatgataaaatgagtaaactattgaaatatttaaaaataatttagtcaaatggtagaaataactaagctctatagtggaagtaactttttataacattagaagtaattacatatatgtgttaaaagaaatatcttcataggtaaagtgtagattcacaagttgtcgacgtttgagatcgtgactacggtatttgcatagtatggggattgttgataccaaggtatatgtgagattgaggtaaaagagatggagacatggattttatacaggttcaggccccttatttgacaggtaatagccctactcttattggccgaaaccggtgttgctccttactcatatggatcacacaagtacataattcgggataacctatctagttgtcgtcgacttggcggcatggataaccaactcgtagtcaacgacagggtaattttcctcctcgaatatgaactcatcgagatcagagatggtgctagatcctttttggcggcctccgtaggcaccagatgaggtatgtctaggctaatctctgatgttgagatctggcgatgtgtgttggcttgtgtatatattgtgtcttgttgatcttgtggcttgtcccctatccttctagggggtcttgtatttatactcatagatgtccctttgtccaagtagaattagggagaccaatatggatacaatccacgtagtccttgtcatttctatatagaactctatttgtctttccttatccggaactccttctatatacgaggtatgattccgtataagacatggtatgtgatgggccatgccgagtttagtcaactattattaggtatgtagcatccataaccatgacacaagtaaatacatgacttttttatccaaggtaaaccatatgtgtatacatatatatagattattgttttcgataaaagtaatttattttatataggaagtaactctttagaaaatagaagtaactattcatagtattaaaagtaattcttcataatattaaaagttggtacactcctagaggaaattaactggaaaacagaactaaccttttatggtgttagaaataactaaactgctagatagaagcaactcttcgtggtattaaaagtaactatataacaatgttatagggaagtaagtcttcataacagcactgctacaaaagtaaataacctaaatatattcaatattgaacactttttcatatattttcagtagagtatgatggtttgattggatattgaaaacaataaacgatttaaaacaggggcgacggagccaactgaaccgccgcatcgacggcgacagcagtggcagggtcacgtgtgaggaaggagattgcggtggcagggtgaggcacgctgcggtgggatgatggcaaggatggcctgcgccacaacgtgtcaacgtgttgagaaaggagacggcaatgaggcagccgccaccagcagtgccacaaactcaccggagtcgctgactcggggctatggaggggtgtggatgaaaacggagggaggaagatgtttcacggaatatgggacccactattattattattactcccttcattccaaaatatggtgcacaaccacccttaatccaaaaactcagaaataattaatatcacatcattgttatgaatcattccaactaatacaatgcatgcaaccaatagaattaaagatattgtgagtgtaggatttaaaataataataatttaggggagagaatgtgataattaattacatgcatgcatgcacacctcatattatgaaacaactttataaagtaattgtgccttatattttgaaacggggggagtattatttctatctagaatgccacctaagcgccacgtagaataaaaccatctagaaaaactccttaggaatcaatttgcattggttttgtaagatggaggaggcattatacccggtttacggttgagggatgcaattcaatcgagagcaagagattaaggaggcaaaatagatttattctgaataggagagctgataaccatcctaccctcattgattttcttcgttttttgaatttttttttttgcattctcgaggagatttgcacgtgtttggctgtttcgcaaaaagctccgcacgtttgcacgtaatatctcatatgtcacgcttgacgccccgttgtaatttatctggaaactccttgtcttttagagaaatacaatgcgaagaagataaaattccgcttatagggatagcactgtaaacatgaaaaacaaaggggcttttccgaaaaaaaaccaccatctccaatctccccccgtgcactgccgcctcccccgcgcgtcatcaccgtctcctcgcacttgtgcacactcacacgggcgccgcgcgcgtggcacccgtcagagtcgtcatcggtgccctctcccttctttttctccctcccttgggtagtggtggcgccacggcgggggtagtgcggatgtggcgcccgttagagct

SEQ ID NO: 26786 - DNA, 16940 bp, Oryza sativa
  unsure (1)..(16940): unsure at all n locations
ttcaagtatttcccattaattgctctctaaaatcattctccttgcaatgtacatgtggacttggaaataagctttacagtctgcccatttttattataccaaaagcggtagctcccctattcataataggctgacattaatgtggtcagacggtcagacctatcaactatcatgccaaacttcaaaattcttgtacaccgttgtaggctaagcaactcaggctgtgtttaattccacgctaaaattggaagtttgactaaaactggaagtttgaagaaaaaacttctatgtgtgtaggaaagttttgatgtgatgaaaaagttaaaaatttaaagaaaaatttgagaactaaactcggcctcagcatcactagtaagctttacagtctacccatttttattataccaaaagctagcttcctggtagctcccccattcataactaggtgataccccacgctttgctgcgggattcacggatgagtatatgttaaatattgtcgaaatgatgaaagttgaaatattgagaaaataatgtgaggaagatgatttgacacatactggttgatctctataatataatattgtagatgatatgccatgtttgcatgggatttaaaataggttagaaaagcaattgctagtgagtgaagatgtggcatgcttgtataggattttaaatgggctagaatagcaattgctagtgggtgatgatgtggcatgcttgtatgttgagctttagctttagtgggtaccaactatgtagaaagtatagacagataggctgacatgtcgcactccatctcaatgacagagtattcttctgagtcaacatctaacccaactatagaacctctcttgtactcctttgtaacatcaagtaaggtcacatatcatgtgactttaatctctatcttacgtaaggtgttctgatccaacctgagaattttgagacaagacatgcaatgattggctggacagagacgactgccaccgatggtggcgacggggacgtccggcggaggagggagaggagatgggcacggcgaggccacactactacagaaagcgtttttgcatacgggcggaatcgatcttcacatgcggttggccggcccgcatgcgcgaaatggtctgcaaagatcaccatttgtgcatgcagccggcccagccgcatgcgaagatcgatcttcgcatgcggtcacttaagacgggccgcatgcgaaaatagatctttatggtccatttaagaagccgcatgcgaagatatattttcccatgcggtcgacttaacaagaccgcatgcgaagatctattttcgcatgcggccgtcttaagtagaccgtatgcgaaattcaatttccgaatagctcaaataatatttattctagccttttagtgaggtgtgtctcgtaattaatattaaattattgagggatttattatcatatttcggaatagtaagacaagtgccgcagtaacaaacatgtaatacataaccataaattcaatcgtaatttacatacgaaatatataatacaggtgccacagttttttcatcatatgtataagtagtgtacatgtcattgcatatgttctttctcccactctctgagaggtttaaatttgttgtccattgcgagttcactctggttgtcatagaagagacctcttgtattgcagacatcgcgcggatgaatcggtagaggtcagcggccacgttcaagatcgtagtgtcgttgaatcgttgtgcaatatatgggatttcggggatctacgcacagaaaggaaaataaaatggtactcaatgagaagtgtgtgctagatgggtttctgtgtagagaagagttcgtttacttactcggttaccgattgttttgtacctcccatttactctgagcatctcacacacgtaataaccgcacaagttggttcctggtggttgtttgtagcactgcgatataattatgggggaccgatctcagtagatataatttagtatatatgtattgttcgataattagttgtattggtatagatttgatagtaccggctagctagtcctgacggataacttcttctgggatggaatatgtactggtccacctcttttgcagtagtacttgtgtgctctgtttgaagaaaacaattgttttatcagtagttagaagactggcgatcgacctaaacaatttatattaatgaaatgtttatcacttacaaattcaaaatagtgaggaattccataaatgtctccttgtcatagtgtgcggggtccaatgatatgatcaattggtctttctgatatacaaggaataatatgtagttgtctctgcatataagataggcttattggagacagaaaattccgaagaagataaattaattaaacaaaaagaagagaaagcttacgtgaacgcgtagggggccattaagaaatctttgtcggtgtgcgccaacattgctattgccaagtatgttgctacttctagcttcttcctcttgtgcaatgtcttcacatattcttccttttcttcaggggtcttgccaaccaattgctcgcagtcctctctcagctctacggtgtgttgtgttttgcatattcttgttggatcgacgtatccaacctttgctccagttctatcagcttcgtggaattgcatactgtacaatgaacaaagaagaaatgggatttggtttatttgtttggaatgatacgtgtaacatgtaataaagagttcagacttacagacagaacgccgcaacgagattaacgtccattttatctagcttgtagagggcgtaaaggtctcggaaagagataaaaaatatcccattaggaccactcatgaaagcgccttccgggatggcgacgcttatgaaactgagacctttcctagatgccttcatataccattcgtgcattaccctcatttcccatggtagcttgttcataagataagttggcaagaatggctttgccatactcataagtgtcaagcacatcagcagataaccaggattgcacttcatcttgggctgctaatactgacttctaggagtctgacaagatgtgagcaagttcttttctcttctcagaattcctgaaagctgaaaacatgaacttctccttatccttttcaatctcctttgggtcgtatgtggatatcaactttggaattatacgacgaggttccaaaggattagacttcggttcggatgtggtaccttctggtatgtgcacttgttctaccagagcagattggggtgtaggtggagaggcttgaactgagggcggagccgggggagcatgctgtttagctagggaggtgggagaggcttgaactggttgcggggccgggagagcaggctattgataaggggagggtagtggtttaggttggtgaggcggtgacctaagcagtggtggtgacgccggatgtcgaggtgacggtggttcaggaggcgacggtggtgcaggagcggcagctgtccttgcctgcgatgaggatggagttgaagatcctgctgctggaacggccgcggttaggattatgtctctgcggtgccacaagataaactgattcactgcatcaccgagaagttcaatcccctcaggtgcaggtatgtctagttccaaggaaacgtggtcgctatggaccttggcgacctatacccttgcgtaatcctcagggaatgccgtgttgtggaattgacgtccgggtatcgctaaacccattgcaacctccttagtctttccagcgcggccgattggtacgacgagactgcagggagttggtccagttatactatccacagggaagggagttgtctgcactgagcctacactgctgggtacattagttgtttgctgtgcagattgtgtgggttgttggccattagggaataaccttggaaaggctgtcgggttttcagctgccaacgagtagaagtgttccttcacttgcgcatagattttgtctgatagttgttctttgtatttgtctctcttcttataacttggtgcgtcttatggaaaccctatcttccaactcatctttgaggacaaaccacttacacgtccagagtgttcggcggtccccaacgccgcagtaaagctggtctcgctccctccgtgggacgaactgtcctgatctttctttctcgactatctgctgcaaattagtagtcacttcttctatgtctggagtctcgaatagtatgtctccctcatccgagactttacctgtgctgcgcacccaaacccagttcttgctacgttccaccatggggtctaccagcaggggtttgccggccgcggaaaatctttgctcgatctcccaccattgatcgacgtgaccagcgtatccgctcgaccccaatctatggggatatctgttcttcttcgcgagctcagacatttttttcctcaaagccaatgcttcagctattatatgatccgcaacaaacgtatcccagtcagcctgtgatatatgtccataatccgtgaacggtgggagattcttctgaacataatcccgatttagatcggacttccactgtcgccatcgatctcccatctttttaagtgtgtaatctctccccctgacctgtgatccaggagggaacacaaaatacttctgcaactcattccagagaagtgtcttgatgttgtcgtccaccgtttcccacaacttgacattaatgggacaacgcgtcctgactagagtaccacaggcgttgctaaacttggaccgcactatcggtggctcaacgggcttcccatcctgatcgagagcaatcacgttgtatgtttccttgggtaatttattcttgcttctctcaccacgtctttttttcccactcccgcctgcacttgtagatgtctccgtatgttcaggtgcagacgtagcggtgtccatctcaacttcttcctctctcctgttccgagcggctttacgtttcgagcggcgtcggactaccatctgcagaaaataggtaactctctacaccattagattcatgtcacatcatagttaggaaataatacatggctaacgattttcagcacttacggcctgttccataggtatgtagtccggatcatcatcgcgaggggcgacttgtgttatttccattggaaacgggtcacttggtgtgcaccacgtttcttcactagaagcgtcaggctgcttgttgctaccggatttttgaggagcgttaccttcttgaggcgctattggtgcgttcgatggaaccttatcgttcgacatcttccaacttgacgtaaaaaaatttgacataagtcccaatttaacataattttacataagtcccaattacgtaagtcccaatttaacataagtcccaatttaacataagtcccaattaaacataaatctcaatttaacataagtcccaatttgacataaattccaatttaacataagtctcaatttaacataagtcccaatttaacatcagtcccaattgaacataaatctctatttaacataagtctcaatttaacataagtcacaatttaacataggtcccaatttaacatcagtcccaattaaacataaatctcaatttaacataagtcccaatttaataatccacaattaaacattctcaaaattaaacaatccacaatccacaattgcacatttcacaatccacgatcaacaattaaacaatccacaatccacaattgcacatttcacatttctttttttaagggaaatgttaccgggggactttggaccggaggagccggcgcggcggcggcggggaggtattgccggcggtggcggggaggacttggcggcgacgacacgcgaggggggagagatcctggcggcggcgacgacggcgacggcgagaggggcgacttcggggaggagccggcggtggcggggacgacttggcggcggcgacgcggcgaggggggagaggtcctggcggcggcgacggtgacggcgagggggaccacttcggggaggagccggcggtgacggggaggacttggcggcggcgacgacgagggggctggggacttagaaaattttggcagcctagcggctagggttcgcgggcgccgggacttagaaaattttggctccccgcgctccctatatataggggcagatcatcgcatgcggtcggcttaagcggccgcatggaaaaatgatcnttccangngggnnnnntnanccggccgcatgcgaaactgatctttccatgcgggccattaagccagccgtatggaaagatcatttttccgtgcgggccgttaagccggctacatgcgaaaaagatatttccatgcggctggcttaactcgcccgcatggaaagatctttttaccaaataaactcatattttttctttcgtctaaataaactgtacatatatatttttttccaatatttcggtacaacaaaaattccaaatatttttggcagtaagaaaactcatgaaaatcactcaaaactcgtaaccaaatgttacatgctaatgagtacaacataagggggacttaaattcatgcacgtacatttggaacacaatgacaactaaaggttacaaaataactatgactaaataaccttggcaacaccatctgctcgaacgtacgacatattcgctttatcgattgtactctcaaccttcttaattcgcataggaagatcagtaaacaatgttacatcgtcgaactggttgtaatcattggggtcttcgatgttgtcgatgccgacgatctgttgctttccagatatgacaatagtttttctttcatccgaagggtccttcacataaaacacttgagccacacgctctgctaaaacccatggatcatccttgtggcctgttttactgtgatcgactatggttaccccgtagtcatcaacggaaacccctgttgtgtctttaacccattcacaacggagcactgggatttggatattcaggccatagtccagttcccatatttcctgtatggtcccataatacgacttattttcaccactcgtgtcaatcgtttcgacacagattccactgttttgtgcggtgcttttcatgtccttcgtagtcgtactcaaggtaaatccattgatgtcgtaaccttaccatgaattgacaatacttgaaggcccacatgccagtctttgtaaagtaagttcctccacagaatcaccaactggcaggtttagatctttgaaccacagaggaaagtgatgcttgtgctctcttgatacccaatcattggaccgccctaggaagcaggctttgatttcttctaggtgtcgctcaatgaatggctcaacgatagcgagctgttaaagaacattgttgtgtgccgcggacacctttttgtaatcattatcgaagaactgcttcctaccaacaataccccttccagacaatctcccttcatgtcgatgaacaggaatcccaatggcattagcatcctttatgtagtccatacaacactcgactgcctcttcagttgtgtatccctctatcattgatccttcggggtgagcacgattgcgtacatagcctttgaggatcgacatgtaacgctcataggcccacatctgatgtaagtataaggaaccaagttcaataatatgagggacgatgtgaacgatcaaatgctccatcatatctaaatatgatggtcggaaatacatctcaagctggcatacggtctcgacggcaaatgtctgaaggggacctaattctagaggatcaaataccttctgcgaaattcgattgaaaaagtagcacaactttgttataaccaccttggtatggactggtttgactgcccttatagcaattggtaggaataccgttaacaacctatggcagtcatgtgcattgtatcccagaaatggtcaaatccttcactgatactagcttcctgatgttcgatgcgaaaccagtaggcactctaaccccttgtaaacatttacagaaggtttttttctcttcaagtgtcaacgagtaacaagcaggaggaatctcggtcttcccatttggcagcactactgggtgaaggtcatgccgtatggccaaatctacaaggtcgttacgtgacttcaatccatccttcgtcttactcgggatgtccagcaatgtgccaatggtgctatcaaacacgttcttctcgaggtgcatagcatgaattgcatgtcgaatctctaggtccttccagtaatctaagtatttgaagaaaattgagtgcttcttgaaaggcgacgcagtatctttgtcaccatcagctttcttcctctttactgtcttcttctttccctttccatatacaaccttaatcttctttgttatctcatacacgtatgtaccacctcgtgctgctggggcagtgtcattctccactgtattatcgaacaatctagccatcttacgatacatgtgtctttgtggtaggaattgtcgatgccgcatgtacactatcttcaaagacgacatcaggtatttgtacgaagttttctccaaacatatcagacatctagtcttccctttaatctgcccagataatgaaaagtttgcatgtaggtcattaatggtaacgaatatgatcgcacgtagattgaagtgctcccgcttaaactcatcccatagtcgtaacccctctttccaaagctcctccatgtcctccatcaaaggctcaaggaaaacatctatgttgattccaggttggtttgaaccttgtatgaggatagtgagaagaatgtactttcgtttctgacatatccatgttgaaagattatacattgtgagaaggactggccatgtgttttgcgagctgcttaagtcaccaaacgggttcattccgtcagtgctcaacgcaaaccttacattcctgggatccttagcaaattctgggtgttttgcatcaaatgtcttccactggcgagcgtcggcgggatatcgaatcataccatctatcttccggctctcttgatgccatctcatcaactcagcatcagtcgggtttgagtacagacgcttcaggcggtccttaattggtaggtaccacatcaccattgagggaatctttccgcgcttactcttatcagaatctggatcggtacactctgaatctatgggcccattccctgttttataccgacttgtgccacacgttgggcaactttccaagtccgcatattctttacggtataatatgcagtgatttttacaagcatgaatcttttctacaccaagagataaaggacatatgagtttcttcgcttgatacgtgtttgatggtacaaagttaggcttaggaagcaacacacgcaacaaactcatcagatcattaaaacttgtgtccgaccatccatgtttagccttcaatcttagaagttcaagcactgaacgcaagattgtgaaatccttatcacatcctttcgtttcgtcgtaaagaagatccttcgatgccttctctaatgcctgccaattctccaatcctcgtgacctacccgctagcacctctggttcaacatggcttagcatatcctctaaatcaaaaccaccctcaaaatcatcactatcggtggaaacatcgacatccattctttcactggacatgtcttcgattataaaattctctgcctcattcatctcgaaacataactcttcatcgtcatcttcgggatcggcgaattccccgtgaaaggtctaaaccttgtagttggcggtgaatccgtactccattatgtgacccaatatttcactaggatctaccaacaatttctaattcttgcaatgacggcacggacaaaagatctttgtcatattctccctcaaagcatgtgccttagcctgatcaataaatttagatgcttcctcaataaatatcggctatgttctccgcatctcatacatccatgacgaccgatccatctatttatataaagacaaaaaagttacagataaaaaaatagaccacaggtatttcatataaaagtttaaatgcatttgtccctccaaaaaaattacaacaatacatgtaactagtatgtacaagtgattacatgcaaaatttgcccatcaaaacatatattttgaagctagattttgcaaaaactagctagaacaaaccttgtcaaaatattaaaaaaactccactttccaccaacgaaatataacagaaatggagccaaatgaaggagagagagttattcacctttcgtatagagttcaagcaaaaatttcgagttgaaaacctcccccctaattggtgcttgctttaggagagagagagagcttcgttttcaaatggtcgagcttgggcctggaggagcatatatggccgatcatcgcatgcggtcccttaagccagccgcatgcgaagatccattaccgcatgcgataatgggcctattttcacatgcggccgtcttaagcagccgcatgccctaatacatgcggccccttaagacggccgcatgcgaaaatagacctattatcgcatgcggctgtcttaagcagccgcatgcgataatggatcttcgcatgcggctcatcgacctgcccctaggggggccgtttttgcaggcgccgccacaagcggcccacatggaacctaccaacccatggtacagaaaaacgattttttagtagtgccagccgccaccgccacgcgcgacagggatggcaagaacaatcagggcgagggaggtcatcgccaccaaggacggacgacaagatgatttttggttcgatcattttgtcaggagatcaaaacaaatcccgtaatcagagatgggcaagatggtccattcgctcagccattgcacactccatcacagtgaaagaaaacggaaaacgggagagagcgacggaaacctctaaacaggaacagaggaaagatttgggtgccatctatctattattatatactaaaattccactaaactttttacaaacgctcttaagatgtcacgtggcgctctaataaattagagaaaatcctagaaattctaagaaaaaagcaaaacatctacccctttattttcacttaaattggtgggtccaatattatacaccgttagataaaaatgatcttaaaataaaccaaatactataggcccaacctctcctcttttttttctttgaccagggtcccacctctcctctttatgcgtgcataggtaggtcacgtacatacatgggtatgtagtacgtacgcctccctcccttttgtttccttttttttcttattttttctatttatacaattgatatatattttttaataatcataattttacaaacaaagaatataccatcatataactctttataaacacacgtaaataaattagctctataatctttgaaaataaaatttacaacatattatatgtttacctagtaaatcaataagatagtttccacttaaatcggtgtactcattactttgtactattattttcaaataatgcactattttaaaataaaatttacataattatattgtgtacctattaaataaactatttaagatctatattaactaatatatagatgcacttaaacagataaatccattatttaaatcattggatctatttttttaattactttggactattattctcaaataataaattgttttaaaataaaatctacaccattatattgtgtacccattaaattaacaatttaaaatatatattaactaatttacatttacactagaaccagtggacccattatttaaatcatcggatctattgttaataactaaagtgtctaaagttctctttttggcccgctgcataatgcacgtctacacctttgcctttcggacgtgtgacagaatgtcatgtctgaggcatctcaggtgatcacgaccattgtagtgctaccgattttgttaataacatgaaaagaaaattaaaggtgtgatgccgtgagagaagaattaagcaccgtgggaacacttagctctgtttaagccaaaatcgagagttgattgcataataattataatgtattgtgttttgatgtattcagattttgtattatttgttcgtacaattgaatgaaatcattatattataaatgtgagcacaatattaacgaatatcaatagaactcttactaggataaaagtgttataagggagtttaaggccctatattttccttgattccatcttttgggttttcgtttgcatgctccacgctttccaagttcctaaatggtgcttttcttaaataactttttaactttttagaagttaatttatttgtttataatctcaaatagctatcacataaatcagataattcatcaatttcagttgtcctaaactctaaaccctaagtagtacatatttttttcatgcgagtcatggtgatcagtaaattggttatcaacgcataatcaaagtcgtaagatgaacatataagagctaatgtaaacaattgtaaataggtgtcaaaattaattgctattaattagacatctaatggcttgctagcaacatatttaatttctctctacatgtatataaacatggacaaagctaaatgaatattaacatatatcccatacatatatattatatggttaatattctaattacatgtggtaagtccattaaaatttcttaaaataccataagctgtcacgtggtgctcaaataaattagagaaaatattagaaattctaagaaaaaaaacaaagtatgattttcacttaaatcgatcggtccaatattataaaccattggattaaattgatcttagaacaaactaaatactacgaggtcccacatctccaccttcggtacacacctacatacgtaggtacctactcttccccctccctttttccatttttccctttcttctttttctccatgaatacgcttccctctctttcttactgtatcatgcaccttttttagatgatttaatcacaaaaattttaagtatcttgctctcacatttttcatttgttatttactcaagaactacaagcaatagtttattatttactcgagaaaaaaatatgattcaaaagtcgtaagtacttaatccatctcctactcaaaagtttgtgaatggatttttaagataccttaagaaaaatagaacccttaaattattacaaaataacaatatccgaactttagtttgcccttaatctataagataaaacttttgaacaaacagtaaaaatcttacttttcaataatacaagtgcccgtgcatacgcgcgggccaccttcctagttaaagtaaacggtgaactttcggtgctataaatctaaaaacgtaaacttttgatgctatataatcaattttgccttaaataagatgtctccatataataaacgttcataataaaaaaaataaaacaacattaaataacatactcacgcatatacgcgggctaccttctttgttaactaaacagcggctacaaagtctgagatcgctaggcatcagcaagagcacagagagagtgagaagaacataattgttcatactggcagttgagcttgagagacaataagaaacagtacattcgagagtcacccctgctttgctactttgccttatagccccatttattcgtcgtattccagcaaaatagttgtcctttgttcctacaaatccaagaagtaaatagatggtcaaggaacacgtagcaatcatgcaggaactaggcatggaagaacagcatagccaggagacttaccaaaagtcataagacagcaagcaaaaagatggtggatgaggctgtacggagccagtctgtagccttcctcgattctaccctcagcagctgtcgacagggtgccacttctaacatggtattgtgcaaggaatttcccgtggtgcctgtagatgagagagccatctgcaatgccaggaacagccttcgaggagacacacaggctcctttcatccatgaaaatggtgtagtccccaaatcttgttaacgggatgaaccttcccaagataatgtcagcaagtctgtaaaccacggcctgcgagtacgagcgatcagtgtgaccgatcagcaagacctctgattcacagttcaccagataagcgaacccaaacagcttttctactggacatgtagcaaacaattttggttctggtagggaaaaagacgaagcagagccattcgcctccacccggggtgggtctatcacgaaaattctgtttggagagaagtttacccatattgatgctgcataaatcttgccctggaatgccatgtatttccatgagaggttggtctgccaatttgacaaggtccattgctgatccgcagaggtggcaaaggcaacgcgctgtactctggtaacaacgaacatgatagtgatgactccgtcagggccgaagctaagagcagcgcaaatacgattgaaatatgagaatatgcccatctcttttcgctccatggctctcatataagccaactcagtgctggtgaagaagggctcaacctgcggccgtagggtctccagggatgataactcaacaatgtcaccggtgaaagggtggaggatacggatagcactgtcccgatcccgctgcaagaggaggaggccatcgaccgagtcgatgacgaagtgatccgggaagaacgggaggaggagacgcgcgaaggcgcccgtggagacgttgaagaagcgaaccctcccgtggagcttgcggtggccagggaagaggccatggctctcggggaacaagatccaccggcgcggatggaagcgcgggtccacgacgctgcggccgcgcgggctgacggtgctggaccgccaatggcggcaaacagcgcggagccggaggtaatccgccacgtcgccagccagcgcgtgctcggcgacaaggcggatgatatctccatccagtgacgcccagggagactccatccagggcgcggcaccatttggggcaacggcgccgaccgtgcggccgcgcttgcacttgcgagggattttgcgccgcggcggcgacagagcgcgcttctcgcatcgcgccggcgacatccgtgattcccaaaatacagatatggacagtcaaccacacacgatgatactagcaaatactccaaatctcgcgtaaattaaagaagagaattttctgctgcagaatcggaaaacgaggccgaagcgtaagctgatttgacttaggctgtgatcgagcaacacggaggacgctgccgattagagcacgccaacgtactgtcattccggaagattagtattgtcatttgccagcatttagtgacggtcacagtcacgcaatagcaattgcagcgttttgagctttgagagttttatgaccacacatgaagattaacagttagtaaattggagcaaaattcacctacaagcagtagctatctagcttgcatataccttggcttcacagtgtattacactccagcctttgatggttgcacgcttttgctgttcttcaattctttctcagcgatggttgattcataaaccttgtccaagttggagtctttaaccaagaaaggccttataaatttggccacgaagtcttcctctactatggtggcgacgttgatgaaatccctgccgcgccacagccgccaagcctgcaccctgcagcacgctgaccacccggaaccgcgcgcggcacgagcctcccgtccaggtattaactgagcatcaccgggaagttggcgacgcgctcggcgtccatcccgacctccttggtcaggaactcccagttcttcctcagccgctccacggacagcatcagcaccgtcggtatcttggctgccgccgtcttcacctgcgcctccgtccacccgagctctgctcgtccctgaagaaggccgccttccaggcgagatgctccggtttcaagaggaacgctgcgacaatgacgtccttgaatggtcgcatcctgcgcggcaccccgaactcgtcggcgatcactaggacagccttggctacatctggtgctgccacgagcagcttggaggcgtaggagacgcagaaccagccgatgtcgtcgttggtgaggcctcccagtcgacgcagccgcggaggtacccgagccagaactggacattaacgaggagcgtcggtgagcggaagaaggcggcgctacagcgcgccacgatgaggtccatctgtaatgtggtgaagccgagcacggctgcgcagggcttgagtatcttggggacgctcggggtttgcattttttatttcagccaaaatttcggtgatttcggtaggatgaaatttacaaaaatttcatgattttcggcactttttagatcagaaattattaaaattataacatattttgactggatttgaataaactttgaccgaattcaacaaacatttgataaagtccgaaaattttaattgatatattgattttgctggaggggtccgaaattagagaaatttcgaactgaaactgcaatcactggcgacactgcaggtgagaatcttggggtcgcgagccacggtgatggcgatgaggggcggagagagcccgagctcttcggcgaggaatgcaagcacggcgtcgggcctggaaggtgacctgatggtggagagctccggtgtgacacgacacattgaggtagaggttgcacctgttcacgaggtagtcttccacggagaatgaggacgaggctgtggtgttgtccgaggatgtggatgcggcgacggtggcgtaagaagatgccgatgaggtgtgggggaggaccaaggttgaaaaggacggcgggaccacagggccaaggaggaagagcataacggcggcggcggacgccagtgaatgggatagatggctggcaagcgatctgaggctgacactacttaaaaaatgattttcctggatatggacccattagatttcagacggaccataacgg

SEQ ID NO: 26787 - DNA, 16352 bp, Oryza sativa
ggcgccgctctcccccacgcgggatcgggcaagcgctcccctcccctcccctccccttcctagatccggtggaggggaggggcgtcagcggcggtgcagccggaggggagcgcggagccgatggcgggcggtgcggaggccgccacccacgatgacgaggacgggagtggcgtcctcggccaaagacgaggatgacgaggaggaggacgacgacaaggaagaggcggcggcgccaccgccgaattctaggttttcattttttttttttcattttttctggatttttgttgccgcacacaaaaattacaattttcgcagacccctgggtgggtgcggaccgcccacctgcacacaaaaatcggatttgacagtagggaaaaacgttctcctagtagtgagcgagagcccgtgctggtaactgtaactcgggagaaatccgacgaaaacaacccgtgtgaccttgaggttatgaggttgactcccttctctcgtgcgtttgcatttttctgggaggttcctagcatgaatctcaataaaaatccaatggtcaaaaaaattgcaagatctctaaagaaaaaatcttgcgatagatgtatagaaatttcggtgtttatttgtgaggaaaaactaaaattgcgttgacatatttttagtggattacagttaattttcagggcttttgatttgttcactgtgcaagaaacgattttttagtgtaagtgtaaacgcgtgttgaaaatttgaattattttttaatataatattatagtaacataaatatattgataaaaaaaatcttgcgtttgtattgttgtgtatcttcacttttgcactagatcaatttgaaaacttccttccaataacttgtaaataaatatgagaaagatatttaaatcttgtttggcacaacttcaaatctcaaaaccacgataaatttaaagtttgtatattaaattatagttgtcatggttatggataccacatacctaatagtagttgactaaatctcggcaggacccaccacataccatgtcctatacggaaacaaccttcggatataggaggagttccgatgaggaaagaaccagagttctacatggaaacgacaaggactactcggattgtatccatattagtttccctagttatacttggacaagggggaacctatgggtataaatacaagcccccctaggaggacaggaggacacacactcaccatgagacgatcaacacgatcaccactatcgggacgaccacctcatcaacacccaacacaatcaacatacaagcctacatacgccaagacacgccgccggatatcgacttcagggataagcatggctattcccctacggtgtctccggataccgtcaggagatacgaaagcgctatctctgatctcgccggacacggattcgaggaggaaggctaccctgttgtcgaatacgagtcagaccttcagaccgccatgtcgacaacagttagataggctaccctacatattgtaggggtgtgattatggtgaataaagagcatcatcggctccgaccaacaggatgtagggttattacctgacaactcaggggcccgaacctatataaaaatccttatctccatctcttttatctcagtctcgcgtatatcctagcaccgacgatccccatactatgcaaataccagaatgacgacatcaaacgtcgacaatagtgatttaaaattttaaaatgcacctaaaatgtaaacaatgatttatccatacattattgacgtaatcataaatatacatccatgtaattttgaagttaagaatactcaattttaagatccagagatgtgtcaaaagaagggcctctgtgtttgatatagtctatttcaaaatcttcctggcgggccttctttaattttttttttttaaaaaaaagaagcttcctggccaccgaacgcatgcaaaccatgccctttgagactttgatcgagtgcatgcttaattacttacctcgctaggctacgacgaaatcacgacaaccacctactcaatatatgataatcgaatcgacaatcttcctagccgccgaatgcatgcaaacgtgcctagtgagacctttaatcgagtgcttcagggtacgacgaaacacggatgagtgcctgctctgctcaaggtcaatttcgttccgcgttgattaattagtcagttcgttaacaacctcgactactccatatgcccaattaattaagttaaccaactcatctaatgatgattatgtaaatacgcagggcaggaaacggatgcgcatgtccgggaaagactggagagatactttgaacttcaagatgtcgtcgtcagtttccgtggctggtccaaaggctggacaccatcgccacagcagcatgcaatgcatacatacaactaccatattcatgcatgcatgcgtttcctataaatacattggccagatggccatctcagctcaggcaaagcagcagcttacggcactgcgcacacgaatctcaattagctgtgtgtgttcttacgcttgggttggcgattgaattgtatgcgttcggcgagatgggaacagccaagatacctgcattgctttggttcctactagcaggcctggtgttagcacttgcagtgaaccccgctcatggagccaagactcgccactacgatttcttcgtaagtgattatctacttgaattctagcgtgatggatatgttgatgtacaggcagcatgaatgcacgaagttttaacttttaaccatgcgtgatgctatctgcagattacggagaccaactacacgaggctctgccacgagaagagcatcctcaccgtgaacgggcagttccccgggccgaccatctacgcgcgcaagggcgacttcatcatcgtcaacgtccacaacaacggcaacaaaaacatcaccatccactggtccgttgccccacctgctgcagagaagaagagcattatatatcgatccttggctcgaaattaaacttacgatgtacgttctggatgattttactgtggcgcaggcacggtgtggaccagcctcggaacccgtggtctgacgggccggagttcatcacacagtgcccgatccggccgggcggcaacttcacctaccaggtgatcctgttcgaggaggaaggcacgctatggtggcacgctcacagcgacttcgaccgcgcaaccgtccacggcgccatcgtcatccaccccaagcgcggcaccaccttcctcttcaggaagctagacaaggagatacccgtcatcctcggtaatcaattttgtttaacaatgttagttccatcctgcaatgcgatgcgatgcaatgcttcgtaagtacgtgttttgatctgaaccatcgtttaatcgtttatgatgatatgatgttgtgcatgtgagtggtggaatgacgacgttgagcacgtgctcgacaaggcgaagcgcatcggcggagacgtggagccgtccgacacgaacaccatcaacggccagcccggggacatgttccccctctgctccagggacgacacgttcaaggtggccgtgcagcagggcaacacgtacctgcttagggtcatcaacgcggggctcaccaacgacatgttcttcgccatcgcggggcaccgtctcaccgtggtcggcatcgacgcccgctacaccaagccgatcaccgtcgactacatcatgatcgcgccaggccagaccatggacgtgctcctcaaggccaaccgcaccttgggatccaacagccggtattacatggccgcgaggacgtttatcacgttaccggttgataccatccgtttcaacaatagcaccgccacggccatcgtggagtacacggacagtgccgtggcgaggccggtcgggccaccagaattccccgtcctgctgccggccatcaaggacgaggacgcggcgatggcgttcgtcaagcagctcaggtcattaggcaaccaggaccacccggtgcacgtaccaaagcaggtggacgagcacatgctcatcgacattgacatcaactttctcccttgcgacgctaacaatgcgacaaataaattgtgcgagggaccccaaggcaaccggttcgcggcgagcctcaataatgttagcttccagaacccggctatcgacgtcctcgacgcctactactacggctccggccgcggcgtgtacgaggagaacttccccaacaagctgacggtcatcgtcaaccccaccggcgacatcaacggcggcgggcccttgctaacgaagcgtggcaccaaggtgaaggtgctggaatatggcactgtggtggaggtggtgttccaggacttgtccatcgagaaccaccctatgcacctgcacggcttcaccttctacgtcgtgggacgagggtccggaaccttcgacgagcgcagggacccagccacctacaacctcatcgacccaccattccagaacactgtctccgtgcccaagtccagctgggccgcaatccgcttccgagcagacaatccaggtgagatcaattattcagattaatttcggattatagctcttcatgtacagttttaaatattctttttgtgtttattttgattgttcattgatcaggtgtgtggttcatgcattgccattttgatcgtcacgtggtgtgggggatggacactatgttcatcgtgaaggatggcaagacgccgcaggctcagatgctacctcgtcctccaaacatgccagagtgctaacgaccgtggttcaaggaaaatgcaaacacaagcaggcggaaatttgtttattttgttcattgatttagtggtttagtttattttatttccttgtttggctgaaaaggaagaaggcattttgtcatcttgtaattgttagtcatttcgttctatcatgtaagtttggaatttttgttattcaatttacgaatataactaaataatgttttttttcagtggatcgggtattacgacgtctttctttataaacacacacccttgctatcttggctattttaattcccagcgctatacattgtgttacactggattaatttttcacggttaagatgtccttcgcttattcttatacattggtggagaaatcgtttttactcctggtttgtaaccccttgtagtcttggtttttcaaccaggactatgaatccgagactaaatatcgctatctttagtcccggttcaaatacccaggactaaagatcgatcttagggcagcggcagtcccggttagtttccttttctttttttttcattgtttctgttgctacttactacttaatccctaactattttctcccaaatcaagtgggatacatatccccaaatcaaagtaacatcacaaataccacaaatcaaatatatcatagattatacatctcatatgtatgcaatgaccacaaatcaaatacatcacaaattatacatctcagatctatgcaatgatcacaaatcaaatacatcacagattatacatctcagatctatgcaatgaatcacaaattctcaaaaacgaaattatacatctcaatccatacaatgaatcacaaatccttcatctcaatccatacaatgaatcacaaattcttcaaaaaaaagaaaagaaaggacaaaagtccctgcaggagagggcgctaccggccgccggccgccgccgccctcccatccgccagctcgccctcctctcgtgcccacggcaggctcagccgctgccgcctcccctcctccccggtcgccgcccgcccggcccgccctcctcctacgctcgctcttcctgtgaagtgaagggaggaaagagataagctaagagtaagagcatctccaacagtccctctaaatctcactctccccattcgctcaccgccgacgctcgggctccgtccgccggtgcccctttggccgagctctcaccggccgcctcgtctcccatctcaccggccgcctcgtctccctcaacctcgccgtcgagcaacgccgccaccgcattccctcccatctccaacccacctagcggatgaggaggcggcggcgtgaggcgagggggcgcgtggatggggagccggcgacgacgacaccgttttcacgcgacgatggccagcgccaggccgccagacgacgacgacgacgacgggtgcatgaggcaacgacgggatccgctcctcgccagcctttctcgttcctccctcgccatcgagccgccccgtcgcccttgtcatgccgctgatggccgacgccgaaggactcatgcgccgtcaagccaccccgtcgacaacggcaacggcaacctcggggacgacgacagtggatggcgacgactggcgacggtgcagatgacggcgacagcggctggcgacctcgtcgacaatggtggcgctccagcgtgggttcaagacgctcgccgtgatgcgcaccgtcgtgctctccgccgccggcctgcacttctgcgccgcatcgagcttggatccccaagaaccccgccatggctccctcctcactgggcggcagcggcccagcgcccgtggccaaggggctccaccacaccatcgtggagatgcaggcggcgcatggaagccggtgctcgcggcggtgcacggcgcttgcgtcggcggcggcgtcaaggacgtggccgcctgcgccatcgtggagaagagccgaaggagatggggggaggaatctatgtggggcccatggttggccagtgatttctagttggccaaatttggctagtggaggggggttttggccagccggatgccggatggctagaggctattggagcttttttttttttggctaaaatggctaaaatttggcttggagagtgggatggagagactgttgaagatgctctaaggaaagagataaggattagagaggaaaagagagaggagtttgtgtgtggacgagagaagatgataagtcctagggattatatagtgcgttttgatctttagtctcggttgataatacaaaccgagacctgggactaaagatcccggagaaccctgacagcatgtgaaccaggactaaatatcacatagtcctgttctgcttataaaccgggactaaaaaccatctttagtcctggtttttattgtaaccgagactattgtggtttttagccgaccgtgtaaagatggtttctccagtagtgatataagattttttttaacctagtcactacctcttgtactgtaattaacataattaactcttagtacaagaggtaatgatttgcctgtggcaaagccgctagaaatttgcaggcctgcatgcgactcagtcgctaaattttagtgggagatagcggtcgcggggcgagcacgccgcgttagagcatggttaattaatagtatagtcagccagctataacaaactctattttattttacagctaatactaaagccaattagcataatagataggctcctgtgttgattgtatcttattaaccaaataatcaattcctccatacgcatattaatcaaaagtgtgttctattcttgtggctattttatggtgtgatatgaatatgagtagtttgtccatatagtactacgtataaaaagtctttgtcctctcgtcgtctgaatttttcaccaacgagcactgtccgtagatgtacatgctgtccggatgctcgaacatcacaaaaatcataaaagcttcactctatcttagccctgatcatgcccaaaatatccacgctatgcttaatgatctgacaataagaatcgacttaagaatcttaacatagtattgccaaaacaacaaataacaattaatcataaaccaattggaagagggactccgtccagaaagcatatgcatcagcagagaggaattgctggaatcaaaccccaaacccaacgaatcaagcaccggagaagacgagcaaaaaaggcagagaatgagtccagatcgaaacagattcctccttgactaccggcttcacctaccctcggtgagagttgtcatatcgatcagaaataacgcctcaccggatgaatctggagcggggggccagtgatttggcacacagcagagttttcacgatgcgggaaaacggaagagaagaataacgaggctagaggataggcgatttggtggcgcgcggagccatggtggaaatctcgctccgcttgtgacggggaggaagaggaaaagcaggccaagatgaacgcacatgagatccgacggggtagatgccgggctcgcaaaatgagcttgctattgctatgcgcgtctgtatgcgtgctatcactcagcgccgctagaattgtcgaggtttgacttttatcttagtcaaacttcttttcttttagagatgggttttttttaccctgtctctacatctaactggatatatacggctattgaaataggaaatttagcctcgcaaacaacccaatctaaaattcactgctataaaagtttaaactcaggaccatagggtactactcactgcaaccattaggttacatgccctgcttaaagtttgatcaaacttgtaacaaaatatagtaaacattttcaatacaaaataaacattgcatcaaaatatatttaatattaaattttatgaaactaatttgatatcgtaaatgttagtaattttttctataaatttagtcaaatgtaaaaaaataactaaaaaaagtcaaaagacttataatattaaacggggggagtactataattatatcataaccatagcgcaactaaaatatatactatatacaagatgcataccccgcgcattgctgcgggagaattgtgtgataatacaatagatatgagttctaaaattttctttcctacctactttataatttttttcatgtttttatatatttttgtacctttatcaattatccaaaagttataaatgattgggttgtatggtgtgccttttgggggaaagagatgcaatttgcacccttgatgaatcatccaaatactaaaataaattgaggtaatgtgaaaagaaggaatttacacccttgatgaatcatccaaaggctaaaaacaattgagatgatgtggcttcatgagagaagagagaattagcattaactacatttagtgggaatgaactttatagatatataggattaaaacataatacaattttatacgtaagttatatagtttactaatattgttacattgtaattatactatcagtgtcgttaaaatgtaacaatgcgtaattacaatgtagttactaagttacactattactttcactattactttgatatagttacatttgaaagtttttataaaaaaaactttgtgatagtttttttaagcaatttccttagctttatatttattaatttgccaccaaagataaaaggattgttaattttatcccactttagaaaaagtaaagtagcacactatgacggcgtcttgatttttcataaccaccaactggttgaatcgaatgaccgagatcttgttagggcattgcaagctacttagatgcgtgtatttatgtgtcaaatatgcaaagagcaaataattatggctacacctcctacagcgcatagcggcaagcgaatgtctatagcttcagatgagcatagagttaaaaaggcatatgatgagatcacgcatctaatacgggcgtggagtcgtgtcgcgtggacatctgatcttggacgcaggcgaggtgcaggtcatccctgtgaagggccggacaaccaactgggaattcgactcacatagacgtgtacgcgtttttcttacgtgttcactgcgaggccaaacaccatgtatctgcattgttagggcctttacaatacaggtcacgtataggattggcgcaagaggccatcaagatttaagacctagaaaagccacaaaggtccatggtgcatgtagaaaaagtggaacgaagcctcgccctcctaacgcgtctgtagccttatctcccctcgccaagaacaggtgatcaaagaagatcatgcgggctttaatttggtaggcctgcccacaaacgtggcaaagattgacaccgaatctctgacgtgaaaagaccgaactgaataacagctcaccgcattgtaaaggcccttactaatcttagcaagagtttggtagaagttttcaagtaactcttgcactactatgctgagaaaaaaagtagcgatgagctgaactcaataaaaaaaactgacgaactgaataccatcatatgtattctataagcgtaaccgtaaagagaagtcgcacatgagacatatcagttcacatgtcccatgtacgtaaaagggtttaagtattagggcctcattgtaactcaaatttaataataaacacaattataaaagttttaaatgtaaattattattttattgtctttgtttatgttttaggtaggtctgtttgcaagagttgtaaccagggtttcccttaccgccggtaaccgcgcggttaccgcagttaccgagcttaccgcggaggtacggtaatataaataccgcggtaacctccttaaattcaaataaattttaaaaataatttgaattttttataaattttacatggttttgtacggtttttcacggttaccgcgcggtaaccgtgcttaccgccggggcacagtaaccccggccccggcggtttggaaaccctacttatcgttcaactatgacaaaaataaaagcctgttcaactgtttcagctacgagagaaaaaaaaagaacaaaaaaaaaacaaaaagcggaacgggctaaagcagcgtagcaacgggcgccgaggtcagacttccacccagacttccagactccagaggcgagggcttcccaatgggcaacatcgcgagcagcggcggcgctagcccacgtccgccgccgccgcatctcgaagcctatagacacggggtgccgcccccgtactaccacagctaccctcgtccgccccccggcgccgccgcgccgccgccggtgccggtgcctgcgcacgtggagcggcacagggccgtggcggtcagcgtcggcgtcaacgtcaagggggacaccctgcggctggtgcccgacgacgacgacgacgatggccgcagcctactcctcgccttctccttcgacgccgatggccccggaaggtcccgctccttcttctttttcccctctcacctatttataccgggctaagtgggtttcttgattagacgctgtggtaatttcgttgctatagctttgatttaggatctttagatcgtagtaacattggtatactacattactaaaatttctgccagagagctcagcacaaacaaatgttgttgcaatcgtgatgctttcgattgtgtactgctttcttcttctcttttttttttggggtacaaaattggcccatcttgtgtttggcataatgtcgtgattacctgtccaaatgtaagaatgcttcaatgtagaattcaattaaacttagtaccagatcagatgcatactgcttgattcttcttgctaaagcaaatgtttcttacttgaatatatatatactagaaatgtaaaataaaatcgttcacataacttggtattgagtgtgaaaaatgaagttgaagaaagtagcaagaatcaatctataattcttactaagaattagatttgtttaggtagtgacatgggactcaccgtactccagacttgtcagaatcagagcttgatttatcttaatgattttggatgtctactttcattttattgtcaccattgccatgttatagtaattgagattctccaaattcctgctactctcatttctattgtcaccattgccaaatcatattagttgagattctcctaattcctgtgacttctgttactaatcctacatggttcagtctcttctgatgtttaagctatttttacgccctcaaaatgttccatgcttaatagtattttatccttggcacatctttcatcttcccaacaaagattaagacatggtaagatagcactcgtgaagttgtggctgcagaactcataaagatccataccaattatgaaggtctatcataaaatgacttgtgtacttgaaaagagtatcgagttattcatttctactttcaactgatggaacaatgtgtgatctagagcatttaatatccgccaaaaaaaatcatggcttattggattcattctgcatatattgtctgtcctgatgtgcaagatatctaaacttaaggagtatgtggttatttgggcacgtattggtattctccacctaacccatgtattctgaaaggtttaaaagaaatctcctgttcactcttctggcagattgaatggaactaacaaacagaagatgagacattaggagttgtaaccaatccagtttgtgttgcgcatattgagtgtaactctgttttcaaaagttatgccttatgcagaccaggtcatactagatttacaatttgaaactgaactgatcacaacttcatatgtctcttgttccatgttttgtggaattccaatccatgataaacattgaaaggaaaccttctataccttgattaggatgatatcatccttaggtgtatttccaattgcagacttctccaatttggtagtattttatatatgtgcatcatttttttcagaatagcctttcttttttgcagaaagctcaaacttagatgctctttgatttattaatttattgtttgaaaatagagttgtactgtttccaaatttccaattttctgggaccttcacaattagtatggctatctccttgaacctttttaaagaattgaacgtttactggctttccttgttgtcatcacttcttttttttttttgtaagattgtcatgtgttatgtttaactaaaagacctattcatcatgcaaacagcataactgtctgcttctttgcacaagaagataagtgtgccttgaagaccgcaaaggaaaatttgcttcaacctgtgaccgtgccttttaaggaaggtcgaggtcaggagttcaagcaaccaagtgggtcgggaatcgatgtctctcgttttgaggaatctgagctaactaatgttggggaaggtggtgtattccctgtagcattcaaagtacaaatggatgtgtcaggcaaccaagaatcagaaggggcacatgagaccgaacaatcgaaatatcttgttaaatatgctatatttgtgaagaaagacaatgctgaatatggagttcatgttgtgcagcagatcctttgggtaaatggaatcagatatgtcttgcaggaaatatatggtattgggaacacagctgataagaatgctcatgaggatgattccgggaaagaatgtgtggtttgcctttctgaaccaagagatactgctgttcttccatgcaggcatatggtaagttactttcttactaagtattcttgaaagaatcacgattttgccataagacttatctgtttaagcatacatatattattatggagatagagttggaaaaaaaatagttatggattttctcctagcattctttcaacttatcagataattttgaagttgcattcttcgggcattttccatctttgatttgctttaaactggaagagaatatgaaaaggtttggattgtgtctactgctatatggtttggagtgtgccattggaggctggaagagggatagttgaaccgctaagataaaggagtaggatattcgtcaaatcccactttaataataaataaaggcagtcactgtccagcatattaaggaacctgcttagcgggcatagatatttagattaaaacccattttttctttcagtgagtatgccaactatcttgccattttctcttaacttctttcctagttttctatgccaaagttcatggcttatattaaacgtaagaaaaaaaattgctagtgctttactctcttccagaaagtgaaagacagacctttcttaaagcacatcaaaggtctgatatgcagtaacatccactgctccactattaggtattagcacttgcaacccccctggcactgtactgattattgaagcaatgacaataagtttatgtacttctgaatggctgtagcattttgtgcccaaatatttacccttctgttctttttctcagcagctatgcatttgtgctatttcattttttatgccatggtaagaacttcgtgaatagattgcaccatgttaagtagctagggatgatgatagagaaataacgattatatcctttaattttgctgatcagttcagttttatgaaaatcaattaaagatagcatgtgccatttttgcagtgcctgtgcagggagtgtgctcaagttttaaaatatcagaccaacaaatgcccaatatgcaggcaacctgttgagggccttcgcgagatagaggttgataacaaaccgattccccaacaaggatctcagcagttaacagcacctcaataaagtctcatctgattgcaagcaaactacctgtacatgtgtcatgtgtatataaaaggtctgtgctttcgggaaggggaaatcggaagttacctggtagcaacaaagctgtttctgatattttgttaaaggatgaacctactgggatttaattgtctacgtttggaccaccaaactcgacttattacttggaaaagacactattttagattgtatggttcaagccttttgcaggggacaatcgttttcttgttctaatttagttactcatccatcactttgatgtgtttaagagcatacgatgtgttctttctagtggatgcacttattgttctatgatgtcaccaattggaagtttttcctccaactggcgtgtccctgggaagactagccaggcaacattttggtgctacatttaccatgcttaagatcttacgattacaaggttatgtagatcgacaatcctttttgggtcctttttgtggtattgcacgtttgcactgctgataacttgctagtgagagaggtcagaaatgagaacagctggaaatttctagtgagaattgaactgtttctattatagtattgcatatctatataatccttaacgaacacacctgtaaaaaacagtttaggcacaacttagctttgtttcttttttttaggattttggattttggattttcatttgaacgtttcccaagcttctagacgatggatatcgagcaaaattttctataaaactttctggactactctttgaaagcaacttttttccaattttgtagtagttaatttatttgtttataccctcaaattgctacgaagaaatcagataatccatccatccatcaattcagctgtctcaaacaggcctattaatgagtgcatcccgaagaaactggttctctaaacagaccttcacaactataaccttcgtcccaatttaagtgtagtcgtgggtttttgtccaacgtttgattgtccgtcttatttgaaaaatttatgaaaaaattaaaaaaatagtcacacataaaatattgcttatgttttatcatctaatgacaataaaaatactaatcataaaaaaattcaaataagatggacggtcaaacgttaaacataaacggtgtaaaacagcaagtctggagttagtagataaagaagtgtaatcctttaattggataatactctccgttggtcgcctgagccagatgcgaccacctaccgtggcaatacttgtcctccattgtaacgccccggttttcgttcgggattaaaaatcattaaataaagcatttctagaaattaaataaaattgaaagcaaattaatcaagtgaaataatagaggaaattaaaatttcctttaaaaaatcattggccgagaatattttgtaatattatctgtgccttaatgaactctttggaatttcctgtgaattttcggagctcaagaaataattttaacaatacaaagttcattttatcaattaaaataaaaaggaaacaaatataactcccccttcctccttttcgggctcggcccaagtcctcccctccctcggcccgctcggctctctctctccctcaagtctgttctgcctcccccttccaactctctctccctctctccccgacaggtgggacccatggaccctacctgtcatctcctacctccagccaccccacagcaattgccatggccgccgaaaccatcccacgccccgccgccttttccgcgccaccccgcccacctcctccaccccccgcgcgcacgctcgtccgtgggacctcgccgtccacgtccccgctcttctccccctctcgcgctcgcaaaaaccggccgccaactcccccactgatgccacccacgccgccggtggttgccgccccaaatc

SEQ ID NO: 26788 - DNA, 11964 bp, Oryza sativa
  unsure (1)..(11964): unsure at all n locations
ctgtgccgccgcgccggtggtcgccgccccccggccggccggccggccggtgagccaattcccgctcgcccgtggccgcccgattcaccccgggtggatatgggccgtccacgtggccctccccgagccgctcggcgtcgccgcccctgtggcatcacgtcggcaccacctcgtcctccccgtcccgcgtggccaccacgtggtgcgcccgccggcatcgcgcgcgtggaccgagtccaccgtgcgcccatccctttgagccaccgataggtgggacccgcttgtcggtgccacctattccccttggtgacgtcataatccattaataattgcgcaataaatcattaataattatagaaatttatttaaatggctcaaaacttctaaaattcatatctaattcatacgaacttcaaattgggtcattcaacttgcaaaattcatctaaaattgagctctacctgtttgtttactttttatgtactgttttcttggtgtttattagagttttttcctcttttgcgtgccagcgtgtagaatccgtcattttggaagatcgcggtcgcgaggaaaagagtcagaagattgttgtgaagaagcaaggcaagtcacacattcctcttgagcatgttgatcccaattgataaatgttttatcgtttgcaaataaatgtgcatgttttgctaattacataggatcagggtttacctatctgcttgcttgtgccatgtttacttaatatatgtcatttgtcaaccttgggtaataaatcgactagctcatgttacttatgtgacctagctagaactatatgcttagccatgcttaattgccactagctcagttgatggaataattgcagtattagacctttttagtagcagaacgagctgtgtgctcgagacatccggccatgtttcattggccgtaattattcaactaaaatacgactgaatggtgggctgtggatgcatggttttgctagtcgcacccatggcaattaaagatcagttcacgggatgcactggaagacatacaacgcttgccacaggcgggaatgtgtaactgcctgacttgaagtatagctttcatctaactgacgttcccaggcaagggtgggcgtgatggagttgggttggccggggtgttcggttgatcggcttccggattcaccgtggcacgagagggaactgtcggctgccttgcgagaagtgggggtgaaacctgaggtgtggtgcgattggtcagagggagttatatgaagggtcttgtcacaaccactcgacatggtgacgttttcatcatgggtgcatgatgacacggtgacatgccggtggattgtgtcttctgggtacagtcgtatacctctggccagagtaaaactattcgaatagccgtgcccgcggttatgggcgatcgaccacattgaccatgattagtctcacccctaataaatcgacccaatgcactatagttcaggtgggttggttggacatgttcaacgtggtgtagcgttgatcagtggagatctaatttactctcgctttgaatcctcacgttgagcggcaaaatggcatgtggattatattggctttgaggttcatgcatgtggttagttaagtttttggcgttcacagtaatgtcacgtcacgtaggctacggcaatggatataagatctaagtttttcatagtacaagtgactctaggagtagatttaattttatatttcagccccttgatactttttatattagctctctttttaaaaaatttatgtggaggtcctaaatttacaccgaacaccctagaatccagaacaaagcgaggaaggagagtatagagggctcagatctgatcaccataatagaggaaaaggccgacctaaacctattttgtgaacttttgatagttcaacaagtataacttgatgctttatgtttaatacaaaatatctctactaggatttaaggaagtttcatttatttattaggctgcactccacgccgagcgcaagagattcatggaatgatcttaggagtgaaatttagttcacttaagtagagaatctatttaaaaaacataggataggagcgagaaacccatgagttgatcttaaaaatgaagtttaggtgagtttatttacttaatgtagaagaggtaactaggatatgtcaaacattacctgtgaatttttcgctagccccaacagaggacagtcgcggagatatcatgcgagactgataggcacggctctccaccagcccaaacaatagagtgatcgctggaagatggtttgcaattttgcaaccattgcatgcatatgggcaaaaaattctgattccagctcagtggctatgtgaatcaagcagcgtccattatcttctctcattcaactaatagggtacaaaacttgggatggcagtccaccatcatattataattatatgatctacttcgtattctcaatctgccgagttccatcagttcacgcatcatcgacaccagtcatagggtcagcttccttgggctcctcatctccaccatcgttgccctcttcggccagggcatccttcatctgataatccaccttgaaatcgtagtctgcatccatgtcggtcagcacgctgaacttgtttgccttgcgcctcttcttctcggctttcctcttgcgaggatcaagtattccctctgctgtgtacagcttgtcattctgtgtgctcgcgctggccgtcttggctccttcacgctcatttgcatcggacatcgactcatcatggttttcctgcgcaggttcattctgcttcttgccatcctatatcaagcacaagacaagtacattatctaattgcagtgtcatgactcatcgatgatgccaactatggcaatcctattcctagcacaaatgtcatgcaaatcacacccataaagaatagagattattttcaatgggacgaaaaccatagtaatacctctagcatctcttcgtcaatctgcggtggggcattagatggaatctcaatgtgacggaactcctccagtgatttcagaccaccaatatatgatgactcagctttgtaaatttcatcaatgttaaattctttcccagtctctgaaataattactgcatcggagtcgtctacagcatcccttttaggtggtaccgtaaaatagggtattttacctaaaaaataacagtgtcacatgactcagaaacggaataagagtaaagaaaaatcagtacaggaggaatcatcgaccataccctcattccagtcatgaagtacaattcttgcagcagcttcaacatccactataccaccttttttcaatttcccccggagtgtggcaactttctgaaggaaatcgtccactgaagtaaatgttggaaccctgtaaagggatagcagcttctcgtgcgggcatagatcgagaatttcctttactgagaggatgtaaagtgaagaaaaatggaacaagttataatacagtgcacttccagcaacatttaatgcatattgttgaatgagatagtattagtatacacataataaaaacatatatagctaattaaatgaagatttcagcaaaactatctgaatagcaccaaaatgatgcaagctatttttcaacacttaccaggactgattggatcttccatcttctcaactcgtttgcagttgcgaagggccacagatacaccactattggaagatttcagcatcacaacaccaggacaatctagcagcttcaccttcttgtctaactgaacttcttgcattgatctagtaactcctggagtggacccaacattaaccacacgggacctcttcaaactgttaatcagactgctcttgccaacattaggaagaccaacaatacccacagtaattgccagtttgagctgtaacatataaataataaaaattatctaaaagggcaacataaagcagaaaagaaaaaaaaaactcatatgcatcgctacaggtcagagtgtgcaaaatgagaattaaaagctcatgaattccctagcgacggtaccactgtacaaacatgacaaaatgaaagagaactacttggaacaacaaattcaactgtgcccatataacaaattaaggtaggccattcttgagattagaaaattattactacttgatgttatcatcaatgttaatatggtttgcataaagcagtacacagaacaaacggaatggaaattcaatattttcatgccaggtgaggtatcaaaggtactgtttgctaagatggcaattttaacaattactacagattatttcaacaagcagactctaacaacaatccatttacactgcccactgaagttatgatacacatgtgaacgttgatcagttacctcatgactcctggaataattcttgagtaatttgatcaggttctcagcaccaagacaatcactgctttgtgggatattgcttgatttatcaatctttgatgatttccatcccagttttgtcctctgctcttgggtattgcacttaaatgcgacagtaggcatttcctctcttaggtacgtaagccatttctctactgactccttgggaacaagatctggatgccacgaattgaaattgagatgttacaagaaagtagacataacacgagtgaagtccgaactcaaagaaaacttgaattgtacctatcttgttgagaagtagcacaatccgtttactgggatcagccttcctgaccatcttttccatgtcaatgcaacgagtgcccagtggatctctggcatcgagaacctcaagaatgacatcagacgcttcaataactttaacaagctccttgtagaaggctctctctgaatgatctggagatacaaccagcagatttaggaataacgtaactgcaaacagtaagtcagcaaagcatgacaagtaggaacattgaacctcaccttggctcttaaccacgtctaaagaggcattctcctttgctgcatccttctctgcaaactcgctgccctgagcagaagctgcagaggccaaattagcaatgtcctcgtcctcaagcaatccaagctttctcttcctagcctgaacagaagtggtcacaatattctaccattggtcaaacagtacaagcaagatgtataatacaaatgaaactaaataaggtgcagaaatatttaatcctctcttcccagtgcaggtatgtgttactcacacaagtccatgttaaggcactgaatgtgtagtgtttgcatacaacattctaatgaaatctcataaagttcagtgccattcatatgtgcattcaacacacttctgaacagatgtcccaaaatttcacaatcatcgttttttttttacaggaataaaaattagcgccccagacaatgacatatggcatgaaatctacccccaaaaacaccttgcttacagtaacagttacccgttcagttaaaacatctaatccaagaatttcattcaacgactagaatcgccaatcgaaaggaaaccagagaaatcgaccctggcaaaacaactttagcagcagcaaggatagaaagaaagacaaagagggagaaaggcggtgcccggctcaccctttccttgcgcgcctccttcttgagctcgagctcctggagcgcctgcgcgcggcgggcctcgagggccttgagctcctgctccttgaagggccactcgttggggatcccggggtccttctcgaccttcttcctgtggctcttcccttccttcttggcctccttgcgcttcttgcggtggtgctccttcaccttgcggagcaccttgtgcttctgccgcagcgtcacgcgcttgctcttgctcttcttgctcttcttcaccatcttctcctcctcgcgattgctagccgccgccgccgccgccgagggaagaagggaaggaagggccgaggaggggaggaggaggaaagaggaaggaggcgttggagggagatgagctagggttttagctggcggctgcgcgtggttccgctcagtaatgggctgggccgaccgtaaaatcggagggtcgtggtggctattgggctgccacgtaagtacccttctgttacaagaggaaggaactagtccacattgcgtcctcctctttccgtcgagtttaatcggcaactctaaaccgcaatacgagaaatcttcaccccctaacttattaaaatcgttaaaatcagatcctccggcagtatagatggctgttttttttatgactagacgtttacgtggggaaaaaatgagccccacgtgtcatcctcactctactcctccccctttcttctccatctcttatccccttttctctccaactctcgagaggagcaagcagcgcgcaggtgcagcttggagagctgatggatagtgcagttgaggagcgacctaacatggggggtggtgtgcccgcctacgtgtggaccacgatgcccagtgaggggtggggatcgaaggtgagggcgaaaggcgggcggtggggaaggcagccggcgagctcacctaacctttgttaggggcgagtccttggcggggaggtgggacacgatgtcatgcaagtgcacatcggggaggctgctgatgcggttgaagctgccacggctcgctttcaatgcataggtgaggaggctagtgtcaacaagcggtagcaggacgaagtagtgcacgaccatagagatcatgccaatgttggagtccagcatcctagcgtccatctgtccctcggtccgtcgcagtatctcgtcaacggtgaagcccacgagcacatcctcctcattgcgtcgcggttgcgccatggtcgcggcgccaacaagggtttggagcatggtggattgggatctaggattggagagcgtggagtggagtggtggacaaggcctacctcctccccgcctatcccacgtgacagccatcatcgtagccacctaccgaagtagttaatccagcttggtcgtgcagaatcgagcagtaccgacttgcagggcataaaagagagcccctcgacatgtcttggcgtaccctccccatcatcgcggctcctcctcccactcccttgtcgcggactacaacacacaccgagggtctgtgtcgaccttgcccaaaggacgccattgaccggggatgagccccagtcacatgtacggcgcgaagagtgagggcccgcatgaagattagggagcagccatacgggttgaggcagtagtagggagcggcgatacgggttgaggcactggctaggcccaatatgttagtggcccagtcttccccccccctccactttcttccctatctctatccaggcctccaagcgtgcgcccaatagggagaaggatggccggtggtcggtagggagaagggcagcgacgttgggaagataggagagaacaaagagggtgatagggggataaaggagagagagggaagctaggagtaatcgtcatcaacaatgcgacgagggaagcacgagctcggcgaggagagcagggaggtccatggagcatgatatcaccgcgctgctcaaccgccaccaccagcatcaacgagtgacccgcggtcgtgcttggacatggccaccctcccccgttctcgctcctcctccactcccaccgcttctcctcgtggcgctcctccccaatgtccccgttgcgtctgtccttcgcattgtactctcccccaccaatgctccctgttcacctcctccttgctgtccatcttgcaatcgcatccgatagatagataagaaggaagaagatgttgtttcactttcatgtgggtctcatatgtttttctttttaatttttgcttctggtgctacatcaatgtcatgttagccaaaataaccttcaatactgcttttagaaccgtagttatattggttttgaaagataagggacatattatatttggtattgcggttcaatgatgcaattcaagctcataaaggacctaaagtgaacttattctgttacaaaatacaacctccgttttttaatagatgacgccgttgaatttttctcacatgtttgaccattcgtcctattcaaaaaatttatataattataatttattttgttatgagttgttttatcactcatagtactttaagtgtgatttatatcttatatatttgcataaattttttgaataagacgaatggtcaaacatgtgagaaaaagtcnncggcgtcatctattaaaaaacggagggagtaaggccttaattttgattttgttttcaaacacagtaagacgtgcatataactactgtttttgtagcacctgttaaccaatataagcttcaatgaagtattttcttccggtagaaggacctcagagccaatccatcatatattctctatcattagaaaaagggaataactatcaagaaaaagaacgaacaaaattcagcaatgcgcaataaacctaagaccatgtgggacaaaactgaatattacacaaattttcaatcctgatttattagcttcttagcttatttgccactgccaaattttgaattttgaaacttaattttggagttaattttgtagtcttgtcaacgtagtatatttttcactattggcttttaaatcattaacaacacatatatgaaaaagttttaccataaattgttatcttgcttcattcatttttttatggattgtcggcttaaacgatcagaaccaaagcataatagttatatatgttaatcttgacaatcttgacaaagatgaccaatgaaaagataaaggcggcacaccctctactggatgttttagttttttgctgtactcttgcctgggtacattattatgtatttatgtgtagaggatgcagcctgcagatgtatcgttcatcttccattgtcaattcaggcaaatgtctctgttcaccgcatgtgttcaggcgcaagtgatttgtgtttctctgtcaacacgtgttcaggagtactccattctccttattctgccacgcatagaccagcttctttcttgaaaggaaataacagaaattgtaaaacagacagaataatactacttccatcccaaaatctcgattttgagtcagtgaataatttgcaggctccctaaatgatacagtatatatgcttcagtgtggtctcccgttgttctgtcccaggagcatcacaagtaaaatgaaataaattgaacaacagaaaccagggttttgttcctatcaactcagaaaacccttctttctaaaaagttaatgccactaaatacctaaaactcagcatagatttctaaaatctacatacaagcatgtcacatcaacccaatgaacacacaaagctcaacatacaaatatatagtaattatatctacaatttattcatgctacacatgataaatcatcattcacaaatcatttcataatatttcaatccaaataatttcatcatttctccaatatctaacatatatcccgcagtaaaacgtgaggcatcatctaattccttattgattttgtaagcttgcagactattgttaatggaaccagtagcccgtctacataaacgtgagctatataacagggctataagaaaatctacgtactccctccgtcccataatatagtaacctatgcatctgtctagattcgttgtcctataaaatgtctcatccggtcctaggttgctatattatgggacggatggagtatatgaatagctaattgttggatgcacctgaaaattttaagtttccagtcacctaaaatggcacatagctaatcctaaattgcaatgctatacaaatacaatgtgcaattttatttcattttaactgcaacaaggaaggaagcccgcggtgatgcgtgggcattttattttttaataataatgagaatactaaaagtagtattatcttaccatattcatcttataaattcaccataagagatggtaaattttcttataatggtaactaaaatagaagaaaaaatactcatgccgtgaaatagatcatatactttgatatactaaattataatgtctctcaaatttcaaacaaaaatctcttagtccatgcttagatataaactcacctatcaccactacagattattattgtcttgaaagttgggtcccttttcataaatggaattgtattagtaccataaaaagagtctaacacataagtaatacaataaaataatcacgaacacttcacacataattctctatcttatgtccaaatctatctgtagatattcttaagctattcctaccaattaatagggtagtacaattaaaattaaacttgaatgtctctctaacatgtgagaccggctaacacttctaagaaccatgtgaaaaaaacatttgcttgagtaacaatctctcactaacacaggggttagtgggtttcaatatttctttcttgtattatatctgaacttttttaaattttttcccgtgcaatattacatccctaggtagcatgtatgttttttttcagcgaatagcttgtactacgtatgtaagtttagccggacagatcataagcatacgaacatcgcaacatttaatctgagtatcgagaggggagaattgattttttgcccgatcttgtatatgtaggtattatgtatgttttttgggagaatggtgtgtcctacgtatgtatgcattttttcggcttttatccggcgaacaatttgcacgtatttttcttgtcgtcgtacatacacgtatggacatatggatggatgcttttcaattggtgtacaaattaatgtatggattgtgtgtcgtgctaaattgttatatgtatcagatattcagaagatattcagaaggtagctaggcttgtccatcttgctaagaccaactcctacaaaacttctcgtgcataaaaattgttcaaaaagagaagttcacacacacataattgtgtcatacctgcacgtgcagtagattaggagggaggttttttttttcgtcgttgtatacaacctagtacatacacggaagaagattaggagtggtggatttttaaaagatctaatctaatggtctaaaataatgggttcaccgatttaaatgaaaatagagagtttgaatgtttcctgtcacatggcggactaagagcgtttatatagtgccatatggcagtttaggagcgtttatagtatgtttaatggacttttagtatataatagatagatcgacggtaagaaagcagagcaatggataacgtgaggcgccgccgtggtgtggcttcttctcgacctcgtaggagtacttttggtacatatgcacagtttgaaaaataacttagagatcgaaggaaagagaaaactaccagacggccgggtcctacgtagttgtattgtaaaatacagaatgtagggttccattaaacgattatgttatatagacaactaatcaaaattatacggtaataaatatttagtatatatctatcatttattcgagatatttagatgtgtcaatatatatatcattctaatactcttctcaactatccaactgatcaaacgtacactaatcacgtgctggactgctgggtgctagacttaatttgtgttttggtggttgttttttgttcactacaggagataattccgatccgactcgttggttcgtgacagtctcgtcgcctccgtatatacccattaacatatgaataatggaccgtagattcgtacggacagatttttttctttccttttagccattagattagattagatttgttacattagccggtttttaggagagagagattttaacaaatctaatctaatggctaaaaataatggctccatatgtttgcgcataaatcaatggctagatttttttttccagaatttcttatattttctctaatttattagagcgccacatggcatcatgagagcgtttgtagaatgtcacgtggcagcttgagagcatttgtaaaaagtctaatgga

SEQ ID NO: 26789 - DNA, 1491 bp, Oryza sativa
aactacaagtccaactttgagacatgaacttagatatgaaatagatcaatacttatgttcaatgatgcaacaagatatagcaatgctctgaatttatgcgatggtctgatttttttttatattatacacttattctatgatggtctgaattgatgttgtcctgcacgtgcatcagtactatcagattttccctacagattgtggctaaaaaattactctgcttgatttcttatagtgcaatgccattcaaccctgaaaagtgaacaatgccattatgtttcactgaaattgaacactggaagtgaattcaaccgagtgaaatttacaatcagtacaaaactttcagtacggaccattccttgctaaaaccatcatcaacagaaccacaaaggttgcagaaccagtcatccaaacaagggttaatatatacttcctccgtttcacaatgtaagtcattaacatcaatatgaatgtgggaaatgctaaaatgacttatattgtgaaacggatgagtaactaacaaaaacggctggagtacgcctccgcctccatcatcaccaatactcgtatacaaacattttccaactccagaatcatttaaccaaaaaaaaaattcaatctttggacagaaacatttttctttggtccctgtagccgaaatgaagaccgttcgaaactatataccatacaacagattgatacaatttgaccatatcttgtgcatgaaatttctctcctcatccatgtcagcagaatattgcatatcatgtagacacgagtcctatcttccaaaaaactgtgcccaaagaattccagaacacctcacttctcatcctagcaaaatgtgacgaagaatctacagtaacagccattttgtagccacggccttctctgtccaagaaatgacgtgtgcataaaaacacaaaaaagcttataaaaagaatttaattttacagttactaataaagtagaagaaagatggctagaaacagtaaaatttatttcaacaccatatatcacatcagtaaacggcacctgcgaaaattcaggcttgtataatcaccaaatcttttagctaattgcttggcatgtgttggttctaaactcttctctccatctcagcatctgtgtcaagactccctggtcttgggagacctgcattacagaggagcaaacaggatgagttgttatttgtaacaccaaaaaggaactgctgaaaaaaaagggtgcctccacatggaccttagcatcatctggcagtccctgtgttcatatgaataccaaggaaatgattgaaggatcgaagcaagccaattggaaaagacacatgccattctcctctgcatcatcatgaaccagctgttccattctcagtcatccatggttctcatcctctgtcaggtttatttgctgttggcgatcacatggaagcagctactagcctactattagtgcaaggtttgtttatatactactccctccgtttcacaa

SEQ ID NO: 26790 - DNA, 3874 bp, Oryza sativa
tgaaacggaggaagtacatgataattatcaacaaggaatattagcacatcatcaatagtactaatgaaattaagttggttaattaatgataactaaatcactttagtacatacttttccaatttttttctctagcctagtcagttagagctagtattttctagttcatgtcccatctaatccccccaagcaaatactaccatattgggcctccaggatccgggtcatcccattcctttaaccaaacagatagacaaaaccatctcattcacctcagccctcaaaaaaaggattcccctatctttttctacctaagccctaaggttgcattattgttttccaatcatataaccattgaccatcacattagcaatattgtatctagaaagacatagcatgaacacaacacagaagcatcctaccaaatgaaagggcacaaatatattaaagcacagcaagaagcaacctatatgttacaggttgcaatacttctttgagcacaggcccatgacaccactggccagaaaagaagcttggctccagaaaaattgcagtatgcatgacatttcccatttgctctcagggcaacgcctcaagagaaattgacaaccagataatcactgcatcacatgccaaatgccaatgcaacatgcaattttaacctaataactaactgaatgagcacagaggcctcaacattagaaaagatagcatggtttggtttgcaccacagctgcgtggtgtatgaacaccctactagaagagcatacaagagaccagatccttactatctccaggacagtcagcatcaacatttgccaatcagcggccgctccggaacaggaaagtatcaggaacagaagctggatccagctcataaaagccacagagtttgccaccgttttcttttgtcagccggaaagaaggtatcaggtgagaaaaccttatgttttcatttgtaggtatctccagagtgccccttacactgtcaggcttgaacacagctctgtagccatctactcgggtcaaaagtaagacttttgtgctagcttcagtgcagtcagtaatttcaccaattgtgtactcgaaagtatccttgctggaaggaacccaaccaggtgcccaattattgtagatggcccaaatttcccctacttgtggatgaatttcaaagtatcgtttccaaccaacttggctagtttctactaaatgagagaaagcatcattcgtgtctaactttatcctccagttgcggattttaaaagtcccacagctcacaggaatattctgctctaaccacatattctcctgctccagctgagggcagacttcgagccaagtcaaatgcactctgaacggatctgtatcaactttggtcacccaaccatagtactttggaaattgatcaagatcactgtaaagagcccatatctggccacgttcaaacttactatatgatcgatattcttcaaagttatgaaattcagagtttgggtaatcaaaagtactgggggaggaataggcagcactctgttgatgcactggggttcgttcaagggaatgatctttacgtttaccttcgttcatcaaattttctttcagcgcaccttgctcatatccagtgaaatcattaaatccactgttcattgtcttgcagacaggcatgcaagaatcaagagtaaccgatggaaaggctacgtccaagttactaggaagtgatgcagtatctagttcaagaaacccaccagcaacacctaccttctcatctccctttgttctaaaaaatgggatactgtgagagaaccgtagcatttcgcttggtggtataacgaatgatggtttctcctttacttttgcaaagagactcacaaaacctttaatctttaccaaagggccaacagcagcaccagcttccactgtgaaatttgacaagatctccacagcttcatactcataggctctatgcttatctgcatctgagctccactgcatactccaacccttatatagagcccatacctcacccttcctaggatatatttcgtatgagctcctttttctacctttcacccatgacacaatatgagaaaacatgagggcatcttgtgacaccactgtttttcctaagaaaaagttcccacaagccacaggcaattcttcatcagtccatttgtcctcttcctcattctttgcatcatgctccagccaagtgaactgaactctgaagttggttgtatcaatgcgtcttatacgagcataatatcgtggcatgccatcacggtcatcataaagtgcccagatctgatcaactgcaaacatactaacatccctgcacctatcgaagtcaaaaaattctgggtcaggataggaaaagttcccaggaatgccagatttcttctgagcattgtatcatgtgcaacatctttccttttttcctggtttccttcattgctagtagttcctttctggtggttgtgtgcttcgctggagacatgaggttcacaagcttgtccatcagcacggacaacattatcatcagccactttcttacgacttgagtcaggatttgaaaaccaatctaatatggttcgcctctttttgctaggcgtatcctggatgatgctggcatcagcattttccttcctcctagccgatctccgtggattaggaatattcatcacacctgtctctgctgatgtatttaccctattaccagggttttgtctaccagcaacatctggagtagggcacgatgtcatctttccccctgccttactaccaacatttgctgcagaagatacatgcagtgttgaaaattcaagtcccccttttctgattgactctgtatggttaactgtcccctcaccacctgctctgacactggcactgtttttcatttgttcatcatgttgtcctccattcaccatgggctttgcatctctattcgctgcagaagagaacttcgtagaacagtcttctggtttgggaacgtcacaatgttgtcctgcacttttggctgcacttgatgagaatacagaaggcacatcctgttcatttagcataactgctcgaaaatcttttttgcagttctgacaacggagtttatgattcagaacattggagtagtactgatatttagttttacagttaacacacattgtccagaatgcttctccagcactgggtggtcgaactgatgatccatatccttccttagcattactagctctatttgcatctgttttctccattggttcagtagcatgcttcggttgagtagcctgcatcggttgtgtactctgctttggctgtgcactctgctgtgtattatgcgttggttgtgcactctgatttcgttttgtagccagcggtggttgtgtacactgttttggttgggcagcctgcgctggttgggcaccctgctttggttgcgtagcctgctttgatgcaattctccatttgatgtcatatgcacgccgttttgttcgatcagacaatgttgactgagcttctgcaactaatttgaaagcagcttcagcgccagcgaaaccgtttttatcagggtgaagcgaaaaagcaagcttgcggaattgctttttaatggttgcttcatccgccattacatccacttggagaactccatagaagtccaatagtccattcatctttgcttctgccgcacaatgtacttcacagacagttaacatctgggatatgttctcaagctctggaaaaatcctttgagctttaagcgcgatccttttggcaccaacaaagtctttgctttccatcttctttgcagcaatatccctggcccttgagggcctcttctttgttgcactccatcattcggctcaccaaattgattctagaaa

SEQ ID NO: 26791 - DNA, 11985 bp, Oryza sativa
ccccgtttttgggatggattttgggtcaacatctagtcatagccaactgcattttgtgttctccgttagaatcagcttgtttttgacgccgcgccgtttaggccgcccgatcataacaaaaattaacaacaattgagtatccacaaatggtggaggtgaacaattacagataagtccgtggaagatgtgaaaaattgcagaaatgcccctcggcaggtggatatttgcaactttgtgccgttgatccttaatatttgcaagtatattctcgtgaatgtttaatctcagttgattatcgtcgacctttagttcgtcgaggtagtaggggagacatggtgcatggaggaacaggggagacttaattaatccctggcacggagaacggagcagcgattaccgggtgattaattaagtatttactatttttttttcaaaaatggattaatatgattttttaagcaactttcatatagaaatttttttgtaaaaaacgcaccgttaagcagtttgaaaagcgtgcgcgcggaaaacgagaaagggaagttgggaactagaggcaacgaacgcagccttagagggatagattgattattcattgcttatttaaatctcacctacaaacctaacaccatctctaagatacaaacctcatcctcatgtactaccaactatattgacgataggttgtggtgctgaggatagggtaatgtccttggagactgttggctcacaggcaattgttagcaaacttgcaggccgctgcgcaagcaccatgtcaggcatgattgcagccatgtcagtcatgtcaattttttcaacttcagttaaaaatttattagaataaatagagatgctatgttctctgtgaatacgactgctgtgtctgtcatggcttcaatcatgccatttgtcagttattcttttggtcttaacatatattccctctgtcccataatataagggattctagttttttttttgtggagagattaaggatgaatgaaaaagactataatgcccatcattaaatgagggggtatctgttgggggggggggggagcaggaaggtgtttgggggttagattgggtggaaattaagtgagaggtggttgagtggaggaagcagatattttgggacaaagtttgaattcttggatgccttatattatgtgacggaggggatagtgaatttgaagttgaaatctgtacatttcacgttaattttaatacacacactaatgacagttgcatatccaaaagagtgaccacatagcatatgttgcctagaacatggaatatttgttctccaagtggagtccatgtacgcatgctattcatagcataaccatggtttgaaacctaaagccatgtcaagactagatataaacaagttatctggagcggaggcatttattctgtcccaaagagagcacatgacacaattaatctttgactaactattaaattctcagtaccacataaaataaacagaaacaacatcaatattctagaaagctatccaatgttttgattaaatgagtacttgcatcatatgccttccacagtttttttttattcaactcacggaaggacctgtagcctaatgaataatgctcaagtagcacgtgtaggtcctgggtttcactccccatgaagcgaatttcaggcctagttaaaaaaagtcactcactggcctctcataaaaacacgtgttaagaattgacctatggcgggccctcgtatagggagcaggggcctcaaagcacaggttacggactgatccatagggggtgagtccgcgtgtggggggccagggttcgtggcttttctcgaccggtttggttgaggcttcttcttaatgaaaagccatggggaagtcattcccccgccagtcgagtttttttttttttaattcaactcacgaattgatatgttttcttttgaaaaggtatgttgatagatttggatgattcattgagtgattgttccttaggagtatattgcaaaacgagtatgctaacaggtttaactggtccatttgttcggtaatttatgtagttagtgcgttccaggtcagttaacaagtttgtggcacaaaaaacttgcaatcaacttttgtcaggttttgatctgtcttgctgatttctgatcacacattctgatttaacatgtcgttatgaactgttgatgcaaactagtcctatttctactcgctgatttagaattacatgattgactcctattattcatgtcgttattgtcgtgattcccccttttgatcattctacctggcagcttgcgtttttttactatggatagcttttgaagcctacataaatagaaaagatgcaacattttttttttgttctgataccatataaacatcatgtataaattcaaactttaaattgaaaattgagtataatgccaagtacaaggctggttcctgtatatgcattccacagtgaggtgattgaatgaatactagctgctgagttttagaaccttgaaaatgactgcctatcgtgttatcataatccaattcttttttttccatatttttcctttgtgtactatcctagtttctatacattgtaaaagcaatactataatgataaactcgtggagaatttaatactggtgcaatataatgtgcaccagctgagttcattagttgtcaactttagatgtttttttgcagatatattattttattcatagtaagtgggttaatttgacattaggactttaaatattcccttcatatctgttgagttgttatataaaaatgttccttttaacgatgtttatgacctgccaattgaagtgttacaccaactatcaagaagtatcatcctcgtagcaagcttgatggtaacatttggtcagactaggggcacaaagggggatgatcagcctgttgaggttccccacaaagtaaagggccaaatacaaactaaccaaggccataacctagctgagcaatccaaaagcattgcatgggctaaccactgtatatcacagaccaacccacctacaggggttttgcataaacacaacactattgtttgctctatagacaactatttagtcctccaactactgtatcagagaccttggccattttgatggatctatgactccaatagttgtcaatgacatggttgccatgcaatcatggcacatggggggcaccaggacgccacgatgtctaggctggtccctaggtgtcctcaaggtgagatatgtcgagctaaaggggttgactacggctcattgaatacatggacagcaaactgaacacatgatcatagatgagaagacgtacatgctaaaaggacatctcaaaaaagaatggagggagtacatgtatagagcgtgttaattcgctatacatgtaaatctatatattctggaattctcttacaggtgctaattccacaagtttttccatattggcttgctacatggcattttgatctgcattaaaccagcaaattgatgcatgatccactagagaggagataaggaaaagagacaaaagagagggcgagaatcagagaaatgccttttgatttcagttaacttgttgattcatggcatgatttggcttactcatatggctcaatactttgatgactcggaaagttaagggtttaaataaccggttttagagcagagggtccaatctggatatttatgaatgtaaactgggcaaactggacgtatcccatagcaaacatataatagtgaagcacacatatctcttaatctcatgctgagctagtcaatatctcaaggaattgaatggaatgctgcccaccttttcagttagcatgtcattgctggaatgctgctgggttcacactgcattgataccctggtgcctcatgcaacaacctggtgaaaagttaactctactaaatctagaaaactatttggagaaagtttagatccatgtgtttcttttttggattatggagctattatgaatttgtgataacacatccttaaattttgtggaaggttaaaactagcaaaagtataaacctaaattcattcctgcataatattgtacccaaaattgagacacatcttttgccatattgtctgactcagtttgtagatttgtaaatactttattcaagtatgaccataacgtaagaaaagagtccatccaaggctcagttcgaaacagattattgagcagattgttgctgcggataatctacttgatgatagggagaaataaaatattttgataaatttacttaacaaataacttaaaacaagtggtctaagcaatacatcaggagtatatttttttggagaaaatgtattttttgaagtgttgagcaaataatccatttcaacaatctggtaaataatctgaaaagaactaaacccaagaacctaaaaggttttttatctgttcgttcacttctgattgagacgtggcacaatcatttcttattttcgtaaaagccggcgtttggttaaacacttaaactgattgagcgtatctgtggccattaattagctttctatacttgtagaaatgaatatttatattataggatctgtaaaaaaaatatacataaaaggtatatgcttctcccatccttatatttatcttttcattttgtgagctttagttgatttattttgtagctttttccaacgtgagtacttttttatattcacaatgttgcaacccactttgtagtagttggtcatacttgtctaacttatgtatactagtttacaacactatgctttgcataaatgacgtatctgattgttttttttgcagacccaattgggaaggaggccagtacgatggtgatgatgctacaagatttgaagcactccgtttagcaatggagttaggcgtagactatgttgatattgaattgaaggtttgtttccataaatgtgttaaactgttacgctgttcccaattagtatgcagtaatagtgtaagcatccttagcgtttcaaattgattagtgcccaccatttgtgaaagtgcatgatacactgtgtaaaaaacttctgaaaatacatgtaatgtaatacacacaagaaatttcatatttaaaccttgctgctctactttatttttttttgtttgtgtttttgtaaatgcatgcactggacattgtgcaatatacataatcatttcccccatttttctgttctccacaatacaaatgatttgagcatgaaaatgtggtgtgtatgtactgcacataactttgaaaatgagttctcggtaaatttggaaaagcacattatagcttcacaggtggaggtgcctatatgggcacttgttcattcattctaaatgatactatgttagtatctctattgcttttaatattcaattttattgctcaccagtagattaatcataccattaacttcagatggaatccatttgccaatcattcttttatatacttcagtgtttagctgccatttggctatcacactaaaagataactccagatgaggaaatttaattgaaaaatgtcctataattgataatgaatgctcaatacatccttcttatgctcaatttgtggttagtgtcctgtgatttcctctaagcttctctggaatgaaattgtaatttttttggtatttattaaatagagttaaagttgcacagttcatgttttccagttgttttaggtaaatcacgaaagatttgtgcatctttgtattaacaaaggagcaaactaacaaataaaacgtctcacaacagaaaaaaggaacgcctaactgtctgagacagtaagactagcccagaaaatgaaaataatacaaggtagctctaactaataatcttgcaggcagatttttttttcagttgttattctatcacgtcttatgtcatatgttctggaacacaatacaaggcctgtttataactggattaagacaaacatttagcaaaacactctaaaataatttactcttcctcaattatcaagccatgtacacccatatgcctcatttatttgagttcacgatttggaatacatgcacacaattgtaaccaactttccttttttttgtaggttgctgacaaatttatcagctttatttctggcagtaagccagagaagtgtaaacttattgtctcatcacacaattatgaaagtactccgtcctgcgaggagcttgcagatcttgtggctagaatacaagcagttggatctgacatagtgaaaatcgcaacaactgctagtgacattgctgatgtgtcacgaatgttccaagtgatggtgcactgccaagtaagtgtcattgtataaaatccaagatacattttcactcttccatctggaaacttgcgtcacctatcctgtataatcatcctgtacatcttgataccactactgcattccttttagattcatgctgtttttaaattacttcacacggaaatcgttctgtctaatgatccctagctcaggccagtaaacattcctcaaactttgtatgaatgcttcctagctcctatggtttggaagtcattttttttaatgaaaacattaggacttgcaatttaattttagcatattggcttttaggaaattgcatttcacatattgtacttcagttaagctgtatgagaatttcaccaatctaacctgtagtattaaacttttttttcagtcccttctgttatactgtactttccatattcaaatctccctatttaccagtgaaagcaaataatatcattaatttttaatagaaaatcattacttaccattgtgataaaattggttgcttgcacagaggatgtgaatagtgataaaattggtcgcttgcagagaggatgcaaattgaaatatcggaccaattaagcttttaaaactttatgtgtttaggagaattttaagaagaaaactaagctcattggcaaagctgtgctcgtttgttagcttattcttatgtcatcatgtttggtgttatttattactccctcggtctcaaaatatggctacttctatcattcaaatttgtctcatctcaacctacttccccatctcaaccaatcacaaccactcctcattaaatttcttcaactactttctcatctcaaccaaccacaaccatttcccacctcaaccttaatccctccaaaaaaaggcataagtagctatgttttgtgccggagggagtaggaggtagacaacagtatggataatgttgtagtatgtctaaattgtacttttatgctcttcttttcctaatttgtaccatgttgtattaacttccatttgactgaccagtagaaatgacaggtgcctatgattggactagtgatgggcgaaaaaggtttaatgtcaagggtgttatcccccaagtttggaggatatctaacctttgggactcttgatgctacaaagatatcagcacctgggcagccaaccgtcaaagaactgttggacatttataatataaggcgtataggacctgatacaaaggttcttggtcttattgccaacccagtaaaacagagcaagagcccaattttgcacaataaatgtcttcaatctattggatacaatgctgtttatcttccacttttggcagatgaccttgctcgatttctcagcacatattcatctccggatttttcaggattcaggtactaatttcagaggatagaaaaaattacatagctattctattggattgcttggaatttgaaacgtttggatggactagatttttctgagtcatacacgagggatactcccaatctggattcttctttagacactttaccttattcatacaaacgtcacctaatggttgttagttttaatgggaaaacctagctatctgtatttttcctctcagttctttgatcgcaagggaggtgaatagttgcttagaacagtcatctattggcagataacccacaggtcacatgttcaaatcccagaaatcaaagtgaaaaattcacacaaacaacccacccaatccacaattagtaggatctgagctctggtcttcagccaaagagacaaaggtacaacactgttgggatatgcaatatctgaccctctgtattggtttgttactgtgttttttttctcacttctctttatatccaaacttttacagagtacttactgtgcatagctctgcacaatctgggagagagcccaaaatagacattttagtttgggggtaaacaagaggccagttgtctgaaactctgaatgcaacaaatcattttcgtggaaagacttttgttagcatactcccctcctggcatgaaaaatatcaatttggaatatacagtggtctctaagatgcaactctgacgactcgtttcaatttcaatatttctattgtttacaataaaattctaatataatggaagcacttttttagacaaatctacaaatatgattcccatgttccaatataatacatatttaaatgtatatatggatgtatttatgtatatatagaaatgcacaaagcgttactccctctgtcccaaaatataaggacttttatagttggacacggatattaaggagaaaattaaagtaaagtgagggatgattgtgattagttgagatgagaaagtaggtgaagaaattaaatgagatggtggtcgtgactggttgaggtgaggaagtcggtggagaaatagctatattttgggatgacatttgaatgctaaaggtagctatatttgggatggagggagtagagatttgacttgatgcatatgcaaaataacatgttttgttttcccgactggagggggtatttcacaagaacaaatctgagttcatgctatatgactaaatgtaatgcagttgctctcttcctttcaaagtggacgctgtacagtgttgccatgaacatgacccagttgctaaggtaccttgatgtggtacacttgatctaattgcttcatttaattaccattttcagatttctttgacctttgatattttcttcaatctgcagtcaatcggtgccataaacaccataattaggagaccagatggcaaactagtgggctacaatactgactacattggagcaatttctgctattgaggatggcataggaggtttttataatcgtaattctggagcaatttttttactcttttttgggagtcatggaaaaatatctgataaattatgtttcacaggcccaggatcaaaggatgctgccatctcacctttggctggcaggcttgttgttgttgtaggtgctggtggagctggtaaggcaattgcttatggggcaaaggagaagggtgcaagagttgtagtagcaaatcgtacctacggtaagattgtgtttctgagccaaatattctttgtctgtaattatgcaatttctgtgcctacctaattctatcatcatgtgcaaatcataaagaattcattttgtgatataaagttctgaactatgctcctcactccctcagccaatgattaatgcatgcaatctgggaagatatattaactcatttttattatccatgtttttatcagtcatgtggagcccactagggccagatagaaacactggtcaatgactctaggccagcagcattgcacacgtgaacagtacccacgcgaagggtgaatgtcatgtgcagcccattaaggtccaaagcagcaataggcctgcctagggtctgcggtactgcaggtcaacagtaactgcatcgttgttcacgatggctgtttagtcagagattggattagattgactagttagctatttcctatctctatctaaaagggtggttactgctcaggatgctttgcatttctttcattttagaacttgtgtcctggtagtagcctatacaactattctattttccacatcaactccctctttattgatccttaagttgacatcctgtatataagcctcaggatattttcttgtcaactgttttcacgttaagatcaaatttgtaaattcaatccataacagaaaaaaacacaagaaaaattcgtctgatcaggcattcttggcattagacttaggacattaactttctctaaggtaggagtagaactcactggaatttggtcatttgtttcttattgtacatccaattttgagtaaagttggagtggaatgattaatgtcactggttgaataagcatatttactactggattcccagaggcttgtagcacgctagcactattgtctccgacatagtgggtctttcagttatggccataagcattcatgttttgttactctggcaagtgatctcaaccaaatgtatgcacaatatatatattttgcggggatgcagaatattgtctaacttttgtgatcttgtattactaacgcatgcattttttattatccaagatgggtaattactccattttgaaaagatggtgcctatatttttcacaaaatttctctcgaaatataaagcctgcatgtgattttactatgatatatcttctgtgtccctatttggcacatttctccctaacattatcattctactgctaaatgtcatctatgtcgaatagattgaacaatgctctcgctaagtactctcttattttgattttttttcttcttgaatacgaatttcgaatcaatttaagtatgggtagtatgctcattttatcttctttctctttatttcatacatttcttagtattctcgtcctaaataagccctgtattttgaaaacggtagagtaccttgtttactgaatatactacacttgcattatcattctagtactaaatgtcaactatgctcgaatagactgctactgttcatggaacagtcatgtcaaagtgcattgcataagccaccccaaaaatactagtatttctttgtgtagttatttggacaactctttctgcacttgcaatcaacagtagcagtctatgctgatcacatcaactattcttaagttagcaaataaaatatgtatatcttttttgtaatttttgttccatcaattcttgtttcaaactggatatgaggcatctggttataaagctcaaaattgatcgtatttcagtacatcatgtaattgataattttcttgagttcttcagaaaaagcagtaagtcttgctgctgcagtgggtggtcatgccctgagattagccgagcttgaaactttcaggcctgaagaagggatgatccttgctaatgcgacatcattgggaatgtaccccaatgtggacggcacccctatcccaaaggtatcttgctcatgcatgcaccatgttatattccagaacagcatacttggaagctctattaccacctttagaattaacctcagcatactctcttgttacatttgagattatcttgatatagctgtctgctcagtgctgcctcaatatttgttataaattccattgttttcgcagaaagcattaagcttctatgatgttgtatttgatgcggtatatgccccgaaagttacccggcttctacgagaagcagaagaatgtgggattaaagttgtcagcggtgtagagatgtttgtcagacaagccatgggtcagtttgagcatttcacaggtggtattgaaggtattgtgctcttttaacttatatatcatataccttattatgtcgaatgttttttgtggacctacttagctaatacaccttcatctttctgataatctgcttttgcagctcctgaaagcctgatgcgtgagatagctgccaaatacacataacaggttcattcttcatcttttgccttttcatttctatgcttctagtcaagtagtcatgatgggttagcatattagattctgttagcatattacaccatgccaaatccacaagggcaagatgtatatgtaatccaacccatagaactaatatagtttaggacccaaactacatataatgctaataatgataggctactagttacttcctccgtcccaaaatataagggat

SEQ ID NO: 26792 - DNA, 1649 bp, Oryza sativa
aaccacctccttgtaggattggttagtctatcatgggatgatctcatgaactttggtgggatggccccatcctataatttgtattgcctatgcatacgtgcttatgaggggtggatggattttaggtggtgatggaccaacaagatcccatttcacaaaccaaacaatcttgtttggttccaacatgcattcatttagtgtggtttgataggctttcccaccttgttgagctgtggacactataaatcagcggttttgtttatgttagccacgtggaaatgacttgagttgtaatcaatgccatggaaaccattcgttttcatttactaagatatactgatcattaccatcgcttattaatgctcattggatgcaactttttttttgatataaccatgtttctgtaggcgaatggcgaagcgacggttgtgagtaattagcccaaatattcctctgggttaagttaataaaagttttggatgccagcccaattttgtgctaggtggagattagttgttgtaatgttcgatttcgccgacttaacctgtcagagatgtaaacagaaagtgttcaatctcatcatacttgcaataaagaatttgcatgcataactgcgcagttgcttgatgatcatgatgagttttaaggaaacaatacacatcaagctatgatcaggtggtttcatgttcatcattcgtaatggaaccaatatctgtgattggcaatgatacatcattgtaatattcagctgcttatgctctactcctttccattgtacttcatgtcagtctggagaagaaaggtgtacgtgattgctggacgtttgacctatgaatgttcaagtccattcagagaattattatataaagctctggtttatgcctaagtttgcagcttaaaatggaactttatcaggcaaggatgctctgtctcaggatctgtactctatgagtatgatcttttgataacgtggcagtttgaatcactcgatgtttttctcttttgggttgggcaaggatgtaacctaagatttcttagttgactacggttgttatcggatcactaagcttctctaatacttccttcattccaaaataaattattttttcacctatctcacacatcaacacaaaacttaaaagataagaatacttttactttatcaaatctcaatatagatattcttcactttatttatttttaatataattatttcttattttcacaaactctgatacatttacttaaaaaatgagtttattttaggataaatgaggagtcaaaaataaatttattataagatggggggagtaggttctagctggttgaaaactgtatcgatcagttgattccaaaggattagactgcctctattaaccctctggacggtctatgaaaactgtaatgaccagttgatgcaacaaatcatgtggtatttgagcttttatatgctggactagcagcagaaactgacaaaagtagttaaatgctaaaagtaaccggtggtgttcgaaactggtgagatgaagattaagtagatgcaaataaaataagaaagttattagtacatgattaattaaattaaattatcataaatttgataaatggatatatttgatattttaaagcaacttctgtataaaaaattt

SEQ ID NO: 26793 - DNA, 17810 bp, Oryza sativa
  unsure (1)..(17810): unsure at all n locations
tagtttctctctctatcgggaccacgtcattatcggtcacgttcttgctgttatgattttcttcgttgccaatatccatcatctatggacgagtcacatcgtgggacacatcctaccatcttacttactattattggttcaccgaagcaccagcatccatcttccctcctttttgtttctcgcttttggctaggaaagacgatgaacaatgcctgttgggtgctattgcttctttgtccaacctaaccatgctcctgaatcactcacataatattgaaaccatagtaatatgaatataataggaaaattctaatttatgttaatgaaacgggcacccgttcggaattaatggatcaaattttcatctatgagttaaagtaagctttttcaatttctagctaatttcatttgttttttcatttacaattttagttttagcactatttgatccactaaaaattatttttaacttataatttttctctgtattgaattatttatagctaaatgaaaaaaggggatttagttatataattgttttaatattaaattatcattccgaccaaacttatttgtggtttcatgtcgttatttttttattatatttctttcatcatttatgccgaattatgatatatgattttaatttatgtcaatgaaagttatctagaatctattacaatacacaaacgttatgctagtacatataaatattatatgtacgtatatgcaattttgctgtatatttatcaacaaattttctcctaaaaatttgacggatgtaattacagtacaatcgtaatgtaactagtatgtaactacaatgcaacttgtatgtaacttttacataattttgaaccgttagatttgtttcaagatttgtgcaactaaagaaggaaaaatgtcattgcgcgcatatatgcaagaggattcgttcccacgacctcttcaccgaaatagcatgttacgaagaaatttttgaaagtgatatacaagttacatataagatacggtgtaattagatcatgattatactataattatatttgtcaaatttttagaaaatttgacgaacaatgccccacgacacgcggtgtccgcgtcatcttccggaacggcaaaaatatagtcctatcacttttccggcggcaaccccaatttggcaactcccgagtctccgacacaatgccaaattgcttaatttcccttgcccggccggctgctcccacactcccacactcccacctcaccaacccacgccaccctgctacgcccaccgccacagccgccacacccaaacccaacacacctcccgacccgacccgccccgccccccacctcacacttcaccatcagtactctggcactctgccactgccgatctcgctcgcgcgagcattcacgtcgtcgctaccgaaggaggaggaggaggagatgacgctcctgtgcgtgccgctggtggcccgcacggtggagcgcgatgccgggcccgaccgcgggccgccggccagnctgcacagccggccgccgaccttcgtcgagatccggctcgacttcatcggcagcaagttccgcccgcgggaggatctcccgcgcctgctccgcggctgcccgctccccgccatcgtcacctacaggtcagaaccccggccctctcccgctcttgctaccctaccgtacgtcgtgctctctcaggcagctaccgcgcaccgcgcgctggactggtttgatacaggatttgcgtccatttagcgcgtgttcatatgcacagcttgcaagttgcaacgtttcgagtgtttcagcttaccatgcatgattattcctgctttgctttgcttttggggttgtatacatttttcgggatggattttgggcgctccctgtttttttcccttttcttttgaatttttagcacagattatttactcaatgcttttaaaagtgtgatttctctaatgcttttaattagtacttatgcggctagactgcgttcgtttgaaacgattgggatctttttcctttcccacgtaaaccacataaaccggaacagtgtatgattaattaggtattggtttaaaatatattaatatgattttgtaagcaacttttacgtagaatttttttaagaaaataacatttaccacctcgtaaaaagtttgcgtggaaaataagaaagtagtagttaaaaaaagtgaagcgaaacatacctgatgaaccctgagttcatctcgacactcaaggctgttgttggcccgatctttcggtgagttgtgataactacgatttgggagaaacgttgacgatccgactacaactgtacaaaaccgttgcgttgcgccttagcgatcgatacacctctccgtgggttgttgatcttgccggtgcagatcaaccttattcctgcaagctatcgagaacaagcaagaacaagatataaagcaactgaattgctagatagacaagacgcacaaagataaattgatacacgataaagtggggttccgaacaagcagacggacggtctagccgacacgcgcgctgcaagcgaagtagcaatggctaaacttacaattaatcaaaacccgcgaaactctgaaggggtacctaactatttaaagagataggaggacgaccaagggcactctagggtcgtgctccacctggttggggcgcaccccacttgggccccacttgggccagggtcccaaacgaagttacaagcccaaaggcccatgacaggtgacgcagcaccttgtttgttcatccgcggatgactaggatggaatttggcgatgaggctggatccattggaaagaggactccgtaggctttccatcaagtactcacgggccaaaaacggaggtcgtatgcagattcggcggccgtttgaaatcaacagtgcagcaggtggccgaatcggattccagcacttggagaccttgatcttgatgtcttcttgttcacgcattatgtgagcaatggttgtatccgtagtagccatggtcacatcagtacccgaggaagatccaagctttttctaactatttctttaggcggtgcagagaggatacgacaagaaaaataaaacggcaacttgactaaagagtgaacaattttattccttaatgctggccatatacatattataagagtcacgagctccctcaggaatcaaacactttgtagtttgtactctagtatttcctatactcactccgtcactcgtcaatacaatataggttaattcttcatgagacttgatatagtttttagtactgcgatttgtttcaacaagatgagtttgcgccaaggtacgatgccgtcgatgcgtactagatacatataaagatttcgcctgcttttctaccacatccagaagttgaatttagaagagtttgattttgaagtcattttatgaaaacaattttttaatataggctttcaaaccgctaataaaaatattaaaccatatttttgtttgcttcttttcacgtacatgtcagctgtggttttgaacaatcaaagtcgtatgtacccctgcattcttaaaaaatcaattctaattataaacctagatatatgcgtgtcaggtttgtatatagggttttatcttcttttagaacagactagtaggcacaaataatctaagcgaacaactagcatgtattttatttacagtacgtgacacttctgctctatccgctattagtagtacttttttttttagaactggtattagtactatttctactttttttttttcgcattgcatgtttcacatgtgcacaggcagttgtggcagtcagagtgtgttgggacttgggagagttgtactgggagggaggcagtgtcaagtgaggctatgcgatctgcgatactataagcttgtatatgttcggttgttcactttatcatcattttaactttgctaaattttgataggggtaataatctaaaacaaaatcttagcaatatcattctaccaaaaattagtatactataatagtacggacatgctgttgttatctctgccatgggagtacctatacatctttcgaaagatttttataatcgtatcacacagatttttaatctttgtattaaaatctgatagatataataaaaagcaaaaagcaattaagaaacaccataatgaacattaaattaccatatcctcaagaaaaagaccaaatcaaatataaaatttaaaatttacatgtgaagattcaaaaattacagtgtaacttacaaaagttacagtgtaagtttcataaattacactataacttacaagaaaatgcactgtaaatttgagtgagaaaatcgagtgagagataagaaaaaatctttcgagtgagatatagcaaaatcgctctgccattgctttttaattgcacggttagttttttcatggcgtgttttgattgcgggggcaggaaggcccatatcaggcccaaattcattcagtctggcggtcatgaagttctgaagctacgggaatggcgacgaactaatcgtgagatagataattctgccgattcctgtcgcatatgcttcccgaagaacaacgagcacatgctttgttgcgatcaaagagaagaaatactgcatatgcgtatggtgctatagcttcatgatcaaacttgtatctacgaggcaacggcgttaaaaattaaaaatcaaatgggatagtagataagatatacaattcgtgatactcgaggtaacaaggctaattatttatctggtcaagatagagagttctccggttggtccatgcgcagtagaaagagagagcgaagcaaacactcaaacagcagctacactgctacagtgctacagcaggcggcaataagggaaaaaactggaggcgacacgtccgaatcggacgaccacgtcatcatgacgtcatcctgcatacataagtgaactttaaactatttttttctcttaaattatttatccaaatcatgatccgattgcaccattaaatttattgcaattaaatctttaaaacaagaccacacatgaatataatccgatgaacttttttaagcttattattgaattatttttaataaatgttgcacgctgttgcactaagtatatggaattgttttactaagtagatcgaaaatgtttcatcggacgctgtttcaccttatatgaaaacaatgtttcagcgaatagcgaaatgatgtttcaattcactgcaacatttgattcatacatagtgaaacaataagtaaattacgtgaacttttttgtggaaaaaaatgaaatggattcccttaatagagggtttctataatatgtgggtaatttgttacaaaagaattgtttcaattcactgcaacatttgatccatacatagtgaaacattatgagtacattatagagggtttccataatatgtgggtgatttgttgcaacggcgtgtatggtggggacacgtggcgggagcagcgcggggacatgtggcgggtagggcgcgcgcgcgggagggcatgacgtgtggcgcccgattttactccccacgtcgagcgcccgattctaggcattcctaaaaagaaataataaaaaaaaggagtacacttattcggatttgtaacataacgatatctagggatgaaaatggggcgggtatattccaaccgcccgccctacccgaggctcacaggaggaatatgggagaaaaaatgggatacccaatactatccaagttcgaatccgaattcgttagaaaatatgggttaggatacgggaaaacatgtatccgcccgcataccccatattataaaatatatatgaaaatctattataaatccacttacaaacatgataaaagattggttaatcactattttttatgagctcacatgtaatattgcataatttttctcttgatgtatctcttttaatactttaattaccttattatgtttaatatctatgaattagagatacaaatagatatccgtttccgaatccgatttgatgaaaataatatgggatagaatacgagatgagtgatatattatccgtcactaaccgtacccgactccgagtttaaagaaaaatatgggttaggatatgggaatgccataatccgaccgtatccgcccgttttcacccctgtcgatatccaatcttagattgctgtattttgagacgaagaaagcagctcaggttctcttatcctgttttgccaccatgctcacgcggcaaagaactggcaccaatcaatgagaggagaggaagcagacatatactccctccatttatttttggctgctcctatttatctcaaaataagttcttttttagataaacattacatcggtatttgtgaaagtagaggccagataaatgcattgggagcagataaagtgcaaataattgaattagaatttgataaagtggatgtattctagtcttttcagttttatgttgatatgtgtgagattggtgaaaaatgaacttattctgagaaagtattatgtaagaagttgaagcaaacttatcagtttgacatcttcggcagcctaatccatggcatctgcgcgaggcgtctctacttggccggtgcaaagtaattttcgtgtagttttaactttaatgatagcgccatctatgattataaaaagttttatcttaaaatatatttctactcttataaaaattgaagaagtttttatcggtactttggaacgttttctgtgtatgagtcggtttttaagttcgttcgcttttgaaaataaaggagtcatataagaagcctctttaaaaacactcgcatgctagcttgagacaatcggactcctaaatacagctcatgattttttttaaaatatatatatatatatatatctaagcgaattactacagtgaatttcatctcaactaaacaatatagcaataataagattaaaataaacttcacccgttgcaacacacgggcattttttctagtcttgtataaagagtaaaaaaaagagatgttattaagaagtaaagtgccattttcaatagtttggaggataaaaaatatttcagagattaagtgatctagctattggattagtttgggtagtaaaatggattttgttttttcttttctaagctcccatataagcacctagcattggagatggcctaagcgcacactgctacccttaacagctataattattttggcaattaacaattacttaattccctatttcatattgtagatgctgatcatagtaacagtattaccaatggcagtgaaaccatttctttttgtcaagacttgtgtcataacaacatatcaggataaatagggcaaatgtagcaatgacatggctaatagttggtaacaacatgttattgcaccagttgcttatcccagagcgtgttactctacctatatacaagctaatccctccttcgaaaaatctgagatctatttctttttcatcaataccaataagcaattaactcactcaccatgtggcaaaacaaataaacatgcaattgatcaacaatttaatttagcacatagtaactataaataggacttagatttttagaaaaactaaagaatgaaataggtctcagatttttggaaagaggaagcactatgttactgcatgagcatggcatagttactacaatagtataggaccatattactgcacattctctacgcactcagtgaaagtaggcacgaggttattgagaaatccagcatgcatgctctttaagacatgatagaataggcaataatctatacctagctatcttttacaattgctaattccacaagttttgccacattggcctgctacatggctttgtgatctgaaataaacgagcaaattgatgtgagatccactagagaggagataagaaaaacataattctctctattaaaatatagagaacaacttggagaaaatttagttctctgtttttctgggggattatggagctgttgtgaatttgtgataacacattcttaaattttgtgggacattaaaactagcaaaagttgtaagcttatatttgttcctgaatatatagcttaatctatattgtttgactaagtttgaatatttattaatatgtgaataaattgttcaagatttcaagtagaaccacaaattttgaaaagtgcccagctaagaacctaaacccaatttatttgttcgtccttttccgattgagacaaggtgaaatcatttgtcgtttttgacaaggttggtgcttgctaaactagttgagaggacttgcgttcatcattacccttgacaagtggcataagatcgttcatcattacccttgacactctagaaattgatattatgctgggatttaaaaaaaaaaggtccacgtaaacagaatgaccagacttatttgattctctcttctttatatttatcttttcaatttctgtgctttaattgatttactatgcaatgcaggtacatttgttttacttcacaatgttgctccccactttgtagttgttggttatatttatataactactgcatattagattcaccgttatgctttgcataaatgacatttgtatgtgcatatttcttttgcagacccaattgggaaggaggccaatatgaaggtgatgatgctacaagatttgaagcactccgtttagcaatggagctaggagtaaattatgtcgatattgaattgaaggtttgttacctcaaataagttaaactgttacgctgttcccagttaatatgtaatattgtaagcatccttagatttcaaattgattagtgcccactatttttcaaaatgcataacacattgtattaaaaacgattctgaaaaatgccttcttttcatggttaaaccccaccactactttttccttttatttgtggaacacaagtgcatccacattgcctccatttttcattctaccacaatatgactaatttgagcatgaaaatgtggcctgtacataactttgaaaatgagttttgagtaaatttggaatatcatgttgtagcttcatagctggaggtacaaatatgacactcattcatgcattatggatggtgcaattttaatatttttatgtattttaatattcagttctattgctcatgacaagatagatcattcctcttaagttcaaattgaatccatttgtcaatcatactattttattctttagagtctagctgccatttggccatcgcattaggaaggttaactaaaatataacactgaagggggaaatctattttaaaaacgtccaatgaatactcaatacatcgttcttatgctcatgtggtttcttttaagatgctctggaatgaaattgtaaaaagttccttttgtaattacttaataaacttgaagtcaaaaaattcatgttttccatttgttcctttagggaacacaccaaatatatttttttttgcatctttatgttaagtaaggagagcaaacaaacaataaaaaatttggaaaaaaaagtaacatgtaactgttcaagacaaaaatgccaacctaaaaaaagaaaaaaaaacacaaggtagctctagccaatagtttttcgggacgattcttcagtttttattcttgtatctcttatctcatactctatatgtttcatattataagatgttttaactttttcctaagtcaaacctttttaagtttatagagaaatattgcaacatttataacaaaatattaacactatcaaatatattcattgttagatttaatgaaactaatttggtgttgtaaatattgctaatttttcaataagcttgatcaaacttaaatatgtttgactcggaaaaaaagatcaaaactcttataatatgaaacagaaggagtatatgttttggaacacaatgcaaacctagttttaagcaatttaaaaagccaaatgctttaatataatttaattttcaccaatcatctagccatgtaggctctatgcctcatttatctaagtacatgattaggactgtatgggggcacatttgtatcttcattagccactaggcatttacatacataacggcatgcatactatatgtactaaccaagtttatttttcttgtaggttgctgacaaatttatcagctttatttatgggagtaagccagagaagtgcaaacttattgtctcggcacataattatgaaagtactccatcctgtgaggagcttgcagatcttgtggctagaatacaagcagttggagctgatatagtgaaaatcgcaacaacagctaatgacattgttgatgtgtcacagatgttccaagtgatggtgcactgccaagtaagtgtcattttataaaatccaagaaatgctttcacttttctacatggaaacttgcatgtcacctatcttgtatagttgtcccagtacatcttgcctctagcccactactactgcatgccccctttagattcttttttttttaaaaaaataaaggaagctattcagatccatgatgtttttgaattattgcacatgtcaaaactttgtgtaatggtccctaaggcctgtaaacatcactcggcatgggggattttctatggtttggaagtattttttaagtgaaaaacattaggatttgtaatttaattttagcatgttggctttcagaaaattgtatttcacaaattgtacttcagctaagctacatgagaactacaccaatctaaccctattttttttataaataggtcctttcaaaaacttatttcaaagctagaccgtgcaaaaaaacttaccaaaaatagaccgtcggctcaacgccaaccgcctttgcgctgaggttacactgatcagcgccgactcccttgccaatgtggcagccgagccaatcccctcgtctacatggcaggggctcaacaccaaccgcattggcgctaagctactaatctcagtgccaatttctggtgctgagctttgggacttagctgctcgcagttgggccacccaacacaactcatatgttgggcggcccagaggcgctgagccgtcaaatctcagtgccaacgtaattggcaatgaccctaaagatctcagtgccaactaattcggcgctaagttttgtgacttagtcgctcaccacaggcccgctcaacacagctcctgtgttgggctctgccctgatgcgagggttcaacgccaatacccgaggcaagccatggtgtacttgatagatgcattggactccttcacatgaaacatggatgcacccggatagagtagctctgcagccatattttcaagtcttccatagattgaaattccaaccccgttctcgattcctcccctatggcatcgatggttccatcttattgtggatccccatcggcaactgcgagcccatcattgctaagatccttgaattgagtgatttccggattgcgaccaacgattttctcaaacactctcctctcttcctctgacatcttgcccattggacgatcgtcattggagttagaagcatactcatccacatcatcatctgaatgcacattcaacaaatccatgttcaatccattaaataccatagcctcctcacactcctgtcgggtgtaaatttttcttcaaagcaattctctgatgtatgaagccatctgcctatcatcaagttcaactttcatctcattctcaactgattcacatctaggccaacatctgacaaatcctcccctacctccacttcatcctcaacgggtacttccccctacctccatatcctcctcaacctgtacttcctgccctacctcccatcttccacaattaattattccttccgatccggacaaacatatcgttcttcggttcatgacagtacagggggattctatgcgcgaactttaattgaggtctaaaaattcattctccgatttgctgcgctctttcttccaagcaaacatctcaagcgatttgaattgtgaccctagtactatatctacatatgtttcccattccacctctctattcaagtctaacataaaattatgtgatatgggacctgcgcccacattgtatcttcctttcataccaaccgactcatcactccaatccaattcatctttcgtgcgggactttaactcttcaaatgtggatttggcatgaaacactaactatctaacagtctcccccgcaaattggcttccaccagtactttcatctaccacacagctaccaatctattcatctacaatgtgtaatcaataaataaaaataaagtatttcagaatagctgataaatgccacgccaatcccaaaactatcaaacctaagaacgttcaaatgtttcaaaaaaaaaccctaacaacgtatactaatctatccatccaatatgtaaccgataaataaaaataaagtatttcaaaataactgattaatgccacgccaatcccaaaactaacaaacctaagaacgttcaaatgttttaaataaaatctaacaacgtacaaattataaattaccactaaccccaccactaagtcctaatgttttaaaaaacacatgaatcatagtacaacttaactttcaaactcctacaaattgcctaaaacaaatcatttatctcgggttacaaccacacatctaaccctagccatcatcacacattcaaaatataggttcagaaatttacaaatcaacattaatcaaccgaagcaacatcaatatggaacttccacactaatcacgacccagacaacccaactaacaatagatcacgagccacattcctcaaatcatggttagaaccaaaacaaccaaaatacataataaaatgttcaagaaattagggttttcgagggagtttatctttaaactcgaccccacactcaatccttacgaaatcccatttgattttgtgtggatttggagagatttggggaagggaggagagagaacttggcgtcgtcacacgagcactaggggagaggaaaggagaggagaggaagaagagatgttgggttgttgcggcctcgtgtcgcccttagtaacctagctcaacgccaacacggccggcgctgaggttagacggttcagccccaaggcggttggcactgagaccctgccacgtagacgaggggattgcctcgactgtcatgttggcagggggttcagcaccaacagccctggcacgagccgtctagccttagcgccaagacagttggtgctgagccaacggcctattttttgttgaagttttttgcacggtctaatttcaaaataacttttcgaaaaaccaattggttagaaaaaatggaattgaacctgttaaacgaaagaaaaaaatatataaccccttttgttctcatgttctttccatattcgagtctccgtaatccctattttcctagtgaaagcaactaaaacaatgtgaatttacgatgggactagttcagccttattaaacctttatgtgttgaggagattcttaagaagaaaaaaacactaagctcatggaaaagttgtgctcttttcttagcttattcattcttgttgtatttcatcaagtttggtgttattatattaggaggtatgcaatagtatgtgggataatgtcgtaatatgtctgacttgtacttttatgttatttttcctctaatccataccattttgtattaacttccatttgactgaccagtagaaatggaaatgacaggtgcctatgattggactagttatgggcgaaaaaggtttaatgtcaagggtgttatcccccaagtttgggggatatctaacctttgggagtcttgatgctacaaaggtatcagcacctgggcagccaaccgtcgaagagctgatagacatttatgatataaggcgcataggacctgatacaaaggttctcggtgttatagccaacccagtaaaacagagcaagagcccagttttgcacaatacatgtcttcaatctgttggatacaatgctgtttatcttccacttttggcagacaacattgctagatttcttagcacatattcgtctccggatttttcaggattcaggtactaatttcaaaaagtagaaataattactttactatttcttggaattggatggactaattttttctaggagttggatatactagatttaagtggtattgactctcaagggaccacatgaataaggattgttgtaattttttgataaatcatacatgagggatcccccaatctgatgtcttccttagacaaacctcattcgtacaaacctcacctaatgaatcccttgttagttttcatgggaaaaattcagctatatatatttttcctggcagctctttgactgggtatgaataattggtttgtacagtcatatcatcactgactgtccacatgtgacatactcaaattgtggaaatcacagcgaaaaatccacacaaaaaacccacccaacccgcagttagagcatcaccaagagactctccatccaactctctaagctaaattttagccaacatagcaaaaaatagtactgaacatgtgaaacggccactccccctcccttgtctaggtctgttactgtgattcttttacatttcccttgatattctaacatttacagagtacttactgaacatagctttgcacatatttttacaaatatatggaaacaactccttaaaaatgaactgagcctacatctgattatgcttagggaagatgacagacccttgtttgaatcatggataattacttgtaatctaggtccctctgcgatgtttttaatttatttcccttttgtaaataactcttttatataattgaaataaaccataggggcttttccactgtttgatggtaaaaaattttttaaataagttttgcacattctgggagagagctcagaatagatattttagtttgacggtaaacaagaatccagtttgctgaaagtaaccagacttttggtaattcagnnnnnnnnnnnnnnnnnnnnnnnnngccttctgttagtatatagttcctctgggtatggaagatgaaacattgaccactcttttctattttaatatgtctgttgattccaatagagttatgatgtaatgaaagcactgttcaagacacatctagaaatctgattttcatataaatattcaaatatacatcgatgtatttaattatacgacgattctagttttagttatttgacttgatgtatgttcaaactactacttttgacaactggagggggtatttcacaagaacaaatttgagcggtatatgactttatgtaatgcagttgttctcttccttttaaagttgatgccgtacagtgttgtcatgaacatgatccagttgctaaggtaccttgatgtgtggtacactttctctaattgcttacttgatttaattaattacttacctttttagacttatttaacctgacatttcttcaatctgcagtcaataggtgccataagcactataattaggaggccagatggcaaactactgggctacaataatgactacattggagcaatttgtgccattgaggatggcataggaggttttttataatcttaatcctgaaacaatcgttcaactgttttttcggagtcatgggaaaaaagtagctgataatttacatttcacaggtccaggatcaaagaatgctgccgtcacacctttggctggcaggcttcttgttgttgtaggtgctggtggagctggcaaggcaattgcttacggggcaaaggagaagggtgcaagaattgtagtagcaaatcgtacctacggtaaggttttttttgtatttgtttctgagacaaaatgttctatgttggctgcagttattcaattattcatatgcaaagcataattcattttattagtgtaaagtattggaagttctgtactcattatgccgctcagacaatgatcaatgctgaaatatgggaagatatattgcatccatttatatccatgtttgtatcattgtcatgggtgatttttgttccatcaattcttgtttcgcactagttataaagctcaaagctgatcatatttgagtacgtacatcatttaatatgataattttcttgtgttcttcagaaaaagcagtaagtcttgctgccgcggttggtggtcatgccctgagattagccgagcttgaaactttcaggcctgaagaagggatgatccttgctaatgcaacatcgttgggaatgtaccccaatgtggatggcacccctattccaaaggtctctttcttacacgcacgccatgttaatattctgtaagacggaatatactcaacacaataatctattgccagatagcgggagtacatatataggttaggccttctatatctctaccaacttataaaattagaatcgggagtacagaaggaatccgaacctaattacaggaagtagcaataacaaactcttaacatatatattccagctataaactggtggaaccctcccttctactctgttaccatctttaatttcaattaatcttggcatgctctctaattagcacatttgatactaccttgatatacctgtccgctcattgcggccacaatattttccatttgtatgtgcagcaagcactaagcttctacgatgttgtgttcgatgcggtatatgctccgaaagtcacccggcttctacgagaagcagaagaatgtggggttaaagttgtcagcggtgtggagatgtttctcagacaagccttgggtcagttcgagcgtttcacaaatggtattgaaggtattgtgtccttctaacttatatcatacactttgttatgccaaatgctatcacccattcctctttctgataatctactttctacagctcctgaaagcctgatgcgtgaggtattagcaaaacacacataacaggttcgttcttcagcttttgccttttcatttctattcttctagtcgtagtgatgatggtttagtatatttattagattctgttgtatcatttgcattgaagacgttctctaacaccatgccaaaaccacaagggcaagatgtttttgtaaaccaactaaccaaccgatagaattaatatagtttaaacgccaaactatatataatgccaataatgtttaactattggttgtaggatttgattcttagtgtggtttttttatttgagaacctccttgtaggattaattggttggtctatcatggatcacgccatgaactttggcgggatggtcctgtcccttaatttgtattgcctccggtttctaatagttgacaacattgattttttttacgcttgtttaacaatttgtcttattaaaaaattacataattattatctattttgttgtaacttggtcattaaaggtatttaagcatgacttgcattttcataattttgcaaaaagaaattaaataagatgagtgaccaaacgtatgtgaaaaattcaatgtcgtcgagaaattattgcctatgcctacgtggagggatttaggtggtgatggagcaaaaagattccatttcacaaaccaaacattcaattagtttactgtggttatggtgatctttcttacctagttgaattgtggtcacttagagcacccgcaatggtaaagtaaggtgctctctataaaacatgtacatctcagcaatagattagattaatagtaaaccgcttcaatagtgtgtctacatgggtatctatagctctctaatatattgcctcgtttttctctatagactatctccaagttagtagatagctttgctctctctcttcatttagtctcttccatatagtaaaatatgctgacatga

SEQ ID NO: 26794 - DNA, 1966 bp, Oryza sativa
  unsure (1)..(1966): unsure at all n locations
catgaatatcttgtagagagcatatagataaccattgtgggtgcccttatatatctgcagtttgtttaggttggccatgtggaaatgacttgagttgtaaataaattctgtggagaccatttccttttatttatttatttactaaggtagtaccttagcctattatattagcgctcattggaatcaacttgttttgatataagtgtttgtgtagggctgtaggcgaatggggaagcgggaacggttgtgagtaattatagcccaagtattcctctgggttaagttaacaaaagttttggatgccagttttgtcctcggttggagattctttgttgtaacgttaatttctccgacttgtcgcctgtcagagatgtaaacagaaaatgctaagtgttcaatctcatcgtacttgcaataaattaagaacttgcatccatgactatgcagtttgcatgatgatcatgatgggcttcaaagaaactaataaagcatcaagctatacgatcagatggttccatgttcatcacgtaagattacacctgtcgacttgcttgctactaaaatatataatactagcaaaagtgcccgtatgttgcaacgggaagaaaaaagagaaaattgaattcaaacatattaaattctaattaattgaaatataaattttttggaatatttgggtatttttaagtaggtaggtatataattaaattaatttataagtaaactaagtgtgagaaataaaatgatatggttgcatttattttttattaaattctccatattaattacactctttgaaattttcttgaaatttacagagcttaattgttaattttgataatacaaactaaacatcattttagcatttatttaaataaaaaacattctttctctatgggccatttttagcccattttcttcttcagcccgcaaccgagccgtcccacttttctcaggccgcaaggtattaaagtctaactaacatctccatactcctctcagttccacgtttgtgatggactgtcggcccgcatgcggctcaagtgtcaccgtgtggtgatggaggcctgcccaacactcgatcgatctgagccgttcgtttcgatggacaacaaccccagtgcaaccctaaccctagaatcattctccccccacccttccccaccacaccatcggccgcctcctcccgcccgacgccgccttcccccgcccgacgcagcctccccccaccggcgccgcatctccccctcctctcacccctctggcggcgccacttcctctccactctccctccggtggtgctgctccctctccccctttccctcctgtctcaccggcatggcgcggcgacggcggggtacggtggagatggcagcgacggccgtccctccccctctccttctccccatcggcctcgatggccgtccctccctctcagcctcaagatccggcggcgtcctcccaacggcggtggcttcccgcggccggatccgataccggcggcttcctgcggtggatccagcgatgacgtagacatcaccgatccggcttcaccgatggcgccgacagcttcccgtggatggatttaccgcgtcacatgtaatcggattcgattttatttttcgccccattttttcgcccgagtttgtttctttttttgaatcggacagatttaattttttttcgtctttttttcgcggatggaggtggccattgcaggcggcggcgtggaggcgacactcacctccccttcctccctccacgctcctggatatggccggaggaggggagcgatggtgggggcggccactgcaggtgatggaggtggagctcctccctccctccctagcttccagtgttggatagtatagaagagaccgnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 26795 - DNA, 7527 bp, Oryza sativa
tgaaaatttaggttgtctagtggattggttaacaatcccacacagttttatctacttttattgcgattttacctattgcattagatcaaattgatgtggatacattttgaaggatgggtttattttgaactggattatgagttgtgtggactgcgaattttacacaaatcaaacacttggttaatttaaagttttatggatctggcagtttccggtgtttagtgcctagtcccctcttctgctaactttgctattcttgaaagtacacatgctgagagggtcatgtaaggctatggatgattaactcccaattgagttcaggcatccacaattagaatatggcatgttaagtctaaacctttatatgtgctatttgattcccataatattttatcttaagctgagcttgattacaatgcaatcatttctgatttgttttttttaaattttgatttccttaaaaggtttggttgatgaatttggtatctttgccatttggattgccgcaactctgtattgaactgcaattctaggttttgcaatatatagaaattaatggaatatgtactttgtttcagttttttctctgttcataactcatgagatggaatattttacataacaaactctgcaatcccttattttattttgcagattggtgctgttgcgcgtattacacaccagctagcctgtgcaacacacaggttttttgatgagaatggttttctttatgtgcacacaccaataataactacaagtgattgtgagggtgctggtgagatgtttcaagtgacgactttgttcagccatgctgaaaaggtggagaaggaattgaaagagaaccctgcaccatcagagtctgatattgaggcagctagagttgttgtcaaggaaaaaggtgatgcggttgcacagcttaaagctgcaaaagctagcaaacaagaaatcacagctgctgttgctgagcttaacaaggcaaaagaaaatgtctcaaggctggaggaaagatctaagttgaagcccggaattccgtacagagatgatgggacagtagcttatgagaatgacttcttcaaacgccaggcttttctgactgtgtctggacagcttcaagttgagacctatgcatgtgctcttagcagtgtttatacctttggaccaacattccgtgcagaaaactcccatacatcacgacatttggcagagttttggatggttgaaccagaaatcgcatttgctaacttgcaggtaaataatccagatcatattttcctttgcagcatttgaaatatttcatcttagcttattaatctatctactattggttctaagattctgtatgaattgttatttcatgatattttggcgaactgtgttccaggatgatatgaactgtgcagaaagatatgtacagtacctttgcaagtggcttcttgagcattgccgggaagacatggaattcatggtgaaaaattacgataagactgcaattgagcgtctggagcttgtttcctcgacaccttttcagcgcatttcatatacaaaagctgttgagctattgaaaaatgtcactgataagaaattcgaaaacaaggttgaatggggaattgatttagcttcagagcatgaaaggtatctatattggaatttaatattttatcttccgatgacttactgtgctttgtttacatttttatctctcttcttacattgtttaaggtatttaaccgaggtgatatttaagaagccggtgattgtttataactatcccaaagaaataaaggcattttatatgagactcaatgatgatcagaagactgtagctgctatggatgttcttgtgcccaaggtaaatataaatatttcagacttctagttagttccaatataggttaggtgtaagcatgtaaatgtgttgcatgaacataaattttgaggttaggtgtaatcatgtaaatatgttgcatgaacagaaaatttgaggttaggtgtaaccgtgtaagcatgtaaatatgttgcatgaacataaattttgagttaggtgtaagcatgtgaatgtgttacatgaacagaaattttgtcattatcgacctgtcatagtatgatccctaacttatttgctggaatatcttccaaaggttggtgagttggttggtggaagccaaagggaggaacgtctggaccttctcaaaacaaggtatgcgatgctcaacttcaagcagaagatattttggaatctttagtacgatagctattgttccatgcttttggtattctctctgcttaatcaaatagtaaaatgggtagatattgcacatggtaacagtcttaaccattattacatatgtatcatcccatcattattccctattatatcatccttcctggcttgttgctgatgtacctagtcaaggctgatgttgagcatgcaaaaaatcttgcactgattgttcctcatatattctattcaatatgtcatcatttctttggaagctatgcatccagtggatgatgctgaacatgctaaaaatctaaaaatcttacaatattacgtgtttatgttcctcccctgattctgttaaacttatcagtcatgttttccgtaaaatgtatatactcagtcaatgacatggcaattttgcttcacaggatacaagacgccgggttgcctttggagccatatgaatggtacttggacctccgccgctttggatctgtcaagcacagtggttttggtttgggttttgaaagaatgattctttttgccactggtttggagaacatcagagatgtcatccccttccctagatacccagggagggctgatctctaaaataaccagagaaagctggattctaaagttcttctcgctgtcctgttagctcctcaatttcaggtctacaaatgtgcactgatatatttcgtgtcagcttggttgtaatagatgctcaccatgtatttagttatttgccactacagcatatgaacgaccaatttactcatttttgcgatagttgaacattttagaagttttgttcaaagcaagatctatttgtactcgttaattgttacaaaacgtggttttgcaggtttgaagtcataaccgctacattttctacgaatgtgcaagctacttgatagatactccctcctaaatatagctactttaagtgttaattatgtttcaaaatattgctactactataatagtataagggttgtttagccaatctagtctttcgtactttttcccttgaactctacaagagaaactccagattgggacaattaacggccgacgatttaaagcaagttatttgctccgggatcgattggccgagccgactttaatactggtatggattctagcatgtcaattcagaaaaagatcggccggtggtaattcagttttgacaaaatcaatcaaacgctgtcggagcatagtgtacgaaccgcggcttgctggctcgctgcaaaatcagcatggcagctttcggctttgacctgcttctttgaatcttggacaaacaattacagtttccgtccaaaattagatgtcattttgacttttttctttttacatttgaccatttatcttatttaaaaaaaagtatgaattacctccccgaactatcgtggtcgaccaaattgccccctgaaccacaaaatcggacattcttcacctccaactatataaatcggacaactaactcctcgactcaaaatcagacaactaactctctgactcaatccatggtggtttggttccacatggcagtgcactcaacaattcttttaataaaaaattggtgggacccacctttcagttccccacccctctctatctctctctattccccatctctctctctcttctccctcccctcaccagcacggtggcactgaggatggccacggacggcgtcgatggaggttgctcgggcggctggcggcggaggtggaggtcgctggttgttgacggtcgttatagatcaatttcgaccgtcaatataactaaaataaaggagaactagctatgcttgcaatgcatatttattttagaataatctatttccacttgtacttggattttatttgattgcagcgattgagcaaataaaatggagaagaaatgaagaaaactcacccttaagcaagcttaaggataagatgggctcacatgtcaggtgtaaccgtctcggaaactgtcataactgtcgcaaccgtcatagggacccacctgtcagtgacctaggaagtgtggaggcctactgagcctacctaggtgccgaaccctggcagcgccggatcagcctgggcctccacgtgtacgcttgtgatgacttctcaatggtggttgcagggtaaatccaacaattccaaccgttttaaccgtcattccaaggctatatgaaggggtcacttcattcgttcttccacacactcgagcaagctcaagatatctcttctacactttagtttagtattctagtgctaagtggagtagaatagaattgctctcggagtcctcggactcttcggaggaatttcggtatggctttagtagttttccttctttcttttgtaagacttttggaattaatgaaatattattctttatatactttcgatattttaatacatccaagtgttgtctttactttatatctgtatcggtacagtcgtataattagcctaccagagaggtgtagtggtgtgtgtttaatgcccgtttactcggttactatatgtcatctcgggggatgtagagtagtatttaataatgtagacgtggtgtctagattatgaagtaggcacatatgctacgggtcagttgaggtgggtcgctgatggtgacagctcagtacaggtattcctccaagatagtatatattcctaagaaactttcctaggagggtactccttcgtatttagccccgattgaacggccatgacaggttatcgtaagaaactcggcaacctggagtggtctctcgaagcactaggaggtcactgttagagggtactggctatatggttgtatactagcaggtgtaaactaaagttgagtgtatattagaattataggaattgatcgttcttctatttcttcttccacttagtttaggaatgattaaatgagatatatgagtgctttgcttcgtgtcactctacccgtttgccatatcttaacccctgcctagactttgattatacaagtggcatgtatacattattagcatagttctctattacaatcttcccttaggattaaataaattaatacgataccttggaatacttcgggtgaaatgctacaatagtatatccgtgcgtttgcggattctttctttaaaccaggatcatttctagcgtcattgctgggaatttatatttctagtaatgtcgttaagaaataccaacactggtggcgctggcaacgaaggcgaaggcgggcaacgttgcacgggggcgggctggcggtcggcgcatacggcctgtgaggaggaacgcggccgcgatggtgagcagtgcgaggaccacggcggcggcggcagcggaggtgaccacgatgacggccttgggcgtgtcaccgcctcccctacgcgcctacgggtctggcttgctgggtgacgacaacacgttggcggcggcggcgcggggagcagccgggctgctgttgtccacgtgggtgggaggggagggagatcgaaagggagacgaggtggccactgcctgcctctccgccaaagtcccacctcgctactgcctccagccactgtccgcgtctccgccacacgccgcctcgcccaccacggccaccgccgtgtgcaccaaccaccccttccacctccatctcctcccatttcccatccacctccactccccctcctttcttccgtctaccttccccatcccatgcgtgaccgcccgcccccgcccactatccgtccctatgccgccgcatacctccctgcccctgcacactgccccgtgaaagagagaagagagaggagagagagaggaagaggggtatgacaggtgggtcccatattttttaataaataaaatgctgactggattgccacgcgtacgtcacgtaggacaaaaccactctggattgggtcaagggggttaattcgtccggtattgaaagttcagggtaagcaatgtctggtttttgggtttaggaggataattcggtcgatggcgatagttcaagagggttattcgtactttttcctttaaaaatttagtgcaaatataaaaaaagataagtcatacttaaagtacttttgataataaagcaagtcacaaacaaaacaaataataattccacaatgttttgaataagtccaatggtcaaacgttacgaacaaaaagtcaaaacaacaagtattttgagatggagggagtaatataagtaaagtttaactaccttaatgcccgtaatttgctatgttatataaatatatattatttgaaatgtgttttattatgaccttcatttgattttatatatggctatccattgagattttattgagtttaatactaagttcaagggtaatttttaaaattacaatgaaaataggtatggcaacagattcgctgttaccatcactatattttaaagtactatggacagaaatgagcttctcgtctatggatttactcatgttatgaacaacacaatgacatctggccacacgacgccatatgctgatcgatatggagaaaagagagggtggggtcgggtgggcacatgaggtcatttgtgccttgtgcatggcacgatgagctcggcttgccctatccagggaaccacgaaggcatgcttggagccttgtgttagcgaagtcatatctttgcgataggttcccatctatctcgcccttccccttatccgtcgctaggagtttctcattcaatccgctgtcctcgtaaccggatttgcacatgccacccaggcccggcccgccattggatctgcactcgctgtctcggcccctttaccaaagccgtctcgatttgtttgcgccagcccacgccaccttggcctgcaccactacggagcacggtgatggccgacaaatgagaagagggcaaggggggagggtggcggtgtcctcaaacgagctattgccattgcttgaccaatttgcaagggaaacaagtagatctgaggcgtgggggtgactgagctgaagctgcaatggcctccgcaatcactattggatctgaagcgaggactcaaccactactaaggtctcaaccacaagcatggccttcttgacctgtctatggtgtccttggcactataaagagatagtgagtgagaaataaaaggcagcgatatctaccaaagtggacaagcggtagtagcaattcaataacagcggggagctcatggtcaccgtcgagtggaaatggaggtggaggggagacaacgcaagcttgtgatcaccgtgaagaggatgcatttgtcgccgccgagtgagctcagtggtgagaggagaggggaac

SEQ ID NO: 26796 - DNA, 3796 bp, Oryza sativa
  unsure (1)..(3796): unsure at all n locations
ggatagttggaagaggagagaaaaagagattttatattagtttgtatatttttagcatgtttctaccctataagttcaataaatgtttttactcattcatcatgtgacacatccaacgatcgagaatgatatgatgatttacatccgacggcatccgccaatgccgcccgcaccccgccaccccggcgtccacgccctgacgtcgcgctccctgccctaatcctcatcgccgccgccttccgcgtccgtacgactgcctcgccaatctcctccgcggcagccaacaaatatccctagctgttctgatctacatcaggtagtactctggaatggttgagtgctcaattatttgtttcagtataggactgctgtcaagggggaacctcgccgtcatcacagactacggtgccgccaccgattatctgttcccacatcaccgtgaacagctgcttcgcacccacacaacctccttccctaaattgaaggtacacccattacgctctttatcatggtcaattatgatagggggctttgatcagtcagtaaccagattcatggtctatatttcattgccacatcaaattgcacaggaattaatctgtttttttttttttttgctattttactgtcgtgacgacttataaggagaacagccctatattgctatcaacgatggcaatgcagcttaatgtagagtctttttttatgcatatgtgcatgtggatttactattctgaaagctaattgtgattctcacttctatatatgtctgatatctcctcgctcgttagctgtctctcatatagaagggataaggagatcggcgagctgaagctgtatcaccttctctccagttgcatcggcagataaaataataagatcgatcgcctgaaactgttgcggaccacctccacacaggtggaagcgtcgagacctccacagccgcactccaagcccaccgtgtccattctgttgacgaagccagttatgccttccgcctaaacatggcaaacatcagatctttgcgtgaacaggtaatctgttgtgatgtttctttttctctcaatttgcattgtgatgagatgaatccttctgtgcaggccaaatcttgaacctctggtttcgtggaattcacagctcgaccactccattctcccaactctgttactgaagaacaactgcaaactgagagagaaaaacacgtcgccaacccaggaatctggggaccatcacctgcgcccccctccagttccaagtccactatgggacaacacaaccacccacttccagcacgccctggtatgcaggtaccctctccggcatcctgcttgatgaaatgccaatcaggaggaccccacacacatagtgagatcaatttgcatagatttaattatagccatttgctgtgtagcatgaattggtatgtacttatgcattaattctgaagttcacttgcaagttttggcaaaagtgcttttagtaacatgtatgtacaagactgaaagatgaaatataaatgtggcttgactctgaagttgcatgaatttcagtttgcttcacccagagagaccacttaacgtttttttacgaaatttgagtgacttgatttagggtaatctatttatcacaaatattatgccacatggattccacgtgcatacttactagctgtgcctggcaacctttattgaaacgcttagcctgcacgtatttatacaacaatatctatttagcttaccaatttcgtgaaaacatattgttctttagcagtaaattgccatagttcattcgtggtccatgtgcatgcagtcatggtgttgccttggttctaagtttctaacagagggccatggaatgatcatgaccttttgaaggtacgattaaatttgtaagtgtacccttacttttatgcaatagccccaacacttcaaaaaatgctctatggaggtttacttgtgacagttctagagatgaatgttcttcggatgctattacgaaggattcttttgtagctcacactctgtttaatttatttttatagcagccaccttttgtgatggtagcaggatgaagagcggattagtacaggtgagagatgaggatgacacagtggtgttggacaagtctatatctccgtatcttgcttgcggtggtcgattgcatcaaggggaaacttcattggagggtgtcagctgtcatggatgcaaacgtggtgacccttctaatccaacggtttgagtggccacaatactggttaatattgattttggttcctaaccatctgacggctgacgagccggcaagtacgagcaatgtttttaggtgtgcatctttgttacatgttgctataatatttctgtgtgtttaagcaccattgatcagcggcaagaaggtgtgtatctcgttgctccttgtctagatgtgcatatctaatctctggtagtttcaacagtctgtgttttgggcaatggggagtccatccttttttgggaggacaactggttggagggttcctccattcgctacatatctccggcggtttgggcgtctgtcccaacacggcttcgctgtcgcagaacggtcgccaaggcccttcaagaccggagatggattagagactgcaccggagcgctgggtttgcaagctattcttcaatatcttcaactctggagtctcctgaggtcgtcggtgcggctctctgaccaccccgactctttcatttggaagtgggaagcatcgggagtctactcttaacgttcggcatacccgtgcactctttctaggtagggctcctttccactccgaacccatctagaagactcccccccctcgagatgccggttctttgcctggctggtcgcaatgaggcgctgttggacggtggaccgcctgtgttctaggggtttgcctcacccggatggatgtgtgctctgcgaccaacatgaagagactattgatcacatcttggttgcctgtccggagtctcatcagctttggtgggtcctcctttccagcactggtttgccatagtttctccccttgaatgaagattccttttatctctgggtctacaattcctgccttaaagtggggagggctagcaggcggggatttgatacaatagcaacccttactgcgtggacaatctggaaggagaggaacaatagggtcttcaactctcagcaaaggccctggtcagagatagcccgagctatgacggaagcgactctctggcggttggcacacgaggtgctgccggtgctaaccatttaggtcttgttctaggtcgtttccttctgatgtcgcgagaataggcttaagctttttattgttctcctgttttcgcatccccctcctaattttcttgtttggcttcgcttgtacatactctttatttctcttaatacaaatatgcgtgccttgcgtattcccaaacaaaaaaaaaactctggtagtaatatatttttttgtcatatcccttgtacattctataagtttgttgaattgtattttaggatggcaatctgtggatgataaatcaaacccgtgatatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 26797 - DNA, 12591 bp, Oryza sativa
  unsure (1)..(12591): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatacttgttttttttttatcatgatggcctacatttttcacaacagtaataagctttggagatctctactaaatttcacatctcagttttatttacttcgaaggaattatcgtcttaataatgagcctttttgaacccaacacatacttgtaggttttttttttaggtccaaaatttgcatacggaacctgtacagggtgcttaacaaatataataatgcagtaccccaatctatgttcagaaatatatttcctttgtttttttgctctgattcttggatcacctttcggaagcttctagccatgtctcgtcctttgtcctatcatgtattgttttgcatatatgaagtgttgtaaatgtagctgtactgtagcacagtatttattatatctaattattatctagagatgagttgtgctgctcaatcaattgacccccaattcatcatattacgcaaatgcatacacacaaaaggaacacctgttgggtctaatgtgcaaaggctttccacactcatccctactctttattgtcttcatactgtcttgtttgttcttaccaagttccaatgagtggttcacgagttaacacaatcatcgcaggccataatcactgaaatcaatgagaagatcggtgctactggggtagtcagccaagaatgcaagacagttgtttctcaatatggacaacagatcctagatctggtgcttgctgaggtttgtatttgcttcaattttctggaaacagcttttgtcaattatatctttgatgaattaaaacaactttctgggattatgttgcagacacagccatcaaaaatctgctctcaggttggtctgtgtacttttgatgggaagcatggtgttaggtaagaactgcaaatgtttttcaagtgtctgaatctgtaaagtaggatattttcgttttgactcgattagcgattttggtgtcaagtgctatatcaattatgacttatttgagatcggattcgtaggcaatctgtactcactctcatttcttctccatgtggtatgtaaacacagtgctggaattaagagcgtagtagatgatgaagctggggaatcgaatggtctccaaagtggtcccatgtgcaatgcctgtgagatggctgttgtatggatgcagaaccaacttgcacagaacaagactcaggatctcatcttgaactacattaatcaggtgagcttagttaactcctgctctagggccattgtactggtagggatagattttccgttgcttaactgttatcaattttacagctctgtgacaagctcccaagtccaatgggagaatcatctgtggactgtggcagccttgcatccatgcctgagatttcattcaccattggaggcaaaaagtttgcactgaagccagaagaggtgcgatgatttctttatggtttctcttcttttttttcttcccttgggtgcatctagattagctgaaaagttggacacgcttgccggcccatctagtttgtgtagatatttgacgcactggcttgagcacataatttactctcttcttttggttgtgcagtatattctgaaggttggtgaaggagctgctgcccagtgcatcagtggattcacagccatggacatccctcctccccgtggtcctctctggtaaactatgcatttccaaacccttgaattagcagtgaaataatttcacttcttgtcatttttgatctttgactgatgcaccctacaatttgcaggatcctgggtgacgttttcatgggtgcctaccataccgtgttcgactacggcaagatgagggttggcttcgcgaagtcggcctaaacgtgttgttgtcacgttcctaatgacgaggtggacgcatacgccgagagaagaagaccgtagcttttaactagcgtatttatccggcgatgtgtgtatatatgcatgctacataacatgtttatgttttccaaggcctgagatggcgcccgtctattttagcttggcaagaatatctcggaccagtctctgttcgaattctcgtactgatatgtgaacttctgataacatgtgcactgtgttttgtgactgaattgctagtcagtccgaaggttaattatcccatggttgatgtgaagagagccaccggattattgcagctgtgatcacgtggttaagccttaaaagtgtggtggtttcttcagctaaatctaatgtggtggtttcttcagctgaagtcttttcacctaagtaactcttactctctccgtcccacaataaaagagattttttttcttacaacattcgaccactcgtcttatttaattttttataattgtgtttaaagtactgtagataataaagtaattcacaaataaaataaataacaatttcaaatttttttttaataagacgagtggttaaacgttacaagaaaaactcaaaatcccttttattatgggacggagggagtactaaagcttgttaagttcctcaaaccagaattactctgaaattcagaccaactccctcatgagccgccggtacacctgcaaaatttgacttcaaaacccctcaattcccttatgtgccgccgaaacaccagcaaaatttgacttcaaaaccaccaatataagtgatccaactgatatcaaccttcaacattcaaatttgacttcaaaaccactgatataagtgatccaactgagatcaaccttcttccaacattctcaggcgactgacaaagctggtcaagtaaccaccgaaaatagacacaccctctttttttagaaagaatccgttgctggacgctagcaatggcagcaggactctccatccaatccaattcataaacaaaataaaaaaaaatctagtaaaagaagttgtcaacggcagtctctcctccatccccctctccgatctctctgcccagatcacgactcgctcgcgatgcaagtccgcaaacggttgccggatcaagcatggactctctctctctctccacgaaaccgtcagacccgatcgcctcctctgaccttagacttgcttagacgccgcgcgcatgcagccaagctgcgagctgcgatgctgcgagcttcatccattcccatccatggcgctcgcgtcgcttgtggtgtccacgcatcctcagcttaaccccccctctctctctggtcaatggtcaccaacactgcctagaatgatggactcagctccaatctcatcccgccacgtgtcccccgtctcgtcgttatatatatacacactacgccctcgccttggcctggtcgtctactctccctcccaccgctcgtctgtcaccgccgcgcgcgacgcgacggcgaggtgtgtgtgtgagaatggagtcctacgtgggtgtcaaggggaagaatgtcgtcgggggcggcgacgtcggcagggagatgccggtggcgccaccgtcgtcgtcgtcggcggcggtagggatggtggagttcccggcggcggcggcggggctggggtacgccgggatgacggcgaaggaggccgggggtggttaccaggagaggagggtggtggtcggcgagatggacttcttcaagacggcggagaagcgtggggagaggaaggagccgccgccggcgacggcgacggcggcggcgagtggacacgccggtgcctcgccggatgacctcagcctcaacaaggacgacctcaccatcaatgtaacggatcagttgatgcgtgatggtttgagagatttttttttcttggttgatgcgtggtttaatttcgtgatcttgttgcgtcgcagatgggattgctcgtcggccggaggaggaacagcggcagcgaggaatccatcgtcgacgatggcggcgtctcctccaacgacgaggagcaccgcgaggccaaagctgcggtgagcaaacagcagcaaaatcaataggatctctctgtgtttataaattcgcttttgaatttctgaatgcgaggaggagagatcggtctagtgaccgtttgccgttttcttcatcatcagaaattctagttagtgtaaaccggagaacaacaaaaattgttgttgccatgatctgatcataattttctctcggaatttatgatcagctggcagtaaccaaagctgagattgggcggctgagtgaggagaacaagaggctcaagaacatgctgagcaacgtgaccacgaaatacaactctctccagatgcagttcgtcacactgatgcagcagaggagatcagtcctagccgctccgatccaccagcaagaggtaattaagaaaaaagaacaaatcataattattaccatgcaagattcaagatcgctcatggcagcaatgctcaagatcgctcatgtggtgtaattcatcgacgatttgtatgatcggcagctgcttgatccggagaagaaggagcaagaggggagccagcagcagcagcagcagctgatcccgaggcagttcatcagcctcggctccgcgtcgctgcagcccgacgtcgaggcgccgcactccgtcgtcgtcgtcggcggcgatgtctgcgcgccgtcgtcgagcaaccccgacgcggcggtgccggcgatgatgccgttgccgcatttcgaccaccacaaccaccaccaccccatccatggtggaagggagagggggagcagcccggcggaggccgaccaccaccgccaccatcagcaagagcagccgccgccgccgccgcagcagcagcagcagttgccgccgagctggcttcccgccgacaaggtgcccaggttcctccccggcaaggggcccgagcccgtcccggaggccgccaccatgcgcaaggcccgcgtctccgttcgagctcgctccgatgcacccatggtgtgtgtgtgtgtgtgctcgatcatgttccatatgcagctagtgttcttcttcttcgcatggatgtttgatatggtgatgtgcagatcagcgatgggtgccaatggaggaagtacgggcagaagatggcgaagggaaacccttgcccgcgcgcgtactaccggtgcaccatggccgccggctgcccggtgcggaagcaggtgtgtgtgcaagatcgccggagcgtacgagcgtgtttgatttgctgtgtcgtcgtcgtcgtcaatggcgcgttcgctgatgtgcggccatggttttgcaggtccagaggtgcgcggaggacaggacggtgctgataacgacgtacgaggggaaccacaaccacccgctgccgccggcggcgatggcgatggcgtcgaccacggcggcggcggcgtccatgctgctgtcgggctccatgccgagcgcggacggcagcctcatggccgggtccaacttcctggcgcgcgccgtgctgccgtgctcgtccaccgtcgccaccatctcggcgtcggcgccgttcccgacggtcacgctcgacctcacgcagacggtgccgccgccgccgccggcgtcgtcgacgcagccgcagccgccgcgcccggagcccgcgcagctccaggcggcgctcaccgagaccgcgcggccggtggcgctgccccagctgttcgggcagaagctctacgaccagtccaagctctccgccgtgcaggccgtggccggcaccaagggctccgacggcggcgcgctcgccgacacggtgaacgccgcgacggccgcgatcgcgtcggacccaaacttcaccgccgtgctcgccgccgcgctgacgtcgtacataggcagtagaagcggcagcggcggcgccggcgccggcgggagcagcggcacggtgcagccgctgatgagcggcggcggcgatagctgtagtagagacgacaagataggagagcaaaacagctaaaaacttgattcgctagctgcaatttttttgcttgcttcaagtttcgtttgatttttgctcgtacgtaatttttctttttctttcaacaaaattagtttgaattacacaatttggagtagttttgatgttttttttttctccgtcagtctcctcgtggatggagacagaaattttggtccgtgtcacatacggagtacaaatttttgctgaattttatgtcagcaacttggagtaacaaattttgtgggagcctaattaaagggtgaccattttgtgtgaatttggactttgaattggttagttggtcgcacgcagcgcaaggcgtggagtcaatttcgtggctacgttgcctcacatagagctgagtcacgctctgacatttttatggtcgtctctgaatcgcgagaagaataatggctgatctcgtcacactgctgacttgttgggcttacaaattcgtgccatcacgaactgaccatcctgtggtaggagtattcaacaaaaacagggactaaaatttagccccactttaatccctccaaccaaacaccacctaagaatcagtactttaatgtgaacagtattagtcaaatgataaattttggatagtccatacagagctaagcagggcaaagcacaccagttttgatcgaaatattagttcaaaagaaatggaaaaaaatcatatccacaagcattgccatatgaggtaccgtatgtctgaattggccttttagaaggaaaaaggcaggagctctgcaatttatagattcaggtagtataaagccatcacattacaggtttagggtgatggccacttaagcaaaatgctttcaaaggagatgctagtctatgaaattgaaagccagatcacgctgatttatgtcttgtatcaccaaagccgccgtctacatgttgatgaacatattcaaaaactttacatttttctcaagccaaatgtcccatcaggctataagtgccccagtattttcttttctcttctccttgggttttatctcgcaaaaggattgcctccaatcagctactagtactgacttggctttcaaccatccaatgatacagaccagaactatgtttctttctattagaaacatcagtttcatgatacaacagatgtacatctatgcaataatagagtgggcacacaaaattttgtggagatacctcactaattaccgagctaattcgaccttcactcatcacctcaatcataaacaaagctaacagaaaaaaaaaggtaaattactcctagctgtgacagcctgcataacaatctgatggtcatagtgcttgaatctcccctccatagccataacgcttcaaaagaagttcatcctgccgccagttttccttcaccttgaccattatctgtccaatatatagtatatttgatattaggaaactgctcagaacaaatcctcaaggtagatcaaaatttcacagcctccaaacaaaggaagcagttactacctcaagatagaccttcttttgtaggaaatcctcgatatcaagtcttgatgctgttgctagcatcttgattgcttttccatcctgcagttgccaaacatgttacaaaaatatatcccactaaagcaatgcaaataagatgatttcatgaaactgcttcattctacccaaatatgcaccccaagttatggtattttccttagctatactcaatgttaacttgaaaaagattaaacttaactgatttcgtaaccataaaatcctgaaatattcaggcgcacaaaggtactgttttactattttttttaccttcccaagtataatgcttctttgtgattccttctcaacgagtatctcaacttgaataaaatccttggctgtaggtctgctcttgtaacttatgacattaacctgtcataaacaaagtcgcacatctgacacatgctggcagaaaaatgccgcacaaaattgataggtgcaagcaccagaagatatacctgacaagcatatggaatttcttgacgatactgaagaaaaatcttttctctcactatttcccccacaaaaaatctctcagggtgctcactagctatgtcctggaacgagaatcacatgaacaaatatatttgatatcttgtagtatcagtatttattggctgcagttaaacatcaaagcaagcactggatatcgtgagtagcactatctaaagaacaaacatgatgctatggaaaagacatattatagtcacactatggctatctggttttacatgagtacagaaaaatttgtgccaaagatgaagaaacacttgcagaaatagaataagaaaaaaaaattcatctaatacaccaatacctttggatagtaagcaggccccagagggagctttgataatatccactccttgatatcatccactccatgcccaaatttagcacttataggtatgacgtcatcagcattagtgaatttttgataccactgtgaaaatcgtagccagtaaatcaattacatcgaagtagagggaaaaacaaaaccatctccaaatttttgtaacgatattttacctcaagtttctttgcaatttctcctggctttatgagatctttcttgtttaataccaacagtactggaagctcagtatctttgttccccacaccttcttccagtatttcatcaatctaaaaggtacaaatgtcagaattttagattgtatattggcataataatttttttttcataattcagtcatctctttcctatgttgcaataccttttcaggcattttgcaagcatcaacaacaacaagcacacaatctgcactgccaacggcactcctaacattcttcatcatcattgtgtctagcttatgcatttcctttttgatgacacctggcgtgtcataaagtattatctgcaaactaaatgataactcagattagcagtgagaaattaacatttccccctttcatagtctataatcctaaagctttagaaactaaaaggtgatacctggtattctggttcagaacatataccaagaatgcgatgccgtgtggtttgcggtttgtctgtcacaattgaaagtttctgaccaacaatttggttaattagggtgctctttccaacatttggctttcctaatacagcaacataacctgtgcaaacacatggtatatcaatattacaacaacatgaaaaaatattcatctgcagaatagtttcatttggagatcataaactaaaaaggctgttatttcagaatcgaaatgaagaggtgaatttcacagaagctagaagcctcaccgctgcggtggttggcacaatgagaggtgcctagctcctccgactcgtactcgtcgagcagacacaggctccggtccggcttctcgatgagctccagacgcggcctcgtcgtcaccactgcagcctcctcctcttgccatccttccgcttcttcctccgcttcttcccactcttcctcttcctcctcctccattgccaaggaagccatactcccaccggatacaacaaccccaaccctgcgctccaacctcgaggagcggatgcggcttcttcgggccgcacacggagagaaacaaggcatcggcggcggctggagagctctacaggggagacgaggcggcggcgcgacgagccgcagcgcgaggcctagctccatggctgtcgcaagcgagagctcctcggcttgggagtgtggctcgccgcagcagaaggggataagagggattatgacatgtgggtcccgggcccacatgtcatagacacacgagtggcaaatagtgaaatgcgagatgataccgcctatttgccactcgtttttcttctcttgggccggcccaataaacgacgaaacgtttttcttctcttgggctggcccaaaacgagaaaggaccggcccaacaaagcccatggagacctcaccgccattactagcaaagcccgcgacaaaacgaccaaccgctcgagcaaagcctccaaaaccctagcgctctctctctctccccccccaccctcccttcgcctatagctgaggcggcggctcgtcggcggcggcggcggcggaggaggaggaggaggaggaggaggcagcaatggggaagacgaaggggaagcagcggcaggacaagttctaccacctcgccaaggagcaggggtaccggagccgcgcggccttcaagctgctccagctcgacgcgcggttccgcttcctgccgacggcgcgcgcggtgctcgacctctgcgcggcgcccgggggatgggtccaggtggccgtcaaccacgcgcccgtgggggccttcgtcgtcggcgtcgacctcgtccccatccgccccatccgcggcgcgcactccctcacggaggacatcaccaccaccaagtgccgcgccgccgtgcggaggctcatggactccaacggcgtcgccgcgttcgacgtcgtgctccacgacgggtcccccaacgtcggtggcgcgtgggcgcaggaggccaccgcgcaatcgtcgctcgtcatcgacgccgtgcgcctcgccaccatgttcctcgcccccaagggtgccttcatcactaaggtaattatttatccacaaatccgctccttttaggcgtagttgttgcattgttgaatggtcttagctactgcttacattagcagttgggagtgatgcatttttcttaccgaggttaaaaactcaaaaactttatatgctctgtatatgcgattaaaaaattgttctacagattgtgatgaataatttttagtttcgtaggaaagtgttatgtagtccctctcgtattgtaacaggctagtgcaattattagttcatagaggttgagaacgatgctattagttccctcagacaaaatttctctaatgggtgttcctgtattttctgtagccctccttaaccagctgttccttgtcttctacaggttttcaggtctcaggattacaacgctattatgtactgtcttaaacaggtgcatattactctaaggtttgattacatttttctttttctaaatgtagtttcttgatgtatcaaatatatctgcatgcagttatttgagaaggttgaagtcactaaacctactgcaagtcgttctacgtctgcagaaatttatattatctgtctgagatataaagctcctgcaaagattcagccagaacttttggatataaagcatttgttcagtgtggatccagatcctaaaaaggcatgttgaaacatttatcctacttatattcttggtttctcatcttttctgtgctagcatccatttgatgttttgaattttacggcttctacaggttagggatcctctcaagccggacagacagaagaggaaccgtgatgggtaggctatccctattacatcatctctggatcttgcctactaattttggttaattctattttttcgtcttagcatacacttcaatacaatgctggcctgattcccaactttcaattgtgtaatcatttactcttgaccctaactaccaaaatagtatttttccaggatttatagctttaaatttccacttgtatagatgtcagttttgtggcaatatagcattttgaatttctacattgcacaatttatgcagatccgaagaaggaaatacaacattgcgaaaagttggtctggcttcagattttatatggtctgagggccaaacgcccctagagtttcttggttcttttaatgcaatttcatttgatgacccagcatctcttcctatcaagaaccatgagcttactacagatgaggtagtggactaatgcctttcctccgtatgctggctgatatattgtcttctatattgaatagtcatattgatggctgcatattgtttgctgtgtgacagataaaagctctttgtgaggatttgtatgtactggacaaaaacagcttcaagcatatcttgaagtaagtagtttaccacatgagggtgattactgatgtattttattgcacagattaattctgttgagtttaagtggttatggttatctatgtgtataagttgggatattcagagcttagtcttgtcaatatcatgaatgaaactaattttgtatgatgctgttagatggcggatacgcatacggaaagcactatcatcttctgaagtcactaaaaaaactgatgatactgcggtggaagtcaatgtcaaggatgatgaccaacttctacaggaaatggaagaattgacgagtgtcattgatagaaagaagaagagagaaaagaagcgtcaatcaaagcgccgtgcaaaggtatatcagtcatgagatatagatgctgccattgccaaatgggtggttaatttgagttatgtgctaatacactggtcttttcgttccaggataaagcacgcaaagcaacaggaatgcaaatagatgctacaggagataattacggcgatcctgatttgttttctataagtgctatcaaggttcatgctgtttctgtagtcatatcctgtgtggttcttaagtatttagtactaatatttgtttaaaatcataggacaggtgttcatttgcatgggtataattttcc

SEQ ID NO: 26798 - DNA, 9742 bp, Oryza sativa
  unsure (1)..(9742): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagaagaagttcatgtcctttgccactgaggttgagaaggatgctgacaacataagtgactgtgagaggttgtacaaggcctttttacaggaaattaatgcttttgtgttgcctcttcttaagagcaaggccgtggttgatgcaaaccttagggagaaggagagcttcaacgagctgcaagacgagattcagcgacaaatcttgcaagctcagactgatattgaggaactcaaaaagaaactggaacagagcagaattgagaggctgtacaaagaggagtgcgaagcgatcagaaaaatgatttctttgcagcctccacgatcggaaacagagaagctcatcgcgggtcttgagaaggagattgctaatttggaggccgagaatacagcatgtataaggactctggaactaaggaagaagcagctttctcttcttcttcatgtggtgagtttattcgtcaggttccttttgcttttctgaatcatgccttttccctttctatatagagtggtaagaggatactcattggaatttattaatctgcatggtaagcttaaatgatatactacttttacaaacattgtttcccgcaagaccgcaacacaaaactacgtttaggaaaaatatgactgtttctgatttttatcaaattataactattagcatccatttgtctaagaaggaacttggaagactatatgtagctattttaatcatgccatgcagttcattgttttggctgatgcctattgatttctgatgttgtatctattacaggtcgaggaattgcagatctcaatcgaagatgagcagaggagcatagcggatgagctgagagctggcgctgaagagcagcagaacatgagcacagatgaaggtagcggcgatgcttcagatgccatggctttagactgatcctagcagaaaagcgcgatgcctgcctagttccacaaaggcagatacgttttcttgtggctatatagcacttaattgccttggttagacttgtaggttgcttaattacaccctgacacatgatgactctcgtgtagttttttttttagagagaaggccagagtctctcgtgtagtttcagttgtaatttcagtcctaagttgtaatcgtgtgccctttgtctgaaggaacagaacatcatggtgtgacatatactcctccagattattccaacatgtatggttgttattatttgctaaacaagcccctaactgaatgctaatcgacgcactgtcgacgtggaaaccaaattctagtccgagtccagctctgcccttgttgcggctaataaaagggctgaagttacggccggtgagcgatcgatcaggtaattttaatttacctttggttgttggctgcgttaggtttttaacccaaggagcaagaagctaggtacatagagacgatgaagtacgtggtggtgatgggaggcgtgatcagcggcctcggcaagggggtgacggcgagcagcattggcgtcgtcctcaaggcgtgcggcctccgcgttacgtccattaagatcggtacgtactggagtactcctagcaaccaacgtgctgctaattcctccttttctctttttcctatatatgtttgtgtatgttttagtttactactgtactaacctccatccctaaattaataactgtaattctaacgtataccttttttgtctcaaaatataacagaggtagtatgtttatttgaatcctagaagtgcatgcacttgttaggtcaagtttgacacattatacaacgaattgttacataggattataaaattgattgtagggataaattaaatattccttaaaataaatttaacaaatagcttagagtaagtagactaattaatgcaggtgaagaatcttttcagaaaacgtatttttagagaagtagctgaaaagaacaaggccttaagtccgacctaaagtcacctcttttctttgtagatttaccgattgctgtttccttctgcttatcgatctgttttagaggattttctagaaaaagaacacttcatatcagcgaggcgtattgccttgtagaataatcatgccaacttttatttaatcaggcgtttgatggattgaggtaagacgtacttgttgtaactgtatcgctcaaatgtgcagatccttactttaacgctgatgctggaactatatctcctcatgaacacggcgaagtgtttgtattagatgatggtggtgaggtattggataaattgatgttcacgtcgatgcatccataataggagtcatttttgttcaattgatgtatatattatcttgcacttgttgcaggtggacttggatcttggaaactatgagaggtttctcgacattaaactaactcgagaccatagcataaccgccggaaagatccatcatgtatgtataaacttttgaataatagagtgaacacatcatttcattcactcccaaacattgatttactgcctagaacccacatgcatgtctaagctatggccaataaattgttggccacatttacacttaaaaaataacgccttaggcagagtttgaaaaataaatggatgttatttttttttagaaaatgggtaaaacccaacctctacatccaaacagatgtacatagccaaatgttatgtatgttagattatgatatactcccactatttaactaaacaaaaatcaatattgtaatatgtaagtacttagaataacataatgaaagctatgagctttcgcaaacaaatgaataaataaataaataagtctcattttttaagcaatatgctagctcttgatttgtttacttaaagccatgttcttgtggtggttgacgacagtatgtttacgaaaaagagagaaggggagactacttgggtcagactgttcaggtgccaaccacttctcctcaattcttcttaatttgtttttcaatttttggtaaatttaatatctacatttcttgaaaatccaaccaatcatcatttttttaaggttatcccacatattacaaatgagatacaagattggattgagcgtatcgcgatggttcccgttgatggtgaggtggatcctgccgatgtctatataatagagctcggtggcactataggtaacaagagacaattaaccagctgcattttattcttaacaaattcttagagttacataaatttttggacttacaagtcaatttaaaagctatatatcatgtctttattttcagtttattaacagtatttgttcgacactatgctgcaggcgatattgaatccacgcaatttattgaagcctttagtcaattctcctatcgtgttggtaaataaattgaattattgcataacagatattttaattttctccatggtgatatgataaccttatttgcatgttatttttggacaggtgctggtaatttatgtgtggtgcacgttggtcttgttccagttttgaacgttgtgggtgagcaggtcagaaaaatcatgtctattaattaaccacagctttgctatttgctaattgtcgtcttcgtcttgaaaataatatcctacatcttttggtttatgttcttgtgtagaaaactaagcccactcaaaacagtatacgtaagtagagaatatggtctcacgccaaatattatagcttgccgctgtaccaaggtttgtattatgaacccagtaaccttcatcttgcggttcatttttagttttggaagttgtggtagtcttttatttattaactaagagcgtgtttatttattaataggaactggagaaaaatgtgaaagaaaaactctctctcttctgccatgtgccggtaatgaaattttcttggcttttagttaatgattattttcagcaactaattgctctagttgctaatgaactcttgtggtcatcgcaggtagctaacatttttactctgtatgatgtttcaaacatctggcgtgttcctctgttattgcgggtaaacagctttcttatacaccagacgaaaattttcacccttgcactgtgctgaatatcttcctccatcgttttaggaccaaaaggcagatcaagctattcttaaagttttgaatcttgaaaggtaaaatttccatgtgtcatatatatatgtaagttgaaggtgtcatgctgctatacgcaatcctaaattctcctttatctcatttgcagcgttgccgaagagcctaacttggaggaatggatggcaagggctgatctatatgacactttacatgaaacagtcagcctctttttcatccttttttaaataacggatttttcataaatccggtctttatatttacgaaagatatacacatccaatattttttatcctcgtgatggaaacgaaagggatatttgagattacattaaaaaaggaaaaatatatacgttctattgtttttcttactaacactgatgtgtcatggtgtgagtacatctagatttatctaaatcaaactattgagatcattgttagtaaaagttcagtaagaaaaatttagaaagacctaagcaatctgtgtactcttttttcaggtcaggattgccatggttggaaaatataccggtgtatctgatacatacctttctgtgatgaaggtgggatgcatggatccctatggtgttttcttccttcagtccattacaaacctcatcggttttgtccaacatattttttgatttgcaattcttgtaggctcttctacatgcttgtatagcttgtggcagaaaacttcttgttgattgggttccttccaccgatcttgaggattcaactgccagtgtggtttgaaaaacttacactatgcatcatattttgctctgtagtatatatatttgtctccttacatgttttttgttaaattttaataggcacctgatgcttacagcacagcatggagtttactgagggtgagaagtttactcctgaaatatttgctacatgtagaatttttattatatatgctttatctgaaatatatttcatttcagggtgcagatggcattttagtacctggtggctttggagaaagaggtgttgaggggaaaatattggctgccaagcacgcacgcgaaaacgatgtccctttcctgggcatatgccttggcatgcagctcgccgtggtagaattcgcatgccatgttttgaaactgcctgatgcgaacagcacagagtttgatgccaaaacggagaacccatgtgtaattataatgccagaggtaattaactgtcaaaccctcagtctatatatatagatatgattgtaacatttatatccactcgtgaatataaatatcagatttctatttattgtgtaaaaacgtgtatttgcctttagttttttttttagaaaaatgtgttgcatttaggtgtatgtactggttagctataaacttaatttaggccattagttacttgtttccttaaataagtaacttaatttacttgcatttccttcagtgctccaacgaaggaaagggtggtaccatgcggcgtggatcaaagaggacatttttcaaggttgcaaatagcaagtctgccaagctgtgagtgatcatgaacacttacccttactgtaattgcattgtttctgttttaattttctgtgttaattacgttgcaatcactcagatatggtagcgtcaaccacatagatgagaggtttcggcacagataccaggtttgttgttcaatatctttagtgtagttcatcataatgttactcatggtgttttaattgcttttttaccttttttttaaaaaaagaactgtgatattgactaacttcccaggtaaatcccaatgtggtgcaattatttgagaacaatgggcttcaggttgtaggcacagacaagaccggagaaattgtgcaggtacaagctgaagaacccagcttgcttgaacaaatttcaacttttcacttttccattattcatgcatgctgatgttattgtttgtccaattttctagatcgtcgaaatacccaatcatcgatttttcgttggcgttcaatttcaccccgagtttatgtcgagaccttcgaaaccttccgcactttttgtcggtaagctacttaaacctctgtaaacgacccaagggaagttgatatatatctttcttttgaaaaaaaaaaaagttagcgatgtaatatcaacataccgctttctcgagtaccgtcaaaatttctctttgacaatctgatcaacatgtataccgacctgcaggactaatcgctgcatcgtgtgggcaactggatggtgtgctgcaagatgcggcttgtaaccatgagccacagcagaatcagcgtgcagagaagcgtcctgctgctagtgatctaggagattgaacctgccgcagcaagcggcaagtgacggcgtgctctgattcaaatgaccctgatgaagcaccggatgtcaaaagctgttaattgtagttgccgtttcttgatatcattgttagtaagaattttgtaaaaagaaaaaaaataagtatgtgtagcagtgttcttataatggaaatgggggagaataatcctctcttttttaaaaaaaaaggaaaaaaaaagtaaaggtgtgcaacacatgaatacatgatgcattgcatcgtcaccagtagttcttcatgtcgagatacggactaggggtttttttgtccgaccttttctccgctcttcacaaaaaatctggtttttttgggaggtccgtggatgtttagaaaaaaaaaagtaagctcttctaggttaatcagcatatctactggaattcaagctaatgcaaccatcggattcttcaataaatatgtgtgctaaataggaactgttttacatttgctagcatcggaaggctacatgttactgctataattgacaataacgatcgcaacagactttgcagacaaaatgaagtcgctgtgataaccttatggtcctcactaatcctttgttcagtattttcaccgttatctggtcaggctcaataaagtcatccagaagttcagtttcatcagcaccgccactgttactagatcagaagttaatttttatagttgaaaccagtgcatcccttaataagatactcttactgtgtatttagtcatgaagacaatgaggaacaagcaatttgtttaattgtttgttgaaatcatcagtttgtcagattgagacacatactacaagttattcattggccgtcaagtgctttaattggaagtaaatttcaaactctttgggagatttctttggaactggatcggctgaaggacctgtggaggcgataccgaggcactgaggcagtgctggcccttggcgtagccctcccaatccatggcggcctccccctggcccctgggtaggttttaggcgcctggtggtggtggatcggtgccggtgggggatttgccgggtcggcgaaagaatgccgaccaaatttcattaagattgagagtaaaatacatgtattccgatattaaactgtcgagtcaaggcaaaagccttgaaacaaagtgagaaaaagaaaaggggaaaactatgccggtggggggattcagcgagttgaatgcggacaaggcggtttaataaccggaatcagggtacggttatgtatgggttatcccgatcaatcgtattcgtgtccaattccaaatggacaatgcgtgcctacttaaattaagtaaggcgcgtttaataaccaattaagacaaggggatatactacaggacatacagatcaatcatggcggcagtcttctgcggggacatgatcccggtaaagttgtggtgggagatcctgctcagggcaccaaccaaagacgtcgcccggtcaagctgcgtgtcaacgcagtggcgcggcatcgtcagcgacccctcctttcggaagctccaccatgacaggcatgccgtgcccaacctcaacgacggcatctccgacactttgctcgtcgccacgtctgacgtcgacggtgaaagcgtctccagcgtcttcccggctgcactggtctctccggcggtgacgggccaggcgcccatctgccgggtcaacaacccatacggctacagcctcaccaacgtctgcaatggattcctctgcttcgcctcctggagcagagccaaggtcatcgtgtgcaaccccgtcaccggcgagaagctggcgctccccagggctcctcaccttggactcgagaagcgtcgacgttactcgcggccggtcacgttcgccttggggttcagcccgaccaccggtgcgtacaagctgttccgctttgccgaccgcaggatggacgtgtacacgcttgccgctgctggcggttggcgccaacacccgtttcctcacccgtaccgcgtggtacaaaatacgccaactattgttgtaggtggtaagatatgcatgctgacagccaacccggcgtcgcatcagcacccaaacgatgttggcaaacccggtccggtgatggttgtcgatgtcgcaagcgaggagtaccgcacgtacaacccagcggactatgggtgcctgtgggccgacatggcagtgagcggctttgagctgcacggacggctatgcctggccatcaggtctgatacggaaatccatttctggaaaatgcctgttgaagaaatatccatgcgtgcttggctcgatggtgatacccacacgttgtgctacggagtggacaataagttgtactccaggtatgtcggcacaaccatgacgatgacaacatcgctggcggcacggtgtctttctccgaccgaggttatgtcatgggactgcaaaatccgtctccctacgactccaccgtggttagtgtcgtgcaactggaacatctacacgggataccgccccagcctgctctcgcctctcacctttgcgtcccagcaagataacaacgacgatgatgaagatgaaggcgacgagtcccgtccattcgtccgcagattgttgtgtgcactacgacaccagaaatcgcagaaacgccgcatgtctccaacatcaaccgatcataccaacggcaagagagtttgctatagaaatccatgcatatgctaatgtaaatatgtaattccccgatcctcgttgacaatattcacatagaaattgtattttaagcagtacaaacaatacataaacttatttatgtggtggattcaatcaatcctttccggcccaaaaaatatggcccacgtagaccacatccccttttaggcggcccatcgagctagcggccagaccgtacttgtaccgtctatttgaatttttttcatttttaaatttttttcttttaatatttacagaaataatctatggcgcaaaaaattacaaaaataaacagtagagggcggcaagctgacgtggcagacggcggctgccgccatctgcaaaaattacatttagccccttgccgccctctgtaagggttgcaaggggctaaatgcaattttcgtagcgctaaagagcatttggctggtacttttgcatctggg

SEQ ID NO: 26799 - DNA, 47152 bp, Oryza sativa
acttttgcatctgggccccttgccgcccagatgcaaaaagtaccaagggcggcaaaaggcccagatgcaaaaagtaccagccaaaaagtattaggcccgggttggctttttttgcatgggagccccttgccggttttcgtcgaaaaaaaaaaccctccctctcccgtcaccgcccgtccctcccctatttgcaacgtcaccgcccgtccctcccctatttgcaacgtcagcttgcccctcccctatttgcaacgtcagcttgccgcccgtctgccattaccgcctgtccctcccccgtttgccacgtcagcttacctctcccgtcaccgcccgtctgccgtcaccgcccgtccctcccctatttgcaacgtcagcttgccgcccatctgccgttaccgcccgtccctcacccgtttgccacgtcagcttgccgccctaatggagggcagtagggtctatttttgtaattttttgcgctgatggattatttctgtaaatattaaaagaaaaaaaattaaaaatgaaaaaaattcccgtcgctttcaactcgcagcgctgatacctggccgtctccgggggatcggtgaccactacggcgtcctggcgctgtggaacccgctccacgcgccgttacgcgacgtgcaccgtacagcggtgtggcccttgagatccaaaaggcatcaagacaggtaaccacaaccctctaaaaaagaaaaatatttggaaaatatttgccccttcgtgtgagagttctgtgtcgtcgtacgtacgtgcgtggtgacgtgtagactcggggagacgtgagacgagtcaacacagtacagatggggagacgtgagacgagtcgagacaggtacagatgtcacgttttgaactagctatacacaacctgttctgttgttcttgtgttcatcaagctgctagaaaagaggctacaggtactacagtcggatactctagtgtgcttctttcagaacaaacgctcagggacaacagatcgatacataacacgagtgaaggtacacaagctaatcggagcatcccgtgatatgctagcatactacttaaccgtcgtcaggcagaagcagcaaggccgtcgagtcgtcgctcaatcgctcatcagtgtgtcgtcatcaggtgaaaaccctcccggcgtgcgccgtagtcatcgccggcagatcaacctcccggagatcggtcttcaagcccttgccggcggcattcgccagcgggtggatgccgtgatccgggccgctcatgtacgctcggttctccctctccttgtcgaacgacacgctgaacttctcctccacacctgcaatgcacgcaccaatcaccaacacaagtagttaagctgtgacgactgacgatagattggagaaaaaaacacaattgaacatgaatgattttgcacgtacatttggcgagttcttggcggagctggccgtcgcgggtgagagccatcatgatctggggcaggccgagcgggagcgcgtcgccgcggtcgacctgccagaagtggatggtcttgccgtaggtcttgcacaccctctcgaggtcgcggcgctcgacgacgccggggacgccgggcatgaagaggacgccgcccttgacctcgaactcgtgggtgtgccacagcggcttctcgtcgtcggggagcgtgaggaacagcggctcggcgacgatgtactcgacgccgatgaggcgcgcgccggcgtcgggcccgtcgaagatgaggcactggcgcatgtcctcgttgaggtgggcgcagaagtggtgcgcctccacctgccgcgtcatgtcgtcggcgtagaagtggaacgcgcacaggtgctggtggatctggttcacggggccgaacccctggatgctccccgtcgccgcctccagcagcgccgtccccgtctccgtcggcttccccggcacctccacctcgtggcacgacgccgccattgctcaactactagaagctagcttggtgtgtgtgccgctggatggatgaacgagagagagactcgagtgcgagcgagctgttcttatggtgcgctgactcgcccatgcagttgcacacgtgtagttctggaggaggcacgtgtctcccgcgacagatgcttcgctgccgccggctgccacgagcgcccacgactcgaactatcggcacgaagcatatgggcctaagagcgatgaaattgaggtgtccattttcggcccgcggcccaataggattgtcagaattcagcccattttcctccgactaactccataaggtggtgggctagacgatctgggtttgaaacctcacccattctaattatttgatattagatccttctctaatattggcctttttttaagaggatttttagggtacattgtactgcaagtatatactagcagtatatatgatttaacggtgtagattcatctaatcttccgcccaatgagcctgcagtataaattgaatagggtatattagtttttttcatcttttgcgtggaggaatatttttgtattttcgcatttctttacttcttcgtcagatcccgctcgagcgaattccagttggagagttagagccgttccctttcctttgtcgcatgtttgaccgccgccgccgacaaccaccggaagcacgccgcgccccgcgccgccgcccccgggaatcgattctatttacgtcctcttttcatcctcttctatcattcccactcatccaaaaccttccttaactcctctattgacggctcgggtgtgcggagacggcattcaggcggagctgcatatgggtgccggctgctgggggcccaggccaaggggcgcagctgcggcagtttgcaccggcaaggctacacacaaggactgaacattaatgatgaacaggttcgaaaagggtacatatagagggcttcagatgttcaagatggctacgcaaaaaaatattttgatcctgttttggataagaatctgatactttcagtagtagcatgtaacattgaacgctcgacctcagtctttgtctctccctcaggaggcagaccgcatggaagtaacattttctgcaacaccagcagtccaaggaagcctacagaatcggcgacggccgggcatggagggcagaagatggggaggcagccggctatagcagcgcgccgcctcgccgcgagagggcacggaggctgatgctgggttccagccgccacgagagtagtgtacaaacacttcaccgccacgggttggggagtacaggagcagtgagactggaggtgggaagcggggggaggcagccagctcgtagcggtttgggaaaggctggagctgtgaggacggatgcggaggagaaagccacgcggggaggaatcgcgcagtcgtcaaacgaggagcctacaagcgcgtcgtcgtcagaacatgccccgaccgctcatgcgagatccaggcctccagggtactgtcgatggacggtattataaatctcaacttcaaatgactaataagcactttttaggtttttgacaaattcctattatacccataaatatactgctagtatatacttgcagtataatgtaccgtaaaagtcctcttttttttaagtgtcaccctgaagtctgaattctgtctgcgtagctgttagctctgaattctgatcagaaaagttcagtatatcttgcgcccacatgtattggtatcacagaaaccaaaacaaacaagatgactctggcataagcttaaaacgaaccgctgaccaagatggtaaaatctttgtacacgtacaagaagaatttttaccaagatggcagaggaggagcatatcgatctcatgtaaaaaaggaaaatggtaaaattctaaactatcaagccatattctaaatgatgataccgggttgatcaagatggccactgcagttagtcgatggaacttcagaaagctcaagcttccctgtccactcctctcccggtttcagagtgatttgtctctccgctgcagccgcatcaacgcacagcatctgtttgtactcctcatcgccgaagtccacgatgtttttcgatttcttttcccacggattccacacaactgggaggaataaagcgaatatgatggaaatttttcaagcaaagttaccatggttaggtggcaaagagaatattgtgtcttaccaacgtcaggcagtccttcctttcttatgacaaatgtgcgtttcttctcatggtccagaacagctattacatttggtgagctaacatagactcggtcaacctgcatatgtttgcacatagaccaggtgctaacaccgtaaatcttggactttatgatgtggcaagtaaatttttacaacaaaatgtcaaaacaagatttgcggaatcagtagatcaaagtatatagcgcatatgattattcaaacatttttcacctccgattcaaatgttatggcatctccttgttctgtaaaacgttctctctggctaagattatcgagataatcaagtgtctcaaggccttctatcctcacctcactggaattaacaagatatataatctgtcatcttcaaaatattatatggcaccaacaaaaagtggttgaagtacaaaaagaatgttgggtgaaatgcctgacctgatgtcagaaacagacagatatgtgtgataaccaaatgagaaactgaatggcttgccattaacatttctgatgcgtgatactagtgacaggttcccatcctttgtaagagaaactctcaggcggaactcaaaactgaaatcaaatattgcaggatcatacataaaatcaaattcagtcagcattaacaacgagatgaggtgcaaatgttcaacaacctccctgaaataaaatattctcctgactattatcatcaaaagtgccaggattaggctgttcaactaattacccccatgatgcagtacataacaaaactttgacatatggcccttactaacaaaaaggcgtgctataagagaaaaggaaatacatattggacaaaaacaaatgcatacccatgtggccagcacttcaggtcatcttcagatggctttagtataaggtcaacagaagctttgctgttgttatcattttgatttaatggtggatgctcctcatctagggcccatatcctgtttcttgcaaatccatgttgctccaatgttccagaatttccaaactgcagtgagtcttgtggatatcagaaaagaccaaaaagaagggaagctagcttccttatcaattggcatcctatttgtaacagtatataatacaaatcttcagtgcaatggaagactatgatacctgtggaaaacatatcgggattccaccacgcatcgcctttggtggcttgaagattgcctgcacgtcaagaaactgcgtgttgaagccagtgaaagagccatggaagagaatactgaagatttcttcagtttcccagatggaaacagtgaaacagttcaggtttttgtgtcttcagagcccgtctgaactgtccttccacaagtacagtttaatgttcagagtacacacttctcaaacagaatcaatccaagaacatatcccgcgagcgtacagtttgaattctactgcaatcaattgaacttgcgaaatacacttccctaggctaatcgcagtaatgtgaacccggttgcagagcactgaagaatcgaaaaatgaattgaaaaaaaaaaaacgtcaccttgctgctggtgaagagaagctcctcgccgcggtcgttcctccaggagaggacctgcccgccgtgcaggctcacctgcaaaacacacaccacgacgaagaaaacaaagccatcagaatcgcaccaaaccaaaccaaaggactcaatgccaagccgatcaaaatccattcgcaaaaacctgctcacccgcgcgtaggcgccccgcggcgagcggagcacgacctggtcgacgccgttccagtccctgaccacctccagctccgtcctcggatccgtcaggttggtgtagtgccccatgctcatcaacagccagccagccagcccgcgtgaagagagagtagaggagaaggagagacgcacacgagcgcgcgcacgtacgcgtacgagattttatggcgacgcgcgggaagcagtgggcggcgtcgccattgggacggttggggttgccacgacgttttacactgcgcgtctgcactttccttgtgagcgcaaaaaaaaaaaaaaaaaaaaaaaaaaaaaacaccgcgcgagcgcgcgcgcggcctgaaacccgtgagccaccggccacaccagcgcagcctcagcggaagccaaagcttctgcaaccaaccaaaccaccggctcgctctcgctcggagcagcaaattcacaaggcacgccacggcaacaacaacaaacggatcggatgcagcgggaaatggaaatgcacgtggtggtcagaagcgcagcgcagggcaaccacctcgtcacgtcgccattggaagatcgagatgagggaggcgaggcgaggagagaagcacgagtgggtgaagctctagcttctctagtgcgcgaggaggatgagaggatccgaggctaggagaggagaggttgatgctgataccgatggcttcgtgcacccggcagagcccggaacccggtaaaaccaacccagcgccgcggccatggaggacacgtgcagtcgccgctttttcgttgagaaaaaactaagacaaaccgtgggggttcgaccactttgttgcactttgcaggtatagaaaagtctcaggaaagaaactgagaaaggaaaaaagggtttcatcgacgacgcaatgctgagtaggagaaagaaattttgaaggaagaacgaggaggagaattaacagattgttttggcttctgccttgtggataataatcggataaactcttgcagcttttctcgtgtcctgccttgagtctgcgtaatgtaatgcctgcattttaattttagccggttctttttaatttcgcggaggagcccacgctgcaacggtcaagttttctcctccaagtttttcaaaggcttttttggcgtttcttaagccttccgcttcgccatctctctttctttactcctttattataatctttattctcttctttaaagcagaacggcagattagtagtagctactataatcaacaagccttgttctaaacatggcgtctgttcaaacatcgaagtaatgtgttcttttgttttcggagaggacaaatttccagaaacaaacgattcttatgcgtgacacgatctctaaataactttgtttgcatgcacacataggccaggtatgctttgttcacagacagtgcagcgaaaggaacacttgcgttgcttcaggacctggaacttatccatggtcgccaaatgtacgagtgccgtgctctctgaaacctgcttagaacaggggcctctcatttacttacatcaacccagtgatttaactttttttaacttaaaaaagaactcaatgattcggacaaaaatggtgatccgaaaactgtttaagcgaatctttcggaaagggagaagtgcagcgagtgtaatccacaagtcagaagcttggagatttgccctgcacaggtcgtcttcagttgtcgtctcgttgagtctcccgcatgtgcatgggcggcaggtccatggcgaaattaacggcatcctccgtgtaaagctacggctgctagctaagcaccatgctaagctgagttgaagagatagagattttctttcacccatcgccgtcagagatcaggagaggtcaagtgcttagtacggcattccattttttctttctgtatcttttcctttcatttcgagcaaagtcttaagctgaaagaggacctaatctcccacttaactgcgagcaagtgaagcactagctaagccactagagtgttaactctgcatcagtacatggacattacatgtggtggcatgtcatggcgagagtgcgccattgcttaatgctaacttgctaatgcgcacagcacaaaagagggaattgcttgatcaaactcccaagacatggcacgattatgcatcaaagattcaagaacttgcggttggtgtgatgttgaactttaagcaggataaattgatgagaaactgaaagatcatacacgtgttgtaatgtagtacatgtgcttaagacaggaggacttctaccatccttgagtttggctttggaaaaaaataagaagaagaagaagaagaagaagaagaagaagtttggcatccagcggtcaaagtggatctggatagtgtttcggtgtcaatcgtttgtggtttgtcgtttgatccgattgcaaagggtcaaacgtcaaactgtcaaagctgttggggcagagtggtcctcctgtacaaggacaggccgacagagtcattaactagagttgatcagatcagaagttcagatcacagggtgtactgtagaaagtgtatggattcacgtactagtatggcttaaccttttggatatgaactacttcctccttttcgtaatatattatagagtaaaatacattagcagttcttaaacttgcagaattgtgttatataactccctaaactctcaaaatacatatccaggtcccaaaactggttaaagtgtatcatctaagtttaaattgacacatcccctctaggatcctacgtggtgctgatgtggcaataccacatggacgtgacatgtcttttctttttttttactattttttttctttttcgttttcttctcattcttcttttttccttttttttctgctcgggtcacagagaaaggagaagaaacgggaaaaagagaaaaaaaaagaaaaaggaaaaaattatatgggttccatttgtataatgtcatgtcatgtccatgtggcatgctacatcaactccacgcaggatgctgaaggcgttgcggtgatttaggacctagataacacactgtgataagttttgggacttggatatgtattttaaaagtttagagacctagataacataccactataagtttaagtactgcccgtacactttactctatattataatagagtttatccttttatagttaaatttatttaaatttaattaagcttttagaaaaatctagtaacactttcaaaccaaaacaaacataatatcataatatatttaatgaaactaatttagtgttataaatataaattttaaagaagtttgactaaaaacatcttacaaagttacagttccaagccatgtaaagaatatgggcccatatacccaagtaaaaagggtaggttacatttcatttagtttggtctccacaaatttcaattctaaaaagtgtttagcgatctcacaaggtttgaggttggcatgcagcacaacacccctatgttacaacactgctaaaacgtggtacattggtctcacctagcaagcttccatgcctgagcagggaacagcaattggaaacggtattttgagtagtagatggtcacctgaatatactgaccaaattgacacctaacactgtactgccgaatgttatgtgagtagtagcgtgagcttgcaaaatccccaggccgcatgcgcgtagtctctcctctgtgacagggaaaatggcagattagcttgcagcaacaacatcagtggccgggccggagccgaggagttgtcgaagcttgggttcagcatgctctgtgtgtctgacactcgtcttgttcgtgttgtcgatcattgacaaaaagttctccacgacgcgaggagaggaggctgtggtggttttctgcagagatgtttctgcctgggtcgatgctgcaggatccttaagcttcccctaggaataataaggcacatttctatcagagaaatgtatataatacatgttaagggttatgtggaagcataaaagaggttcagtaccattagagccgaattctccagcctgagcttctcggagctttctgatagcctactgatttcagatctaagtgacgtgttctctgctgtaagtgattctacttgtgtagccagatcctccgtttcagcctaaacgaaaacactgacatcataagtgaaagcattatggaaatatgttctgtactaacttgaaattttgtatgtgacatgacatgtatgtgattaaattatcctgtgacttcactgggatttgcaataaaatccctttcccaaaacagaatgtccaaattggttttcagtttcagtccatgtttccaggatgatgcctctttttcttcttcagaaaactgggttttgctcatattgatcacagggtaattgctactataatatacctgctttctcagccttgatcgtctggcggattccctatttgattgtttcctcttttcacgctttaattccctttcatcctggcatataagaattccacaaagttaatccctgagaaatgtatatatactagtgtaatttttttcaaggaataacaatgacatgaaagttaacttatttacataaaattattgtttttcataatttctgatttcacagttttctaaatgatgtcagattgaagataccttgatcagtaattctgttgatactcctgtatgacttggaacaatcacaccaggcggtggagatattggtgtgcccaatgccctcgaattagcaacattagtagcactgggcctaattacttgagctggaaagctgtgatttggcaaaatcgcagtacttcccaatatatggctgggaggtaaagcattttccatctttgcagctgctgatgtttcagcacctggcagagatttaagttgttagccactatttttttacaaagtcaaatttgaaacaggatttgattagtcaccattccattaagaaactgaaagataaagatgtgtcttatgtgtcatttgataaatatttttcccttttctcaggaaggtgcagaagctttacactattttctattaagaagagccaaataatacaaagggataatgttgagaataaaaaaattgttgcaagttataccaaacaaggcatgatagaggacaagataaccgctgaagcaaatgattaatcaagtttggtactgcatacatctataacaagtcttacaaagatgagggaaaatgaaattagcattatgcctatgatattaaaaaagttgttacaaagtgaaataccagctccatcatccaatctccgtttcctgccagtcttgcccacctaaagaatgtacaattttagtatatttaagcatattcagacatgttcattagaaaacaacaagataacacaatgtagcatgcatttgaaactaactggtacctttagatcatttacatcactagagccttctgcactgtaatccccactagacgtcattgtttttttactgtcaccactcccagtggatactgcagccccatcaacttccttaagtttcttgttggagcctttttccttactgcttgcagacttggctggttccatgctcaatggatttgccatcttgaaagaattgacataaaacaaattaataggagtcagcagaataaatatattgaatcacaagtcaacataggattaaggctaaaatttttcaataagaatcaatatgagaggttctgacgctgtaactgaaataatgaaaacaatcggactgtatggtccaaggggaacaagcgtgatggatcattaggaatgtgattctgttactgtgcctacacgtatgttcttcctgtaagctagtattcggcacatcatttaaaagtttgatatgcttggtatgaaatcagtgctgattatggtgcaccgtaaacaacattacagaagtcagattagcatacattttttccctttaatatactgtgttgtctggtcaaccgtgatagacttttccgaaatatctgccatgttagaagttaatttgatactgtatatgatgggacttggttgtccgattttccacaaaactacaatatcttgtgcaagtccattattgataacaaaacatctatctaaaatggttaggcagaaatcttatatttaatgcttcaactaacaagtttaattgaacaaaaaagtgtatggaagcacatcaagattaatgtttaccatgggcataagagggtgtggataagctccaccgtgtgggtacattgcagcatacggggtcccaaaagggggtggcattataggctgcagatatgcagagagaaattcagatttcatgcaacacctggaacttcattgcatagatagatcgaaaataaattacctgaggaccccacatatatggtggaggagcatggcctgaagctattgctggggcaaaatatgtcggtggtaagacaccagggccataatatgcctgaaaaattttgtattgatgcttacattatatatattctatcttttggaagtggagattataggataatttactagcaaaacacttaacctgaacagcggaccaatcaggaaatggacatggagttggttgatcctgcaaatgaaggcaattgataagatgtttatggatgtagctctactctcctacccttgaaattgatgagtcaggtgagaaaatacaatatgttgtcattccacacaagacctcagagtaagccatgtagtggaaataagacctcaaagtgtagacatcatgttaacagattgggaatactggatgtaattcaaaggttgctaattcatttacgtactctgtcccctacttttggagaaagaagaactctcccttttagaaaagaggcggtaagagactagttttttttttttgacgcaagaaggtagagcatgctctaccttatagtcatttcattaatagaaatgaggtttacaggttacaagtttaaggttagagagaagagagacagagatagaggtacataaaggaaagcaaaaaagagtgaaggaaaaagagacgggttatatatacattgatcatgatctggggcttttggtcatgccactgttttcgacaacagtacaactaatttcaattcacagcaaagaagatataacataacagatcacaaggaatatctcagtagtcagtacaactacaactaaaacaggtattcttaccttaggaggggaggttgttttcccaatcttttgtgtagcaacagcttcatcatgagccatgccttttatgaaagcctgctgtctgcttatcaagtagaaattcaggttataatggtgtgcagttaagcaactaaaaataaataaaaatttgcgtgagcctgaaatgtgagaaatgtttgatttcaccaaaaggacgttttggcacactgcccaacagtatcgatataaagctatcaacttgtgtaaaaacaattctcaatcttttcataagatgcaaattcctatcatacaagtcgaattatgatttttagaactaaaagcagctattaaaaacaaaagtttcgtcggtctcctacattggagagcacaatttttttttcgaggtcaaataacttttcatatgtttattattaatcctggttccaggaacaggacagggcaaacgcatacatcaacatgaaactgcttcagtaactagatattcagtcacacacccaatcgatacaaactgcaattagaactccaccaccaacgcatcatcgaaatccggaacaaagaggaggacacggactaataatttggacggagtgaacaaatcaatccaacttgctagcatggatctcctatcgctcatgaaagcagcggctaggaagagaacaaataccttcaattcaattgcctcttgtagagagatttaaggaagagagccacttagaacatgctcgctcgccggctccgcaccggagtagccgcacaggggttggaggagtggcgaaggagagggagctcgccgccgcccgcgcgcgcgtgccgggaagcgagacggcggtggaggaggagaccctcggaggaagcacgcggagagagagaggagacgtgaaagcagattgatctccaatgagcagcgagagaggggagagagagaagggcgcggagagaggagggagggagggaggcgagagaaaggggaggcggcaaaggctggagccacgtcacgagacacgtgtctatgataaggactaggccaccgggggttgccctgcaccgccaattgctacgcgtaccctttattgcaccccaacttgagattgattcacattagcgtatataagtaattttacagattgtaggtcgttttggattcaaattcaaattaagcgagcggctgaatttccctcagtatccttctactcctctgttgaatttcgctcgagttactacttcctgccatcagtgccgtcgtccactatgttaacaccgtcagccgccgatgtaccttgtttgttccccccatctccttagccttcagccagccagtgaacctcatccccaagtgctacgtgtaccttttgttacacccctagcttaagattgtctagcattggtgtatataaatagaccctaatcatgaaaaactcacaacataggaataggagttacacaaaaaatcctcaattctaacataaaaacttcaaaagagatgtttgattacaaaccaagagaaaacatatgattgcaaaagagaaagaactaaaaacatgatactggatctcttggctattttcctcaaaaatcattataggattgtttattccatatgaattcaaagatataacaggatttaatcatttgtttcaaaggtttcacaagaattgctaatataatattagaatcctctaaagtttctatgctaatcctccaattataaggagacctaccacgctaagaacaataatgttgtgattaactggacgactaagattgcacgcaccaagcaaataattgagttgccaacaagcttctgtaccagatagaatctccaggataagaactagtagtactaatttcgtgataaacgtgcgtgctcgactgctcgttaggtaagcaaagtggtttgtgtcattgtgcgccccatggaccaaatggtggtggtggtgtactggtgtgtacattctctgggggggtgcgtctggaatttggggtcgggtgatgggcgaggcggcaagtggagggtgcactgggccacgggctgcgtggtgtgggggccacttgtttattcctcgtcacctccatccgtccgctcacgtgtcgaccatctcgccgctctacgcgtcgccccctccaggtccagctttgcatccgagtcatgtgggtgacgtggtgcccgcatccccaggtgggacccacaccccccacagaataaaataaactttttcgtgctagagcaagtacaatagcaaatataagacccctttgaatcaaatgatttatctaggaatttcatagaattcaaatcctatagaaaattttcctacctggccttttgattcaaaggattgaagttttccaaatcctatgaaatttctatggaatgacacattatatgtggattttagaggaaatatagcaagagctctaacctcttggaaaattcatctctctcatccgattcctgcgtttttcctgcgcttcaatcaaacgatcattcctgtgttttttttgtgttttataatcctctgttttacacttcaattcatatcagaatcatgtgtttttcctatttctccaaattttcaaccctacgattcaaaggggccctaaacaagctataacacatttcataaagataaaacaggagagaaaaggacaacggactatagatttgtagccagttgtagcacagactttaagatgcatgtgtcgaacttcaagatgcatatgtatatgacatgtgtgaccatctattaaataattattatatgaatcggtaattaaattgactataaataatttagagtccacaattagctatactattaaaaacttgccgagcaaaaaagcggaagcttctcccacgccgttggcgtgccgtggggcgtgggctttgtgggcccgagcgtgtgggggtgtggggccaccgcttatagcctggcgattggagtaagtgcgagaggagggaataaaaggaaaaagaaaggggacatgtgcgtcaattttgccacgtcgtcgcccatgtgcgcctacgcagcagtcaggaggcgattgagccacgtcgccgggaacagtgtgggggtgggcccacgcgagcgtggagacgaggcggtcagtgactaggtgccagctcacggggcctagctagcttatctttttgatcccgccctgacctggcttgggttggattggggcgcccggtgattgggttggaccagacctatccaattgcctcgttgcagcatgcgtgttggaatagaagttcagttggtgtgtctagttaacgctaaaattaaaaatttgattaaaattgtaacgatgcgataaaaaaataaaaatttatgtgtaggaaagttttgatgtgatggaaaaattagaagtttaaacagaaagtttggaactagtgtgcctcgtgtgtgtggcttcactgatacctcgtccgtgtctcggtttgctgaatgatttttcttgtttccttgcatatcctgggggctcctccttggtctagtgtgggtgtggatcccctggagttgcctccaaatccacatggtggatttacttaatccaagccgtccctttaatttgatggattagattaaatccaatccattttcccctggttactactggcccattttctttcaaaagaaatactacaatgtagagtctataaaaaaatgttatctagtattgtagagaacatgttaccttcaaactttctggcaacaattagagaagaacaaaacaaaaacattgcaccgatagaagccttttgttctgtcgattattaggatgaatgagttcgatacaggtctcaataccgtaaatttcataacaactcagttaaaaaagtttaaagataattattttttactccatgatgtataatgctcttccgagactattgatctgaatggacggacaacacaaaaaaataaaagtagataggattatttctgttgtaaatgtgtaattagaaagaggtaacatggctacatctagcccatagaaacaaagtaaggggtcagattggttcaaattcaccggttagaattggaagccaactccagaggatctgcacccgtctagtataggttggttgcgccggaaacctgatcaattgatcatgtactccgtttttttctcccgttgttaatggtcgattttgtctataatgaccattgatcagtcctggtttgccccagcagatacacaaagatgcaaatcatcgatatgtttttcctttgaaagtactggagagaaacatagtacccattattgatattgatagaggagaaattagtgaggaaacctgcgcccaagaggatttgagctcaggccagcgtattactgctagcaggagcttgccagttgagctaggcatcgttctctaaaatgtgttggaatcaatgagaaacttagcatagtgtaattgctaaataagaaaatgataagaaacttgcgtttgagaggatttgagctcaggccagtgctctactcctagcaactgcctgtcagctgagctaggcaccattctctcggtggcgatattgcgtgatctggaaatgaaacacaggacagtagcaagtagcaaacgttgtcttgtagtactacattcgggacaccaactttatgcaattacaggcaaggcgagtcttcctgattccattttatgtagagtcgctattcggcgttcagataagtactagcctgaatgcctgatggatgatgccatgttgccaatcactatcttgtgccttgtaggctactgctggctatctgagctggatgcagttcccctgctcgttaggtgcaacgaggcaaagagaacgcaacagttttaacaaacccaaaaataaaactagaaccaccgatttaaaggctctgagatacgaatacgatagtgcatcgcactaccatcggctgttccagagaagaacccaagcacagaggtcaagaggctactcaaaaaaaattcttccagactatagctaaaactgctggagtactactcaacagtagttgcagcttaaataaattgccaaattatcagctggacgtctcatccttaagcacattgaattattacaaatgaaattgagatacataattaattttctcttgtacaaatgactgaagggaacttaagcaaagctccttcctgatggacgtcgaacgaccaatcagcagcagggcagagcttttcttagtcactcatgaaagagcatgcacctactgcgctgcccataagctaagatcctgcaagaacttctaatcttgagcctctgatggcctgatgagattaaggtcctccaagtattgcgttctcgatgtcttctctgctaagggcatagctgaatctcctctctacgtccttgtcaagattcccagggccgctcttcaagtacctgattcacaatatgacacggagttagtaactgaattttgataagtgagaaacagaatcatcgtccttataccgaaacattccatagtgtgattcgagggttcagtcggggaagtcaggctgtcagggtactaaataaagttggtatatatctgctgaactggcaatatgctgattgctatgaagagattgcagcattagctgaacaatatgccgattgctacaaagggcagcaatgaaacatccacagtgaatattcagtagacatatccatccatttgatgcacccacaccacataatttagagatttaatttggcaaaaccacggttcaggagcaatttggcgagcaagaattaaagcccaaacgagcacgcattgtgcagtgcatcaccaagttttcagagactactacagcctacgacgtgtgggcagcaaaatctacggacaagttactgcaaaatctacctgatgtggaggtcagtgacgtcgaggctgaggcgggcgtgccagaggggcatctcggcgacccagacggcgcggtcctcgcgggtctgggagaacccgatgctgcgcagccacgcctcgatgcacggcaggctgtgcgtgtacagcggcttcttcttctccggcagccgctccagccactcggcgtccgacggcagcgccgccgcccgcgccacgaccgccgcccccctccgccgccgcgcccgcgcgtgctgcaccggtgccgccactccgcggagccctgggcgagcagagggcgaggaggagacggaggggaggatggggacgaccagggcacggagcgagctcgacggagcaatcgacatggtcgctacgggctacggcctccctggatcgctcgctggtttccttaccctttttccccttcgcctcgtttctcttctcccattttgcctgtataatattgggccgtaattttacttgggttgtgcccgttatagttgggcctatggaagagaaagctgggaaagtgttttcaacccccttttcctattttcttgcatgtcacattgtacctaaatagtcacactatttttttttaaaaaagataacaagatatattaatatgaaatatgtaacttcgatagcatggctattcaaattcagcttttacaagttataataaaaataacaaatataattgtgaatatgttaactattttcagtttaatttgttctttttattgtaatttgtagaagttgaatttatgctaacatgtttatgaagtgatattttatattaatccatgttatgattttttttataaatatttagatgacatgaaaaaaaacgaggtgatgtcatcttactccttttccgagaaaacttgtcaacaaatttgtatttcatttttttcgttacagtgaagacaaggtccgtgtccgtacaccgcactcacgaactcaactgcgtctgtgcgtctgtgcaggtcgaacttatacaaaagggaacgggatttatgttatgttagaatccgcgtggatttatgcagcaaattctcttggcattggtgcaaccggctgacgtcggagacgggcggcatttctgtgatttttgggatcgcagtgtgcgtagtaagctgcggatgaacagatcacacttgttatcatcttcctcatgttgcccggatgcaaaggtgagaggcgatagcagggtcggacggtagcccgcgtagatgtcccactggaacgacgacaacgacgatgaagccaccgggaggcagattttgctgtcccacgacataataacgacctttgtcgaagaaaaacgtcgtactgttgccgtggtagtgccgacgtacttacggtacacgttgttgccctctcggtagcaaagcgtgttggtgtggccgtcgagccaagcactcatgggcactagcctttgaaattggttgaatcggatatcatccacgaccttgaacttgtagagaagctgccatggttggtcgtcgtcgtcttcttcaactggcattgtccaaaactggatcatcctctctgtcctgatggccaggcacaacctcccgtgcagctcgaagacgctcaccgccgcgtccgcccacgggagcccgtagtccggtgggctgtacgtgcagggctcctcgtgcgcgacgtcgaccaccagcaccgggccgggcgtgccattgtcggctgggtgcctgtacggcgcagggccgatggtcgccatacaaatcttgccgccgatgacaacggccggcttgctttctaccaggttgcgcgggtgcagaggaagcgcgtgtcggcgccacccggtggattcggcgccgcggcccagcgtgtacacatccatcgtgcggttggtgaagcggaacagcttgtaaacacagttgttcgggctgaaccccaacgcgaacgtgaccggcgagcgagcgttgtcttggtcgggagggaggcgaggagccctggggacctccagcctctcgccggtgacggggttgtgtacgatggccttggctgtgctatgggaggcgaagcagaggaagccgttgcagatgttggcgatcctgtagccttccatgtggttgacccggcagatgggcgccgtggccgtgcgcgtggacgacgtcggagagacggcggccggttcgaccgggaagacgctggcgactctttgcgagtcgatgttgtatgtggcgacgagcagagcgtcggggacatcgtgcgccgtggcgtgcctgtcatggtggagcttccggaaggaggggtccctaacgatgtcgcgccactgcgtcgagacgcaacatgaccgggcgacgtctttggttgatgccctgagcaagatttcttgccatagctcgacagggatcgtctccatagttggtgtcctcgccagtagatctatcgaaaccggaaccgaaaccccctggccctgatgcccagctccttaattggcttaacaccctaaacgaggatgatgatgagatcgtccaatgcgttcaacacttcagctgttctgtaaactaataggcaggcgttgtccggatacgattcgaaattgggttcaggcaccgagcgtacgtaccggacagcgctttcttcttcctctaggactcggactctcggaggtcgctcgccacgacgcgcggggttgcgatttgcgttcagcacttcagctgttctgtccagcgatcttaaagtccagctatctctgttcgcattgcgaggctgctgctactccaccaaacgcctgaaattaatatatctgttctatacgcgagctattttgggtggcggggccttaactttacaaaaataattacgcggagcagttagtaaggcaaatttgactagctatttttcattaaaaatagtcagattacactgtaaattatacacatttatattgtacgaaaaatctcacctatatcatgtcgatcgaccgtagctggacacttagggtctatttagggtatgtttggttgcctgtactaggcctagctcgcatcagaccatgggactgtctaggtatctctcgtgtgatttttgaaaaaaaattacccagattttttatcccctcatatttgtatccaacggtagaaaaaatagtacacagacaaaaacaggtctaaataagatcgggccaatacagactaataaaacagatacaatatgggttgcaatatgctaaaattacagtgatttataactaaaattacagttgtaaaaatagtagatatggcatgtaagtgcactgtaattttagtacaaatgtaatgtaaaatttggtaactagaatatttatcgttttagtataaatgcactgcttgagaaaccgtccaggtatctaaagtgttaaatattgcatttataactaaaattatagtgctttataactaaaattacatttgtaaaaatagtagttatggtatgtaagtgcgctataattttagtacaaatatactgtaaattttggtaactagaaaaagaaaaaaaagaaatagagagaagcatgggcgcgcaaatcaaaatatcgcacggagaccgtggtgaacatgggccccatgcggcgccatgcatgatccattttctgttgactggaagctgagatactccggctactggctactgtctactgtgttactatcagcttatcgatcgtttcctccaccatgtcgcccgtgagacgtgtggcgctggaccactttgtgcgtgtctgattcgtcgcgcctaatcgcggtgcagatccgacggttgaaaaaacgtcaaatacgaagaaaaaaatcacacgagagatatatagcaaattcgtcagaccatgcatgcagatttgatatgtttggctgcctgtattggctctcgagacaggatgaggcaatgcaaaaattgcctttgagccatgccgagcggaaacgcaggaattgaacttcgcaactcaacctggctccatggatacagtggtactgcgcccatgcaatagcacatagcacccgcacgtgcaagggggagggagctagtcacctccccttccttattttgcccccaccgaagaaagctagggtttactctcatttgatcatttctattcacggctcatcatctcttcatagatctactcccttcgtttcataatgtaagacttcgtttcataatgtaagactttctagcattgctcatattcatatactagatgttactgaatctagatgcatatatatgtctagattcattaatatctatataaatatgagcaatcctataaagtcttatattgttaatcggaggaagtatgaagcagcagcagttcatagcaactagcaggaagcgttcgcctccacgtgcatctatcccacgtcaaccaccattcgtcgcggcacttgtcatcctcaccgcctgtcgctacgcaccatcctctgccgcccgtcgccgcgcgccatcctccgccactagagaaggttggcggggcccccaatcagccatcaactactagccatcgcgccaatctactccgtcccaaactcgtctacttcgccacggcatcgccgcccatcgcagccatgtgagtccgcggcttgcctgttgtagctccatcctcactgcccgtcgtggtcgtggcactacttggccttgctttgctgcagtctatgctccattttgcagagaaggccacattacccttcgctttcgcctcatcggcaatggcacgcgacagcagcgctgctccgatcagatcagtggcgtgggctccagaagcttctggaaggcgtccaagagggcccgcctccacggaggcgatggtgggagcggaggaggagtggtagtgcgtggcgctggatgttggagtgctgctgcgccgtccactgatgacgctgagaaacggcctcggtggcggtggcaattacgtgagtagtggccgccggagctaggcggtggcagtagcggtgatgctcgtggtgtcggccgtcgtattgcgctagggcgtcaagaagaagaaaggaggagagagagggggatgggagagatgaagaagatgatatatgggtcccactttattttatttgatgattgagatgccacatggacaccacgtcagcaaaaccgctctgcaaaaccgtcgtgggagttaaattgcaccggttttaatagttggggttgagagatcctctattatggttgagggatacgaattagattcaggcactaggtaagggagtcaaagtggacttattccttcagtcgctcagctattagatgggtcgggctggtatcagatggtaaacaacccccaaaggcgctagagcgagaatccccacatacggtttgctttcttcttcttccccaggtctgtgctctgtagatctccaaaaaaatcgtccattctcttgtcgatttgctcatccttctccgattctttaatcttgtcctctcttaggcattgaggccgcttacttgcgacctcttacctccttgctataatatatcctcctcgtcgtcctgctccgctccaagtttgaagcgatgggatcgattgctcgaatcgttcgatcgatcggccgccatctgcttcagccatcgtcaacttggcagatccatgaaatcccttggctgcagactgcacagagagactcaaatctcttatgccgccgccgccgccgcctcaccgcccacccggtcgccgccgccgcagccctagtcggtgcctcggtggtagcatcggcagccaaatgggccgtctggttgtatatcagactgggcctactttgtggcttggcttagcccggcccatttgaggtacctagccgtgggcgggtatgagtatctggccagcccaaatgttttttctcttcttcttcccgtgctcggcttcctcccaaatccttcctctccccgcctcccgcgcgcgtggcctgctcctccgcttccctgcatcttctccgaccaggcgtccaccattgttgctgcctcctccccgttcgcggagatccaaatccttcctctccccgcctcccgcgcgtgtggcctgcccctccgctccctgcattctccgaccaggtgtcccagttcaccgatatggaggggagcgattctgttacctctccaggttggttcttctccctctctttctttttcttgctttcttgattttacgattttctctctttctttctgttcttgcgatttttctttcttttctttcttttgtttcacgatttcttcttcttgttcttatcccctcttcttgcttgaattatagtgtttttcctcttttcttgttttctttctttctttctgttcttcggatttctctctcgctctctctctctctctctctctctctctctctctctctctctctctgttcttccatgctacgagagttcttgcttctttgacctaccacatttctctttgtctggagcagatttggagctggtggccgggcctctggatttgggtacgatatttgatgtcgatatggaggactttgtccatggccgacgcaccctgtttgccgtaagcttattcatacaactcaatccttgttcagtttcttcctagaaatttctcttctttagtccctcttcgtgaacatatatctgaaggatttggtcaaattcttgagtaggctcttactttttttttgtcaagcaaagaagctccaaagttatatttacaaatctggaagtggacagaaacctagctattccctgcaaattcagatgaaaaaaaaaaccagacataaattgacttgcatttcacttaattacatttcttcatgcattgcaaattatgaaaaaaatggaagaaatatctgttcctgaatcatcctgaatcctgacacacagtgcactgaaaatatataggaatgttaatgtgcacaacctgaaaattcagtgtcattggacacagaggcccagcagttgatcacctgtttgcctggatgcatcattcatgtgggcgagtacactataattaagagtccccaacaacaactccacatgaccttagacctgagaattttttgtcctttgcatttctgttcataacaactgttccagccaaggagagagtggtcaaaattatccagaaacacaatctcacatgctgcgatccaaggccaactttggctggccacactggagaacaacaccaattagcagttacttccgctttgatcgttttactagttatccaatcatatgatcaagttgcaaagtcgtaatgtagtagtacttttcatctgtgcggcaactcttattaccaatggaatgattcagatgaagaagttatcctctgggtgaattaaaaaaaaatcctttcaatttcctagtttccatgtcaggctttcagattctgcttgatgttctttatgatttgcgttataggatccttaaacttgatatatttggaccaaatttaagttattcaacatgatatttgtcctcagtctttatttcgtttctagcaaattaagtgcagaatctttatcggttctagaaaatataggcgaattcagtattttctggttgtatttaagcttttgacctctatttaccttatgtattctgttaatttaggtaagcctctggtcgtattaagtccagtttcaggctatagtttcctaaagccaattttcgaatgtgcagtcagacttgcgtgcatgttttgtgaaaataatccctattccttgctttactaccttagagaaaaaaaaaactgtacaccataaggtcttgctctaggcaagtgataaaccgaggtcgtatactttaacagaatatggcaaataaaatttgaaagttccgaagagattatataaatctggttgcacaagtagtgttttacagcagacaagatatgcgagcctacatgagtgtcttagtttcaggcttatgaaaatttcatgccacagatatgatgtggtttatgatacaatgcagttataataaatgttttgtagggtctatgtatctagctaatctcaaatggagcagtagtagtatgaaagattacaatgttgcatggtactcttgaaaagaatcaagttcaattctaggaaatcatccctttgaatatgctttcaggtatgcgcttatgctctcctgaaagcaatccctggtctcagagctctcgtagatgacattcctcatcatagttatgatgttggacatgttggaggtactaatctgatccctatgttattttgttcccaaaacctcaaccattgaagtgaaccactcatatttattatcttttccacgtaggaaatctgtgcttgagatgtaatatgaaggaattgaataaatatattctgatggactatttggaaatacaacgcatcacaaactccctgtttattttcagaaactgtaagtgttattaactcaatctatagttgaacactctaaattcctgatctgcagtgttcttactggtagtttatcaatattataggggagccaaaaacagtgacggtgaatgtacaagctcttatggatgagcttctatctgagattgactattggtgcttagagaaggattatgagaattcaatgaatatggttttgatgcaagtcagcttcacacaacaaacaaatgatcttcttctttttgagtcctccacaaaggtagtacttcccttatctctaacataagttgggcttgtattgtgcgaatattacattatcataattttgtagtggggatgctacaactgtgctgtacatttcacccgcatggaatgtagcaaatctatttatatggatggccgttctgtctccgagtttgaagaggagtgttacctggactgtcatgagtgcaagatcgctgtaggatacaagcgtatgaaagtgtgcaaattaccacaggttctaaacttctatgaagtttcaggcctcctgcctgagttgagaatcttaaatcaggtatattcccagatttccttagtgatgtggaaaagtatttagatcgtagcagtgaactgaatcgcctctcactatttttttccccaaggactatgggcttacgtgcgtaatgccagaaagaaacaaggcttgtctctattgcctattagagccaacaaattggacacatgtagaagccgctggggtaagttttaagcaaaaccaatcctgtataatgcattgtttcctttacaatctgttcagtagtaattctctttcagtttttattgaactttttcagtttctaactgcacacctgcttcacctttcagttcaatgcccgtctgtgtccactaggccctgcattaccaccgcagatccagggcaaatgcgcaattgcaatgtaccaaaggatttgagtacgtactacttgtgctctagagagattcctgaaccttggttgctggtgcagtgtaaattttgaaaacctcaatggggtggctgttagcaagggtcgtgaatagtttcaggaaatactggtttggaaacaccttgatatatgtatcttggagcttgcattaactaaatagtcgtggatgttctttatcctcattttaattcttgtgatctttgctttgtgttcccttgaaagactagagataaattgtaagtgtaatatttctaattatcgctttgctactgcagtgcgagaggctactgataaataactaacggggttggatttgtggagctgggaacaacctcaagagcagaatttgaatcgagcgatcagtagacctgtcaagccgtacaagatctctgatgatgaattagttctcggttgctgttgtttccccagtttgcttgtagaaaaatagtaaacctggtgctcttttcttgtagcttgacttggtaggtgtagttttctgctgattagaagccgtgatgatgcagtgacacaactgtgagctcctcttgtaatgtgatttggggttgaaactgttcacacaaaaaagaaagcattattggctgaaaattgcccttggtgttgcttatagatgttcaaagatagagtttactagctgtggtcgcttttgagctgtgtgacctgctgtaatgtgccttgtagtgctttctataagagctgggcctaggccttgttagtgattttgatcttaaaagatcagatagagtatgtctgtatatgtaaaactgttggtacaaaatgtagccttacatactgcaagtataaaatgtattgtcgtacataggtttccttgcttctaggggttgttcaaactctcttctttagtcaatggaatgggcactttgctgaatactaaattgctagaacataaataccagcaggagtaacttattatgcgatacactggttcaactacagaatttaatctctccttgcaggtacactctccaccatgtattaatttttttcatccaataaaaatggaggtgctggtgaaactgatcttttggatgactttgcttttcttttttcaaaaattgaattttgcatttctagggagcccgagctagataacgacgaaaaatactgaggaaaggatcatcgatgacagaaatatgaactaatctggggacgatggcaagctctgttgctgaccaaaagcctagtttgtacttttagttgacgacgatgacaatgattagttgcccaaaggttatactacaaattatcagttatggcaaacaaaaccgtaacagaccatactgccaagctccgatgcaaggttgaaaagaggaaaaaaaaactaatcgattggaatccagatccacctcccagtgccagaattcaccagctattacatgatcatttgtcgagacagaatcaaattgaagtatcagatgcagcttcaggttctggagctgccagccgtataaacctcttcggatcttgttggtagtacgtgagtgttgtcagttatcgcaaaatttgataataacaagcagccttgcaaactgccatcaaattcagatcatccgctgaattccatccaaaatgcaaactcgaacaatcgagaaccatccgttgatccatccgtggaccaaaagaagaagcaacccgaaccaaggcgaagaccccgacgagggcaacaacaataacaagaagaaaaaaaaaaggaaaaagaagaagacgacgacgtggcgagccaagtagcagcaaatcctcgtccactcatccagttctacgggaggccgcggctgctgctcctccccctccactgattccgcccttcctccaatggccgccgcctcctcctctgccgccgcctgcttcctctccccgtccccttctccccgcccgcgccaccattccatcaaacacctcgcgtgcgccgcctccaggtcgccgtcgccggggccctcctcctcccgctccctcgccctcccttcgccttcggcttcggcttctccgtggccgtggccgcggcggctccgcgacctgctccccgacgagaccggccggatcctgtcgtccgccacgggctccctcatcgtcgccctcgcctcggccgcgctgatcctcggcgacgccggctccgcctccgcgttcgtcgtcgccacgccgcggaagctgcaggccgacgagctcgccaccgtgcgcctcttccaggagaacacgccctccgtcgtctacattaccaacctcgccgtgaggtagaaatccgccgcgttcgtcctcctcggcttgcctttttttttttcacgcgtactgatgcgaattcgggttgctataggcaggatgccttcacgctggacgtgctcgaggtgccgcaggggtccgggtcggggttcgtctgggacaagagcggccacatagtcaccaatttccatgtcatccgtggcgcgtcagatctcaggtttgttaaaatgacatgctgctgtcgcccacttagagctgaattcgaatcatacttcacaattctgatagatttttttgggtgcatgaagatttgtataggagtgtaaattgctctagacttctagaacttgaaatggatggagtaatgcaaatagatgttggttagctgcagtaatgtggttacagtgacaactgacaacggttcagtgaactgtaaacacttcctactagtgactcattattcaatggcttcctttttcttagtttaatatgttcaaaggtgctatgatatagattagtcatagttgctgacaggattgtgtgtttgaagctttaaaacgattatattttgcatatcattttcattatgtacttaaatgctacacttgagtatttggtgcacaataattcattcccgagcccaacaataacttgcgttttggtttcttctaagccgcatatactagtatgctgtgtacactgttctgctaatgctacatggtgccaacttattgacaatgcattattgcatatagagctaaaacatccatccatctaagatactgttttgatgaattcttatgacataataacctccaacggtatcatggcgaagtgaagttaccacgctagttttatgcagggtcacacttgctgatcagacagtgtatgaagcgcaagttgttggatttgaccaggataaggatgttgctgttttgcgtattaaagcaccaacagataaattaagacctgtaccagttggtgtgtcggcagacttactggtcggtcagaaagtatttgccatagggaacccggtgagtgtttcttacaccaactgttcggtgtattacccattcatgacaactggctcataagcttaataaaatgtattctaacatagtctcaaaaaaacactatccagttctttacttgtgatgtgcacccctgaataatttatttccatagtttcaatgtacttttctgttcagagctgaaacaaccttagaaatccccctagctgttcatgaatatgtctgacattgtaatgaaaatacaatatatgctagagaatattgtacacaaaaaaaatacaattaatcactatgcaaacaaccaatatatcaaaatgatcttatgccactaagactatgtatcgcgtgttttggtgatatctttaggcttttagcacgtattgattcctggatagaaaaatatgcttacaacacttgattattctgagttattttctatcatgcttgcattaacttactgatcactaacagtctgtaacatgttatgtctatgtttatgcagtttggtcttgaccacactcttactacaggagtcatcaggtgtaatgttgtttgagtaaacagattctgtcttttgctgattcataatgcaatacactgagacacctctgttttgtttttctgttgacccccttccctgcagtggattgcgtagagaaatcagttcagctgcaacaggacgccctatacaggatgtgatacaaactgatgctgctatcaatcctggtaacagtggtgggccacttcttgatagctcaggaaacttgataggtgtaaacactgctatatactcaccttcaggagcatcatccggtgttggcttttccattccagttgatacagtatgcaacttgacataaatacaaaactcagagtttcagaattttttattttctattctattaacatctcttttgaacacatccaggttggtggtattgtggatcagcttataaagtttggtaaagtaacaagacctattctagggataaaatttgctccagatcaatctgtagagcagcttggattaagtggagtgcttgtcttggatgctcctccaaatggaccagcaggcaaagcggtattgtccatagatcttatttattggtttcctgtaaattgcagtcagtcttaaaagcattggttttcttgcactaggcatgttccaattacgtgtcaatttgagtttactgggagaacacctgagttattactccataacatcatatgctatgttgattgatgtcctctcgtgtgttttcaatcgtcactaggactaaggacagctgaacagacataacagtgataattcatttagcataaaggctaaccttatgtgattgatagaacaaatcctttttattgcagacactgtattttctttgaacatgttcgtgtaatagaagactagctgcttgctttgaaaatgactggtgcaactaaaacttatacatcttgttgtatgctagggtctgcaatcgaccaagcgggattcctatggtcggcttatcctaggggacataattacttctgtgaatggaacaaaggtaacaaatggaagcgacttgtataggattctggatcagtgtaaagttggagagaaggtaagctttcacacgtttttgtaaggaagaaattgctgtgattgataatagctcaggtacttatgcatattgtgttataggtgactgtggaagtattgcgtggagatcaaaaggagaagatacccgtgattcttgaaccaaagccagatgaatcataatagtaagccacctccataggatccactctactgtttgtatgtccacatagatgcagaaatggaatatatacaagaaattagcattttcccctaccacggaattcgctgtacataattcatgcttgtaaattttctggcaaaaagagaaaatccaatttggcttatttccttgtcattcatgcttctggtgtaaccgcctcagtagagacgtgtcatacgtgatgtctctgttttcctgtattttggtgaggaccatgtacagcagagactatatagtagaccccacactgctccgtaagtctacttaacatggcctaccgtatttacactgcattcatcactgggccatctatgaactaacaggttgatggtcgtactgatctcacatatcacctaaaaatcctttctgacagtagaatccatgcaggttttgctagagaagttgttttcatggccaatgcaatgcgttgggtagtctgcgatggcatggagattaatgtgatggttatgtcgtgatgtctaatacagcagtgtcaaccacacacgaccctgtcgtggattttggggatccatacggttgtcgagaggcagggctgatgtttctgtaaacgcggcagggtaaccatcaaagaagtctctgaagatactttagcttcatggtcacacctctgcgaggattttgcatcaaaggcgtgaaaagatctgtgagcaacaagtgaaaaggatgcaatgttttagaaaggaagcaccgcagcaacaagcaacgaaaagctaatcatgttcattgcatgattaatttatatcagagaataaataaataaacaattaccagtacgaggattttcaagtgatactactacagtatccttgctgctctggacaagtagacagacgtcaggtccatcggtctgggcactgtttgcaaggtaaaccgtcacagtccactttaagttctgatagatggatcatatctgacttcatcaaagaatacattaaaaaaaacttaattgtctcttaagtatagcagaggtaggatgtaatcaagaaactagccatgctgattgattccatgcaacttctcatcaagccctgcacggccgtaccgtgttgctatctgaaaccggctataaatcagccgcaagatgatactataacacactttgccctattcttttgaacttaggccatgtttagttccaaaataattcttcaaactttcaatttttttatcacatcaaaacttttctacacacaaacttccaacttttctcaactttttcgtcatatcgtttcaatttcaaccaaacttttaattttgatgtgaactaaacacatgcttattcattggattcttatgaattgtttgttccattgattagaaaataccttttcttaaaaaaaattctactacattatttacccacttattgtaagacatttgttaagtttattttgtaataaagtatttactccctccgtttctaaatatttgatgccgttgacttttttaaatattgaccgttcatcttatttaaaaaatttaagtaattattaattctttttctatcatttgattcattgttaaatatacttatacgtatacatatagttttacatatttcacaaaattttttaataagacgaacggttaaacatgtgctaaaaagtcaacggtattaaatatttagaaacagagggagtagtttatccttgtaaccaaattgataatccgctacgataagtcgataatcgctcaaccggggcgctgacgagcgagcagagcaggacgatcggtcaagccgccgttggccccggctgtcgcgtgcagagtctacttcacattgaagtctgctcggctcagccgctcagcgagattaccacccacaaattgattaattagaggattactgctatacgtgtgatccagttacataactcatgtataattagagacatacaactatagattaattaaaatagagtatatttatatgcattgcattcgtttaaaattagtgattaaattgagtcgtacgtaaataacagataggtcgtatgcatagtaatttcctaatcagagccttccttgctaatcaaacgtggtccaaagagatatgcctatcagagaagatcgtggagataagcacggacagagtaggctaaaactcgtttggtttttaatagctgtcatttatacgaaagatatggattaaccgaagtgtgtagtatttgtacttcacctctttgctcttctggaactttggttaggtagttatgcttgtatcattcagagtacccttggtgtttagctttcatcttgatggactagtaataaattagatgagacaacaagccaaatcagtactacattattgcatgcatagatgggctttctctcactaaatatagctaataatatatttttgaccggagaaatagttaactttcatgagtttaattagggaggacttggtagcatattctcgcgcatgaccggatttgcatgattgcacaagtacagattatgatattaagggcactaatatatatttttcaggacgaattaagagtaaagcttggtaaaggagagttggtgatcgaaggagatatctggaaaatgaccgttcatttgtagcatatggttgaaatctatggtgcatgcagcatggttcatagagtagttcagtatcagattatcatcagtacgtagtggccggtcaggggaagagaaggttggagagattaaaggccctgttgaaacaaagaagtttgcacctgtactttaattagtttcgtttgaatgttgcatcgatctgtactttaattagttttgttttgaaggttgcatctgtcctgtacgtacgtgttgagctagctagtacattaatgatgtagctaattatgtgaatatgccgaaacaagtgttacaagtcgactacaactgtgccatgttggttaattagcaacacaagtcaatctctgcactaccacatactcaccacaccatgcagagctagaaatatgacaggagccgcacgtagactgttttaccaacatacagcattggccatcaacttttagggatgaatctgaatatatattgtctaaatttattcttagaaaatttggttttccagagacggatggagtatttagtaacaataaagagaaaaacatatgactacttcggtacttctctatgataaaaaaaacaaaggctatgtttaaaggggtttaagattataagaaataattgattggtacgttgcttctgagaatttataaaaggtaactttcccagcatctaatttctagtttattttcttaataagggaattgaagattctgtgcgaagttgtacttactagaaattctgcgaacaagagcaaataagcttgtggaaaatattgcgactcgaggaaaaattttaaaaacatttttatgactatatttgaacttatatagtagccctgcatgaacatataaaaactctgtatacaatatatacttattatgcaagctctgttacactcaacatttttttggaataaattgttacaattaccatttaccgcagacaaacaaattaaagcgtgcagccaaacttatcagccacacgcatcaaacaaatttaattaaacctgctcacgaatttatcgtggcaagtaattaagtacatacttaacctgcagagagaagagaataaaatcgatcgagcaacattggtatcgaagacgttcgcgacgtcagaacgggtgatagctccggcggaacgcggtggcgttggcgaaaagtccgacgatgtcctgccggtagggaaggaacgacctccggcgaccgccgccgccgccgccgcccctgctgccgccgttggcgtagtagctcagggcaccgtcatggcccacctcgccgcctctgccgcccttgtgctcggagccggaggaggaggagctcgcgttcaagaacacgaacttctccttgccgtcgctgtggctccggccgatggagcgctggcgccaccggaggagagacgacccagtggagccgctcttccggcaccgcgccggggaggccgccgccgccaccggcaacgcgggacacagcgggcagtacaggaacgtcgactccgccggctccccgtcgaggtcgaggtcgaggtcgtcgtccgccgccggctgcgtcgtcggtggtggcggcggcggcgggccgtggtccaccatcagaaaccgccatagcggcagacgcgaggccttctccggcgcctgccgatgcggcggcggcgtcggcggcggcgacctcggccggccgaagaccgggtacagcggcgggcccacgcagcggccgccggctagcggcgggacctcggcgaaggtgaagccgccgccgtcgtcgtcggccatcatgttgccgccggcgatgatcgcgttgagctccatcgcgttcagctgcttctgccgtgcgtgtcgcctcccatggcgtgtgcggcttcctcctcggtgtcttggcgccatggctctccttatatacaccaagctacggagtagtagaagccttcattctcaactgtactgcacgaaagcgtttcgaattgcctcgagatgggggcactaatctcgaccgctgatcacgatatttgacagctcgcaacggatgtgattgcgcgttgcagttgaatcgtactactagttgggttaggttgcactcgctgtcaacgtggcatgcagagatgtggctagttgcggcccaagcccacctgagcggagccttacgaatcgctgggcaattttggtaggcccgaattttttattgggcctaggtaggtctcttttttcgccaggttaggcctccctaggcccaataaggccgcagagtgccgcagaagctatttaatgggccgaattaaccgtcaatgggcccatccgacatttcctctaaatggaccgcagtcgaccgccattccttcgtaatgggccgaacgagtcgtgattttctccagacgggctctagagggcctacatttcctcgtaatgcgtggtaacctcatcttaatggacaggaggaggaggactcatgcctcaccaccgtggcgcccgccactgtctccgccatcctccaaccttgatggcatcctcgccatgggcagtggcgggtgagctcccgcttcccaacctgctttcccgccaccgaagacgacgacaacaacggtaatgggtttgaggaggaggacgcatacctcctcttcctctcccctgtctcatccgtcttcgcaccactgttgctcgccacaccacgctgttcgtcctcccctcccccttccaaccgccgcacctctcccagcacgatctccgccacctcctccgccacttcgtcttctccacctccttcctctccttcaccgatctcaactccctctcacggacactgctcgccacacagtgcccgcccttcccaacgccctccaacctgctcgccatcctctgtactctatcgtgctccgacctcaacaacatcctcgccatgggcatcggctcgccacgctgtcccttcgccatgggtggaggaagtaggacccattaacatgtgggtcccaccattttttatcttgtttgtaggcccctattttgttttaattatttagttttcaattttgctccttttatttgttttccgaagtaaactaccacgtaagcgtcaataccacgtggaacaaaagacatggtcaaattagcctagtaggtaccacgacaaccaaaaaaagggacaatactaccgagggatctcgtttgcactggttttataagttggagacccgttgtatctgttttttttccagggacgtaaatcggattcggtgtcaaattaaggggcccaaatgaactttttcagtcactcaatgacaagacgggcccacctaagttgtacggcgattcgtacagagcgctcacgtgggcttgggctgcaactccgcaaacccacatctcgtgtcaaggccacgtgagctctctaatgctgtgatcagcggtcaagattaacgccccatctcgatacaagtgcccttttgggtacagtgagactgtacgagaatgaaggacgttgctgcgtcgagtgctagctgctgtacaaatacagcataattaagcatgagtccaatagctcaacgacaaggtgccaacaaatgacgactctataggtaacgggttaataataaaagaggcaaaaaaaaaaaagaagtaaagaaccacttgtacctttcacctacgaaacagggtacagtgctacgtagacgcaacgaccgggttaattgtgtccactaacccaaagcgcagggcttaattgaaaaggagatggagaagggttggtaatcgagtggtgagaaagatactgaagatttgacagcgatttttgtgtcctgtgttgtgttgtgttgcgtccgtatgtatttgcgacgtctgatccgatgtactcttcaggcttccagatcgataagatgtgttaacataagcaggtaatcctactccccattgccgcaaccacaagttgcgtccttgattctgagagagctaaagctaattgggtaatctgcattgtttggtgtgatgatgcgttgcatttttcaaatgttattgtaaactatttgtttggaaagacttgtttaaggtgtactcccctgttccatttttaacgcaaccatgagttttcgtttccaactttgatcttccgtcttatttgatttttattttatttttttatgattagtttttttatttttattagatgataaaatattaatattattttatgcgcgacttacattttttattttttttaaataagatggacaattaaagttggacatgtaaactcatgattgtatttaaaataggaaggagggattacgtcgaaggccctgtttgattcagtctatgattattataatctgtattattaggagtaagctaaaataaataagtagattattaagatagattattataatctataagccagattagtataatctaataatctataagacccactgcccttatatacctccaatataagagcatatattggagaaacaaacaactcgcagcttagactgaaataaacaaggcctaagtaccaatagttgttcaaactgtgaccgcgtacatcctttaaggtataaaggctggatttttaatccattttctaaaataaactatttgcttggaattcctatgttctaaaccgaattcgaattaattcgaacttcggctggcggaatcgcgtttcacgtactgctacacgtttttacgttggaaagagagagaaacgtactacacgtttctgaattccaatgcttattaaaaaggtagtaggaatcatcaaagtgatcaaaccaatacaaaatccacgatatatacataagtattagtattacccacatacaaaaaaaatctgcataaagattttctgctactacaaatctgtcacacttcagttctaccacaaggcaatccgaagtcacaccatgacttgacaaaaatatatataattaaggaattaattaagcaaacgatcagcgagaaagaacgctacaatacgttagaacgggtggtagctccggcggaacgcgccggcgttggcgaacaagccgacgagatcctgcttgtacgggaggaacgacggcctccggccaccgccattgccgcctccactcgcgtaatatctccagccgccgccacggccaccggcatcgccgcgcgacgtcgtggtcgtcctccccttactacggacgtcggagcccgagctcaagaacacgaacttctccttcccgtcgctgtggctccgcccgatgagccgctgccgccaccggaggaccgacccggtcgagccgctcttctggcacctcgccggagagttagaaaccgccggcgcgggtgatccgggcgaccacaggcagtacgtctccgccggcacgccgtcaagaacgccatcctcgtcggcctgctcccccgacggcggcgccgacgccctctcctccagcagaagctgccccagcggcacccgcacggtggccgtgtcaggctcctccacctcctgcaccggcggcggcgaccgcgggcggccgaagaccgggtacacgacagcgccgatgcggccgcctccaaccacacacgtgacagccgccgccgccgcgaaggtgaagtcctcctcgtcagactctaggacgtcgtcgtggacgacggcggcggcggcggcggcggcagcgacgccacggtcgccgtccgcctccgccatggcgtggctggtggtggtggagtttttctgtggcgcgagctgcgctgcgctgtggccaacggggcggcggaactaaagggaggcgggagatgcgcgcgtgaggtgggccacgggcggttgcgcgtcgcgagcaacaagtgacggccggtacggcccataatctaaccgacaggtgggccccaccaatctcccgccagtgatgagaggggggagctggttggtcggttggtgcgtgggcccatgagggccacggtgggccacgcgacacgtggcggacgatgcttgagttgagttgccatttgggagaggaaaagaaaagaaaaggctggcatgcaatggaagggaaatagaatgcaagctggacagcaaagaatcctagtggaatggaacggaatggattggatccatgtgcttttctcatcgttttctagtgtctcttacaagcctttttttaaaaaaaaattattgttgtctatctattctacttgttgcttccttgagctccaaatggatcacctaccaccgagatcagaagacgttgttgggttagatctagaagcaaaagatgaaactgaaagggaaacaacacaaaaggaaagaaaaaaattagcagctctggggttccgtttagcttgtcctaggatcgatgcttgtgatgtttgatctgtatggcgtgtgattgacggcatggcgcccgggtaatctgctccgttctaagtaaagtatgtttcactcaagatgcacgccatggtaacagcaaaaaatcaaaggcagcacatgtaaatgtactgtgcagtacatacgctactcaaccaacatactgtgagcccgtgaattcacaaaagagtcgaacggctctgcagggttttctttccgtaaaataaaaggcattttttcctcggaggaaataaagggccgttttgatttgataccaaaaacataccctaccaatttattggcaaattgaatagtatgcgtgttattttggattgaagccaaatatttggtagtacccttatactatttggtcattttctagaaatttcttcactatactataagaatttgactttatatcggtagcaatccaaatggtagccaaataattttaccctaccaatattttggtagtgccaaagtttgcctagactttggcactaccaataaattggtacggtagagaaccaaacaagcacaaactctttattttttaggggtttaatgggccaagatgttctctctggtgcttgagctgactcttattcatatctacttttgtagataaaataaatttaatttgactcactgaaatataggtctaatttaattcgtatctctcatcagcaaaccatgtggcataccatcagatgtttgacgttggtttgattaggtcaacgaaccacgtcaatggaattcgccttcaaaacttttgagggagtcattttacacttgttttaatagtcgatatgctagtatgtattccttttgctattaagagatacgaacatgatcagacctacattgagggattaatattagactttctccttttttttaacgttcgcctacgcgacaaaagtttgatggatccagtcgtcggcctagtagaacgggcccatcagttgcacgggctacagtaagtgccagatacgagagggcccatgagtacttcggaaactgcttccgttgggaaccttttttacattgagattcgtgcgcgcgaaaggctgcagcacacgctttccagagccacacgcgcgcgcgaggcgcgcacacacgcacgcacagcgcacacggccacacgggcgcgcgtgtgcaccccgacaaattcaatcgtacacgaaaacagctggagaaaacatcaaaccgaatagtggtgcaacctttgcacgtactacgttgacccgttcccgcgccttgcgccgccggggcgcgcgtcgcgtggacttgatccgatccggcgccggcgcggcgaggcgtggcgcgcgcgcttctcacggggttttccccgagatggacacgcggccaaagccccagtgacccatctggtacatctcctccagccacgccaggtcctcgtcggtcggggcacccgcgccggcggtggcagcggcggcggacgcggtgtcgtcgtcgttggcgacgatgtcggcggcttctagctcttcttctggcttcgcgatcgccttcttctcgccggcggcggccgccgacgtggcggcgacgtcgcggacgcgcttgttgtgcagcagcgtccgcctccggctcctgaggcggccgacgcagcggcggccgacggcgagcggggccttgacgagcgctaggctcagcatgctgaccagcgcgcacgggcagcaacccagcgcgatgcagtccgcgagcatcaccgccgcgcacgaccggcacctgcaccccacaccgccgccgccgcccgccgtcgtgggcccctcctccccgtcgccgtcgccgtcgcgccaccgccgtggccgctgcagctgcatggccctgctcatagttgaacaatgcgcgattcgcgtcagtgagcgagcgagtgagctagtagctgtagtggcacacacactgaactcgccggcgatctcgagaggatgcaggaaatgatcgcgacgtgacacggcgagctttgctgctagcgttttgtaggtagggttcgggtgcgagctgagtagttacgacgtcgcagtagtaacgcatgcgctgcatccgtcagaccgggaggcaggtaaagcgttgttactgtcagcaaacgagcagctagctagcagcacagtcgcatcgcaaagccggaaacagcaacggttataaatgcatgccactgccacgagaggagaagagatgtttctcagttttggccatctcctcctctccactgaagcaaagccgaagctgaatttaaccctctcagccagagacgcagcagcagcagaagcagtaactttgaattcagaaggtgagagagagagagagagagagaggccatgccattgccattgccattgtcacactgatctcttttacttggagagaggacatggtagctacagtgctcgaaaactgcaaggttggggcgcttttggtcgcggctacgccttttgggaagggaggggacaggggttgggtacccgtgagttgaaggccgtgcagtgcagggcgccatttctgagcaaagtggctgtgcgttttgatctagccactgtgccaacacgtcagtattcacaggctctagtacagctgggaactgtagctgccaacatctctcgatccgctgtctgattccccttgttgttccaggacccagcaatactacttcacatgcatccatgcattagtactgacgtgagagttcattcagagtgagagaaagagagttgtttgtgactgtgtgagtatgggggggcctgagtgagttgatcatcagattcagagattgcagggggctttgggacaagtacgttgatcagatgctggacaaggacaaatgcaactgtgcaagcaatgacttttttctgcatgtcattattggatcaatgataaaacaagatgcatggttgtctggaaaaatggctggaggaggaagatctgtgtacgcgtgctgcatccgagagggggcatcagtgcatctgtgcatgtgtggaacatgtcgggagtggaccgaatctgatggttctgaacttctgatctctgctcggcgtgcacattgcatttatcaattcctagaatattttgaccggaaaatcttgtgtatataagctcagaaaataatgcgtatgtaagcaaaaactgatcaaagattatatggaaaatggaaatattgagatagtttattcacatgaaaaaatatctttgagtgtgttgtagtagcatatatggccaagctaagggggaatcgatcgataattaatcaactagtgcattgaccaaaaatattttcgttgtgagaagttagctaggcttatggtcactccacaccttaattaaaaagaacatattaggcctatacgatgtcctacctgtttcagaggtttttcagagttgtaattactattgctgatcaaaatatgagagtgctagctaccaatcgttacaaaagctaatatgtagtagcagataaaatctacgagcagtacatggcaatcaagttaggaaggggctatactgtatatctgtctgtccgttgatcacaattcacacatgtcgaggtacatgggcaaaaagctagctagtagcacctagcaattcctgcatttctgcccatacactgcaagtgatcatgtcatgcttttcggatcgtagcggccggaaaggtaagaaaatcacaggcttaaagaagcatatatcttgttcgaaattcagtgagtgagatcgtagattcaggctttcagcaccattagctgcagacgcccagatggcagctcatgcatgtaatacattgtcgccacattcactgaatttgatggtttgatcacatttccaatcaaacgccttaaatcgagtggaacagaaagagatagagatgatcgaggaagagtagattggtgtacttacttggagcgggagatcattgtaactgcagtttcctgatccatggacgtcgttgctgccgtgccgtcagagaatggaagaacccaacaccaccgaaagcttcagcttcgacgatccgtgtaggtgttgctcagccggaagcggagacgacgcctccgccattcaagatcgcaacgggaagaagagcccgaattcagcggagagaataagagttcttttttttttcttttttacaacggctcatcggaaaaacaggggaggattaatagttgtttcatgctgtgcaaatgcatgcatggtgttgcttggagtcaggaatatctcagagaaaaatatctctctgatgtactaagcttccactaggtttgatttgatgattgttttctaatcggtgcaggtaaacagagattagtatactgaatttgccttgctgctgccgaccagatcggtcagatccagatccaggtgtggcgctgtcagatgtgagcaatgctctgcagcatcccagttcatgtgcattgttgcctcagacatgcataggataaggtaatttgcgtccctatctagttaattacactagaccgtgcgaataatctgctgctctgctgtctttgacctcgatgactctgacaatgatgagcaggtgctaaccttctgaagccacacaagaaccatactctctgtcctgcttgctggcctcttcctctgttgatctgttcttgcatttttcaccattttttttggcaaaattattaacctgatgtatgctaaggatttgtgtatttcgtgttgcgttgaaattggaaaagtggaacattttctgcaggacttgctttcgcagtcgtcaaatttttgccttccgtggagttcaaacttgttcagacatggtatattttgcaacgaatatgtgatttcaccagcagaacatcttatcaaattagaacctgattcatgtcttattcacaatctaatcacct

SEQ ID NO: 26800 - DNA, 51556 bp, Oryza sativa
gtcgcatgcaactccacggcggcttcttcccccaaggtgctcgagctcggggacgccatcgcggggctcaccctgaggaggccaggggcctcgtggaccacctccaggagcgcctcggcgtgtccgcggccgcgttcgcgcccgccgcggtcgtcgcggcgcccggctccgcgggcggcggcgaggacggcgcgcccgccgagaagacggagttcgacgtggtgatcgaggaggtgccgagcagcgcgcgcatcgcgaccatcaaggtggtgcgcgcgctgacgaacctggcgctcaaggaggccaaggacctcatcgagggtctccccaagaaggccaaggaggccgtgagcaaggaggaggccgaggaggccaagaagcagctctaggaggtcggcgccaaggtgtcaatcgcctgacctccctgacgaacacacgcactaggctactaggacacccaaatcttgctcaattttttgtgttgcattacacctcgagacattttgtatcatcgttgtttcgctgcaagaattgaataactggatttgccaaatcatacattccggtttatacatttcctttgaagaattgatgtgcatatacagatactttgctaactagcatggtggcccgcgcagattgcgtggctagcatcattatattttgtcacataataacatatatgttttctcaatgtattattgaaatatattaaaatgacaacataattttaaattttgtactacctttacgaaactactaatgtatagtattcatattgtattttatatacgtgttagttattaattatttttaatatcaaattttagttatttgtaaattatattcctatatagactctaggctcttcttctaatattatttatttttaattctaaaattttattatttttaattgtatttctatatggactctaaactcatatttcaatattctttaatttataatttcgaattttagttacttctaaattgcattcttatattgactttatactcttcttccttttttttaatttcgaattttagttatttgtaaattgtatttttatacgaactctaaactctacttttaattttattatgtttattctgaattttagttagttttaaattcttatatggactctatactctaattctaatattccttatttttaattccgaatttctattatttcttaattgtatttctatatggactctatactctacttataatattccttatttttaattctgaatttctattatttcttaattgtatttctatatagactccagtttcctcttctaatattccttatttttgaattccgaatttcaactatttgtaaattgtatttctatatgtactctagtcttatcttctaatatttcttattttttaattccgaatttcaactatttctaaattgtatttctatatggactctatttttctttttctccgattaatgtgggaatttttaagccgtgagagcgaatgtgaaggctattttttctatttctttgataagttaatagatagatttgctatggcctacatgatcgaacacaatcacccatgatccattcagcaattgccgtggagagactgcaccgtgggccacaaatcctcgagggcccagaagttgtcgctcgacgctgccaagaactcgtcggagacgacgacgtcaccagcggcggcggcagcagcaccgccatcttgtcctccatggattgagctcgcgtagcctggctgcagctggtccaagtagctaccactactcatgccgctcggcggcggcgcctcagtggcgtactcctgcgtgacggcgacggtggcggtggtggtccggccggagacgctgctgctgccttggtcctcggccaccgtgttctggtgcactgtagccgcaggcatgatgctttcgctcgtcgtcgtcgcgtaaattccgtcagtgcttttcctgtgcttcttctgtatcttggtcctccagaagttcttgacctcgttgtcggtccggccaggaaggtaccttgcaatcttggaccacctgaagaatccaagtgatcaatctatcgatgatcccttccaaaattttgtcagccagtactaaatgagacatactaatactataattttggatatatatatacgtagattcgtaatattagcatgtgtcgttagggttcacaattccaacgaaaaccggtcgaatttcgcgaaatttcgaggtttcgacgaggctccaaaatagaagatgtctgagattttgatgagtttcatccaaattcaaatttgaattgataaaaaaggaaaaaaaaattaaataaaatcttataaatagtatgatatttataaaataaaaaaaagatgtattccatgtatttactgaaatttacagtacgaaagaaaagaataacaaattaaaaaaagaaaaacaatctcagtttacctctttttctagttactgatgaaatttcgatgattttgctcggaatttaacaaatctgaccggttttcgcgagcttatcggtaaactcagggaagttgtatttaaagtttggtttacgaaatttgttcggaatctaccggctttgtaccggatttcgtgaaaaccgtcattccgccagagcccgaaacggaagaccatctcggaatcataaatgctgtatgtcatagcaatattttgcgatggaggcgatcgagttaatgtgcgttacctgttgccccatctggcctgtagctcgacgatgagcgtgtgctcctccggcgtgatgttgccgcgccgcacgtcgggtcgcaggtagttcagccaccgcagccggcagctcttcccggtacggttaagccctgcagcttgatggcgtgaagatatatatatatatatagagagagagagattttctactatgcttggtatatattagagctaagatagaaggtacagatgcaaaggtacttaagagtgtgggccaggtataaaagctagaaggttataatggtaattgtcttttatcatcactaatggttaaggaccaatcagttgacaaggagcatatggatgccatgccacagccactgtaccggcggcgcgggcgagggtgttccacgcgccctcgccgttggcggcgatgtagttgacgaggctgaggtcctcctccatcgtccagggccccttgcgcaccgccgcctccaccgtttgcacgccgccgccgccgctcccttccaccgtatactgcatggctaccggcggctcaacgacgtacggacgatggcggcggcgtacacacctcgccgcgcgacggccacgcttatatactgcactgtacaagaagaacagcatgcgcgcgcgggggaggctggcacgacgtgacgcgaggtggctgatgatgatgatacgatggatggatagcaacttcggcacgcctaactcggaaagccgctcgccgggagcccccgaaacggctgcaggggttggcgtgtcgcatcaaacgggcgctcgatcgtctcgtttggccttgcactgcctttaacttcttcggcaactgatcgtatcatagttacgtgcaattgccattggtttggatctatgtaccttttcctctccattggttatttcgcacgtgcgaattccatggaaatgtttacgtggagctaggttggatctccacgtcaaagttcagtctcaatctgtcaatcatgctctgactaggtagctgattaatttttagcagggagatgaagctgaatttgctagttaggggagattttattatttaccgtccttccaaaaagacagtttcaagtgtcacttttctaaactttcattccctaccacttgtgcccgccgcgagggttgaggactgttacgaacctctgtagttgtaacaaggacctacaacaaggacctccacgacaactggtgtgccctgtctcgttggaccactggttgctcatgctctttaactgtcctcactcactgctcgtctttgatgctatggaccgttcctggaacctctaccacgctcgcaccatgcgtgggggccgtgtgctggtggcttcctcaggtggtctcatcctctactactcgtcggccatgggcaattttgccgttgccatcctgctcatcagtgcggctgaccgtagtgactgcaatagtgtggcctattcttaagccgctccttgtaggtgatccctagggtattttggtctttttatgagggcatccacgggccaataaaaaaaccagccacgtagttaggaattgggcaaagagtgacacacgagagagaattagtgaagatcgggtagtaaattacaacagaaatttaggagagtgatatttaaaaactgattgttggaggatgtcaaatagtaaattcccctgctagttagtagtacatcgtggtattaccaatcgcgtgaaagattagctcaagacacatcagagacaaatcgtactaaggaacaacactacgaattaattgtggaacggtgtgtgtaagcaggcaactaactacatactccctccgtcccataaaaaaccaatctagtaccggatatgacacatcctagtactatgaatctagacatacatatgtcttcgtagtactataatatgtcatattcggttctagattcgtttttttatgaacagagaccaacctagtaccggatatgacacatcctagtattatgaatctgaacatacatatgtccagattcgtagtactataatatatcacatctgatcttagattcattttttatgggacggatggagtataggcaaagatatatggttgctattccttaaactattgttgcttggataagcagcttgcaggcttgaaggttgcaatggatcttaagcttttgcgtggtgcatgagagtgagggtactcgtgtttaattctgcaagtatcttatcgagtgaacccgagttaatgaaaaccgtgtactctagtgcccaacttccatagctacaaacaagaccacgttcctgaatcctgaagagcgtaacgtctgtaccaaactgtttcatttccagctgctagctgaagtgcaaatgcaccactactgctggaagccacatttgccaaacccattagctttctgctggtaaccgtaagcagcccaaagtccacagattacgccacatgtttcatgcctctgtgaaatggactatcgacgtctatatgcgtttcaatcataaaagagccccgataaaagaaacaggacagggttgcacaacaggcagcagccttgagcccttgactatgttctaacatatactccatccgtttcacaatgtaagactttttagcattatccatatttatatagatattaatgaatctaaacacatatatgtgtaaaatcaaaggtgtttttgattattattctgtgatgaacaattgacatatgtgattattggttttcatatttgaagattattgacgaagtggttttggagatgattggatttacaggtgttaaacatgtattgctggatttggtccgatcagaccgggcatgggttgccggtcagaccggcggttatcgagcggtcagaccggccagctcgcggtttgatcggccgaccctgtgttggttttggtttcgggttgtttgtttggatatccgtgattgttttatgtttatgttttctagaaggatactatgtgtatgtaatactgttgtttgctactaatgagtcaagttggagatagattggtcttggaatatggtttctttatttgcttcatgtgtaggtgactcgatgtctcgggagagtattgccggtgatggatcgggagttgacttggggataaggcgatgtccgtgacggtcagatatcatgcgggatgcttaggctagagttcaatgtacgtggttggtgaagattccatatggcatacgatggaggtattgtgtgcacatgggatacggagttgaatttggaaggagtccaaatttgttatgattggagtttgtaaagtttgtttctggtacgagaaggtttcctaggtggattaggacttctagtatgagtttggttcgtggctttaggctgcctacctcgtgtataaatagagagggagtgtgaggcttcccggtatcacttttgagagcatttagttagggtttcgaatttagtcgagattttggtgagtagtctgttgttgcactttgtaaacacatataagagtaataaagtgttatctactttaagatttcttcgatttgtgttttctcgggtgcggcggtccaaccggcgagacatctacttcgagagttcttcgatttgtgttttctcgggtgcggcggcccaaccagcgagacatcggtggttagactggcagcatcgcggtagttagaccgacggagtacctgctgtcagaccggcaacgattacagacggcaggagctgatctcggcggttcgaccggtgttactatctcagtcaaacgacgacttccaggcggtcaaactggttaccgtgatccgtcgaatttaagggtaacttttgattccgcaaaaactttgggtttttgggtataccaaccattcatccccctctggttggtttagttctttgtgtttcgatcctacaatatacgtagagattcattaccatatatatgaatgtgtgtattgctagaaagttttacattgtgaaacggacgaagtactacaatactagggtactgtatcatttacaggttggttaaacgccttttctacattagactcaccagtatcaagcacttttcatgtacagaacttgggtacaaacgacactggcaagttttgcataccttcgtgtacaccttcgacaacatgtggtgtactatagctggacgaaccgctgccaggggcaggctttgcctaatacaaactataacgttgcatgcgtttatttccgtggcaatataaacatcatcacacattttatgatactagtacatgctatgctactggactatcccctgttctctctttaggatgtctactcgttccccttatccaactttgccttcttcgcttcataatccttcacggcggccttgattgcatcctctgcaagcatgctgcagtggagctttacaggcggaagcgatagatgcttcgctatctcactgaaaacaggacatgataagtcaatagaactccaatgagcacaataaagcttgtgcccaagcaatgctagccacaggcggaagacaataggattgtaagtgaaactcacaataatatggtaaaggatgtttcctaaaaatgagggatgagcctacgatccctgagatgtactacctctggttatatgtatgacatcgttgacttttttaaattcatttcgaacttcatatgttctataaatatttgtgcaaatagacatttatattaatagtatcatacatttacaaaatgcagaaagtaataattctctattataaaaaaaatttggtacctcctaataccaaggcacaatggagcaagctgacataaaagagagaacttgtaacatcaaatagatgactttatttagttaatagataactaagcattcgggaatttcacgggatttagaagacctaagttttccacctccattcttcttttggattagatgccttatcttgcatctaaccattcacagatatgagatgaacaccaatgtgggcctactgcctactgcaggcctggacaacacactttggggtgggttttgcagaagataaagtggttcagcttgctgttaaaacttctctcttttatatcagtttgctctattgttttctccttcttctccaatcagtattgaggtactaaattttacactagataaaatttgcagtcctgaagtattactatgaagttccgacaattaacattcagatgcagggtacagctgcgcaagaggtaaaaataaatgtagatgtgctggtgcactaccagaaaaaccggtcgttgtcccaggcatgcaattggaaaccattaaaactccaagcaaactatagtaaaaaagacaggctaaaacttaaggatacatgaatttaacatttgccctggtattttcaatgaatttgcagactcaatggacatggtagtcactaccatgagtcagccaatgcttccaagaaaaatcagcaatcaggcattgtgctcaaatctataaaagcaaatagatatcatcaagcaaataagaacagaaaatatcctatgactaccaatgctgcaaaaaaaatcaagcccatatcctgaagcccataccaccgagccatctagaggacactctagtgtatctcacaagaaactaatgaatcttattgctgagaactaacatagaaaacaacctttattgctgagaactaacatataatgaaaagactacatcaacaagaaaacaaagaccccacaaaaaaaaggactagatcagcaagtacagcagttatttacctgttcttgattgaagctgcatcctccatttgttttcccttcacccactcactggctgaaattaaaactatattagagagacaaactttttaacctcaattgtaatatagtaataatgatattaggaaaagccatgcatgatagtaagaattgtatctatgcagtctagagagagccagccaatagccatttcaactttataacttcataagcacgcatattatatctaaaagagacttctaaacccaaaaaaaattgtatctcaagtatgtttaactgattgacactccatgcaaaattaactttttcggcttcttaaacattgaagtcaatatatttttggtgcaccctaaatgcatatcaagtgtgtcaaatgttattgtgaccgcaatgacagctagattggctacataatggcaacatgttaggagacaagtccaacatgttagggagacagcaattaattggatacataacggcacgtcctcatgttattacctaaaagacacttgcaaacaattaaaaggtcaacagagttcaattgctaaatgcgaatttatggaataatgtacagatatttgcagttttcaacataagagtgcttatcactatctcaaatcttaacatagtaagcaagagcagtcactgaatcagttggttgatcaacctcaaaacaacttgtgagtgattcagtgactgctctcctaacatgttggccttgtctcctaacataagacataggatccacaaagtaatctggatactagccgtggaaatgggaatttctgtgttaggatatatgatatctacaaatatacaatgcccacacgatatatctataccctataaaaactaatatgaacacattaaggcaacagcgtagaatattagaaccaatagcatcacaaaaaagtaagtcaaactcaatttcagccatctactataattctcagattcacaatattgcaatgctcaggtaggcatattcgtaattttgaactagcggggacggcactattcaatactaagggctttgcaataatagaatttgattgaaatggaaccaaaacctacaataacttccctattttacaaatttcatcgccacattcaagtgcgacatcagtcacttccatcattcgtacaattacccaccagattttcacaagcacaccgatactggggatctaggtttactcaccgacggaggaggaggcgatggcggagccgcacccgaaggtcttgaagcaggcgtccacgatcctaccggactcctcgtcgacgcggatctgcagcttcatgacgtcgccgcacgccggcgcgccgacgagtcccgtgcccacgtcggggtcgtccttgtcgaacgtccccacgttccgcgggttgtcgtagtggtccaccacccgctcgtggtaccccctcctcctcacaacggccaccgccgaagccgccgccgccgccgccgcctctccagcgccgccgcccgccgggcgcagcccaacgccgaggagacgcttccccgccgcgcgcagcatcgtcgccgacgaattctcgccttgatcgggatggaggggtcgaggcgtctctggatttctctcctctctctgcttctcgccacgaacgcgtgtgctccgctaaatatggcgaagatatggagtggcttcgtgggcctcgggagaagcgacacgtggagcccacgtgggtgggcgggcttactccgcgggggagaatggcggttcggttcagcgtgcgagagatatgggccttgtagtattgggccgtgattttcttgacagatatttgggcctgggcctcctcactttcgaggtcatcagatcagggctatatgctgcttgcctgcttcttctacacgtccatgtccaagtgtacacgtgctctgtcactctcgacttcatctcgtagtcaccctgtccatttcattttctagagcacgtaactgtcacgaatttcttgtggcaatcggttcgagaaaaaaaaaacagccgttttctttattctgttcatatcccctgtccgtctgcatcgaaactagaaaaattgcccggtacttcatcgatattgagtgagtgcaaacttgaaattgaatggatgaatattgaggtactattccctgagaaaagaaaggggggaaaataggcaagaaattccaccggatggctcttgtactgaatctaatctcaatgtcaaacaacccgcgttacaacagcgacaccgagctagcttagatcccgttcttctcggctgcttcttcacattattgttatagtttatttgatccattcttctcaaaaatgttttcttaaaaaaagagtaaattatatttgcggtgcaacaaggcaggagggtgtaatttagcgcaaaaactttctaattaccgtacgagtgtaacaacttgtgaggacggtttcattttagtccaataagttaagaagtgatatgacaatttaattattttgagcatttgatatacatatttaattttttagtacttattttgttactatacttgtacggatttgcataaacatatttagtttttttattgtaataattgaaagtcaattaatctttactatgtagaaaatattatacttcaattgagatttcagaaggtgaataaaaaaatcaaaccggtgatgcgaattggatgtgccatgtaaattttaaatattaaatttaagattaggtaatatccatagaattgctaagattaggcaatatctatagaattgctatatgatgttatattaatatcatgaaaataactcgcctagtacttgttaaccaaaatagcacgtacttacataagttgttgccccagaatatttcttgcactatataatacactcatttatcaagttgttgcacttagacatttattgctctcaagttgttgcactgtgggtgtaatttacttaaaaaatctactgattggttaaactttttttctaacctgttttgttaacttattttttaaaatatttaatttatctttataatcaagtagatagcccatgataataattcactcagaaatctatttctactatatggttcttgtactatctgcacgaatttatattagcatcagaccgagaaaaaacagtggtttgcttgcatcaattcgtaccctctgttcgtatacatccaactagaaatcgcccggcacttcgctggtacttaagtgttgaaatcttgaaattccccattaaaaaaatggaaattgaggttagaaactccactatatggttgttgtattaaatctaatctgaatgtcaaacaattgacgttacaacagcgtcaccaagctggtattaagtgttgaaattcttgttggatggatgacaattgaggtgccattccctgcgggagaaaaggaaaattgaggttagaacgatggttcttggactaaatcagtaaatctattctaaatgtcaaacgatgcacgttacaacagcatcatcgagctagcttaattcaaccatgttttcatggctacagtaaccagttacacacgctttcgttatctgcttgttggcttagacacagctaaaatttaaatttagagttgattttatgaaatattatggtctatgtttcagatttaacttttaaacaacaaattttattgccttatttatctgatataaaagattatgcatgattttttattgtcttttcacatttctttggatatcaaccttagctcaacccaccagctacggacgcaagacaggaacgagttatggctgctaaactctgctcatgaaagttcttaggaaagcttgtccatctggtcaaagtgcagagtctagattaagataattaatgatacgtacatccgtgacctcttgacctttctgctctctatcgtcagcaaataaccaatccatccaggacaagaattatataacttgacattgctgtcttccagaggccttgggtatacagatgttgttcaacaaaaaaaatagtacatggttagctatttttaagctaaccttacaatgtttaacgatttgtcaaatcagtgaatcagatatgattacacatcccatccacacttacgtctgacgttgcaaatatttctgtgttgattaattgttgcgatttttggcctaatcgttgatttggcatgccccatgcaccatgctagctgcgaggttaacttacattaaccgtttctagaggttttggtggaacgtcaacttcagaatcgatccatcgccatgtccatttcagaagccttgcacttactatcttactgattggatgctgccataacaagtaaaagattactatcgtgttctgatattggagaaaggatgtggacgacgctatgcaaggttgccaactgatgttgtttcaaaacataagcccagtttagttcgaaactatttcttcaaacttctaacttttctatcacattaaaacttttctacacacacaaactttcaactttttcgtcacatcgttccaatttcaaacaaactttcaattttgatgtgaactaaacacagccagattctagatgaccgggctcacttctggactgaacattcttctatctgaagatttgaccaaagtagagtgcttgaactttctcgttggagttgctgcaacaacttttttctggggtaccagagccatcgtcgatatatttgcaaacaaaaagtaatttgtgaataaaacttttattatatgtgttcttagcaatctaaaagcgaagactgaaaaataaacttcgatgagaaaacttcaaaatcggctccaaatttaagtttgaaaattcaaattgctatgtgtgatagcactactataccaaacaattttgctatgctcatctctgttatttcagtgaagattatgatatctctcaaacatccatgcaagtaaacctttttgtttaaggctccagatgtaggtgatatatttaactgaagattgcatgaccttctgcccttccatttttttatgtgtccaagaggaacagctcatgttacaagttgcatcttacacctaaagttactttattttagagggcaatggcatgtagcgtctgcaaggtgagttgccatgcctttgcaagatcgatgaggcattgtctccaagaagtaggcctgaatctttttgcacatgcctggatgcctgatgctggtggtaacagggggacatttccaagaccatgcactagaaaaagtcccaaatagttagggaaaaactgtctaaatattatcttgctctttcaaaagttgccttgtctattcaatttatctgtgcatctctttgttgtatagcaactggagtgagaagatggtcagatagtgggtccaaaagtcactcgtacaatgatgaaagcttacagccatacagtgttttctgatgcttcttcagttttgagtattttcttcagtttgcagcatcattgagtttacagtgcttgtcctgcttgtttctgttacaaaaaggaggtgttttctgaaaggcctgaaacagtaaaagggtgcgtagctttttgacaggtttgcattatatcctcttttcacatgccacctggaaaacatgttgtaccagtaaattgccattgcattctaaaccaaattgcattatggcaaattaatctgattgtctcacatggtcccaagctggtctagcaaatcatctgaatttgccaggccggaatttttgtgtcatgaacatggtctctcggattgctatctccagattcagtacagtctgtcaaagctaccaactgctcaccagtcagcttcctccaccactgcagtcacagacatgccgtacttgcctgtaattgagaatgtaatgactatatcctgtgttgctcaatggtcctcactcctcacctattggttatacctaactttactaccgtactactccctccgctttttaatagtatactctacttcctcagtttcacaaaaaattcgagattcattattagaattttattttttgtgaaacagggagagtacgacataggttgctttttaattcatttgaatatttctgtttttagaaatatttctgcaaatagataagcaaatggatatgcttaaagtaattttgatgaaagttctgacggtactattttcgtttctcttaaaaaatgatgtttaaagtttgagacaagaaaaggttaagtgtgttgtatattaaaaaacggaggtataaatagctagctagttgacttcttcatgctaaacaatcaatttcgaaacttggatgggttttggttggtcaccacatatgcaattttcgtttcgcagacctaaccttaattttgttgcctccaaactgctagccaaatcttagcaaaattcagagatgcactccaggtattcggttagctttagatatcacaacaaaaaaagaagtacagtggcgactggcgatgatgaacctatcagttcatccatcaaagctgaactcaaagagacaaggacagcatcatcaaagagcaagatacatactaacgaatcaccgctgttcaattgatcccttcatcaatgtgattagattcaagaacattccaatacactgttgttctctgaaagtattaactaacctgttgttctctgatggaattggacgctggagcaggtaggatgtctgatcttgcatggcatgatcacagcaattctctcagtacctgtcaacttctcactgtgctgccgtgagatcattaatgctaagttggtcacgtccctttctgtaccaagaagaagaggggatgaattgaattcgctgtctttctcttgctttctctgattcgaagaagatgcatgattgtttatgtgaaagtttggtccagttggttaatggatgttccagtggttaatccacttttgctgtctctgtgatcagatcaacaaactgccacaaaaattcaggactcttttacaatctctcagatgactttggatggatagacaagttcagtgactacgtatttgcaggttgcagctacttaaccaaatctcaccaactcgctctcccggctgctcgtctggttgccgatttggctcggaaatttcctgaaaagagcagcatcgtctgatgaaattttatgggtttcttttgggagttctaaattctgagtagcagatagtgaaaatctaattgatgagaatctaaacaaactgagaaaaccatcttctaatttattttatataaattttattacacctacataatatgaaaaaaaaaagctgaaccatactacgagggtagtagaatgaactattggagtaggaagtcctatttaaaagagttttaaaaaattagagaagctacggagtacaacggaattaaaaaaactctcaaacaaacctcatgtcacactttactcatccctctagaaagatcggacgtgcatggccatggaaaacttcgcgatttcttcctttcgttttgtcgagtcgtcgcaaagtcggaattttcttggcagtggccaccgctagctaacttgcaaagtcgtctacacatcaaacaggacgcttggacaggtgcagcgactttgtcttctcctcgaaatttttttctcctcaaaacattattttgcacaaaaaagatcgtcttctccttcaaacttccaaattcccgatgccaaccatgcgtcaatggccagattaatcatgtgttgagagagtgcagactgcagccaacccagcaggtaagtttgttgagcaaatttcatcaaactaatagcaaacgtcctttttttttctttggggagttgacaatgtcacctactattcctacttcggaatttttgcaggcatacaaaataaaccaatgggggtgagtcatgagcaatgttataggtctaggcttaccacatttgtattcataatcttttttacaaaatttcacccgcaactatggtcttgttcagtaacaatgcattgtaagatcagtgctatacattttctttactgtgtaatatagctgctgcatcatcttttttcttatacttatacttatcaaccaaaatttgaatttgttgattttgagggtttttcattgaagtttatttttcaggctttacttttatattgcaaagaacatgtgtataaaagttttattcacaaattatttttgtttgcaaagataccgttttgcttattccgtgaataagcgaaacggcttccttaagtagttagctctgtcttttttattattttattattattttttgtttttgtggtatctaaagactcttaagactctgttgctacctctatattctagtctcatttctattaatgaaaatgaagggctcagactctcgctcagaccctttgataaggaaaaaatgtctatgggcatgttcggctgcactcttttagtgttgttcgtatcatgcagccaaacaaaccctattggcttgtttggcaacttgagggaaggggattggaagtttacacgagggaattgatggtgagattaagatgtgaatttgattttttatcccagtctcttatttggtagaggtggtggaaattgatagggagtttagttggagattagatcattaatgaaaacggatggctgagatttgtttaggcaaagtaaaggagaaattctctcctaattagctgcccctacccaggtattgaaaaggagggagtttatttctcaattccatatctccatcccactaaaattcccatgtcccacaaccaaacaaaatagttaatagcctcatccctctaaacttccaatccattttaaaaactccctccaaccaaacaggtcatatttggatagtatatgttggtacgtttgttcaactactattttcagctggaattctttttttccccctttgcaaggatgagtacgacaatggcacacgggtgcaacaggaggggtacgtaaattcacaccgtgggtgtgttttcaagttaaaattgaaagtttggttaaaattggaacgatgtgacgaaaaaattgaaagtttatgtataggaaaattttgatgtgatgaaaaagttaatagtttaaagaaaaattttggagctaaactccgcccatatatctccctcttcgtgaccgcgcaacgtcgccgctgtcgcgatcaactgctcatcacatcttctcatcgcacgacgcggccggccgctttttcctctgatctgttcatccgtcactcactcacttgggagaatctccgccgtccactggaccggcgacgaaccagccggagccgtccgctggatccgatggccgacaaaaccgcaggtgcgacgagaagacgcgcgtgggggcccacgtgtcggctacacgctgcgtctcgtggctgtactggcatgtggggccacagcctgggaaccggatgcctagcctagggctttcctttctctctgactcttttgagagtttttgccctttttttttcttttctttttttttttcactctggtcatgcctttcttttcagccacgccctggtgagaacagagatttctgtttgggcatctcgtcctgtctgcaaaattttgagcctgtttcttttggtttcttttgaaaggaatctgaactgactgttttaagatgaaaatatgcgagtatttgtttttcttgtatgagtaaaagttaacaatgcatgtgtgcattaccaaaaataccaattagcggtctatttgaaaatagttggatattaattgtctttcctcgttgttatagtctacttaggactgtatatgaaactatcagctctgtgctactttcaaattatcaacttcgaaaaatgaacagaattaaaaaaaaaactgatgtcagctgttaaacttcacaaaaaattgtataatagtgcagtggaacatccaaaactactggtttagaggattcgagcacataagtgaaaatctaataaacaatgtaggcccaatattattgctaagcaaacaacattattattaaatacaatcacattaacaagggagggaatgggatcgcttgaacaggcagacccggcggcctttaatatcgcaataatactccaacactacgaggggttccagaaaaggaaaaaaaacctgcggtctttaatactccaacacttcgaggggttccctgaaaaaattccttcaaattaactataccacacctcgcctcgcctgtggttaactacttctatttatccacccatccctcacctctcccttctcacaaagccccaaacaaccgcgtccgcgtccgcctccgcctcctcctcctcctccgccgccgccgcatccgcatccgccggcggcggaatcgcctcgcatccgtttcctcctccgctcccactcttctccagctgccccccaatcatcgccgcccccgaacaatccgttcatccaccaggcaggcagtccagtccacgcgcaatctcggacgagcacccacatctttgactcgggtgattgattccgccatcagatctaggcgagagccatgaacggcggcgacgcggcggcggcggcggcgacgccgagccaccggcggctgccggacttcctccagagcgtgaacctcaagtacgtgaagctggggtaccactacctcatcacccacctcctcacgctcttgctgctgccgctcatggccgtcatcgtcctcgaggccggccgcaccgaccccgacgatctccgccagctctggctccacctccagtacaacctcgtctccgtcctcgtcctctccgccgtcctcgtcttcggcgccaccgtctacgtcctcacccgcccacgccccgtctacctcgtcgacttcgcctgctacaagccgcccgacaagctcaaggtccgcttcgacgagttcctccaccactccaagctgtgcggattctccgacgactgcctcgagttccagcgcaagatcctcgagcggtctggcctcagcgaggagacctacgtccccgaggccatgcacctcatcccgccggaaccaaccatggcgaatgcccgcgccgaggcggagtctgtcatgttcggggcgctcgacaagctgttcaagttcaccggcgtcaagcccaaggacgtcggcgtgctcgtcgtcaactgcagcctgttcaacccgacgccgtccctctccgccatgatcgtgaacaagtacaagctgagggggaacatcaagagcttcaacctcggcgggatggggtgcagcgccggcgtcatcgccgttgacctcgcgcgcgacatgctgcaggtgcaccgcaacacctacgccgtggtggtcagcacggagaacatcacccagaattggtacttcggcaaccgcaagtcgatgctgatccccaactgcctgttccgcgtcggcggcgcggcggtgctgctctccaaccgcggcgccgaccgccgccgcgccaagtacgccctcaagcacgtcgtgcgcacgcacaagggcgcggacaacaaggccttcaactgcgtgtaccaggagcaggacgacgaggggaagaccggcgtgtcgctgtccaaggacctcatggccatcgccggcggcgcgctcaagaccaacatcaccacgctcggcccgctcgtcctgcccttcagcgagcagctcctcttcttcgccacgctcgttgccaagaagctcttcaacgccaagatcaagccctacatcccggacttcaagctcgcgttcgagcacttctgcatccacgccggtggccgcgccgtgatcgacgagctggagaagaacctccagctgcagccggtccacgtcgaggcctctcgcatgacgctccaccgcttcggcaacacgtcgagcagctccatctggtacgagctcgcctacatggaggccaagggccgggtccgccgcggccaccgcatctggcagatcgcgttcggcagcgggttcaagtgcaacagcgccgtctggcacgctctccgcaacgtcaatccgtcgccggagagcccctgggaggattgcattgaccgctacccggtggagctcgtcgacggcttcgccacccacaacaacacgcagcaataacaccatccatccatccatccatccttctcctccattggtgcaacaaacacaaacgtttatcatcatggatcaaaccaaaaatcctcaaaagattggttagtgagaatgacataatggcacttgcttttataggacatgattgcattggaagaatctccagactttgctgctgccaactctgctctctactctgtgatcacactggtctgtacttcatggatcatcaggtaagttttacagagtagcagcagagctttgctgacgaggtcatcggtaggccttcctattgttgtattatgtacactacactttgttgtctctttagccattgcttccgattgtcatttactccactagatactgccatagtggtccagaggaaaggtcgaattttgttttccttttcttttcttcttctatttcttttatttttttcccttcttttttgtcacatgggattgatgttagtggcaagggcgttttgatcctgccaacctatgatgaacggatcgatgtgctgtgtatttgtcatgttcaattggaagtttccttttgcttagctattaccactggccctgatgtattaatggtttttagctggatgtgatcctgaagttctcgcaaatgccgtccaatccttgtagctgacatcaatgtatacttcatcagatactatacaacaagatatcgatgctcctggaagttgtttcttttaaattcacacatgtcttgtttcaatccttatatttgacatcagtgtctacctcacacatcccagctaagggtggattatctaatttttcttttatgtgataatcaagctggtcaatgctttccttccatgtgctttcaacctatcgtaagcaagagtgcactggtataccaactgaagttcaataacaagaaaaggcaacttgttagttatttacatgtcgttggatgatgtgctgaaaaacttcgcaagtaggttcgacgttgtgcaataacaaagaatttcctcatttcagtgacaggaagttcaagaatcaagcagttgtttttttcctcccccagctatagttcatggtcttctgttcaaaagagtcatgctctccaaatcaacatctgcttcagcctgacaagattttttgtgccatgtagttcatctttaagatgttgacgtactgaatgagtaaatgatgattgggatatctatgttacttgaactaccattgtaccttgtgtggtacaaaaagatgaatcttaattgctttctatagaaaaaaaaagtgataggtgttctgtcactatgcatattattcatgaaccctttttttttttgccagatatatttatggaccttaagtgtacagagagattgatcaatcatcaaatcacacaggtctcgtcggagagaaaaattgcagtcatagtattagacagtgaaccctcctgcatcatgcatccatgtgcaataatcatctcaattttgcactaatcttttgcgcgcatgtgttgcactgttctttactatagaaaacaagatccagcgaatcatgatccgcatcatgttccttgtattcggtcacatcattccgagatattgagataatgccaatgtggccccaagtgctgccatcctttgatggtaattgcctaattgatatgttgatagcatactagctagtccaatatgttcatcgaaagattaacaaacaaacacacagcactaatcaacggcgcatgcgtcgagtcaaagaaacgtgcataaacgaccaacggcgtcaaaggtttcgtgacaaatatcatgattcatgaccagtctgcatgctttgctatagatcgatgctgaagaaaacgaccaccaatatcgaaagtgacacctgtgttttgcgtgtgcgcgtcttcatgtgttaagaaaaaagatactcgtatttgcggccaattatatttttagtgatagacgatatacttgtcgataataagacagtgataactttatcaattccaaaatatatcgatctactttttttaaggtgatcatagttgtacctatgcgtttgcacggtattttcacggagagaagcggatgctgtcatgtcgtgaaatgcattccatctgcaacattactttccgtttcagggcctcgattaggccaggttgtgtgtgtgttctgtaccgggctcagagtgtcatgggctggcctgaccaagtgtttcaggctggtcaaggatgggctaataaaatccagctgaaaccagattcggcccagcacatagctgggccctttttccttccctactcctagatgtgcaattgggctttccggatgaactccttcactactcccaagtttaatttgccctcgaaagcaggggggacaaaagcgtcagtcaatctcgagcccgaggccagctattaggtgggccgggtcgtgggccccggaagcggggtttcaaaaggcgcaggaagtaccactgatgggtcatgtcacgtgggcccgccaaccgttaggcgccaaagcaagcaaagcccggcatgggttgttgggttggatatgatggcggcgtacgttctccgcatcgatcctagcggagtagatcctccggccgagaccaatgttttgctaatgatatggtcatatcgacctaatcatttgaatgcatttttgctagtcctatagtactaatccatctggtcgactgtgctgtgccacatcggcaggagtccacgagatcgatgcatgtgaatgtgatcgactgtgcttgtttgcttattacccgcatcttaaatttaaattttataacttagttttaagttgatttggagggtttcttagctctcaaattgtcggtaatacaggtataaaagtttattaggtaaattattttgattgcttagggagtgtttgggaggagaggattagaaaatattgagaatatacaccaaacaaggtgaatcattagcataagattaattgagtattaattattttaagcttgaaacatactagtagattaatatgagttttaaataaactttcgtagagatttttttgttatgagaagacatactatttagtggtttgagaagcgtacgtgtaaaaaacattggatttctcctctcaacctgcttctgctgttcatttttctactgtttacgacctgtacataagagaggattacatgcacttaactgcaattttaaggtggtgcactgaactaaacaacaactagtcgtagtgctgatcgagggatgaatggttcaaacttggagaagcgagaaaaggcttgcaaattccaaaagatacctgcctggccggccgcttgcttcctccgtgttctctctcatggatcagtcatcaaaaactaaaggacatgaggccaccaatctctaggcttaactctggccgtgtcgggacaactttttgaacgacgatctcctcggccggattggctgcactcccctcaccacgcaacacacacagaactgcacaccccctcaaagcaaggctaataatacagctaacatgttggttataagtttttttttagccttctcttagtctacctatataatagttagctctttacaattaatataggatccacttgtctctcttagaaagtttattggttcttgtgtccaggctggctataagtttatagcccgcttctcctctctctcctctcttctctcctccatctcagcatttagccggcttatagcctactattatacttgctctcatcttatgcagagaaatgctgctagctagctgcaggcatgtggcacaatttaatcgctttgtttactgaagattcatcagcacggagcacaaggcacacaatccctgaatcccctgtcatacgtgtagagcattacgctgataaataacaggccacacgacaaatcacgccagtacgtgtttgcatgcagtcttgcaccagtaacatataatcaaccaataattaatcatctagtatccggttaacattcacactaccagtttgactgccgatagttaattcatcgctccacttgtttctaataatatattcatgtcacataaaaaacgaatatagaatcagatataacacattttaatactataaatccggattgatgtactccctccatctaaaaaaaacttaaccttacctctcttagaataacgaatctggataaagagtagtctagatttattgtacaatgatgtgtcacgtctgttagtaggttgatttttaaggatggaaggagtaaagctgatctctaaacacagatttgatgcaaaatgcaggcactgtagcaggtcgatctgcaggtggtaataaccagcagtactacgagtgattgcaacagtggagttggaggagtactatgatctgccacttgcacgagcgagcattaatcgatcggctggcgctgcaggcgtgtctgagacgaccgcacgtactactacggctggtgcagacggatcatggatgagtacgtgcgtgtgcagagagtcatgggggccatgctgctgcaacgcaacgcaacgcgcatcatcagcgcatgcatgcagcgcgcgcgcaggtgcagatgcagtcgtgtcggcactgatgggctgcagcaaatggaatgatgggctccactcccttcttggctttctctgcatgacacattgccaccgatccctacatctgcaagcttgcttcttccttaatcggtctataaaacattaaaaccgacaggcagctaattctctactccattatatatgctaaatcgttttaacttttatcataagttaaacttctctagagaaaagaaaaaaaaggcctagagctcagagtaagacacgccaacagtccaacatctttataatataacaaataaatacactattaaaatattacatctaccctttaatatatgacatccaacggtcatacaaaatatgacatatggagtagtatattttatggtagattttggtaaactaatttgattttatcgatcgatgttgtcgtattttcatataaacccatatatttgatatcacattaggtatgttcggttgctgatttcacggctgtgccgtgttacatggcagcctgctgaacagactcattaataatataaagcgactctcaagatataattatagggaaaatgaagccaacatagcaagcagggatgatctagttcgagtcgatcgaccggccgggccggttggccggttttgcccggggtgcttttgtgaacgggcggacggctgagctagaggtctcatcattggcgtggccaactcatgatccgtccatccattccatatatccatgcaattatatctccacgtcttttcttgagttatcctgcatgcatgcatgcatggaaactagtggtggttactggttgccactctttacccttttgcttcttttgatcatttcgcctttattttttcttttgcacccttgttctctcttcgatctatactactcctactcctttatttctttcttgttttgatagaagtttttgcatgcagcagcttgctggattcgataatgtaggcaagggttgcgacacgcttttcatttgtgcaaaggaaagcaaggacatgacgttttgagaatatccactgtggcaatgcaaggagtagctagcagcagtctttttatctgttccccgttccagcgaatgatcaagcaatcgcagaactgctggtgctggtacatgcaaaatactccgctatccgtttgaacaaattgaggtggtgttcttttctcattaagacgaaaatgaagattggcagtctcttaaattaatatgatattttatagcagctttcatatagaaagttttacataaaacacaccgtttagcagtttgaaaaacgtgccacgaaaatcttaatcttcatccaatttttattggagaaaagaacgggacctaaactataaacacatgtcctgttcagattcattgtaatagattccttttaaattgagtatttttttaaggagtatattggtagtggagtagatgacgggctgtatgtactgcgtgtagctagtgacaggggatcggatcatacaggatcgatccggtacgggaggaggaacagatcggactgtgcacctcgtgatcggggaagtgcgattctactgcactgcacacaagagagcgagtagtgtctctgggctggggtgggtagggtagctaacgaccacgtccccaggagttgcatgggagactgttccccgtttcacgtgcccctctcctcttttgaccccccctcgctgcagctgccccgcttctctctctcttgaccgcctgctgcctctgccaccgcagcgctgcgtgcagacacgcacacgcacgaacacaaaacacacgcgagacgccgagacggacagggaggcagacatgcgcgcacacacacccacccacccgcatcgcatcgcatcgctccccgcgccggcaacgcaaaatctcgtccacttctcccgcaaaacgccaaccaaacccaaaccccacacaggtgagcggctgagcgatcgagtctcctcgttataataagcggatttgccaccgcgtacgccgcgcctgcgctagctcacatgcccccgcccgctttgcctcgccgaccacggctcgcgatcgcagccaacgagacagacgatagtaccctcctctcgatatctctcgccgatcgatcgatcgatccaccattgttaggttgagataatgctgcaggagctggcgccgtgcacgtgcgggatgctgtacggcagctgcggcggcgggtgcggtggcgcccccgcggcggcgtcggcgttctcgctgctgttccccatggcgggcgggcagtactactacaggcagtgcggcggcgtcgcggaggaggacagtcggtcgccgtacggcggcggcggtgcggcggtggactgcacgctgtcgctcggcacgccgtccacgcggcgcgcggaggcgggcgcgtacggcggcgggctgcagccgtgggacgtgccgtcgtcggcgcgccctggcggcggcggcggcggcaagcaggacggcgccggcgtggctccttgcaacaaggaggcccccgccgccggccgcctgcctcgccgctgcgccaactgcgacacgatgtcgacgccgctctggcgaaatggtcccaggggacccaaggtacgtacgtactcctgcgtgccatgccatctaggtaggcagcaacgtgcacgaacgcctttcgtgcaaatcaagtgctactatacaaacgtcacatcacatgaaaaatattcttctgtcgttggttgcagtcgctgtgcaacgcgtgcgggatccggtacaagaaggaggagaggcgcgccgcggcggcggtggcgccgacgccgccgccgtcgctggacaccggcgccgggtacgcgtactgctactcgcgacagccgccgccgccaccggcgccgcagtggggatgctacggccaggccgcggcgaagtcggcgtcgtacgcgatgttcgacgcggcggacgacgggccctgcctgtcgtggcggctcaacatgatgccatcctcgccggcgttcgccgtcggcgagcggcccggcctgttccaatactattagcttagctagagaccctagatcagtgtactactactactacgaactaattttgatcagtttagtttagtttaagcaatgagatcgatcgatcgatgaccagagttgtactgtttggaattaactagttccaccattaattagttactagcagcagtataattcctattgctcgcgtgccaaatttgttctttatatttcttttgtgatttaactaacagtactttccactgtgcactaatcatcgtcatcgtttgatccaaaaaggtaagtggatatatatgtggagggatatatgtttgggcttttgagatgtgaggtaccatcgatcaatcatcacggttatatgtcttgggacccatataagggttctccttttgatcagaggcctacaagatcttgtttgagctgttgcctagctatttaaattgaccgaaccactttttttgggcaattaaattgaccgaacctttgatatgctcgttgtttggtcgttggtttacaagtagtactaccaaacaaaatttgaattattgaagttaattttaaattattgagttcttttattttgggcatgttcggctgctgctttcatggctgcaccacagccggcacgaatagtcccgtactcacttagcacattcgcagctacagccattgcagtcggcctgtcgaacactccctttgttttcagccttggcttctaattaattaaaccactaagacataagactaaagttagaaatacagaagttctaccgtaaaatcattttccgttggctccttttatttttctagggtttatcagtcgaaccaaccaatcacacatgcagacggaggactggaggaaggagagtgacaatggctaaatgttgggtgggaaacaatgattatagagaaaacgttgtagatatgaaaaaaaatgaaatgttggatcaggagccaaagtgaaaaatactggatctcaaataactatagaaatccattatccaaaactgggttaataataatacgcgaaatgtggtatcccaaaccatatcagatttgtttctgtggatcgtcctgaaatgtctaaaccttatcgggcccaattatatgtcatctcgcaatgagaggcccaccaaggcagaactgactgacactgcgttcctcggagacctacctttgaatccaggaacatagttctaaaaaaaaaataccgggaacatttctactgttacaagtgaagaaaaatgcttgtccaaagcagtatcagactatcagtagaagacatggaactacagagccaaggatctttcacatgtttaaatgctctaatccatcgatcagatcactgtgccaactagtagtgtttatattctggagacctcaggaccactggtaacaagttgctaccataccatgaattgatagaaacctcattccttggctgaactcgttactcagcatgacgcagtgagagtcaaactagaatggttcaaatcataatctcagtaaaaacttggtgttattttagacttcccagaggggaatctgaagcttgttttgtccaggaaccacgtaacactgaaaaactagctagcatccttgttttgtttcccggcaagagttcattaatttctgtatgtatggaccttgtatatgtatttttttaatagaaaatgtcatatccctatatcacagcatctgtatctccgtatcttactaggcaaattttgtttgctaccattgatagcaaatcgagattttgaaccgttactatcaaaaactatgggtctttaccaaattttaataaagttattaaaaaaatagctacatttagtttgctgccaaaatttggtaactatataagaaatcctgctaaaattttggcaagttgtcaaaattttggtaactatgtggtaaggtttttttgcaacaaactgaacaggcctagaaaattagaaaaagatccaaacagggagctaactgcaaaaagcgggtcaaccggtcaactctggaaggaacatatgtacctgaccggattccaccgcaatagcggtgcaccatggaccagcccaaaatgtccattaagaaattgggcctaattagctactacagtatattgataggcccatatagtacactcacgtaagaggccatcccgttacggcccaatggcacgtactctgctttcctgttctggcccataccggcattgatgacgtcaccatcgtcgtcttcctcggatcaaattcttcttcatcaaggctctgcctctgcgctatggatcgccggctaccttctccagaaatttctcagactattgaaatttgacaagaaaaatattttcgaaggcaagcaaaggcgtcaagaatgcctgagagtatactcatattttacattgatcatgctcatgcagccgctcaagacaaaaaggaaaagcaattaggatgagatcacgagtgtgtcactgcacaaaagcctttgcaagtcgatctggaatacgtgaaacaatgttgtacaagaatatatgaacagaaagaatactttgctttttgtccagtatacttgactcggaacatagaatacacaagatttgcaaatgcgcaaatcaatccttccctttgtacttgaaaaaatggccatattttcgaagaccacaaggctcagcggaaggaccattgtatctcttcgagagttcttccttttgtctctggcacccaaaggatgacgaacacgagggtgaaagcactcacgaccatgtaggacacaaaggtccctgttgatgtttaagaagatagcatgagcgtcaggttggatattcagaattctactctagtctcgctcaacgaaaagaacaattccactgcaggaaagagagatcagagaagtagaagtatgtacctccagcactccagctaagcatcaagtttgctgtcattgttattccaaaggatgtaagccagttggcgagcgtcgcaaagcttcctgcgagactcttgatactaaccgggaggatctgaaaatatacaagttggaagtgagtcttcagaccatctgacaaatgctccaaaaatcatggccatgtgaatgctcttcagctaaattccaaggccgtatgattatgagccatgaagctatacctctgacattatgatccatggaatggcacccataccgaaggagaaggcgattacaaaagcctaaatgaagtgtacgagtcaacattttctgtcacagcttccatatttgtgatgcatatttttagagaaaacaacataatgagggacataccacaagagcaaccaaggagatcatacttaaggtgtagtacatgtgagaatcttgtgaaatgctatcctgaaacaaataaatcacaataacaatatgaaaatattcagtggattgacagaagagacctgtgatatattgcaaaattcataagccatatatggaatattgcatatagtgcaacagatgaaacttttcccttttcttttttactggtaggaacttaccttgaggaaaaatacaacagcaactgcaaggaggcttagagtcatcccagcagaagagatctagaagttgaagcgagagctttattatggtcacagaatacagaaaattagcatgctttagtttcaggaggaagagaattacgataaggaggatccgtcggccagctctgtctaataaccaggttgtaactcctgtagcaagaacctgacaagaaatgccgtgagcaacttaaggacatgtttacttgtctagtgtgtggtttaagtgattgcatagagacaggaacggtatttatagttgcacacctggatagcaccaagtgcacatgtagccaagtcactgtttgtgagacctgaagaaattttgcgtgtcacgaagccaaatcggctaaaatatgactatgatacagagagacgaaggaaattacatatgcataaacctattagaggtcctatcaggtcagcggtcccaaatttagtagtttgaaatctagtatgctattccttctgggctaaagtttgatgaacagatgattacactgatggtaatttagcaaacactaccgttaaagttggcaagatatcccaatatatgcatacaatttactatgcctaaagccctaaccagtgtaatgaaaaggtttactagcaaagaaggaagcacgacacaacttacctgctgctttgaagatgctacctgcataaaacaatattccattgattccacttagctgttgcagtacaagtaggccaattcctagctgccacagttaaaagtacaattccaattataaaatttagtccctatatttggtatggcataaaagtacaataccaattataaagttaaggaaattactattaggggtgtgcggtatttcttctggtttaattcttgaaaacggatcgttgtccttttgtttgctgacgctactgctctctgcataaagatgatgctgttacttccagaagcatgtggtattgtggtgcatatatcagtgtgctcaatgttataacaagtgcttacctttatatcattcacttccgcgctgatgtcagtctcaaatcccctcagaacttgtaaagaagtctcaaaatcatccatcatgttcatctttgcctagagatatatagagataaaaatatggctataaaaaaatgattcagatgatgtaatttcatatcgattttttgcatatacaataatacataccaaccatcttggggattctggaatgaagaataggccaggtatcaacacagtgcaaggcaagattcctacatgcaaaaaaaacacagatttgaataaaaaaaccatttactcctagtagacgcatatatgacatccaaactattactttaatacttgtgaaaaaaatatgtgctggctattgaaaatgactaacattccatctatgattcaaatgaaaatatttgcatgcaatgtttgtaggatgttagctatgtttgtcaacatattagtatcatttgctgttaatgaacttgtgaactgaaatatcagaacgcagacataaaaaaatgaaaggaaaaaaagatcacattagcaatacaatcagaacttggttatattacctattacagcaagaagcctccaaggaacaaacatgccgagcaaatatgccaacaatataccaacggttacagataactgtgtaacaaacaatcacataaggtgcttaaaataaacaagaaaaacatagaaaagcaattgtctttgtgtcaaaaagattattcctgtgaagtaaggttacctgattcactgagccaagagcacctctcatgttttgaggtgatatttctgctatgtaaactggcacctgttatcacataatacacagatcaatagtaagtctctaacatagctggcaatgcagagtttttcctccaaaatattgacatatccgttattccttttttttctttttcttgaacaaagaagttaagtactcaaactataagtgcgcataaaaaagggaggaaggaagttttctcatacaaaccgtataagagatgacaccaacaccaaacccctcgagcaatcgtcccatataaagaaacgatgagtcctataaagcaaaggcatcgagcttaaattgtataaagcaacaaggtggtgaaagtaagattctgaaccatgtaatgccatacttttgcaaaggagatggcaagccaaccaatgatgtttggaattgcagcaatcatcaatgactggaaaattcaccaaacaattcagttagcttaaaagagtagaccattgaagtacaactgactactgcaaccatgccaaaaacaggacattaaataaaattaccctaaagtatgtttatctactgtaagtcatgccagaacacgagcatgaaaaatacttcatccatacattttcgtctataccgatttcttgagtaccatatgttcatatctgtatgaaacagaagtatgcaactaccaaactcatgaacagacataatgtcaaacccccaaaaagccatcctagcaattcggtagctcaataatctactgaagaatgatcaacatttatttccagaaagttccatccgttttgcccacatttgtattacttaaaaactaaaataataattttttatttgtactaattacataaaactctcccagcacagcaggtgacgttgaccgagaccaccattattgtcctttagaaagagactggtaaccctacgaaagcgcaactaataactgcatacgatgtgtacccaaaaaaagaaaaaaaattctcacccctttgcgcccaatgtactcggccatctgaccactggcaatcgccccaaccatggcgccgacgttggacagcgatccgaacaccgagaactgcagcagcagcgcgtcgttcagattcgggacaaaaaaaaaggggggggggggtaatgggaagaaccgaagaagaagaagaagaagcgggcagcaacctcggagagggtgaggtcgaggtctcggatgatggcgtcctgcgtcggggaggagaagccccccgtgaatccgaactggatggggccgagcgcgacgatgagcgtgcagaggaaggcggagacgtgggactcgcgtaggatggccatggacgaggtccccgcgccggtgaggctcccctgccgcgaccccatcctgtaccagctccccgtgtgcatcagcagcggcttccgcatgccgccgccgctctcgtagtcgcttccgctctcatcgccgacgccgacgccgccgcccctgttcatggcgccgccctcccgatctctacttcgccggcaatggttggattcccgaggcgagacgagatctctttacgagttacgagagagaggacgagatgaattggaaggaggaagaggcgacgagacgaggagacgcgacccctttttttttccgttgaagcgggggagagttggggggatcgcgtcgtgtgtgtgtctacctgtctcttggcttgaccggttggcaggtggggcccacctgtcagtcaccgacgggagaagatttcgtttggtccgggatggaaaaaggggcccacctctgtttgataggaggaatatttggaaataaaaaataatttgtgaataaaacttttatatacgtattcttaacgatttaaaagcaaatgttaaaatataaactacgctgaaaaaactccaaaattaactttaaatttaaagttgaaaaatcaaaatttagctataaacataagtataagcaaaagataaattttaagggatttcattattttcacggtttgaacaaagaatttggtggatagtcttcctaaaggtttttgattccttccatgcactttttccccaattttataggaaagcaaatatttgctaaattttgttggaaacttgcctacgggtatgttcgttttaaagcagctgcagtttgactaatgaatcctttcttccaaacatcccatattatatttttcatgtgtttttcatttcgctggttaacacaagcattcttgtgttctatttttctaggtttttattcctgtgtgtaataaatggggcctcatttttctttgccataaactaccaaaaaagagtaatcatccagaaatcatacataatcaattaaaattgtatttcttggactgttttatggcataaatactaaaaacgttaataagttcgtgctcagatgtactagtgtgcacaagtgcacaacatgtccagacaacgacgtgtactgctttttttaacgcaaaaactaatcggcgaggcctctcgatattgtgttatcccgcgatgccaaccatagaagccgtggagaagccggcgcacatgcatgccttttttttctattacacatgcatgtttttccccttcttacaaagttttctctcaaattacttatccgatctataatccgattataccattgtgttcgttgcaattaaatcttcaaaacaagatcttacatgattatactacgataaaaaaatatttatacttgtaaattacttttattatatacttaagttacttttatcatatatataagttacttttagatttgactaaattactttttatatattcataatgctttaagtcgattatgtttattatagtttttagtcaattctataatttatggactttaaatttaatttttagatacaaaatatttttctctcgaatttacttctaatgttgtaacaacttacttctattttgtgctaacttacttctattgcatagctaagttatatctattgcatagctaagttactactacaatttaaataaattacttttaaattaataaaatatttgaatatattcaatatggatattgttttgtctcatattttatgtagagtacaatgatataaatagatcatgaaaataatacgtgatttaaaagatataagttattaaagagcttaaatctaaaagtgatttatgtataggacaaaagtaacttacatatataataaaagtaatttgcaacatagatattttttatcagaatataatcgtgtaagatcttgttataaagatttaattgcaacaaccataatggtgtaatcggattatagatcggataagtaatttaggagaaaattctctaggaaggaaaaaaaaggcttgtataactgttgttttttttttaagagaaggacgtcgctggttagtgatatgccattagcgcgcgcgatctagccgtgtcccttttttaatttcttctgatctcattaggatcatcccaatcattttcacgagctaagctggataagatcgtgatgacgaggaaagcgattgcttgctgaatgaacaacgaccatttgaaaagggccggagatttcaaaccaccccgtttctccaaaaaaaatttgaacgaattttatggaaaccgaactaaaatttaatcacgcagaaggcgtagtctgctggaaatagatggcgtggcgtggtagctggctacttgcttgctcaaagccacgtcatacggcaacattttctggctgtcgtgcttctcgtggacactataatataatgatgctcccagctgaaagaaacaaacatgttccagtttgcagacatgatgccaatggacatgtgcagatcatggcaaaattcctaatcacagctttgatagggatgcatcaccggccaaaaacggcagaaatctgtcttagtacatgacagatattcaaccagcaatgtctgcatttctttaaggaataaggggagtaaatatattcatttatcaccaaataagtgtctctgaactctgaatttctgatgaaggtgccaaataactgtggaaatatcggcagatagctgaacttcagaacagaagtatttccaaaacagtcagggattcaaattgctcatttatgcatctttttattatataacgtcgaagacaagtaggaagcaatttgatttgagccactgcactggcatttacaagccaattgggcataactgaattaaaattacacaagaatatacaaaaaaaatgaactgaataaaaatgcttggccttcaaccagtaatcgacttggtaaaagaaaagccaaggttcctaattgtataagtaaatcctttccttgtactcaactggagtatccactggatgcaacgagaaactcaaaatttagcagaacgaaaactgtatctcctccagagttcttccctttgtctctggcacccaaaatatgacgaacacgagagtgaaagcactcacaatcatgtaggacaaaaatgttcctgttgaaattaaaataaaatatttaacttttatcaggtaaatcagttcagaattttattcttggtaacagaggatttttatagaaatacggacctccagcactccagctgagtaacaaatttgctgtcattgttattgcccaggatgtaagcatgttggcaagtgtcgcaaagcttcccccaagactcttgatgctaactgggaggatctaagaacaaacaaagatttaactgaaatctttagattacttaagctgatgcctgagatacttgcaacaaaatggtggatgtgtcaatgctctaaaaatactaacatcattgtgagctatggggcaaagcattatacctcagacatcatgacccatggaatggcacccatgccgaaggaaaaggtgatgatataagcctgaagtaagtgaccgaggtaaattttccggcagaggttttggagcaattttcaaaagaaatggtttaactgacagacataccacaagagcaaccaaggagatcatacttaagatgtagaacgaatgagaatcatgtgaaatattaccctgaaacaaataatcattgtagtaatattgaaatattgagtgaactgaggagaaaggggaagagtccatgcgacaatgtaggctatcaaagagactgcaacatatgattttttttatcacaatggtatactggaaaaaatctgaatgtacctccagaaaaaatacaacagatactgcaagaaggcttagagtcatcccagcagtagagatctgcaattttaagtgagtcactatgttattgttacagacaactaacaaaaaggtgatttcattgggaagaggaaattacaataaggagcatccgtcgaccagctctgtccagtaaccatgttgtaactccagtggcaagaacctaatgtaatccaacgatttctgtaagcaacttgatataagttacagagatgagatcaggatattcctaatcacttacctgaattgctcctagtgcacatgtggccaagtcactgtttgtaaaccctgaagttctttgcgtgttaagattacaagccaaaatttactacaacgtgactgtagtactaaggacctataagagatatccacaacttacctgcatctctgaagattctacttgcataaaacagaataccatttattccacttagattctgaagtacaagaaggccagttcctatctgtcaacataaagcgtagttaccattacaaaacatgattaatgactttggtataaactgaacaaaaggggtatgtaagttaccagtaagggagtgcggtatttcttttggttcaactctttaaaacggatgtggttcttttgtttgccgatgctactgctctctgcataacagggatttgaaccatattagtcttccagaaaaatgaaagtacatatctcccaagtgttgtgttagtgaaaatcttactaagatgaaatcacgcgaaaccgcaaataacttgtagtcagttaatcaagaaaaataaaattgcttgcctttatatcattcacttctgcagtaatatcagtctcaaaccccctcaaaacttgtagagaagcctcaaaatcatccatcattttcatttttgcctgcatatagatgtaggaaagtgcttgctacagatttcagatttgtgatacaatatccaacttaggtgtataacataccagccatcttggggattccggaatgaagaatagaccaggtattaacaatgtacatgggatgcttcctacaagcatggcaacccagatatttgaatcagaatcagaggtaccagacatttaacgcacatacaaattgcaataagtccaaaaggtactagcaaatatcaaaagttaaaaattcattattatttattacatatccctaaatagaaaacattcagacatcaggtattgatttgtacctatcactgcaagcagcctccaaggaacaaacatgcctagcaaataggccaacaagataccaatggtaacggacaactacataatgaaaaactgcatggtaagtccaacataaacaaaccataaatttccctcgcataagataagatgcttctgacgataagcacacctggttcacggagccaagtgctcctcttgtgttctgatgagatatctctgctatgtatactggcacctggtacgatataattcacacattaagggtttatacatgcactaactattaactgatccaaagttcttctggcaacaaaaatgtaaaaaagcttcattagcaaaggatgctctgcctcattctacaggcatctcagtctcagtcagataagtactcaagcagtgaagccacagaacattctaagcagcaaataaacatgaaatgaagttggtaaatacagaccgtatatgatataacaccaacaccaaaaccttcaagcaagcgtcccatgtataaaaatgacgcgtcctgaaaaacaaagatcggcaagaatgaaactagtgaaaaagagcaaacagagaaaaataagcttgagaaatatgtgacacgtacttttgcaaaggagatggcaagccaaccaatgatgttaggaaccgccgcaattatcaacgactggagattcaatcagcaagaccattagagtaaaataatagagcttcactgtagttaactactgatctgattaagtgattatgaagtatgaaccaaagaaaatgtcacaaaaacttcatctacacattttctgtcatactaactcctcttttgccagatcaatggcaatcacaactaaagaactcgtcaactttgaaattaaggtcaaaccccaatagtatagctaactgaacctgaaattttgggtttcatattttcacaagctacagttcacaggaaatgaccagcatttctaatcccactcactttctttaatggcaaattattggtgttaccggaaatcatacaacagtgacgtattgaccttgtcaactatcaaagtatcaattgttcgtcgtcgagatacaggatggccttctagtggaagaacagataaggaccaaatgaagcacaaattctcacccctttccggccaatgtactccgccatctgcccactggcgatcgctccgaccatggcgccgacgttggacagcgaaccgaaagccgagaactgcatcagaaagataaaacttcacactacaagaaacgcaataagcaagaggaagcagcaaaagcacgcaagatcgcagctggaacgggcacgggacctcggagatggagagcttgaggtcgcggatgatggcgtcctgggtgggtgaggagaagccgctggtgaatccgaattggatggggccgagcgcgacgatgagcgtgcagaggaaggcggagacgtgggactcccggatggcggccatggaggaggcggcgaggctggaccgcgatcccatcctgtaccagctccccgtgttcagcagcggcttccgcaagccgccgccgctgccgccgtcctggtcgctgccgctctcgtcggcgcacgacgcacctccccgcctgctcccgccgccgttcatcgcgcccgctcgctcgctcgcctcggctccgccgcggcgccgctcaaccggagaaatggatgagagagagggagtagaaaagaggaaacttttttccgttgaaatggggggagagttcctgaccgtgttcgttggtctcctgtggggcccactgtcagtgacacataaggaggctactctgattttgtctgaactgaaacagaaatagaacataggcttcttctttttctgtaactgttgcatgtggaccattttgtcattcaccctgatccgaccacctgtactacatatatgtacaaacaatcagttcattctagttaagctcatgacctttctattattatctttgaacacattaatttctaataatttataattagattggacataactacgaatctagataagcttttgttcagattcatagtaataagatgtgtccaatctaatattaggtttttatccagattcataatatcgagatatatctaatccaattctagattgatatagctattactttcttctataccattctctttttttgggcttgaaataaacaaacatggaatgcacagttgcacaccatatgctgttgtaagtacagatcatcatcatatcttgctgctttgcctcgtggtcgttggctagttgcttccatgcattctggttgtctgtggcgagagcatgctgcgatgctgctcctggactggaacccagctggacgaacacgaggtctcaacttgcagctgtaatgctgacaagaaacatgcactcagcgtggcaaaaatccaacaaactttagcttcactactaccaagctgccgatgggtggcagaagggtcgccagatccgaagtgagcaacaggaatactatgttcaatttgaatccggatgcttttctcagtttcatgtgtagtgtaatcactaatcagttggtaaaaccgaaaatcgccttgctgaaacatagaacggttatcataagttgtcagctgtctggttgccaatgaaagaccaaagcaatgatcacatctgagatctgcatccagagtaaattttagatgccactagaaaaccagcagaatgaaactgaatactccatctgtttataaatatttaacgttattgattttttaaaatatgtttgaccgttcgtcttattaaaaaaattaaataattattgattttttttctaccatttgattcattgttaaatatacttatatgtatacatataattttacatattttataaaagtttttgaataagacgaaatgtcaaatatgttctaaacaaatttttaaataagataaggttcacttgttaccatcagataacagtagaaatatatgctcatgcaactatgcgagtggattcgccgctgtctccgtcaccgcctcaccggcgaggccaccatctcgccgccgatctcatctagcgcaggtttccctgaatcccgtcgcgagatgggggccgcccgatgaagcctaaacggcggatgcgaatcggagtaaagattttgcttaggcatttctccatcaaatggtaggacccacctagcagtgacactgacggctaacctttttggtacgtactcccgttccgagttacgggccgttgcttagcctttttatgggcccagatcacggcccgtcacgcgaggaggacgggtgggcccacgcgagtgataaatgggcctcaagggaccacccgacaaaacggccaactgcttccctccacggtccagtaatccacgccgtctcgtctccaacacccaacctttgcaatggtcaagaccagagcggcggcgactccccgcccctccggcggcggcggcggcgcaggcgcagcggacatcaccgccggtaagatctccttccgctcccgcaagatcgtcaagagcacacccgccaaagggaaatccgtcgccacaacaacaacagccgtactatcgccaccgccgctgtcctcgccgggggagctcgcggcggcgctctcgcacctccgcaccgcggacccgctcctctccgaggtcatctcctccaccggcgccccggccttcatctcgtccccttcccgccccgccttccactccctcgcgcactccatcctccaccagcagctcgctccctccgccgccgccgccatctacgctcgcttcctcgcgctcatccccgccgccgctgatcccgatgccgcggtggtcaaccccgctgcggtgctcgccctctccgccgccgacctccgcgccatcggcgtctccgcccgcaaggcggcctacctccacgacctcgccggcaggttcgcggccggggagctctcggagtccgccgtggccgcaatggacgaggcggcgctcctcgcggagctcaccaaggtgaagggcgtcggcgagtggacggtccacatgttcatgatcttctcgctgcaccgccccgatgtgctgccatccggcgacctcggcgtgcgcaagggcgtgcaggagctgtacgggctgccggcgctgccgaagccggaggagatggcggcgctgtgtgagcggtggaggccgtaccggtcggtgggcgcgtggtacatgtggcgcctcatggagagcaagggcgccgcggccaagaaggcgaagagcaatgccattgccactttgccatcgagttgctaggtatgtactgtaccatgtaatttgttgatggtgtgcctcagaattgttgtccccaagctgtcaaatttagatggcagtgtgttagattctacttacccggattagtgtagtgctgcgtgtgtgtgtgactatgctcacactatggttcttgcaaagttgcaatcggaattctgaatatgctcaaattgaatgttactacttttgcattattgtatcttcgtttggtatgtgagctctggtaaatttgtaggccagttttgtgttactaattacaaatgatattggtactgctgtctgctgatactgtgatcaagatggcaaattttgtggtcagaaatggtatgagatatcgtcgtctcggcagagaccagtggatgcaaacccttgttcagtagttatagtagttgagtatacagtcagcagaaacatgacaagaatgttttcagaaatgtttgtttctagctagtcctgtgagtttgtaactaccgttcttgattctaccctacagtaatgagtgattcttaacagtgaacattggtgggcttggatgtagatcattctggcattaggttctttctgttgttcttgaagacaattcagtgacttctcctttttgagaccgacatttgaaaacgaaagcagtggtggcaatgattctgtatttctttaacgttttaaagctcagaaatttaagattgaacatagcgtccatcaaatttagtgatttggggcaacagaatgcaatcgaacataacattttataattggacaaacacatgagtttacatcacaatgttacttcataatttagttcacagagttaatgaatactgcagttgacgaatgtagacgagaatctacaacagcatggggacttaaccttgctcataacccaatactatatgcatacacaccccttctcttcctttattctctaagcaatgctggattacttaatttggttcctcctagagcaagtctttcttagggatctagtttatacaacttcatcttctgtctatcggagcttccaatggttcatcctgggaaaaaggaaaaatataatgtactgtaagtttatcggagctcaaaaaactttactcagatgaactatatattgcttttggatgcctgataggagagagctgcttcttttctctcttttggttgctttgttcaactagacatcaagttaggctgataggtacggaaagagtttggaactcaaccaagactagcaaaatagacctagtactttcgctttttttaaacttgtatgatgtacttttgttgatctcattgcaaactctagcttgcaaccagctgccttttatatttgtaaagtgttgcgattgcaaaattgccaactcaaaaagaaaacaaaacaacaagaacaagaacccactcaaagcatacccaccagcaccctctcaaaaagcatgggagatcaaccttttggcacttagctgtgacttgtaaaggactatgagaagtgcatgtcggctgtaagctggaagcacgaggtagactgtacttctctaagaccaaagcttttcttttggaaggtattattctgatagcgctaggattagatcccacgtgattagagggcgtcagattacaaagacactcataaattactgactctttgtctaagtatgcttatgatgccagtcatgcatggtggcaacatggaaagaatataaagtactaaaccctgcatgttgtatcttcaagttaaaccatgaaccatctataaacagccaaatatacatggtctattcttcatcattgcatttagtaagcttgtaaacaatcactgacttagttatgactaccatgcttctactcgactgtaattctgaaaacttattggaggcaagttatcttttttcttttttgcagctcaggtttggttgagaggtggcatgcatggtttttttttttttttttttttacctcaggtccagtatccctgcgtcttgtacttggggaactgcactcgcccggactcgatcgtcttgacgtcatcggtgaggtcttcgtagtggcagcggatctcctcagcggacttgatgcctcccatggcgctggccaccttgtcccaccggttgggcgtgtcctcgccgtagtaggcgagcgcctcctcgaacatcttgttctccttcctgctccactcagacttcgagttgggggaggagctccgggacccagacatcttcaagagtggccttggtaagacactgaactactgaaagctctaatgctaaagatcttgctgtgtcttagctctgaatgttcttgctctttcagaagctctggtggtttgtgctttcagtgttgcaaggtcggctatttatagggcctggggccttgggtgctgttgtgtgtatgagctgtaagctgtatggaataatggctgtgcattaaaggtggccgaggagaataaggttcgcagattttggagcaaagggacacagacagcgtgtgatggaaaatgccaattacagcagttgatagtattggctgtgttctatagcagcctaatctcccggcaaaaaaaatagcagcctaatcgatcgagactatggtgcatgatgcctaacatggtaactttgatgagcttctggtaaagattacatcttgatgttagtgtggctcatggctgcacattggcatgcctgaacattgaaaatttttgtggtgaactttctggtgctgaagatagaagttaaatattctggagctgcagtatatgtgtcactcagctgagaaggagctgacctggcatgtagctgggcatcccgatgtctcaatccttatactgacaaacgccgatcgtttttgttttttgcatgcagctgcttctctcggatccatgcgccgagcgttccagtcatcgaggcatcatgctgcatgcagagctaacaactgttcatcactactatgcacgcatggcatggagtgcatctttcgacagcaacacagcacttggatgtgccattttgtcatagtatcccccaagcattagcatggtgaaattgcctcatgttctttacactttctgagaagaagacaaagcaatatcttgtgctgagcacgcgcaggcgcgtttgcattcaatggaaggtaaaggtggccagactttaccacaacctatcagtgaaaaaagtgagatataaattcccatgtttggttcgttttctgatcaagcttccattctccagttttgtcctgtgtttgctcgaactggagcactgaagcaacggtgaagctaaaaacagcatcagaaagaggcagagaaaagaaagggggtaacatcaaagtgatcagatctaaaggatagtaacatcaaggtaaagcgccaacgaatctatggatccatcaagattttatcacgtagctgttttgtcatcctgcagagatcgcacagtcatccggatacatgcgtctttgccatgaattccttcctgcttagcaagcagctggccttgctctccaagtataagcttatgaagccttcagtgatcttgtatatcttgctttgtctcccctctaagtagcagcttgcctaccaagctagtctaattccagtgtttaacttctgttttatgcacactgacagcttggtttgcaaacaatttagcctaaccttttgtgcagctgaagttgtttttgtctgggctacaggcatggcccatgcatgcatgaaagatcggaagaatatgtgccaaagcaaaggctttcttgagcatcacccctggacctagtagttgccattatcagtctattacctgtaggctgttgccatggccttggaaggaagagggggggactacagtactacatctgcatatgttctatggtccatgtaaaacatgcatgctatcttgtccttaaacactttgtttcattaataaaccctatttctgaatcatggttatgtcatgcatacagaattctggcgtggcagcatggaatccatggatgctgctgacatcacgaatgaaagcatctctgtgaatggtgatgtgtcagccatcagcctgacatggtgcagtgcaggttcgatcgatgcatgagagcagaggctgcagatgcagagcagtgagcttgtaacgtgtgagcatcaaccaataggctgtgcctgtgccctgcaaggtgcgccgaaggtgtgcttcttcagaattcagaactgcaaaggtgcgcaaaccgaacccattattcagtgttcttttttttctttgaaagatctatgatcctgttattccaatccttgatatgataggctgatagcctataaatccagtggtggatccagaaaaaattagagcccggacatacctaactatagctaatatttgctgtggaaatggtatcccaatccttgaaaaacatgcaaaaaattcagtagaacattcgctgacgaggctgggcagccgcccatggtggctaggcggtgaatctgctggtgtatgaatccacctcacaaatctctctcaacatggtgccgaatttctaattgtggttcagaaggtattagaaacaattgctcatgcatgcactgtttggatatgtaattcgttggagaatagcaggatgtgggctaagaacatccattctttacaatggacgcgttttgcgcgatcccagccagccatccactttactgctactatccaaagaacatattccaaaggaagataagcagccagtgaagtggaaaataccctttggggacccaaagaatatatatctatgtgtgtatcttttccatctccaatgactctggaaagtgaatttgacgacatgccatcttgttcctggcttgccgtttgctcatagggtcatggaatttgcatcgtatttctgtatttttttttcttttccccctgtttatgaagatctgatttgggcctgattgacctttccaaaggcctggcatggcatttctcgtgatgaactgtgtcgtgtaggatcctggtccatcggatgcaaatggccattggagagcagcaagtgcttgcaagcagcatctttgattccttcctgcagcatggaccaggccaccggagatctctctctgggaatcatatctgcataaagccatcggaaagatgcaggattccctctgatattttgaaccatccgagcaaatgctttctgggagatgctggctagtgaattgacatgctgtgcaaagcttttctcatgcattctggaaggatttctgctgattttggatttgcagcctgagttctcgtttgcttttcatgttggtccaaagtccaaactgtgcttatcattgtcaatctgtcacgcatgagggttgaaataattcaactgatctagttttttcttttaaaaagaaaaagaacaaacatttcaattgggaaattgtttattagcatcaagcagaattgcagattctggattgactacagtattgccttcagatgaaaagggacagaaaagaaggcatatctgcgcagattacattatcctgtaccgtctgcttttgatctacagagatgtttggttcttggaattccttgcctgacgttgaaacttcagaagatgcaccagcctgaataacacggtcaacttctcccttaatcatagtattaaaccccttaaacattgcagcatcttcagtatctgccaaatagtgctaactaaaatgcattttaatccccaaattaaacaaacacctgagacattattattccctgagctgtgagccatcattagtcggtatcatactatcattcctgccagccacttgatcctaatcgtcaagtagcagctcactagtattattcttgctctaatcgtcaagtagcagctcgggattcagctcagtggccgtcactgcgacggccggattccaaatctttgcagcgcaaagctggggattcggattcgatcctaaggctgatcgatcggcgccaacttgaggaatgggaatctgcatcgccgtgccccgggattcaaaggcaaagcgccgctcctctttcttttcccttgacaaggaaacgcgcgtgggttccactcccgctgattcccaaacgctacaacatgcagcaatgccagtgcaggctctgaatggattagtggaactgaatggatcacaaattttatgacacaaacacctctatcgttttttcaaagttggattaagttgctaatttcagcattgtgattttaagttcctaagaacacgtataaaagttccccccagaaattatttaagcgttacaggttataatcagttgtaggcttaaaaaacgatgggactgaaaatataatctgacgagacaactgataattcacgcatttaaaaattccgtacatatgaattcggtaagttataagtaaacaaaaattgagcagtagagccactgaacaaaaattcagtagaaaattcagtcatgctctattgctactcagttttgggctttcctcccagctttccctcgcataccgcctttctggccgccgcccttcttccccttgcccttagctcctttgccacccttcactttgctggccctcttgtccttcttcatacgcttatccaccagtatcttccctttgccagccctcacctgaacgcccttctttgcgacaacgtactccttctggggcttctttggaatcgccttcttgtaaatcctgtcgatcatcttcctctttgactgctcgtttatgtcgttttgatctgcgatggcatctgccttctggcgcgccttatccagcttcttcatggcgacgcgcttcttccgagccttagcctcagcgaccttcttggctggccgagcatcgatctccttgaactgagccctcatggcagctacctcctcttttgttacaggcttcataggctggttatgcctcttttcatcctcagcaaaccatttaggtaaaccctcgtcgtcaaacatgtacttgttgtaagcgtcgtcaagtatctgctctctctgtttcttcctcaacatcttccttgcataggctagtacttcagcttttgtgtcatcgtcgaggtcctcatctagttcatcagactcatcagaagatgaagatgagtcatcttcagttcggactggttctgctggcacaatctcaaaatcgtcctgttgcaagtgttttgctttagcagacttttccttctttccagaatccgccttcttttttgcaatcctagttagctgctctctttcatcttcactatcactctgctcaaccacacctgttcctgcttctgtgaatacatcctggctgaaccactgctccatcatctgctcttttgttggtttctctgcatctagggataataaaaggggattggtctcttgatcttgctcttcatcagaaccgtgatccatgtcaacatcgtcaccgtcatcttcacctccctattaagttcataccgtaagaataacaacgattaccacccatgcaatctagttatataa

SEQ ID NO: 26801 - DNA, 175 bp, Oryza sativa
ggtgtccgggacttttgtacttacgtttcatgttgcgctcttcttcttcattgggcacgggcacatccaaggctacatcggtatatgaaagatggagggaatacaaatagataataagatgatgctgggcgataaggtacgacgttaaatggaatttagatagcaacaaatgctt

SEQ ID NO: 26802 - DNA, 615 bp, Oryza sativa
atcggctacaaaaggcaaaatgtatatgaaaaaaagattgatcgaactttccgacgggctcattccatgagtaaacgattgaatgggattcgtttgggcaaccaaatcaagtgctggtcccctattctctgttattgaattaactaattccttcccttttgactttaggatttttcgatattttttaggcgctgatttgtcattacgcaacaggaaaaaaatcaaaatttcgataaattccttttttttgaaaattatgcgataattatgagaaccaatcctactacttctcgttccggtgtttctacaatagaagaaaaaagtacagggcgtatcgatcaaattattggacccgtgctggatgtcacttttcccccgggcaagttaccttatatttataatgctttggtagtcaagagtcgagacactgacggtaagcaaattaatgtaacttgtgaggtacaacaattattaggaaataatcgagttagagctgtagctatgagtgctacagatgggttgatgagaggaatggaagtgattgacacgggagctcctctcagtgttcctgtcggtggagctactcttggacgaattttcaacgttcttggggag

SEQ ID NO: 26803 - DNA, 1127 bp, Oryza sativa
attctaattgattggatatcccgcataaggaatcgaaggaagacgcgacgttttattccagggaatccccaacgaaaaatgcacactactccctcttttctatcgaatcggtcataaccactgcctacattccacaaaatagtgcaccacaagtaagcgctaatgaataggcctgcgattccgtagaaagacatcacgaccccctgtggaaaaaaaagaatttgttgagatggaagtacagatataatattcttaccaagataactggaagccccaaccgctaagaatcctagtgaacctagaaaaagaatacaggcccagaaaaaattacctctttttcgagaaccttttagaagttctatccatatgtgttctgatcgccaattcatattagatatactaacagcggtcgattgaaattgagagaataagctaaatgattttgactttactttttttgattctgaaatcgccttcgccaactagatactcctgtaaaataattggttagatacattgactttctattcaaaaagtatttgttgatccacttaaaaaaactcgctatacccggttccgcatatgcatgcatttatgctcgtagcctatatccgcatccataatccccatccatagcgggtttgcatttgtgtgtagaaagagccacataacataccatattatattacttacactacaaaagatccgtattatgatcctgtgtggaaatacattgagaaaattcggtcccgtcggttctagacaatcttatttttctgcacataaagaaataaagaagccattgcaattgccggaaatactaagcctactaaaggcacgaaaatagagggtaaggtaaaatccatcatagaataggtgtctccattcaaattactatttctatctattcgatttgatctattcaaaaaatatcttaagattcttatgatataattaagtatatctattataacgaatattgactattgtatttttgagtttgcaaaaaaagattttttatagaatactttttttttagaatactttagtattctaaaaaaaaagtattctaaaaaaaaagaatcgaatggattatataaataataagaaaatagcaaaaaaggaga

SEQ ID NO: 26804 - DNA, 997 bp, Oryza sativa
tagtatttgcggtgaaccccccggttaagtagtcatgcattacaataggaacccctaattccctcgcaaatacagctcttttaatcatttcttcgcatgtacctgcagtcgcattcaagtaatgccccttaatttcaccggtttcggcctgtgatttataaatagcttcggcacaaaagacaaaacggtccctccaacgcataaatggttgtgagtttacgttttcatcatctttggtaaaatcaagtccaccgcgtagacactcataacatgctctaccataattttttgcagataatcccaattttggtttaatagtacatcccaataaaggacgaccgtatttgttcaacttatccctttcaacttggataccatgaggcggaccttggaaagtttttgaataagtagggggaattcgcagatcctccagacgtagagcgcgtagggctttgaaaccaaatacgttacccacaatggaagtaaacatgttagtaacagaaccctcttcaaataggtctaatggataagctacataagcgatatattgattatcctccccaacaacgggctcgatgtgatagcatcggcctttgtaacgatcaagactggtaagtccatcagtccaaacagttgtccatgtaccagtagaagattcggcagctactgcagcccctgcttcttcgggcggaacccccggctgaggagttactcggaatgctgccaagatatcagtgtccttggtttcgtactccggggtgtagtaagtcaatttataatccttaacaccagctttaaatccaacacttgctttagtttctgtttgtggtgacatacgtccctccctacaactcatgaattaagaattctcacaacgacagggtctactcgatatggattaggcgtaaatgaaacctttgcaaaaatcttaaaaaaaagatattcaattaatatcaactcattaaagaaaatggggggcatgcttaagttaatgaat

SEQ ID NO: 26805 - DNA, 1647 bp, Oryza sativa
gtatcgatcatgatatacgtaataactcggacatctatttcaaatgcatatcccatttttgcgcagcaaggttatgaaaacccacgagaagcaactggacgaattgtatgtgccaattgccatttagcgaataagcctgtggatattgaagttccccaagcagtgcttcccgatactgtatttgaagcagttcttcgaattccttatgatatgcaactgaaacaagttcttgctaatgggaaaaagggagggttgaatgtgggtgctgttcttattttgcccgagggattcgaattagcgccgcccgaccgtatttctcctgagttgaaagaaaagataggaaatctctcttttcagagttatcgtcccaataaaaaaaatattcttgtgataggccctgttcccggtaagaaatatagtgaaatcgtctttcccattctttcccccgaccctgctatgaagaaagacgttcatttcttaaaatatcccatatatgtggggggaaaccgaggaaggggacagatctatcctgatggtagcaagagtaacaatacggtctataatgcaacgtcaacaggtgtagtaagaaaaatactgcgtaaagaaaaggggggatatgaaatatccatagtcgatgcatcggatggacgccaagtgattgatcttatacctcccggtccagaacttcttgtttcagagggggaatcgatcaagcttgatcaaccattaacaagtaatcctaatgtgggagggtttggtcagggggatgcagaaatagtgcttcaggatccattacgcgttcaaggccttttgttcttcttcgcatccgttattttggcacaagtttttttggttctcaaaaagaaacagtttgaaaaggttcaattgtacgaaatgaatttctaggtcccgggatttcttaccatcaagttggtaaaaagccgcgatttattggcgattgctagaattctctatgatccattttggaaatcttttttttgtttagactattttttgtttgcgagatgtcttgtctgcaattccttatttctatcatctcatgcaaaacgaggagaatgcaaggcaagggcgagaacaataaaaggaacaaatccttttaggagggattgctggtcttcttaatcctctattgggcacaagaaaaaggcttttttgcctttttcttgtgtcgattcttcttgtatcgaaatatgaatcttttttcttcctattcggcaaagattactatttcttctttatttgggtctgtctcttgaacctcttttgcttaggttcaggcgatgtagtggacaaaaagagggaaagaaaatatggcgtgggacaaattttttgtgaccaaatagaattgcttgacttgttcaattaagttcaatttagaacttacagaaattttgcaaaaaaaacggatactcttccattgaaggctgttttttatttttaggctagttgagtagttttaattaaggttttattagtttattactctaaattaaatcaatgatttacaagagacttcctccggggaataaaatattggatcctcgattgatcctttctttctcctcgcttcataaaagtgaattaatttcattggcgagggggttataaatcaactgatggattact

SEQ ID NO: 26806 - DNA, 7095 bp, Oryza sativa
  unsure (1)..(7095): unsure at all n locations
ctctaatcagataaaaggggggccggacccgctaagtgcctattttttcatgtttacaacctggtccctgcaattactatggagatgaacccaatccagaatatgaaccgggaaagaaaacacctattaaaccaatcacagcaataccgggtacagtacctatcagccaaagaggaattcttccagtagtatcggccatttcccctactttcctccacattttatcaagtggtcatgctagagacaaaaacagtcatggatagttataaggatggtatccttccaaatggggataagagaattcttactactctctttctttctctcaattgaagaagtaattggaaaataaaacagcaagtacaaaaatgagtaataaaccccagtatagactggtacgattcaattcaacattttgttcattcgggtttgattgtgtcatagttctatagttggaatttggtttatcgttggatgaactgcattgctgatattgatcccaagaaaaaaacagtaggtacagctagtccgtgaacagccagccatcgcactgtaaaaataggataggttcgatctatggtcattgagggcctcctaaaaggatctactaaattcatcgagttgttctaaagaatcaaaacggtcggttattaacggaattccttgtcggctttctgtgaaatactcgtttggccgaggacttccaaacacgtcataagctaaacccgtactgacaaataaccaacccgcaatgaatagggaaggtatagtaatgctatgaataacccagtatcgaatactggtaataatatcagcaaaagaacgttctcccgtgcttccagacatgctgagctccccaaatttttgtacattcaaaaaaggaattgattccgtaaaagatgggatcaaccagtaaatagaaaattactgatatttcatccttgtgagattgtcaattttgtaccaaaggtgtattttgagtataccaaattagtatagctatcctttctatggcacagcaatcctgtttcgcttggtctcgaaacagaattctttttttctcttctttgttccttgtctatagggtaagctatatggtattcaaggcatcaatagaaaacctcaattttgagggtcctacttaattttcaccggcttcggaatagtagaataattcggaatagggctcaagatcttgggaaaatctaagttaatgatcaacaggtttggataaagaatttaggaaagatattcttatactgacacaatacaaagagaagtagatgcgaaagctatcccttcgaatccaacctttccccttaaagaatttaattggttagcataatataatatctaataaatagaaaatcaaatagtagataatctgttatgaaagagagaaaacattctttgaagaatcaagattcgtaatcaacccttgccttgtttactaactttcttgaccaaactgcaagcgtggaactttgccagttcttaggtttccgaaatagtgtaatggaaaaagaagtgcttcgaatcgactttgattggggttcgaaaaaggaattaaaaaaaagtaaattcaggaaagatttcctttttttaggagaccctcgaggggtcgtggaatgcttttcttctcctcttattccatatggaatacaatcaattaaaataagaaggaataggggaatattcgactgttcgctccaaaaagaaggttaaatcatcctattgaaaaagaccaaaatagaaagaactttttcaaattcaattctttatttttcactggggttagctgatctagttcttaatatttttactttactcaattgacagattacacagcaaatctcttgattcggaattagggactcatgccccatctgatgaatccattttcttttacacttctgtatctcactctatcttgttttttagtattatctaaaataaccgatgaattatgaattttccataacttaggtaagtgctttaccaacatatgtagtgtagtaaaaaaaatggaatttaaccctttcatgcttactataactagttatttcggttttctattggctgctttaactctaaccctaactctatttattggcttgaacaagatacgtcttatttgaaatgaattgaatgaataaggcagaaaagaaaaaatctctcttttggattcctggtattctacgcactaattaccaattctttttttcttggtcattgagattcgtggataatttagactactatttagggataaatcgtacctcttttttttatcccctcgaacaaatcgaaatgattgaagtttttctatttggaatcgtcttaggcctaattcctattactttagcgggattattcgtgactgcgtatttgcaatacagacgtggggatcagttggatctttgattgagtaatatttcttttttgattgccctcctctctggtctggaggaggtcaaattggaattgcaatttgttttgttaagttattttgccctgcttcgacataagatagatggaatcacgctctgtaggatttgaacctacgacatcgggttttggagacccgcgttctaccgaactgaactaagagcgctttcaaaaatcaaatccttttctactcctaatgtgtctcacgtacgtatagtatccacaaattcaagttatacccgctttaatcgacctcctcactactgcctataaagaagaaagaagtaataggtagggatgacaggatttgaacctgtgacattttgtacccaaaacaaacgcgctaccaagctgcgctacatcccttttccaaattgttgtacaatgtcattgtacacaattcctatcttgtttttcacatcctaattttcttgtctttttctatctatagagaatcctcgtgtcatttcttctttttggtctcatataatcaaggaatggtatatatctaaatccaatctaatttcacctataaaagaaagattactattccttggtaatctataggaagggattgtctttttcgtttttagttcggaatttcgcctaaacaaaagaaatacaaatgatcttgggcaataatatctgatcatatacgtattccaataaggaaggaggattttcaatgcgggatataaaaacatatctctctgtagcacccgtgctaagtactctatggtttggggctttagcaggtttattgatagaaattaatcgtttatttccagatgctttgtcattcccctttttttcattctagttgttgctatgtgaggaatagagttcttcgtgacatgataaaaaattcccacttttcaatccctttttagtataggaaagaaaaagaaagaaaagatagattgggttggaccttagagtcatgaaaaatttggtaaatctcatttttgaaaaaagaaattcaattaaaagcagtatccaagctaagtcaggcctcagaaatcagagcatagaaagaggctgggttggctactaaaatgaaaggattttgcttcaaaatccttgctaatttgacaaggattgtattccttaattatttctctattttttattacttaattgaaaaatttccaaaaatttttattctaatggattttcttcttcctcttcggtttcaaaatagaggaataaaagaataagtagaagaattaagttaagtcaatccaaaaaggaaaggaggttcatggccaaggggaaagatgttagaatcagagttattttgcaatgtgtgagttgtgttcgaaaaggggccaatgaggagtcggcagggatttctagatatagtactcaaaagaatcgccacaatacacccggacaattagaattaagaaaattttgtcgttattgtcgtaagcatacgattcatgccgaaataaagaaataggagcatcttgtgttcgatctttccaaagatcaaaaagaataagaacttcctatttaatatatagagcatagatagaatacaaaatacaaatcaacttgtctgatttccattagatattatttcatatgtatcgagggtattcatctaatatatggaccaaagagagactatttcttctggatccaaaattaataaaataaacaaatcaatttttttttcaattttaaaataaggaataaatcatgtatacatctaaacaaccctttcataaatccaaacaaacttttcataaatccaagcaaacttttcgtaaatccaagcaaacttttcgtaaattcaaacaaccttttcgcaaacccaaacaaccttttcgtaggcgtcctcggattggcccgggggatcgaattgattatagaaacatgagtttaattaatcgatttattagtgaacaaggaaaaatattatcgagacgaataaatagattaaccttgaaacaacaacgattaattactcttgctataaaacaggctcgtattttatctttcttaccatttcgtaactatgagaatgagaaacaatttcaagcccagtcaatttcaataattacaggtcctagacccagaaaaaatagacatattcctccattaacacaaaagttcaattccaatcgaaacttaagaaactccaaccagactttaagaaacaacaatcggaacttaagttccgattgttgatgttttattcgaaagggccagactatatataaagaaagtaatccaatttagattcttgggtttgttataagaaagaacaatggggaagaaaaaatagtttttttatttattgcaacatgctcgttgattcctaccacttaatcttaatttattgtatcttcccggagttacctctccgggaattcttttttaattattcctgtatattacttttttatccctttaattgataatctttattttattggaaatcgtgtaaagattatttgaatntaatacagctacttgtgcaaggattntacgattaagaatcaattctttcttggtaagatngtgtattaatttactnataatatcgaatactttatgtatncgcgttgctgcgttatccgactgatccacanacgccgaanatcccctctttgctgactctatctcgatgagaggaaacaaacgctcttcttacctgttgagtaatcattcgattaagtcttaaatgagcccctctaaagtttgaggcaaatgaacgcatttttgcccgtcgtctccgagctatatatcctcgcggaactctggtcattgaatcaaattaaccttaatgaataactaatgatttctcttcttttagccatcctttttcccattaataacaaaacgaattattcccatatataaaatattagttccaatggcttttgctactataaccttcccaaccacaattttctcttctactcccttcagttatttcgcacgatactaaaaaatagtgggttccatcgtttctatggttcccttttaaacggcgaggccctctctatacaccggagccctttctttcatttcatcaaagggtattgtgaacttgtatagttcacattctttggctctacctatccattatagagtaaatagctcttttcacaataagagttatccatacagtgacggcatttaattatgaaagttggctaagtagctgaccctcttagtccgtttttttaagataaaggagcataagcctttatctttttattactatttcctccgcttaatgaatagccgtttgctaccaatgggggaattgcttcttatttccaatctagatgattggatttgcaccaaaggaaaccagaaattccatataccgtagaaatctaggatagagaagctctatcctattcattggtaccgatcatggatacttcaaaaatgtcttatttgtttgaacccatgatccgaacgagtcgcacatacaccctagcacatgttcctcgacgctgaggacatcccttaagcgcggccgattttctagcatttcgtattggctgtcttgcgtttctaataagttgtttaaccgttggcatgtcgtatgtatatagaaaaaatggattggtttagatcgatcttaacctgaatgattgatcattatgaagtatttccattaaattgcataaaacccgaatttagggttgaaataaatttacaagaaatctggccactaccaatccttaaacatttctggaaaccacactggatcagtatcgcagtgctcgtcaagcatttcatcccctacaatatcgacaagtccataagctttggcttcgtctgctgacataaaaacatccctttccatgtcttcggatacaacccaaaaaggcttgcctgttcttagtgcataaacccttgtgatcatttcgcgaactttgtgtaactcttccacttctagtaaaaattctggtgttcttgcccgataataagcactagcaggttggtgaagcataatcctcgcgtgggggaatgctatacgcttggtgggttctcctccaagcagaatgaaggacgccatggacgcggctattccgaggcatattgtatatatatctggtgtcaccgtttgcatcgtatcaaaaatcgccattcctgagattaaccacccgccgggggagtttataaacaaaaaaatatcgctaattccatcttctatactgagatataccatgagacctgtaatatgattcgtgacctcgcaacgaatctcttgacctaaaaaaagtgtcctttctcgatacataacattgtataagtcaacccaagtcgcttcttcatctccgggaatccggtaaggtacttttggaacaccaatgggcatattagattaatattattaaatttaagtaagaaaactacactttaatatggaaacgtaagaatggaagagaaagaaagaatccgcagtttattgttttcactttttttcttattctatatgaatactatagattctattaatacgtagattgaaataatacatagattgaaagattatacatataagtaggataagacagattgcataaagaaaaaagaatgggtgattcgaatactaaacaaaaagagatagggatctattgttggttttttccaaataagccgagctgcccattgcat

SEQ ID NO: 26807 - DNA, 2494 bp, Oryza sativa
catttcagttggaaaatgcagtcggatgtttggggtactataagtgatcaaggggtggtaactcatatcacagggggaaactttgcacagagttccattacgattaatgggtggctccgagatttcttgtgggcacaggcatcccaagtaattcaatcagttcttgccaataaccacggccgctgaataaaaacattaaactgaaggcccagacaaaatgagcacctaagaaaaaaagaccatatgcggataatgaagaaccataagattgttttcactttttttcttattctatatgaatactatagattctattaatacgtagattgaaataatacatagattgaaagattatacatataagtaggataagacagattgaataaagaaaaaagaatgggtgattcgaatactaaacaaaaagagatagggatctattcttcgttttttccaaataagccaagctgcccattgcatattggcacttatcgagtatagaatagatctgcttctctttcttcttacgaacagaattggcttcttatttttaatggaatgaaataaatattcacgctttctgacacagaatcccctagaagggttaggtacataggatatggatagtctttgccaatgcgataaaataaagtgacatcgtgtctatttttctttgctaaaggggtatttccatgggtttgccttggtatcgtgttcatactgtcgtattgaatgatccgggtcgattgctttcggtgcatataatgcacacagctctagtttctggttgggctggctcgatggctttatacgaattagcggtttttgatccctctgatcctgttctggatccaatgtggagacaaggtatgttcgtcattcctttcatgactcgtttaggaataaccaattcgtggggtggttggagtatttcaggaggaactgtacgaatccgggtatttggagttatgaaggcgtggcaggggcgcatattgtgttttctggcttgtgtttcttggcagctatctggcattgggtatattgggacctcgaaatattctgtgatgagcggacgggaaaaccttctttggatttgcccaagatctttggaattcatttatttcttgcaggggtggcttgctttggctttggcgcatttcatgtaacgggtttgtatggtcctgggatatgggtgtctgatccttatggactaactggaaaagtacaagctgtaaatccggcgtggggtgcagaaggttttgatccttttgttccggggggaatagcttctcatcatattgctgcgggtacattgggcatattagcgggcctattccatcttagtgtccgtccacctcaacgtctatacaaaggattacgtatgggcaatattgaaactgtactttccagtagtatcgctgctgttttttttgcagctttcgtagttgccggaactatgtggtatgggtcagcaactaccccaattgaattgtttgggcctactcgttatcagtgggatcagggatactttcagcaagaaatatatcgaagagttagtgatgggttagccgaaaatctcagtttatcagaagcttggtctaaaattcccgaaaaattagccttttatgattatattggtaataatccggcaaaggggggattattcagagcaggctcaatggacaatggggatggaatagctgttggatggttaggacatcctatctttagagataaagaagggcgcgaactttttgtacgccgtatgcctactttttttgaaacatttccggttgttttggtagatgaagagggaattgtgagagcggacgttccttttagaagagcagaatccaaatatagtgttgaacaagtaggcgtaacggtggagttctatggtggcgaacttaatggagtaagttattctgatcctgctactgtaaaaaaatatgcgaggcgttcccaattaggggaaatttttgaattagatcgggctactttgaaatcagatggtgtttttcgcagcagtccaaggggttggttcacttttggtcatgctacctttgctttgctcttctttttcggacacatttggcatggggctagaaccttgttccgagatgtttttgctggtattgatccagacttggatgctcaagtggaatttggaacattccaaaaagtcggagatccaactacgaggagacagccagtctgaggccgcattgctttggtatctttcacctctcttttttgatttgacatgggaaacatctcccatcccttctttgactctttttccttttttatacgggaaatgatcccaaatgacaaatgaataggtgtggaagttataattgtaaataaaccacgatcgaatctatggaagcattggtttatacgttccttttagtttcgactttagggataatttttttcgctatcttcttccgagaaccacctaaggttccgactaaaaaagtgaaataatttaatt

SEQ ID NO: 26808 - DNA, 1807 bp, Oryza sativa
  unsure (1)..(1807): unsure at all n locations
ccgtgttcttcgaatggatctcttaattgttagagggttgcccaaacgcggtatataaggcatacccagtaaagcttaaaagtaaaccagatatggagatggcgactaaagttgctgtttccatttttatagaatttcaagattacaatggatctacgaaaagatcgtgtatttacaactacaacggaatagtatacaaagtcaacacaaatcattaaatggaatttatggctacacaaaccgttgaagatagttctagacctggaccaagacaaactcgcgtaggtaatttattgaaacccttgaattcggaatatgggaaagtagctccgggttgggggactactccttttatgggggtcgcaatggctttattcgcggtattcctatctattattttagaaatttataattcttccgttttactggacggaattttaatgaattaggtttctactaacgaaaactacgaagtcatagtttttccatccaaaagagcctttctactttaagctctacatttctagacattctggtagttcgaccgtggaattttttggtttcggtatctctggaatatgagtgtgtgacttgttagaatttgctcctattgataatacatagaaagcacctgttatctctatcaagatgattctaattcgtcggatattatttattctagtatctggaacacgaaatagatagagtggatcaagaaaaaaaaatgaaactatgattcatattaactattcagacctcgcaaccagactgaaaaaaattcaagtagttcttaataaaaataaaaaaagaaaatttcttccttccaattttgtttgcccaaaaaacaactttttttctctcgattttgtcgagtcattacaccgattcaataaatgatcatcaagcggttcttattcgaagaacccttgccttttgtttagctggagactcaatcatcgtggctctagtatgaatctaaggttntaattgaactgattcataggatcgcaacaagataatttctaccagaaaactactccaattttgctttatttattatctagtaaacaagagtaatctgcttacgcacaaaaaaagaaatccaaattagggaagagaaaatcaagaggcctctaatgatcaacatttggaaagaaagaagacgagccaccttgagattttttggcattatcatcacaaagaagaaattctggatttttcttatttcatatcttcaaggcaaatcgacccaacccagtggctgatgaagttttgaaccttttttctaatatccgttgaaaatttgtgtgtttctgtttgagccgtacgagatgaaattctcatatacggttctcggaggggggttcgggttagttacctatctcaataaagtatatgattggtttgaggaacgtcttgagattcaggcaattgcagatgatataactagtaaatatgttcctcctcatgtcaacatattttattgtttagggggaattacacttacttgttttctagtacaagttgctaccggttttgctatgactttttactatcgcccaaccgttacagaggctttttcctcggttcaatacataatgaccgaggccaactttggttggttaatccgatcagttcatcgatggtcagcaagtatgatggttctaatgatgatcctgcacgtatttcgtgtgtatctcacaggtgggtttaaaaaaccccgcgaattaacttgggtcactggtgtggttttagctgtattaactgcatcgtttggtgtaactggttattctttaccttgggatca

SEQ ID NO: 26809 - DNA, 9871 bp, Oryza sativa
acctttgtacttcctctgcttactgccgtatttatgttaatgcactttctaatgatacgtaagcaaggtatttcgggccctttataaggaaggcatctcatagagagttctaattctcatatatcatatcgggtaggttgtggtatttcattgctacaaacatgggttattctaaaataagacatgtcatttagatacttctcttcaactccgaactattgtgatacaaataatacaaatagttgaagttaattttacgaaagaaaagaaggcggattatgggagtgtgcgacttgaattattgatttggccatgcagatagagagttggatctgccacattagaattcacgaccaaaggtgtctccatatccaatcaacacgtaagtcccctgtctagtaaggataggctggttcacttgaggagaatattttctatgatcatacctcaaccatgtcatccatgaagaggctccgtaagatcccatagagtagaaatggaataagtcatgtgacatgatccaattctctatttattacacttactttttattatagtatggaaatgcattcattttctttgcatcgattgcgatctgcaatactatcggagtaaaagaagggatctaaggaagaacgtaggctaaactttttgattttttattagtaacaagtaaatactttgtttggacgtaagaaacttgcaatattgggggggataaataccaactaatcaagagacgcgagacaatccacaaagcaattgatcatgatcaaatttgtaagcccacttggatattgagcatttacccataagagtaggattcttttcaatgaatagttgtaggtgcaacttcggaaaatagaatctgataaagcttttcttacttagagccattgagccattatataccttattctattatggatcttctacggttttatttctttcattcttgctcgagccggatgatgaaaaattctcatgtccggttcctttgggggctggatcttaaagaattcacctatcccaataacaaagaaacctgacttaaacgatcctgtattaagagcaaaattagctaaagggatgggacataattattacggggaacccgcgtggcccaacgatcttttatatattttcccagtagtaattctaggtactattgcatgtaatgtagggttagcgggtctcgagccgtcaatgattggtgaaccgccggatccggttgcaacttctctggaaatattacccgagtggtactttctttcccgtgtttcaaatactccgtacagtacctaataagttattgggcgttctcttaatggtttctgtgccgacgggcttattgacagtaccttttctagagaatgtcaataaattccaaaatccatttcgtcgcccagtagctacaaccgtttttttaatcggtactgcagtagctctttggttaggtattggagcaacattacccattgaaaaatccttaactttaggtcttttttagggatttttcagtttgattcattcaatcgtgaagtaccgtgcataggtatctaggaaatagttacttccaagtgaatcttccctagatacctataatctattttattatgatccatttcgcgaaaatatagattgtcccaaagatgcaaaattgttttattttttctttttattctaactcgaaaaagaagaagaggaaaaaattgcaatggatttaaaactagaacttattcttaggtaaatccattgggagatgcttctctagagtgtcccatatctgttttccatcttgcatacgaaaactgtcaattctcatcagatcttcttccgtcttactcaaaaggtccaatagtgtatggatattggcccttttgagacaattatacgttctagaaggcagttctaattgatcaataaaaatacaattcaatggaattctttttttgtttttctttagattagttaatcttttttgaaagcttaaaaggggggaagtaaacctgtttttattttcttggaaacgagtaccctcttcctccgtgtgaagaaaaggaagaaataaatcaatcaaattacgagaagcctcataaagcgcttccttaggggttaaacttccattggtccatatttctagaaaaagtatctcatattttgcatttccattcccacaagcaaaaatactataattcacatttcgaacaggcatggatacagcatctataggataacttccatcttgagtgttctttctgacttccgtgtgatatccgcgatctctcttgatccgtaactcaatacggaaatccgtgggttctgtcaagttagctataggttgtgccgtatcaacgatttctacggaaggcggtaagataatatcttgggcagttatgtatctaggacctttgacgcaaattgatgcggttctaactccatagagattacttctcaatacaatttctttcaaatttagtaaaatttcttgtaccgattcttcaatacctgctattgtagaatattcgtgcggcacgctcccaaattttgcatgtgtgatacatgttccttctgtttctccaagtaaagctcttcgcaaggcaataccaacggtatccgcttgaccttttctaagcggggacagaatgaaacgaccataataaagacgcttactatctactcttgattcaacacacttccactgtagtgtttgagtggatcctgctacctcctctcgaaccatatagactagtattattatttgatcattgaatcgtttatttctcttgaaaggggtttaattcttttacagacgtctttttttaggaggtcgacacccattatgcggcataggtgttacatcgcgtatacaacttaatcgtacaccacttttagcaatggctagtaatgcggcatctcttccactaccagcaccctttaccataacttctgctcgttgcaaacccactgtacgaatagcatctacagctgttctttgaccagcatagggtgatgcttttcttgagcttttgaatccacaagtacccgcggaggaccagaaaaccacccgaccttgcggatctgtaacagttataatagtattgttgaaactagcttgaacatgaataactccttttgttattctacgtgcactcttccgtaaactaaaacgcgcattcctacgcaaaccaatacgtactttcctacgtgaaccaatttttggtatagcttttgtcatattttattatctcataaatatgagttagaaataacaaaaagaaaaaaagatacaaagatatccgtttcagggtaaaatatatcctttacttgaatttttttatttggaatttggacattttcgcgggtacttttttttttactttttagaaagtcaagttcttttttcgaaagattacccctgtctttgtttatgcttcggattggaacaaatgactctaattcgtccacgcctacgaatcagtcgacattttgtacaaattttacgaacagaagctcttattttcatatttccgtattcctttcttaaactatgaatttactcttttggaaaaaataagtctctttgtttgaattttagaactttgaattttttaccctagaaaaaaaaaagaaaaacctaaccctttgaatctttggtatccttcaaatcttcggtatccttcgagtcttcggtacgcttcgaatccttatggggaagtctataaattatacgccccttgcttgaatcataacgacttacttcaattttgaccctatcccccatcagtattcgtatagaactagaccggatctttcctgaaatatagcccaggatgatggtgtcattctctaggcgaacgcggaacattccgttgggtagggcttccataactaaaccctcgaaagtaatttttgcttctctcgggttttttttttctctcctatttttcttttctgtcatatttttttttctcctatttttctttttttattttcaaataaaaaaacgttgtatttttgtttgaaaaataggaagttcaagatagaatttgggtactataactataggtggggcgattaccgctataggcggggcgattaccatatataacataagacttctcccccaattctgtttagtcgagcttctcgatctgtcattatacctcgagaagtagaaagaatagcaattcccattccgcccaaaaccttaggaattccttgatagttggcataaattcgtaagccaggtcggctgatacgctttaaaaaggttctagttctatatattccctttctagtctttctcttttgatgtcgcaaagttgaaaccaagaaatatctgttactttcctgatgtttccgaacactttcaataaaaccctctcgtagaagtattttaacaatgttttcggtaatatttgtagatactacccgaacagttccttttttattcatgtccgcgtttcttatagaggttagtaaatcagcaatagtgtccttgccataagactctaattctaggttcctcctaatttttctataatcaacatgttctcttttttcttttcgttttggattctaaagcatatacgtgaaacacaatctactaattttttatttgatctatatcttgtctactagtatttataatacttcaggagctaatgaaactattttagtaaaattcaattctctcaattcctcggcgatcgcgccaaaaacgcgagttccttttggatttcctttttgatcaatgataaccgctgcattgtcgtcatagcgtattattataccgtcttcgcatttgaactctttacatgtacgtacaattacagctcgaattacttcggatctttctagaggcatttggggcactgcgtctttgattacagcaacaataacatcaccaatacgagcatatcgctgattactagcagctcctatgactcgaatacacatcaattttcgagctccactgttatctgctacatttaaaagggtctgaggttgaatcatattattttgatttcaatttgttatttcaatgcaaaaggatgaaagaaatattgtctttccagaaagaagaacctggttttttattttcaatactactttttttggggggttatatttctaaccgaagaaattgacttcgtatgggcattttgctggcagctatggaaatagctgctctagctacagtttcggatactccgcccatttcataaagtattcgacctggtttaacaacggctacccaatattcgggggatccctttcccgaacccatacgtgtttcggtcggtcttattgtaaccggtttgtcgggaaatatacgtacccagatttttccaccacgacgtgcatatcgtgtcattgctcttcgtcctgcttctatctgcctcgccgtaatccaagtgggttcaagtgcttgaagagcatatctaccaaaacaaatacaattgcctcggtaggattttcccttcattcttcctctatgttgtttacgaaatctggttcttttggggttatagtcgatggttctctcttagttccatctctactgcaaaactggacatgagagtttcttctcatccagctcctcgcgaatcaaatgagaaagtgtgcaaatttctctaattccacaatattctaaaatattacggatagatacacattaataggaaaggttagggtttttaatattgaatttattaaaatactaaaatatatagtcaagaaagaggatctagaatatatctagatgtgtatgtttatttatctatattctatatttaatgtaattctttttttttttttttttaatctcctttttttattttactcttattgaatcgcggtaaagtattctaattcaataaaaatttcgcgggcgaatatttactctttcctgtcttatttgttaattcataaccttatcaaataagacaatttttttggtttgttccgccatcccacccaatgaagtattgggattcttttcaagaaaatcctatccagtcataggttctgtcgttcccactgcttctcctttaatggttaggtttgaatctcgcaatggagcttccaaaaaatttctttccgagtcaatttctcagttttattaactcgggacgctctttgttattccttgaaatttgtatttcttgtttcaatcaaattacgatttcgaattctctgttatttttattatattgatgctttatcacattgctttttatgatgtaattcatagaccatacatattggaatcctatatctttcttatttctcttccttctttctatcatccttccttttatctacatcccctttagttttgcttcacaacttagaatcctatttttttttaaagaaaaaattgcagttgctacacgtatatgatagatttactcatttatgatagatgtatttattcatatagtgactgtttcttagttaggatctcgacaatacgaagcaataggttggttattagttcattttctataattacatagtagggttcattctatttttttttaatcccctttttgaaccctaaaaaaaaactaacgagtcacacactaagcatagcaattttattaaaagatttctcaattttcattaaatcttatagaaagaggtagaatttcttctttttttcagggattttagggaaaataaggctcttgtcattttttattctattactgaacagaatgggaagacagggttggttattcttcgtctacgaatatccaaattttaactcctaatactccatagatagttcgaattggatagcagcaataatcaattttagcgcgaattgtttggaggggaagtctaccttttttgatgcactcggcacgcgcaatttcttttcccgcgagacggcctgcaatttttacttttactccctttatatctgtttttttagttaattcaatggcttttttcattgccttacggaatgaaactctattttttaattggaaagctatatattctgcaagaatgttaggttgtctataaggttctttcactttttcgatcccaatattaagtctctggtttacagaattaacttctttttgtagatctttctctaattcttcgattgctccttttttctttaataaattggggaatccaatatggattatgacgtggattgtatcgatttctttttgaatttctatatgtgtaattacttcggaacttgagcctgagtccatttttttattatgtgtaattacttcgaaacttgagtctgcttctatttttctattcgagccctttttcctattcttttgtatatagttcttgatacaattccgtatttttttatcttcctgtagaccttcagaataattttttggttgtgcgaaccaaaaggaatggtgattttgggttgtaccaagtctgaaaccaagtggatttattttttgtcccatatttttctattctattttttttaccgggaatcaaatcttagatggatctaaagattatttcgatttctttactatatttagtacaattgttatatgacacatggttttttttatgggagaactacgtcctcgagcccgaggtctgaatttattcataatagtactcctactgacttcggctttagtgatgaataaatttgctttgtcgaaatccctataatgagtagcatttgctgctgccgaataaaccaactttaagatgggataagatgctcgataaggcatgaggttcaatatcataacagtttcttcgtagtaacgccaacgaatctcatccagaactctttgtactttgaaaacggacatgtggatgcgtttttgtgctttgaaaacccgttcgaacttaagtagacgatcggttggtacttttcttgcgagtttccttagcccactcttcttcttctttatcctaggggtatactttaccagtttgaaacttgtcataaataaggttattccccgcttacctatttcttttttttttattttgaatctttctattctgaattcagttaacgacgagatttagtatcctttcttgcactttcataactcgtgaaatgccgagttggtacgaattcccccaatttgcgacctaccataggatttgttatgtaaataggtatatgttcctttccattatgaatcgcgattgtatggccaaccattgcgggtagaatgctagatgcccgggaccacgttactattgtttctttctcctccttcatattgaccttttctatttttgccaataaatgatgagctacaaaaggattcgttttttttcgtgtcacagctgattactcctttttttccattttaaagagtggcattcgatgtccaatatctcgatcgaagtatggaggtcagaataaatagaataatgatgaatggaaaaaagagaaaatcctttagctggataaggggcggatgtagccaagtggatcaaggcagtggattgtgaatccaccatgcgcgggttcaattcccgtcgttcgcccatcccattattgcaaattccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccgcccccatgggggtggtccacagggttcataactacccctcttactacggggcgtttacctagccaacacttagacccggctctacccaaacttttttggttcaccccaacattacccacttgtccgactgttgctaagcagttttgggataccaaacggacctccccagatggtaatcttaaagtggccgatttaccttcttttgcaatcagtttcgctacagcacctgctgctctagctaattgcccaccccttccacgtgtgatttctatgttatgtatggccgtgcctaagggcatatcggttgaagtagattcttcttttctctcaaaaaaccccttcccaaactgtacaagcttcttccaaagcatacggctttctagatgtatatgacgatctctagacagatggatcttatatgaatcgtatgatgaagtaccacatgagtggatatataggaaaggaatccaaatctgccgaatcgctcatgttatgatcttctacatcctaggtctccgcgttccgtcatctggcttatgttcttcatgtagcattcagatcgaatgactctatgaaattacgtcgatacttctacatattatgggtaacgtaggagacatccctattttcccccgggggtcttaattaccactgcttagctttcaattcgcctctgaccatcaaattaaatgtgaataacccgtcctcctctctttgaaacaaggggcgcttccggttctgtgcgtgcttcaaacaattttgtcttctccatattaccatatctctagagtcaataattttctatgaggaactactgaactcaatcacttgctgccgttactcaacagttttctgttgaggtctatcccgtagaggtagtcaaattggatcagtgatcgatttctaggtttcgtcgtaaacctaattggttacttccaattacgtaaatcaatagttcaaaccgcactcaaaggtaggccatttcccattgatataggaacttttgtaccagaaacaatagtatctccaattatagcccctctgggatgtaaaatatatcccttctcaccatccccatagtgtatgagacaaatgtacgcatttcgattagggtcgtattctatgggtacgattctaccagatatgtctttttgattccgtcgaaa

SEQ ID NO: 26810 - DNA, 883 bp, Oryza sativa
cctcagaagatagaggagagcgccaggcgcagatttccggaatacttctacggggaatgctcattgaatgcgcattctccgtattatgccttgaagaggactcgaacctccacgctctttagcacgagattttgagtctcgcgtgtctaccatttcaccatcaaggcatcttgaaagtgaatcatattccatgaatatgatatctatctaatgtgatatcttgaaagtgaatcgtattccatgaatatgatatctatctaatgtgatatatggaatatatgacaaaggtggagtcttggagtatttcgatcgatcggtcatataggcctgagtcagacatcaaatagcttcgatttgcattatccgtaggacaccttatatgtatcaaaatcaaaaagatgtacaatccaatttctcgattcaatagaagcccaaagaggtgcatatggtacccaaataaggataggatagatatgtcaaaagcaggtctgattacacctattcctaatcctaaatagaatgtaaggacgtggggatttctatgtaaacagagtatcctatttccataggctcgaatgaccccttctcataataagaatgtgcacggtctggtccggtatggaatgaacttataatctgatgatcgagtcgattccatgattataagttcattaccctagcgcccattcccattttgggcggaacagatctactaattcttttattccagttagtaagagggatcttgaactaagaaatagacctagcagctaaaagagggtatcctgagcaattgcaagaatggggttcattgatattcctggtatagtagatgctatcacacatacagtcatactcaattcgatggaattgtttgatctta

SEQ ID NO: 26811 - DNA, 2077 bp, Oryza sativa
gctgaagctgaagcagcaactttcgaagtaacagaaagaaaagcaacgactggagtgggggagtcagagtcgaaaagaggattcctcgcttctttctctcatgcaaaaccgtgcatgagactttcatctcgcacggcttctaagtgataaaagaaagaagaacttgtcttctttcttttttgattaccttcctcgcgtatgtataagaccgaatccattctttttcgaaatcgatttcgaaaaagaactactaatccttaacttttcgaggaatccttcatcagtggttgtgaatgactgactttttcaatcctttcgaccttggttccgtaggagcaagtcagaaaggttgagaaatagaaccatctgatttgattcgttcccaatagccatgagatgatcatcttagggtgatccttttgtcaacggatgctcctattacactcgtagtctctgaaggatgagaacccactatgtagcatctacgtcgataattcaagcattgtatacgtcattagtccgattctttgtaggaactacccgtaataacgagcttgcaaaatggatctgtttatcataaagagattcgttgttcctgaccctgcttcaccttaattgttatttgaacaaaaagatcacaataaacttttggtaaaagttctgtcttggtcggagtggggatagcatttctcttctgcatatctatggagttttgcaaaacccaaacacctcagagatagatatagaggtaggaatttgtcgaacgaaccacactccttcgtagacgtcaggagtccattgatgaaaaggggctggggaaagcttgaacccaagtcctacagtgatggatataagcgcaattgaaattcctggggagttatacatttgtgtattgataagaccgttcacaatttcttgaagctcgatctcccccccagatgaaccatatagccaagagaaaccatgaaccagaatagaagagcttgccccacccatgagtaaatatttcatagtagcctcattagaccgtagatctctcttggtatatccagacaataggtaggaacataaactgaaacattctggagctacaaagatagttattaaatcgttagcaccacataaaaacattccccctagagtagctgttaatacgaataacagaaactctgttatagccatttctgtacattcaatgtactctacggatagaggaatacataaagttgaacataataaaataagaaattgaaagatttcgttgaaattgttcgtttggaaatttcccgaaaagctaattataggttcttctctccatcggaacaatagggccgttatgcttattactaaacttgttgaagagatgaaatagaaccaaggtctatctttttgatcagaggttaaatcgatcatcagaagaagaattaggccaaaaattaggatacattctgggaaaatgaaacttccctggaagagaagcaaatgaaacgctttcataaaaattctcgtagaatcgagaatgaagttttcattctgtacatgccagatcatgaattagtaactgcatccaatctccgaaaagtcccgattgtttcgatttttggaatgggatatttacggaatccccatgaataggatcaaaccttattccatgctatttccataagattcctctttcttattcttaagcaagcccccgagagggcttagttgatcatgatttctgttttctctttcttttcctttttgtttgtttcgagaaagatatcgtccgattctccttctattgattcttttccgatcgagatgtatggatccatgtgtctacatacctagattctgttcatggattaacgaaaatgtgcaagagctctatttgcctctgccattctatgagtcgcttcctttctgcgtatggcacccccaccccctttggcagcatctactaatttcgaacttaatttgacagccatatttcaacccggacgcttttgggatgcttctaataaccaacgaatggcaagtgctcttccttgtttagatcctatttcaatcggaactttccgcgtcgatcctt

SEQ ID NO: 26812 - DNA, 1183 bp, Oryza sativa
cgctcttcaagtgtgcttcttccccttctcccccttaccatggcaagtccttgggaaataactccgatgggcagaaaaaggaaggcgttaagagaccctcctggcccaaccctagacactctaagatcctttttcaaacctgctctgctcccatttcgagtcaagagatagataaatagccacatcccattgcactgatcgagggcgctcgtagtgacttagggagtcgaagaccaagaagtggcttatttataccaagcattcctcttatggctagatccaacctcctggtccctgcggaaaggaaaaagaatttcacgttcttcctttcaggaagggaggattagggaagtcctattgattgctgctttctccagaccgccgggaaaagcatgaaaaaaaggctcgaatggtacgatccctccgtcaccccagaatgaaagggtgatctcgtagttcttggtctgtgaagatgcgttgttaggtgctccattttcccattgaggacgaacctcaacctgtgctcgagagatagctctccatacactgataagggatgtatggattctcgagaagagaggagccgtagtgccccccccggaccgcccggatcccacgagtgaatagaaagttagatctacatgggatctcacctgaatcgccccatctatcctcctgaggagaagtttgtttggtttcaaactccgattcaaacaggaggagtacgccatgctaatgtgccttggatgatccacatcttcgggtcaggcgctgatgagcacattgaactatccatgtggctgagagccctcacagcccaggcacaacgacgcaattatcaggggcgcgctctaccactgagctaatagcccgtcgcgcgggcctccctttgggaggcctgctacgccaaaagcgagaaaaactccatccctttccttttgacatccccatgccgccacaccacacgggggggggcatggggacgtcaaaaaggggatcctatcactatcaactaatttgttccgacctaggataataagctcatgagcttggtcttacttcaccctaaacgaaagaagacttccatatccaagtttagctcagacgtagctgccttctttttgggcgtgaagcagtgtcaaaccaaaatacccaataagcataagcattagctctccctgaa

SEQ ID NO: 26813 - DNA, 1039 bp, Oryza sativa
ttcctttcttcaaaaattgctatatgttagcagaaaagccttatccattaagagatggaacttcaagagcagctaggtctagagggaagttgtgagcattacgttcgtgcattacttccataccaagattagcacggttgatgatatcagcccaagtattaataacgcgaccttggctatcaactacagattggttgaaattgaatccgtttagattgaaagccatagtactaatacctaaagcagtgaaccaaatccctactacaggccaagcagccaagaagaagtgtaaagaacgagagttgttaaaactagcatattggaagattaatcggccaaaataaccatgagcggccacaatattataagtttcttcctcttgaccaaatctgtaaccctcattagcagattcgttttcagtggtttccctgatcaaactagaggttaccaaggaaccatgcatagcactgaatagggaaccgccgaatacaccagctacacctaacatgtgaaatggatgcataaggatgttatgctctgcctggaatacaatcataaagttgaaagtaccagatattcctaaaggcataccatcagagaaacttccttgaccaatagggtaaatcaagaaaacagcagtagcagctgcaacaggagctgaatatgcaacagcaatccaaggacgcatacccagacggaaactcagttcccactcacgacccatataacaagctacaccaagtaagaagtgtagaacaattagctcataaggaccaccattgtataaccactcatcaacagatgcagcttcccaaattgggtaaaagtgcaatccgatcgccgcagaagtaggaataatggcaccagagataatattgtttccgtaaagtaaagaaccagaaacaggctcacgaataccatcaatatctactggaggggcagcgatgaaggcgataataaatacagaagttgcggtcaataaggtagggatcatcaaaacaccgaaccatccgatgtaaagacggttttcggtgctagt

SEQ ID NO: 26814 - DNA, 694 bp, Oryza sativa
aaagtatgttggtcttgcagaaactattaggggatttcaactaatcctttccggagaattagacggcctacccgaacaggctttttatttggtgggtaacatcgatgaagctagcacgaaagctataaacttagaagaggagaacaaattgaagaaatgaaattaaatctttatgtactgactcctaagcgaattatttgggattgtgaagtgaaagaaatcattttatctactaatagtggccaaattggcgtattaccaaaccacgcccccattaacacagctgtagatatgggtcccttgagaatacgcctcctcaacgatcaatggttaacggcggttctgtggagcggttttgccagaatagttaataatgagatcatcattttaggaaatgatgcggaactgggtagtgacattgatccggaagaagctcaacaggcacttgaaatagccgaagctaacgtgagtagagctgagggtacgaaagaattggttgaagcgaaggtagctctcagacgagctaggatacgagtcgaggctgttaattggattcccccatctaattgaagacaacccaacggtttagttgatacaaagaaaaagggaagaggggtagaaaaaattattagatagcgaagcgaagtagggccaatgctatctagtaatttttctacctacctacctactattg

SEQ ID NO: 26815 - DNA, 1192 bp, Oryza sativa
cttttttagattttaggagagatatcctacgtttcctttagtataggtttcatttccctattagtacttgtttatagactggacaggcgcctgcgccataaaatagagataaaaggattaccagaggctcattcatcgaaaattatagagacaggaaaagaaaaatgaatttctatcaaatcaactgcaagatgttctccatcttgcaaattcctactttgtttgaagtatattactttgcttatctatatctatagattacctaaatctaaatcaatctacgttctgaaatagagttctttatttttatagaattactcctcattaggctgcatacattagtcatcctatcttaattaggctctaattcgtagtattttcgtttttattcctttttctagagattctagagaaaatgagacaaagtgaagcgagagagttttgtttctataagaattatgtctccaccatacctaaatagaaaggaaatcaaaaagaaagggggtcgggattccattggatgaatctttaaagaagacgtggcaaagaggaaacaaaggctaaactaagccctttggtttgagaaaaaccgatccttgtttcaccgaggaaaagagagaaattctgtataaattgacaatgctgacttgaattgactaattcagttccgcctattccacattaatgggagtacatttatgtttctgcttcacgaatatgatattttttgggcatttctaataatagcaagccttattcctattttagcattttggatttcagcacttttagctccggttcgtgaaggaccagagaagctttctagttatgaatcgggtatagaacccatggggggggcttggttacaattccgaatacgctattacatgtttgcgctagtttttgttgtttttgatgtggaaacggtctttctctacccttgggcaatgagtttcgacgtattgggtatatccgtttttatcgaagctttcattttcgtgcttatcctagttgttggtttagtttatgcatggcgaaaaggagccttggaatggtcttaactgaatattcagacaaaaaaaaaaaagaaggaaaagattccattaagacagttatgagtttgattgagtttcccctacttgaccaaacaagttccaattccgttatttcaactacactaaaagatctttcg

SEQ ID NO: 26816 - DNA, 1087 bp, Oryza sativa
tactaagcaagttcgaacgaattgactattcgtatgataaattctttgagttaacttgctattttcatgagaaataaaattgacaagtcgaagttggagattaccctcttcctgcaagagatcctgtgggaaaagtgttgctaaatttctcccttcgttcatttcatacgcgactgcaggtcgaaccaaaacaaaatacttttccttgctcttgagaatttttttccactgaacatagacccaattttcccttttttttgattccttcgaatcttttttttctctttctagtggtatcaaactgccacctaatatcttatccgcctcttcaggaaaatgaatatctccagaaaagatttttagttccgtatggcttttttttctcttcactcgaaccaatccacccagccgacttcttgtattttttgtgaggtgtgtatccactccaataatactattgtcaagtacctttagggatgaggatctcggcaagatatgcagttcttgaagaatgaaaaaaaaccgatctacttctttttggtattttagactaaattcttttgttcctcgatgctcaatcaaaacccccttttttaagacggaatcttcctccgggttcccatattcgtcctctgagtcttcctctgagtcttcctctaaagtcccatgttcgtcctctgagtcttcctctaaagtgccatatttatcctctcggggcctatatttgttctctggactcccatattcgtcctcggattcctcctctcgagtcctatattcgtcctctaggattccatattcatcttctagggtttcatattcgttctctgggatcccatattcatcttctagggtttcatactcctcctctcgagtcctatattcgtcttctagggttttacattcttcctctcgggtcctatattcgttttctgggctcccgtattcgttctctgagtctttctctcgagtcctatattcgtcctctagggtcctatatctaaatttaacaattcctgaaccctttttatcttttttgtatcgtgggtcgtcaaaataagcaactatagtatttctacgtaaaaca

SEQ ID NO: 26817 - DNA, 4537 bp, Oryza sativa
agtataattcgacaattgctgagtaggattcgacaatgggcctgagtcagtgattcgaaaacttagttaacttcctttcctcaatctcaatctggattcgtgcggcaaaaatgatgatactagcgaaatcggaatgcccctcgaaaggggcatccccgaatctaacttccttgtttagatagtgtatgaataggcctgactaaatccttgtatggcttcctctatttctctataaaaagaaatatgaccaagagtggtgcgaatgtatatagaacggatttccttttttctatttcccactactagatagtgggcataaatctcacgataagtccccaaagattcatattgaacttcaatcggaacttctcttaacccaatgacgcgttgatctagtttccatcggagccacaagggactgtctaaacagatttgtttctgtctataagctcccagtgcatcataggaactagaaaaaagagattctttatctttcgtatacttaggattattattattgtaatttactttttggtttggatagtttccgcaactattatatctatttgcacaaatacctcgacggtttccaatcgttaatacataaagtccgataagcatgtcttgggttggtacgcaaataggatccccaatagcgggagataggagattcatatgagaaaacataagtaaacgagcttccgcctgagcttccaaggataaaggtagatgaacagccatttgatccccatcaaagtctgcattgaaacctttacacactaatgggtgtaaacaaatagtacgcccctctactaaagtgggttggaaagcctgtatgcctaatctatgcagggtaggtgctctattcaacagtacaggatgtcccctcataacttcttgaagtatttcccatacaatgggttccttttcccaaattttccttttagcaatcctaacattagaagtagcacgtttcgtgattaaatcgcgaattacaaatagctgaaaaagctttattgctatctctagaggtaacccacattgatgtaatgaaagtgaaggacccacaacaatgacagaacgccccgagtaatcgacccgtttcccaagcagagtttcgcgaaacctcccctctttaccttcaattacatctgaaagtgatttgtatactttattgtgaccatccctcgttggttgcccgcgggacccactatcaagaagtgtatccacggcttcttgtaccaatttttcctggcacattactaaatctgctggcgctaattcacttctttttaatagataggcaagattgttgttccgacggataactctcttataaagttcattaatatccgaagtcactactttatccccagacctataaacaatgggtcttaattcgggaggaagaactggtaataagcacaaaaccatccattctggttctacatttgtttgaataaaatgtttcgccaattgcatgcgtctaatcaaaaaaacttttcttattcgtctttttctatcttcccattcatctccactatacccctcgtcttctaattccttccattcgaccgaggaattctctaaaataattcgcaaatccaaatctgctaattgttctctaatagcacctgctcctgtcgcaatttcccgatttcgaaatgttgtaaagcctggggtagaaaaaaagggggaaatgctatggttacaggatgaaatttcatcctcgaataaacctcgtaatcgtaagaaagttggttttttagcactgggcctagcaaaagagaaatcgccatatactaggccctccaatttcttaaggggtttatctaaaagattcgcgatataactaggaagaccttttaaataccacacatgagtcacgggacatgcgagtttgatgtatcccatttgatatcttcgtatccgagaatcaacaaattctactccgcatttttggcaaaatctttcgtcttcgttttcagctccgctcgctcgagaatttccacaagcacaaattctgctttttatgggtccaaagattctttcgcaaaacaatccatctttttctggtttatcggttttataatgaaaagtggagggccttgtgacttcgccaacgacttccccattaggtagtgttttgttagcccaagcctttatttgttgaggggaaacgagtccaatttgaagttgttgatgtttatattggtcaatcataaaatagaaataagaaaagaatttatatttattccgatcaaacttcttccctattaacctggaagttcttctgagatacaaggaaatggttcagttctagagccaaagatcgtagttctcgaacaagcactcgaaaagattctggaggatcctcgtgattaggtactcgttttccccagatcgtagcgttaagtatttcttggcgagctataagatgatcagatttataagtaagtatctcttgtaaaatatgagcaacaccaaatccttctaaagcccaaacttccatttctcctattcgttgtcccccttgcttggctcttcctctaacgggttgttgtgtaacaagtgaatagggcccagtagagcgtccgtggattttctcatcaacttgatgaattaattttaagatataggacttccctattagaacaggctgttcgaaggggtctcctgttcttccatcaaatattctgctttttcccgggtactcgggttcaaatacccacggattttttgtttgtttactggcttcatataattctgaaaacacaagttttcttgaagcctcttgctcatatctctcatcaaagggtgctattctataatgtttctttagcagatcccctgctaatccgagcgagctttcaaatatttgtcccacattcattcgggagggtactcctaagggattgaaaaccatatcaacaggcgttccatcttgcaaatagggcatatcttgcctaggcaaaattttggaaatgatccccttattcccgtgtcttccggctactttatccccaactttgatttcgcgtttttgtaaaatatatacacgaaccattatgtcgaggggatccctctggatccatttcacatcgataacgcgtcctcttccacctatcggtagtttgagagaagtttcttttgaagtggatacctcaagaccaaatatggcccgtaataatccagcttccgcgatataggacgattcgctcgctatctgaggcgttaatttacctactaaaatatcgcctgtttctacccaggaccccaacttcacaactccatttctgtccaaattgcggagtaaatgttcttctagatgtggtatttctttagtgattttttcagcggagccttggcttgttgtatccgtctgaatttcatattttcggatgtgaaaagaagtataaatatcctcatataccaaacgttcgctaattaatactgcgtcttcaaaattgtaaccttcccatggcatataagctactaatacgttttttcctaaagcaagttccccaccaaccgtagcagccccctccgctaaaatttgtccttttttaatggatttaccccgcggaacccgaggtttttggtgcatacaagtatttttgttagagcgccgatgggtaactaaaggaatacttatagtcttcccactacttgataaaaggatcttgtgactattagtagaaatgatctttccctcgcgttcggctataacagaaaccctcgaatctagagctgtttggcgttccaatccagttccaacaatgcacttctcggaccgagaaagcggaactgcttggcgctgcatattagaactcattaaagctcgattcgcatcattatgctcaataaaaggaatgagagaacctcgaagactgaatcttgatatacctcagaacagcaccttcttgttaccgcgagatgtattggccgctacggatcatttgattggaatgaaatttgaaacgggtatacttgacgatgacgatatgaatcacttgaaaaataaacgtattcgttcggttgcggatctgttacaagatcaattcggactggctcttggtcgtttacaacatgcggttcaaaaaactatccgtagagtattcatacgtcaatcaaaaccgactccaaagtttgtggagtcggttgcggatctgttacaagatcaattcggactggctcttggtcgtttacaacatgcggttcaaaaaactatccgtagagtattcatacgtcaatcaaaaccgactccacaaactttggtaactccaacttcaacctcgattttattaataactacttacgagaccttctttggtacatatcccttatctcaagtttttgatcaaaccaatccattgacacaaacggttcatgggcgaaaagtgagttgtttgggtcctggaggattgacggggagaactgcaagttttcggagccgagatatccatccgagtcactatgggcgtatttgtccaattgacacgtccgaaggaatcaacgttggacttactggatcttt

SEQ ID NO: 26818 - DNA, 1982 bp, Oryza sativa
cacagcatccctttcttttatcgaaggtctagcaattgatatcctttcgcaaataattgaaatgaaatttcgtgatctggatctttaattgtgggaaacttctcaagttcttctgccaagccttgattaatgaacctacaaaatccctcgaattggatctgactaaatccgggtattgtggacattccctcatttccattccggagcatcttaatcttaagtttcctgtttatcgaagaaaaattccattatcagctcactcttcatcaatccctacagatcgatctagcaattatggaatctatattctgtttactaaatcacatgaaattctcgggaactccacatacgtatttcatatatgtatttcatacatatgaatagagacaatttcaacgaaagttcgaatttcccaggggtccaaatggaatgaaaatgaagtgataaaacattcctagaacctcgaaaaaaattctgccacttacagtttatgatattcttagattggacggcaaagatttctcattttttctcctttctatgaatgggataaaaccaaaatataataatttataagcactagaaagtttgactttagttcgattgagaatagcacgcttagtttaatttcaaaaaagaatttgaaggttcttttttgtttcgtagtagtagaatttctataaaatataagatataagatttcgttgtagaatcctaaaataaagtaagtacttttttaagtacatgccaatctagttctggacctccacatagcaaagtcaattttcttttttttattcaagatatttaatgcaatgaaaaattaaagaacgattctccacagagatatgtacataagggggatccatagataataatgctgttcggacctggagtttacctatatacggattaggcataaatccattgtcttttattatgacattaaatggcaggcgggagagaataccgaaattcaaaataaaaagagaattctagttaatggttccaatttgatcttaatttagccgcttgtgactagaaatccacttttctcctttttcattacaatagaaagaaaagggaagttttctagtgttagcaatgtgtgttttaagatagaatcctttgaggagaataatcgaaactggatccaaaaaaagcatgaatagattgtttgaaaaagattggaaaaaagtaagtagaattagatttaagataaaagaaagttagttttagtaagaaacgtggatgaatacttgctcttttctcgattttagatcgtattttttggcggcatggccaagcggtaaggcaggggactgcaaatcctttatccccagttcaaatctgggtgccgcctgatcaataaaatacttaggcttatagtactgatccaaatcgacaaatttgcaccccgcataagttggggcaagagaataacaaggctcggcgatactggattttgagaacccaccgttctttcctcaaactggggtttgttttagcagtagtggcccaaaccgataccaatagggatgagatagcgtttccttattcttttattaataagaaagggctatgtatcatatttatacttaatgctccccaattctaccagaaatactctaagaatttgttaagagtaaattctttgaactgattcatccatagccttaggtcagaacccctttttgactctgtacccttgattctactatgattattcatcaatagtagaataattccttcatagaaataggagacataatttacatggatatagtaagtctcgcttgggctgctttaatggtagtctttacattttctctttcactagtagtatgggggaggagtggactctagggatactactaattgattgagtagtcgaattggtgtatcaactcttttctttaattgaccgttttgcattaatcattttgccgaactttattctttctctctttctttaattttgt

SEQ ID NO: 26819 - DNA, 7841 bp, Oryza sativa
  unsure (1)..(7841): unsure at all n locations
ttttctaccacactttatgattccaaccggatcctttcatttaagacttggatttttattttatttaatccctttttcatttcttcaatgattaattgaacttccaattaatcattttggctgactgtttttacataaataataagtaaaaaggcagtaggaactagaatgaacaatgcagtagcaataaatgcgagaatattgacttccataacctcttttttttcgcaataactcgggatgtaatcccatggagagggaaaagggtatcctgtaaattcaaggggaggacttgcattctgataatactgaatcaattcaatattatgaatatcggatctatcaaatcaattcatggttgagagtggaatagtataacataggaggatcccttccacgtatgatatgtatgtctttcgctatcaaccagaagtagtgataaaaaaattcctatactctcctctctttactgagaaacgcgaactaaaaaaagtgaaataggggtaccccataggtatttgatcttgcttcctgccccccttttttcatggaaaaaggaaagatgaatttctccattcattgaaccctagttcgggactgacggggctcgaacccgcagcttccgccttgacagggcggtgctctgaccaattgaactacaatccccgcggggcgtatggcatacttattcttaaatggaaccataagaataagaatattcgcctgtcctactctaagaaatagacgaatcatatactacatacccccgtatcgtatgggggtatagtgagaatgacataactagtatgtcgcgatttattatcgctaaaaatagataataatccacctttcaataaccaataagaaaaggtcttttgtttgtaagagaggaatgaaagagatatagattagaaagatatttccccttttctttttatcctttatttcttttatttctatggatcaaatattcttttttatggaagaaaaaaaatggatttaactcatattcacgaagccctagatttttgggccgagctggatttgaaccagcgtagacatattgtcaacgaatttacagtccgtccccattaaccgctcgggcatcgacccaggaagaatttattctagggtttttgataatctatgattaacctcctttcataatactccctacccccaggggaagtcgaatccccgctgcctccttgaaagagagatgtcctgaaccactagacgataggggcatcactagacgatagggcggtatacaaccgctcctcattatactataatgatagtatgagcagttttttggaattgtcaatatactcgaagagtataactagatccaaagcaaggagtccttcctacttttccattatgcttttgtaggattttttttagttgatggttaggttaattcacggatcatcccctactttttagggaaattcgtttataaaggatatggaataagaatagattaataaaagggattctatattagttcagtacgggtagtgatttgattgatctaataggaaaaagagtccaatttcttttttggaatttacacccccctgcttcgcttagtgtttaaactaaaaatgcatgcatctcgcactaagttatcaaattcaataaaaaaagagaaattttcaaaaagaaagaaagtgaatgaatttagtagaaaagtactgtatcggatttgaaccactgactcacgtcttaccgcggcattactctaccactaagtaaaaaaagccctttatcggatttgaaccgatgacttatgccttaccatggcattactctaccactgagttaaaagggcttcttattcaattccaaaattagccactttcatttcccattataggtctactccataatgtacattatatctgtatatatcgagatatataagtctattcatggtcaggttcaaaaaaatcttaagaaaatcaagaaaaataggaaaatctttcatattctctcttatcacttgcacaaagtatagggttttttatctttaggctattgacttttcacatgctcagaacggtctgaaaaattagggacttttttcttctattggctgatcttatcatgaaaactttctccatttatgttttatttcctctaattgggtggggtataaacgaattcgcgcccttcatatacccatatggctgggtattaattttcagtgatatacttcttgtctgttttggtgagaggttgaaacaatttttaacaggcatcccttggaaaaaccttcgagttcaaaactttgcaatttttcttaagcggatttgttgaagcgattttcagcaggtacctcttctcttagaaatatcttagaaatagggtacttgaatattctcaagggattctgattggtgcattttgaacaaactgtagtggagttttatcaccaattttcttgtaaaaggcgggcagtagaatttatactgctcctggttcagggttttccgtttccgaaaactagcaaaaaaggagggttctggaacccttaaggttcgatggtatatggatatggaaaatccaacatgccccatcctaataggaaaaggaagggaacagatacccaatatgattattgggaagaacttttggtaatggtctcgggcctatatgttcttttttgtgtgttcttagttctattcatcttctttgattcttttaaacaagaatctaataaactagaattgagtggaaaagaagagaagaaaaagttaaacggagagaatcgactaagcagagacattcagaatcttctttacatcaagtaaatccttcggctcctatgtgcctttttctttaagttatttattgtttctctcaagccatagggaaagtgtctatgataaataaaaaaaaacatctcactctttctctatggcccagatttcatgataagtgggggaagatgttttcttccccaaattctttgttcaattctgaacaaaaaagaaagtaaaggaaaggcccgcgatcgaagtaccaaccgctaactgtgaggaaccttctctgtttcattaactaagagggaattagcatctttctcgaatggctacccttgacaaagggtagcgttggtatcagaatttacatgtagcgggtatagtttagtggtaaaagtgtgattcgttctattaataactgaatttgaaatgatatacttaaggcgtccttaaggttttttatattccgatgaaaactttagttcttagaaaggatttactcctttttctctcaatagcatattgaggaagaatatgcattttcgcgatttgtacccaaagactaattgaaattgcatccaaaaaacaaataggatttggattatgagtacagagtcgcgaagcataattttgcattggattaaggattccaattttttaaatatgagtaaaggatctatggatgaagatacaaaaaaatttatttccaatcgtaactaaatcttcttttgttaaaaaaggaaatggaagccaaatagctaaaaaacggtagttttggtttactagaaccatcagcatattgtttcagctcggtggaaacccaattcttttcctcaggatctcttaaatgaaattagggaacgaagtaattagattagatagatttaggcaaatttctatctcctactctttagggatcatctagaaagcagagagccttggttccattcagacaaaaaagctgacttagatgttaagtggtgagaatacccataaaggagccgaatgaaatcaaaatttcatgttcggttttgaattagagacgttaataataatcaaccaacgtcgactataacccctnnnnnnnnnnnnnnnnnnnnnnnnnnnnnnnnnnnnnnnnnnnnnnnttctgtataaaataactattctatttgtctagacatggtagaggcctgtattcaacctttttcgtccaccggtttccagcgctccagagcggagtagagcagtttggtagctcacgaggctcataaccttgaggtcacgggttcgattcccgtctccgcacttagcagtctgtataaaataactattctatttgtctagacatggtagagggctgggtggttggcgggtatccaaccctttttattcattagttcccgaccctataaggccaaattgagcaggttgcgaagtaacttgctaccacaagaggaactctcaaggccccctccctaccttgcagaaaagaaaaaataaatgaaagaaaggcncagtctatctcccttcccttaaaaagctgtntgctggttgtttgttcgggtgaatcccgggtttagggaaccctgttgccgagttcgattcccgccgctgtagtgctctttttttgagtggggtgcaaagggggttaagatagtaaaggggtacggtactagactaacacctattactttaataaaagtagactaaattttttatcatagtaccttactaaattaagctggcgagcggcgggaatcgaacccgtatcttctccttggcaaggagatgttttaccattgaactacgctcgctacgtcctatattttatagggtatatccgcctgggtcgaccgtctatgtctgggtcgaccgtttcattttctatttgagttttctttttattaatttaattgtctgtcaatcaattcggggcgcaaattgcattttaatgcgtctcacaatccgaataaacggcccttttttattttgtatcgggctactaaatactaaacacatttaagaaatgagagaatttagaatagctaccagaaagaccagtccaatccataatgatgtaccggaaaatacaacgtttttattgtttgaccaaccatcaggagaagcaaatacaaggggtacactaatgactaagactgaggaagtcacaattaatgcaaaaacagctaattggaaagcaatagtcatatttctaatcctccaagttaccatcaaataaagttgactacatattatatttgatccctcacttaatcaaaattgtaataaaatacaagaagtaggaggggtttaatcatgaatccattgattcttctctttaaaacttattactcaccactttttttatttggatatggggttgagggggttttatgctttatttcacaagcggatatagcggatcctgtatacatggatacagtatacagaaatatatcgaaaagggatttgtatttgagatgtttctagaggttagtgagtcatttcgtatggctatgttctatttgtaggaataaaataaggattaggctgtggagagatggctgagtggttgatagctccggtcttgaaaaccggtatagttctaggaactatcgagggttcgaatccctctctcttcttttgctttcctctctcttttcttttgcgtattgaatacgtttggttctttatttgttttttttgttctggccccttatctttctttcatagaaaggaatgaatggctcggctagatagaataaccgagccagaacagaanaaaacagtagaacaggtataaataagaaaatcttagttaagaggggtcatgtaaagaacaggctccaaatcacgatcgattcccgtttcaaattcatgtgcagcagccngggctcttcctgcatgccacaaatggcccacaaaaaagaagaatcgtagaacagaatgggaagtcgctanccatcttgtaggagaaacataattaactgcattgatctcggtagctacgccacccacagaatttaaagagcctaaaggagcatgggtcatatattctgccgaacgtcgttcttgccaaggttgtatgtcttttttcaacctactcaagtccaaaccgttggggccccttagaggttctaaccatggagcacgaaggtcccaaaaacgcatagtttcccctccaaaaataacttctcccgttggggaacgcattagatatttacctaaccctgtgggtccttggacagatcccacattagctccaagacgctgatctctaactagaaaagtaaatgcttgagcttgagaagcttctggcccagtaggtccataaaactcactcggataagctgtattattgaaccagacaaaacaacaagcgataaaaccaaagacagataaagcgcctaaactataagacaagtaagcttctccagaccatacaaatgcacggcgagcccatgcgaagggtttggttaagatatgccaaattccgccaaatacacaaatgaaacccaaccatacatgtcccccaattatatcttctaaatcatccacactaacaatccaaccctctcccccaaaaggggattttagtaaataaccaaatataacaccggggctaagggtcaaattggtaatttttcttacatctcctcccccaggagcccaggtatcatatataccgccaaaataaagagctttgagtactagaagaaaagcacctatacctaacaaaattaggtgaatacccaaaattgtagtcattttatttctatctttccacacataaccaaagaatggaaaagattcttcaagagtctccggtcccagaagcgcgtgataaatgccaccgaagcctaagactgcggaggaaattagatgaagtactccagatacaaagtacggaaaagtatctagaacttctcccccgggccctactccccaacctagagtagctaagtgcggaagtaaaatcaacccttgttcatacatgggtttttctggtacgaaatgggccacttcaaataggttcattgctccggcccagaatacgattaatcctgcatgggctacgtgagctccaagtagtttacccgacaaattgataagtctggcattcccggcccaccaagcaaaaccggtggtttcttggtcacgaccagctaaaacaaaagttccattaaagagcggttccacgtggtagaacctcctcagggaatataagattttcatgaggctgatcctgagctggcatccacgcacgaataccctcgtttaaaagaatatttttggtgtagaaagtctcaaattcaggatcttccgctgcacggatttctgggaaacgaagtcataggcacgtaggttcagagccaggccgactacgccaatagcactcatccataaaccggtgaccggtacaaatagcataaagaaatgtaaccaacgttttattggaaaaagcaacaccaaagatttgggaccaaaagcgattagcggtgaccattgaataagtttcttcagcttgagttgggttaaaagcgcggaaggtatttgcaccatcaccgtcctcaaatagagtgttttccacggttgccccatgaatagcgcatagcagagccgcgcctaatactccggcaactcccatcatatgaaatgggttcaacgtccaattatgaaatccttggaagaagaggatgaatcgaaatatcgctgctacgccaaaactcggcgcaaagaaccaaccggattgccccagtggataaatcaggaatacggaaacaaaaacagcgattgggccagagaatgaaattgcattataagcccgcaattgaacagaccgagcaagttcaaattgacgtaacatgaaacctattagtgcaaaagccccatggagagcaacaaaagtccacagaccacctaattgacaccaacgagtaaaatccccttgtgcttccgggccccatagtagcaacaaagagtgtgctaaactattggcaggggtggaaactgctgcggttaagaaattgcaaccttccaaataggaactcgccaatccatgggtataccaagaagttacaaaagttg

SEQ ID NO: 26820 - DNA, 5461 bp, Oryza sativa
  unsure (1)..(5461): unsure at all n locations
tttcccactcgctctctattgcatgggtataagaacaaaaataggattctgaaaaaaagtaaagatattgaaaagaaaaattgactttcgaaatccatttttatgtgtagcggaaaggggttgcgatttcttcttattcctatagaacatctagtaacaagaatatgaaatagtaaatagcgagaaattcttgccttgcgtggtctaagtctaaggaaatacaaaaaaatccacttatacaatttcatctacatcgaatttatatatcagaatagcggatagaggcctcattcaaggagtcaggtccacttactttatctttctttccaattttatggggtgggttggtttgataagacccctttttgctttgttgataaataataaaaaaaagagtttttttctataacctgcttgttttattataacaagtcctatatggaaatgcctgctgaagagaaaatctatctgattgtcttttagccaatatccaattttagaattagaaagaaaaaagaagaattttcttcttttttttattaacattaagaaaaaagaatataactaaaatggaattggcaatataatttttttgaacttttgaaagaaaaaggaaggattttttgcaatcgttatttcttgcctctgtcatatcacggaaacctttcgatttggaacggggagagatggctgagtggactaaagcggcggattgctaatccgttgtacaatttttttgtaccgagggttcgaatccctctctttccgccccctcggatcgtttgggactttcgaattggaaggaattctgacccccggattttctcgtagataaatgtatgaaacaaatccaatttgtaagaaaaaattttggatttttactcgtcacgcccaggattacgtcctggatcattagataagaatccaaagataaagagggaaacaaagaatatcactactgtataaacaaaaagtttgagagtaagcattacataatctccaagatttttttttaaggaatagattacccgtttttccttaccacacaaatccactaggatgggttttgtttattttgacacctaaaaatgcaaaaatcaatttttgaaaaaaattgcaagaattgatttataataagcactcttatcaataaattaggttaggtattgtgcggttacctaaagatacctgctcaacgtagatgcagggagtagaaaggctgatccaaatttattgctgcagctatacattcaatgtagaagaatttgaattttagaatcgaaggttcataatataagacttctcggctcttatccatttttcgaatttttttagaatgaatacatgattcaatttggcagacagagtagtaaagatttcatcgaaaacttacagcagcttgccaaacaaaggctaatagaaaaaagagtacaggtatgacaggcataaaatccacgattggattgaaaatggcataagcttcgggcaatttggcgaagaaaaaactagtcggataaataacagaattaaaacaaatacaggttaaactaagtatattaggcataacaagcgtttcgttcttgtagagtagataattggattttgattgagttatttttctaagggaaaaaggaaaaggaggattcaaaatccttttttcttcggactttcccaaacacaaaatacctccttgtattcgcactctcaaatgagagtggaagaaattcgactttcatataatatcttaatagaattccatgtaatgatcaatgcattttttggattctatattattcgcatgtctagaatcctaccaagagaataccccccatttttatgtaattgaagtaggattgacgaataagaaataaacataatactgtttattagtgtcgcataaaacccgaaatggggcgtgnnnnnnnnnnnnnnnnnnnnnnnnnnnnnnnnnnnnnnnnnnnnnnnnnnnnntccgtcccagattttttctgatgaaacgaaagatgaaatcgtattgtattctgcacgagacataaagtttattaaagagaatttttttctcttataaactcttagattcgatgcagtcctaatgcgttcattttctgtctcagaaaacataatccagtgtcaagtccagtcaaattgaaaatctttttttcatgaaaaaattttaaacttgacgtagaacattgtataaaaaacgagacctattcctttatggtagagatagatttatgatagagataaattttttttatagtattttattagtaaaaaaggttccttcttctttttctttctttggttaagcaaaaacgatctcgatccgcgattttttaaatatccagaatgatccatcccggtaaagataagataagaactgctcgttagatagaatggattcaattttgatttggagttgcttcttttaggtaaaagaaaaaataagtaaaagcaaagaccttaattttactttacaggaaatgcgttttttttacttcatttttttctttcttttggtattcgagtcgaagaaatacgagaattctataactaccaaaaaactttcttttcattgcaatagtttaactagttaatagttaattagttttgttacggaaaaatggtatggaaaaatagattgctaatctaatatattaattaaattaattaaacgggaggttgatagtttatttgttggagaagagtcaattcttctcttatcatttcaggattggattgatcatctcgagtcctctgttgaggatggaaattccataataaataagtcttaagcaaacttgtttattcccttttttcgaactatatttcattcatatgatagaatatgggtttaaataaattggctctttgcggagtctttcccgataaatacttaatttcttttattcatatttctccatagatagcaaagcaagtttgaattagtatacaaaaaacgaaactaatgactattcatgattccatccatattggatcaattccctataacactttgcaatgaaattagaggaatgttatgttaaaacttcgtttaaaacgatgtggtagaaagcaacgtgcgacttgaaggacacgatcgattgtggattttgctatccaccattttccatagtaatgaaaatgctcttggctcgacatagtctgttctattcgtccggaaccgaattttcgctgggttgtttgtaagtaagctaagtaaatagtacacgatggagctcgagaggacagaatttattttttatcaagggaaagaatctagggttagtgaaaactaataaattaggccaactttgtcattctacccttaatatagaaatcgaaataatatagaaatcaaaagggtaaaatagaagaaagtccaattttgaagatatgggaaaactcttttgattaaaagtctatcagaatcaatcgctcatattcgatttctatagaagagggaaatgctttatcgaaggaaataagaaaaaagggtatgttgctactcttttgaaagaaaaaagaataagaattcccgaagtaatgtttaaacccaaggatttcacaaatcaaagataaaggattcccgaacaagtaaacacgattttcaactgtctcaacaatagaattggaccggaataaggaataaaagtgaatttgttcgagatgaggcaaagaaaagagtttagagacgactcaaaaaatttcaaaggatttttttctttcaagtctgtcaatcaaaattagtcaacttgagtcatgagtataaatgaaatttgttttttctgtacggaaattaatgcaagtcatattctcgagccgtatgaggagaaaacctcctatacgtttctagggggggctttgtttatctacatctatcccaataagctgtctatcgaatcgttgcaattgatgttcgatctcgaagagaaggaagagatcttcgaaaagtaggtttttatgatccgataaagaatcaaacttgtttaaatgttccagctattctctatttccttgaaaaaggtgctcaacctacaagaaccgtttctgatattttaaggaaggcggaattctttaaagaaaaagaaagaactttgagttaattgaagaactaaatgaataaaaaactaggagaggctcactagtatcccttgttgtctaactatttagaaataatttgcctctttcttaatcctatttttgactggatttatgtcgtgccaatccaacataagcctttatttttttgagtttttctatctaatttttttcttaccattgtatttccattgacaaaggtccattgaacatctagaatttgtagatggataagtctctttatcctcactccctattaggttttttgcctacactttgctcaaatggtagggttgtccctcttgtttgtactctcatacaagatttatttatttatttaaataaaaatgctaaaaaaatgacaattttacgatcgtgattggtgccacttttaaccttagtgaaatttaaccagacccgttccttttggtatctgagtgttttcaatggtgataaaatctttcttttaatgtcttgctattttaagattttgacaggggtgtgcggtgtaattccattgatttttggatttcgatcgtatctaagatcctagtttatctgggttgctaactcaatggtagagtactcggcttttaagtgcgactatgatcttttacacatttggatgaagcaaaaaattcgtccagactcttggtagagtctataagaccgcgactgatcctcaagggtaatgaatggaaaaaatagcatgtcgtaataaaatcaatttcttattttggatttttggaatggaataaaaaaattctgattttctgggtctaatgaataaatggatagagcctggctccaattctggtaaaacaaaaagcaacgagcttaacttcttaattggaagaactccctgatctaattagacgttaaaaatagattagtgcctgatgtagggaaaagctggttttcctatgagtagacctttgattttttcttttttttttagaaatcctaattattcttgattttggattgaaaaggatgttatggattgaatgtgtaaaagaagcagtatattgataaagagactgtatcccaaagtcaaaagagcaattggcctgcaaaaataaaggatttgttctcttttgtaattagaacaaacataaacaaattggatagaaaaggagcggaaaaagatccgtggattagactccttttcttccccaggggtttgtattaaaaaatgcaacaccctgttctgaccatattgtactatgtatcaccatttgataaaccgagaaatatttctctctctctgattcaagtagaaatacaaatggaaaaattcgagggttattcagaaaaacttaaatttcctagacaatatttcgtctacccactactc

SEQ ID NO: 26821 - DNA, 311 bp, Oryza sativa
gcaatattctttctctttttggactcaaccgcaaaggatccatctaaaccaattagaaaactcttgcttcgattttctggggtacttttcaagtgtaccaataaattctttgttagtaaggaatcaaatgctggagaattcatttctaatagatactcaaatgaaaaaattcgataccaaagtccctgttactcctctcattggatctttagcaaaagcccaattttgtactggatcggggcatcctattagtaaaccaatttggaccgatttatcggattgggatattcttgatcggtttggtcggatat

SEQ ID NO: 26822 - DNA, 428 bp, Oryza sativa
  unsure (1)..(428): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcttatccgagtgagttttatggacctactgggccagaagcttctcaagctcaagcatttacttttctagttagagatcagcgtcttggagctaatgtgggatctgcccaaggacccacaggtttaggtaaatatctaatgcgttccccaacgggagaggttatttttggag

SEQ ID NO: 26823 - DNA, 624 bp, Oryza sativa
acatattgatcattttgcactaggattaagctttttgaaggaatagtcacactatgtagaatatcctgactctgaatagttatatgcaagtctatataacatagaaaagcaggctgcccatgacgggtacgtgtggggtgaaccaaatccccattgaattggatttttccatttgaaggggatcgtacaaggtcggcagtaccccctgtgaataccccaccagtatgaaaagttcttaatgttagttgagtccctggctccccaatagattgaccggcaataacacctacagcttcccccaattcgaccagatcgccatgagtggaactccgaccataacataattgacagatccaagatgtgctccggcaagtaaagggggttctaatatatattggttgtgctcgaaatggctgtgctcgaaaggtggttatgaatcgattgactaacccaattccaatatcttgatttcgagtggcaatgcaccgtgaaccgatatatatatcgtttgctaatacacgaccaattaatgtttgtacaaaaagtttttccgtcatcccattttgaggactcacagaaatagcttggatagtaccacaatctcttctacgcacaataatatgt

SEQ ID NO: 26824 - DNA, 368 bp, Oryza sativa
aagaaggggcgacccatatcatcttgacttggttctgcttcccctctttttttaagaataccgagtcgggttcttctcctaccagtatcgaatagaacatgctgaacaagatcttcttcatggaaacctgctcgatttagatcgggaaaatcgtacagattttatgaaaccatgtgctatggctcgaatccatagtcaatcctattttcgataggaccggttgacaattgaatccaatttttcccattatttgactatccataatagtgtggaaagaaagcccggaggaagggtggccttgagtttctcgcccctttgccttaggattcgttaattctctttctcgaggggacggggaagggatataa

SEQ ID NO: 26825 - DNA, 258 bp, Oryza sativa
ttgaaacgggtatacttgacgatgacgatatgaatcacttgaaaaataaacgtattcgttcggttgcggatctgttacaagatcaattcggactggctcttggtcgtttacaacatgcggttcaaaaaactatccgtagagtattcatacgtcaatcaaaaccgactccacaaactttggtaactccaacttcaacctcgattttattaataactacttacgagaccttctttggtacatatcccttatctcaagttt

SEQ ID NO: 26826 - DNA, 470 bp, Oryza sativa
agcaggctaccatgagacaaaagatcttctttctaaagagattcgattcggaactcttatatgtccaaggtcaatatggaaattctttcaggggttttcccttactttgtccgtgtcaacaaacaattcgaaatacctcgactttttcagaacaggtccgagtcaaatagcaatgattcgaagcacttctttttccattacactatttcggaaacctaaggacttgatggtatggatatggaaaatacaggatttccgatcctagcgggaaaaggagggaaacggatactcaattttaagtgagtaaactgaattccatactcgatctcatagatccctatagaattctgtggaaagccgtattcgatgaaagttgtatgtacggcttggagggagatctttcctatctttcgagatccaccctacaatatggggtcaaaaagccaaaaaaataagtgattcgtttttag

SEQ ID NO: 26827 - DNA, 799 bp, Oryza sativa
gatcggagtcgtaaactaaaactacctcttcatcaaggttatagaaaacttcgtcatctagttctaccattttgaaaatcaattctcttttcttacgagcatttcgagtcacttgttgactcacgattgtgcctgttaaaagtttcaaaatgtcctcttttttgaaagagagtcttagaaaggggtctaacttccaaactctgtcttttttcattcattctcctttagtttttttctctatctagaagtggaatagaataacccggttaaagggtaatgatcatacgtctgtaatgcattgtatgtcattgattctttcccaataaatgaaaactttttctgtaaatactgcgtatttgattccattatcatatgataatactctatttgtatttatttattgtattatacctttatatcttctaaatatatagaatagaggaatcccgatttgtcaagtctcatgatcgtatcaaaatctatttaaactcggctcaatcttttttcagattgagccgagtttaattgcaatcaattagaagaaaaaagaagaattactgcattttcgtaactgatttttgatctttctatttctcttctttttaatttagaccttttttctatctaattttatccacttagtctagctatctagtttatctaccggctcgaactcgaatttgatcgctttccatatttcacaagctgcggctagttcaggactccatttgcaagctgatcggataatttcattaccttcacgagcaagatcgcgcccttcgtacgagcttgtacacag

SEQ ID NO: 26828 - DNA, 838 bp, Oryza sativa
acaaaacttcgtaagaagatatcgcgagaaatagttgaggatcgaactctatctcaaaagaaaaatcgatgttttactaccagccacaagctttatgttcggcgcagtactaatactggaacttatgagcaagaattgctctatcaatcaccatctactttagacatatcttctgaacttttttcaaatccaaaagtccagtatcttcctacaaattagtgaattagaaggagctctttgtgccgaaaaagaaagagcagggcaatatttcaaacttgcattcgaactgcgaaatatttatacaaaggaggagagatcaagataatgcagcagggttggttatctaattggctagtcaaacatgaggtggttcatagatctttgggcttcgatcatcgaggaatagagactttgcaaataaaagcagaggattgggattccattgctgtcattttatatgtatatggttacaattatttacgttcccaatgtgcttatgacgttgcacccggtggatctttagctagcgtgtatcatcttacgagaatacagtatggtatagataacccagaagaagtatgcataaaagtctttgcccaaaaggataatcctagaatcccatctgtcttctggatttggagaagttccgattttcaagaacgcgaatcttttgatatggtgggaatctcttatgataatcatccacgccttaaacgtatcctaatgcctgaaagttggataggctggcccttacgtaaggactatataacccccaatttctatgaaatacaagatgctcattgaatgataagaaattcatgctcacttatacaacaca

SEQ ID NO: 26829 - DNA, 3485 bp, Oryza sativa
tgattactcaatattcgattggaatggattcacaacaattctaaaaaaattatgaattttctatttcataatcattcgtattttcattttaaaaaagaattaaagaacctatattatgatatgagttctgtgattaatcgtttgatatgccagtatctatacgtgtgtattagatttcgaaagcccttctttccctaatttagaaggaagttccgctagcaacacaacgtaattaactcgattcgttagaacagcttccattgagtctctgcacctatccttttcctttgggttttagttcgagaaccggttgttttcttaaaacatggatttggctcaagattgccccttttttaattccagggtttctctgaatttggaagttgccacttagcaggtttccataccaaggctcaatacaatcaagtccgtagcgtctacccgatttcgccatatccccattttctttttttttgagaccaggatttcctgtgcaatttcctccatctggtagttttttttgaatcgttgaattcattactctatgtagtctagcggttcgtctctagttgagagactccgcttattgcaattcagcattgaattgattctatcgttgatgtatttgcaattcaatgcgattcaatatatcccaaggtttttctctcccccacctaccgcgttccttttttagagtattcaaaatcatactataacgcttgatattcattctttttttttgctaatcagaattagcaatttcatttgctatgattctatgttctccttagtgaaatattaatcattaaattattagcaaataacaaaaaaaaacaaaatatctcaaaaaatgtctataatgatggactgaaaatacaagaaattcgcatgttctctttattatgttttcgtatataatatatattatttattcttttccatgtattagattattcgtccgagccatatcaaattaaaaatatctaaaatcaaattcaatatagaaattggaatagattctattagaaaaatagatttgcgaattagagaaaaaagaaagttcaaaaaaatctatctaactttattttatgaagttctagtatttttttctaagtagaacttccaatttcgaactagttaatagctaagattaataattaagatctgacattatacggatttcctatactatacatatttctaatggttacactatttctgttatgtaagcccacttagctcagaggttagagcatcgcatttgtaatgcgagggtcatcggttcaaatccgatagtcggcttttttctctatcaatgttccatgaacaaaaatacctctttttctccgaattaaatggagaagccaggatctattatgtcgttctaccctacaattttgctagatacaaaacaataaaataaataatatatatacaaaaattcagatgttgatgaaattccatttttttgtggtacttttagtagattttactctgtttatcctttactttaattcagttttaatttcgatgtattctgtaatgtaaatacaatgaaattaattgtgtaaaatgaaatttcaataaaaaaaggagtcttcatgtcccgttatcgaggacctcgttttaaaaaaatacgccgtctgggagctttaccaggactcactagaaaaacacctaaatccggaagtaatctgaaaaagaaattccattctgggaaaaaagaacaatatcgtattcgtcttcaagaaaaacagaaattgcgttttcattatggtctgacagaacgacaattacttagatatgtacatatcgctggaaaagcaaaaagttcaacaggtcaggttttactacaattacttgaaatgcgtttggataatatcctttttcgattaggtatggcttcaaccattcccgaggcccggcaattagttaaccatagacatattttagttaatggtcgtatagtcgatataccaagttttcgttgcaaaccccgagatattattactacgaaggataaccaaagatcaaaacgtctggttcaaaattctattgcttcatccgacccggggaaattgccaaagcatttgacgattgacacattgcaatataaaggactagtaaaaaaaatcctggataggaagggggtcggtctcaaaataaatgagttgttagttgtagaatattactctcgtcaaacttgaacttaaggaaaaacggaaaggttcatagaattttcttccccttcccctttccccgaactaaatcgacctaaggctcttaattcgtattttcccattcacctaacagaaatggattaaccctaggattcctttttgttttttgttctttcctctatgtgtattttacataccatagtaatttggtatagagaatttctattaaataaaggtattgtattattgctggaataaattgtcatttgatttgatacattgtaatcattaacgttgctgaattaagaaaaacggaaagagagggattcgaaccctcggtaaacaaaagtctacatagcagttccaatgctacgccttgaaccgctcggccatctctcctccataatcttattatggaaaaaaaactgagtgaatagcgagttttcctattcctgcagtacaggtacaaccacaaccgcgcgagagttccattgttctattagatagaaaaattccttttcatctaagtggacgggtccaggatttttttactaggaattccgctccctcgaaaagttttagtttgggttttccccaaaccaaagaaaaagagaatggaagaattcttcttattcgataaaaaaggaaccctagaattctgtttgcataaggtatcctaccccatacaatcaaatagaaaatagggtatgggacgattaatgactttgaaaatgcgaaatagttgatgagagaagttgttgttgagaaaagaaataggaaagtggaatgaaatccaatcttagtcaaatattttctatctcttcttgttcaaacagaaggaaaaagagagaatttgggctgagcagaaatacctctcttatccatttggagcatagggatcgatttataagaattgaatggatttgttttttttttatgttattttgtgaaggaatgaaaagaattctatatagaatgatagaatgggttgggaattatgcctagatcccgtataaatggaaatttcattgataagaccttctcaattgtagccaatattttattgcgaataattccgacaacctccggggaaaaaagggcatttacttattatagagatggtgcgatttgactctttttttttgtttttagccctacctacaccccggttttacgagaaagagtgggggttcgcggagagaaaaccaaattagtaagggaaacccacgcttagggaaggtgaggtgaactaacaacttcttctgtcgtgtatcctcgactgacgcggcctcggatgcttcaatt

SEQ ID NO: 26830 - DNA, 3010 bp, Oryza sativa
  unsure (1)..(3010): unsure at all n locations
gtatgaggtgaaaacctcatgtacggttttggaacggagattttttgaatagaacgaacgaccgtaacggatgttggctcaatccgaaggaaattatgcggaagctttgcaaaattattatgaagctacgcgactagaaattgatccctatgatcgaagttatatactctataacataggccttatacacacaagcaatggagagcatacaaaggctttggaatattatttccgggcactagaacgaaaccccttcttaccacaagcttttaataatatggccgtgatctgtcattacgtgcgactatctccactatagaaagaaaaataagaaaggatcaaattttctagtatttactagaaaagggggctttctacatagggatcgtcaaaacaacgattttgccctatcagctgtaggaagaaaggacacttcacgagaatcaaaataggaagaaagaaagtatggcctatactactctatggatagagttctcaaattgatagagaaagcaccgtaaagatcaattagtgaccgactgggtcgatacaactaaaaaaaactgcttacttatcccatgatatggggcaaaatttaggaatccgcttatgtaatagagccgatccactaagggattaagcagcggtgtagtatcagatcccaaagatagtaagttcttttttcttgcttatggggaaaaagtctttttcaaggattctatagaaatttcatatatgaaaccgagatagttacctttcagaaaattcggacgaaggatataggtctatctatgcttcatttttctgcaggtgggagaaaagatcaaactgattattgatcaaaatttagggtttgaaacttaggtaattaacttcttctgcgtaacccaagaagaaattggatcgatttttgagaaatcgaattcagttaagacaagggaaattaagatagcaatttctgagccgtatgaggtaggaaactctcaagtacggttctaggggaaggaactacctattccgaccggngagaacaggccattctacagggtgattcagaaattgcagaagcttggtttgatcaagctgctgagtattggaaacaagctatagcgcttactccgggaaattatattgaagcacagaactggttgaagattacgaagcgctttgaatttgaataagaccactctcctttttcagaaaatgggggtttggttgttgatccattaatcaaataaattaggtcggaagatcgaatcaagaatttcattatatctctttcctctgccttctattttatattatatttcataaggataaacgatagggtctagaatagaagtaataaagcgaataaaaaggggcaatataaatattgctaatatatcaggaccatcttattaataattctaatgagttatcttggaatttggaatcgaataaaaaaatctatattatgctcaaggaaagtagatatagatagggacttatactcttaaaaaaaatagactagctttttaaattaaaaaaaggtttttttgttacgtggagaaatccaagataaaaaaagtccgttaggcacccaatccttatgtcataatagatccgaacacttgcctcagattgacttcaatatataattgctccagtgaataactaaaaaaaaatagaaggacggtagatagtaaagaaaaggactaatcataatatctatctttcaaaggttcactaaaaagttggcgggtctctttgtatgtcttgtccggaaagaggaggacttaatgatgattcgttcgccggaaccagaagtaaaaattgttgtggatagggatcctgtaaaaacatcttttgaggaatgggccagacccggccatttctcaagaacaatagctaagggccctgatactaccacttggatctggaacctacatgctgatgctcacgatttcgatagtcatacaggtgatttggaggagatctctcgaaaagtctttagtgctcatttcggtcaactctccattatctttctttggttgagtggcatgtacttccatggtgcccgtttttccaattatgaagcatggctaagtgatcctactcacattggacccagtgctcaggtagtttggccaatcgtagggcaagaaatattgaatggtgatgtaggcgggggtttccgaggaatccaaataacctccgggttttttcagatttggcgagcatccggaataactagtgaattacaactctattgtaccgcaatcggtgcattgatttttgcatcgttaatgctttttgctgggtggttccattatcacaaagccgctcccaaattagcctggttccaagacgtagaatccatgttgaatcatcacttagcagggttattaggacttgggtctctttcttgggcggggcaccaaatccatgtatctttaccgattaaccaatttcttgacgctggggttgatcctaaggagataccacttcctcatgaatttatcttgaatcgcgaccttttggctcaactttatcctagttttgccgaaggagcaaccccttttttcaccttgaattggtccaaatacgcagaatttcttagttttcgcggagggctagatccaataaccggcggtctatggttgagcgatattgcgcaccatcatttagctattgctattcttttcctgatcgcaggtcatatgtataggaccaactggggtattggtcatggcctgaaagatattttggaggctcataaaggcccatttacaggacagggccataaaggtctctatgaaatcctaacaacgtcatggcatgctcaattatctcttaacctagctatgctaggctctacaaccattgttgtagctcatcatatgtactctatgcccccctatccatacctagctactgactatggtacacaactttccttgttcacacaccacatgtggattggcggatttctaatagttggtgctgctgcacatgcagccatttttat

SEQ ID NO: 26831 - DNA, 11435 bp, Oryza sativa
  unsure (1)..(11435): unsure at all n locations
caagtaattcagtcttatggttcttcattatccgcatatggtctttttttcttaggtgctcattttgtctgggccttcagtttaatgtttttattcagcggccgtggttattggcaagaactgattgaatctatcgtttgggctcataacaaattaaaagttgctcctgctactcagcctagagccttgagcattatacaaggacgtgctgtaggagtaacccattaccttctgggtggaattgccacaacatgggcattcttcttagcgagaattattgcagtaggatagtggctaggaggatttgaaaggcattatggaattaagatttcccaggtttagccaaggcttagctcaggaccccactactcgtcgtatttggtttggtattgctaccgcacatgatttcgaaagtcatgatgatattactgaggaacgtctttatcagaacatttttgcttctcactttgggcaattagcaataatctttctatggacgtccggaaatctgtttcatgtcgcttggcaaggaaattttgaatcatggatacaggatcctttacacgtaagacctattgctcatgcgatttgggatcctcattttggtcaacccgctgtggaagcctttactcgaggaggcgccgccggtccagtgaatatcgcctattctggggtttatcagtggtggtatacaattggattacggaccaatgaagatctttatacaggagctctttttctattatttctttctaccctatccttaatagggggttggttacatctacaacccaaatggaaaccaagcctttcgtggttcaaaaacgcggaatctcgtctcaatcatcatttgtcaggacttttcggggtaagttctttggcttggacaggacatttagttcatgtcgctattccagcatccaggggagagtacgttcgatggaataatttcttagatgtattaccctatccacaggggttgggaccccttctgacgggtcagtggaatctttatgcccaaaaccccgattcgagtaatcatttatttggtaccactcaaggagcgggaactgctattctaactcttcttgggggattccatccacaaacacaaagtttgtggctgaccgatattgctcatcatcatttagctattgcatttatttttctcattgccggtcatatgtatcgaactaacttcggaattgggcacagtatcaaagatcttttagaagcacatactcctccggggggtcgattagggcgtgggcataagggcctttacgacacaatcaataattcgattcattttcaattaggtcttgctctagcttctttaggggttattacttccttagtagctcaacatatgtactctttaccttcttatgcattcatagcacaagactttactactcaagcagctttatatactcatcaccaatacattgcagggttcatcatgacaggggcttttgctcatggagctatttttttcattagagattacaatccggaacagaatgaggataatgtattggcaagaatgttagaccataaagaagctatcatatctcatttaagttgggctagtctcttcctaggattccataccttgggcctttatgttcataatgacgtcatgcttgcttttggtactccagaaaagcaaatcttgatcgaacctatatttgctcaatggatacaatcggctcatggtaagacgacatatgggttcgatatactcttatcttcaacgagcggtcccgctttcaatgcgggtcgaaccctatggttacccggatggttgaatgctgttaacgagaatagtaattcgcttttcttaacaataggacctggagatttcttggttcatcatgctattgctttaggtttgcatacaactacattgattttagtaaagggtgctttagatgcacgcggttccaaattaatgccggataaaaaagattttggatatagttttccttgcgacggccctggtcgcggcggtacttgtgatatttctgcttgggacgcgttttatttggcagttttctggatgttaaataccattggatgggttactttttattggcattggaaacacatcacattatggcagggcaacgtttcacaatttaatgaatcctccacttatttgatgggatggttaagagattacctatggttaaactcttcacaacttatcaatggatataatccttttgggatgaatagtttatcggtatgggcgtggatgttcttatttggacatcttgtttgggcgactggatttatgttcttaatttcctggcgtggatattggcaggaattaattgagactttagcatgggctcatgaacggacacctttggctaatttaattcgctggagagataagcccgtggctctttccattgtgcaagcaagattggtgggattagctcacttttccgtgggttatatattcacttatgccgctttcttgattgcctcaacatcaggcaagtttggttaatttagttaattttgttgtactgtatcagcacctagttcattactcttgatggagggggaggatccgccttcttagatttctttttctatttatttttccatctaggattagaaccgtatacttggtagatagtaggaacggcacattatggcaaaaaaaagtttgattcagagagagaggaagcggcagaaattagaacagaaatatcatttgattcgtcgatcttcaaaaaaaaagataagaagcaaagtttaccctttgagtttgagtgaaaaaacgaaaatgcgagaaaaattgcaatccctgccacgtaatagtgcaccgacacgccttcatcgacgttgttttttgaccggaagacctagagctaactatcgagactttgggctatccggacacatacttcgagaaatggtttatgcatgtttgttaccgggtgcaacaagatccagttggtaaggataaaataccctttcgtatttgtatggatttctggaattgatgatcgtagaagagccctctttaccattctgtataaatggactattctatttgtatagatatggtagaggggcgtattcaaccccccttttatccactagttcccctctctttagtttaacaggatagaacagtttggtagctgacaaggctcataaccgtggggtnnnnnnnnnnnnnnnnnnnnnnnnnnnnntattccttctttatgatatatgcatcatacatttgtatatgcatttgtttttctttcctaaaagagttttggtctaacagttttttctcttggtccgataaaaaatgaaaagaaagaagaaaatatgaaaaaagcgtccattgtctaatggataggacagaggtcttctaaacctttggtataggttcaaatcctattggacgcaatcttatttctatctattctttaaataactatactaaaaactaagaaaacttttttgcatgattcaaatgaaaaatctttctcaacgatttctcctctactacttctactaacaagagtagacgtgcaaaatttatgtttgttcctgaagggaaaaccgttcgagttgttcctgaatagcttccttcaaaaggatttccgcttcctcggtgaatgtcttgctagaagatataatttcttggaattgaggtttagtatcttttaggtgtttacgtaactcatccagaaatttctttacctgtccaatttctaaggaatcaagatatcctcttgttccgatataaatagtagctatctgctcttccactggaagaggatttgcttgggattgtttaagcaattctcgtaatcgtcggccccttgccaattgattctgacttgttttatcgagagcagaggcgaattgtgcaaaggcttgtaactccgcgaattgagctaattccaattttgatttgccagctacttgtttcatggctttaatttgagccgcggatcctactctgnaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccagattgagtctcaactattggtaaagcagtcatacttccttcccctaaaagagaatttaatttagcggctctttctaaaaggcgtgaatgcaaataaaaaacatcccctgggtaagcttcgcggccggggggtcttcttaatagaagggacatttggcgataagcttgtgcctgtttggagagatcatcataaattattaaagtatgccgttcgcggtacataaaatactcagccagggctgctcccgtataaggagcgaggtattgtaatgtagcaggggaatccgccatttcagctactacaatagtgtattccatggccccctcttcatggaaagtagttactacttgagctacggaggatgctctttgaccgatagctacataaacacatattacatcttgccctttttgattgagaattgtatctgtagctactgctgttttgccggtttgtctgtccccaataattaactctcgctgaccgcgcccaataggaatcatcgaatcgatagcaataagccccgtttgaaggggttcatatacagaacgcctggaaattatacccggagcaggagattcaattaagcgagattccgaagctacaatttcgcctctcccatcaataggtttagccagagcatttataacacgacccaagtaagcctcgctcacgggtatctgagcaattcttcctgttgcttttacaaaactgccctcttgtatcatcaacccatcgcccattaatacaatcccaacatttttggattccaaattcagagcaatacccctagtcccttctgcaaattcgactaattcgcctgacattatttcaccaagacctataatacgagcaatcccatcccccacttgaactacgcgaccgatattctcaatccctacttttctattatattgttcaatacgttcgcggagaattttatgaatttcgtcgactcgaagggttgccattagtgtttctttactatttttttttcggaagcaaggggaaaaataatgcctaaattctaaaggaaagtagaagttcaaggcctaattaatttaactcttccattccatggccccgagaatgctaatattagcacgaatcgtacggaaatgtaactcggtattcaacaaactattcagagttcctagagctccttgtacggcttgttggaaaacccgttgtcggacctgattcatcgccctttgtttttcaaaataaagggtttcgtttttagacttttctaattgttccaaactaatagaagtggcattaatcaaatttgctttttctcgttctatctcagagtatccattcattcgatactcatccgcttctagttcgactttctgtaatcgaattcgagctttttcgagctgctcaatggttcctctacgcaattcttccgaatttcgaatagtactcaagatcctctgttttcgattatctaataaatcttttaatgaaagtagattaccttgctattaagtttacaacttttatgatctcttcccgaaccaaacatgaatctttcgattcatttggctctcacgctcccttttttctttttttgctatggctacttccatattttttttaatgtaatgagcctatcctctaccctctcttttctgtttatatttcaatataccgaaacccatataagactagataaatattaagaggactcttccgcctagataaaaatctatcgtgggcagcaaagttgtttttttatttgtatttgccctttagttaaaattttcaatttcattaagaaaaactaaatagaaaaatggaaaatgaaaatggatagaattcctacttttttcttcaaatccaaaaactttctccttttttatacataggtcgtcgattcggcattggataaaaaagggcagggtgccccttctagtaaatagttcaaaccattttatcgatatgagtgttctatatcagataaattctacattagctatttcctgtttaaagcatttggtactaatactaatatagttgtagaaagagtacccccttttgcctagacttcaagcagtttagctttaaccgtgttaatggtctcatattattggtctatagagaatcaaagttgatttgatttaccaataggtcgcgaaatgctatggttctttcatatgatttctgcatttattcagaagtaattcgtcgagatcgtgcacccttttcttatttattcgaaaaatactaaaaaatattctaaagtgcagccggatagatccaatctattcttgaaatagacaactcgcacacactccctttccaaaataaatcaatacaccaaccactacagttagatttattagatttgttgctaaaatatcggtattaagcccgaaactcccagcggatggccagtgagctaaaaaaacgaaagaatgggttacatttttcatatgctctcctcttatagataggacgaacaaagaacaaagtttttcgatcacttacttcgctcgccctttttgatcggtttttttaatgcaattttttttaatagaaatagattcaatttagtaatttcttttagattaagtcttagatctcgtttgacctgtgaaagacctcctttgttgaaatgttcccaaaattcctaaaataaaaggaaaaatactttccactgccctaaacaaagggcgggaagcaagacggcgaacatatcctctaaattgatcatcctcaaatcagctattcctggggtggggtattgtctgtccccataaatagaaaactctaggagtaataaattaggagtaaagtattgatataattggaattgcagaagcaaataccaatttactaaaaaaagaagaaagtatctaatctaaaggactcgttttcttttttaggattaaacaaaagggttcgcaaataaagcgccagtgccacaactagtccataaattgttaaagcttccataaaagctagactaagcaataaagtaccgcgtattttaccttctgcttctggctgtctcgcaataccttctacagcttgtcctgcagcagtaccttgaccaactccaggcccaatagaagcaagacctacggccaatccagcagcaataacggaagcagcagcaattagtggattcatgatgagttcctcgtgtcaaaaaaaagaaatggttaaggatacaatcaaccaagaaattcatatttctaagctctattggacagaagtaactaaaaagtacaaattgaaacgataatctgaattctccgaactgcttcgagatctcctttttagtttctaatcattagaggtttgtgtactcattattctatttctctttctttccaaccaactgatctttcattccatccttctttctttcctcttcgatatccttgagtttctattttttcccctatcatctaattcataataaaaggtgaaatagaggaagaacccctatggaaatcgacctaatccagatccaataggaattaaatcaagatatccaattgataacaatatgctgcatcgaattggatatggaatccgattccatatatcggattagataatgaatctaacttgggaatatataatatcccatatcaatttgtttcttctattttgtttgtgtattttctcattttctattgaatcggattcaaaaaaaattccttaaagtggaaacccatacaaaagatgactgaacttatagacataaaggatatagatctagcctgactccgcccctccctaatgcctatatactttgtttggcaattccgtaatatagcctattctctcttctacaactctagattgtatattcatacgcaattctaactattttgttttccaaccaagcgaattttccgcaaccatgcatgaattgagttaagctaaaaaaaagactattttgaaaactagtcaattcaatgatgaccctccatggattcacctatataggctgcggctaacgttgcaaaaataagagcttgaataccgcttgtaaataatccaagaaacatgaccggtataggaactactaaggggactaaagaaacaagaacaacaacgactaattcatccgccaatatattcccgaaaagtcgaaaactaagcgataatggttttgtgaaatcttctaatatgttaattggtaaaaggattggagttggtttaatatatttctcgaaataactcaatccttttttgctaagacccgcataaaaatatgccgctgacgtgagtaaagctaaagcaacagtagtatttatatcattcgtgggcgctgctaattctccatggggtaactgtataattttccaaggtaaaagagcacccgaccagttcgaaacaaaaataaaaaggaacatagttccaataaagggaacccagggaccgtattcttctccaatctgagttttgcttaagtctcgaataaactcaaggacatattcgaagaaattctgaccatcggttgggatggtttgtggattgcgaacagctatgataactgaacctagcaagatagtaattacgacccaagaagtgataagtacttgggcatgaatttggaaacctcctatttgccaatagaagtgttggcctacttctacgcccgatatatcgtataaccccttgagtgttttaatggaacacggtataatattcatattgtcccctgataaaaaatgaacttcaaaaaaagaattcttttgattcaaccatctttttctcaactcagcaacgtgaagtattaatcttatatttaggatatcaagaaatcacatcagatgataatatatatcaataccctctaatatatatcaatattccccgtcttttttctatgcaaaacaaaaaagaatagtaagtgattccataaatctacgcagttgcccaagaattaactattcttcttaatcaatgatttcttatatagagagaacggccctcacaaattgcaaatactaatttgttaagaatcaatcgaattgaagtcatagtgtcatcgttggctggaatcgatatattcgcgagatctgggtcacaatttgtatcggctaaagaaatagtaggaatccccaaaatggcacattcccgaagagctatatactctttttgctgatcgaggacgatcacaatgtcaggcaacctcgtcatatatttgatcccgccgagatatctttgcaaggtagataattttctcttcaagattgccacatctctttttgggagatggtggaatttttccatcttttcttctgctcttaagtctctaaattgagaaagtctagttttagtaatcgaccaattcgttaacataccactgaaccactttttattaacataatgacaacgagcccttattgcagctgatgctactaaatccgctgctctttttttggtaccaacaattaagaagctttttccctgacttgctgcatcaaaaactaaatcacaagcttctgataaaaaacgggtggttctagcgagatttgtaatatgagtacctttacgctttgccgagatgtaaggggccattttaggattccatttcttaataccatgaccaaaatgaactcccgcttctatcatctctttcaaattgatgttccaatatcttcttgtcattttttccacacttccttttgattttttcttttttttcatcctacctttccattacgaaatttctttcttttcgaagattaagaaagagccgaaatagcttgaaataaataataattgttccgatggaaccttctacatggtataagcataaccttaatgaattaactaaacttctttttaaattaaaataaaaatagaaaatctaacctcttagcgttctaaggtcaaaaatctagtttaaagtaaaaaatctgctttatgtatccttaaatcatataaatggggtaaatggtgattctgatgtctcatagaaattgtttgttacgtcagaatcagaagaaactaattctgtatggagaaacaaaatatctctcatttccgacgcaaatagtttttttttttgaatttcgaaataaaggttcttgttttgtgggtaacggtgcacaaatttttggaatccggtaccaacaggtataatcccccccagaactacgttttctttcaggcctttcaaccaatcaatacgacctcgtaaggcagcttttgctaaaactcgagcagtttcttgaaaacttgcttcagatatgaaactttgggtattcagggaaacccttgttattcccaataagattgcccgataatagatcgattcatccaaagcccgccctgctcgctctgctcgcaatagtccaattaattccccaggtgaaaaaacattagacattccatcttcggaaacccgcacttttgatgttacttggcgtataataatctctatatgtctattatggatctgtaccccttgggatcgataaaccttttggatcttattaaccaaagagatacgactttgggctatggttaactcagctccaatcaagaatccccaaggacccccaagaattcttggtatacgctcattccaatcctcaattctcctttcgagattcggcgatagtgaatcaattgaacgcgcttcgaagatttgttctacttttggaagaccttgcgttatgtcactagatctcgctttttcgtatataaacgtaactaacctatcccctttgtaaaggatttctccataatgaccatgaacagttgctcctgtagtggccaaataaggcttagctgctcttataacaaaggaatctatatttacaatgaaaatttgacctgatttttttatgtgcgatttaaatagacatacattttcgcaaataaattgtccaaggtgaatttttgctgatgtctcttcccaagaatcatgagggagaaagtgccaatttaactggaatggatccaacatgatgttactatcgaaatttgaagtcctttgattttcatttattaaagagtgtttaagtccttgaagtactttgaagttttgtttcaaattgtcaaggagcaaatgcttttttaacaggatctgattatacgttagtaaatagtaagatgaagaaaaattcgatatactaggtgcaatagtacctaagagtcccgaaaaatttcgaaagagcccccaaaattttggaataggaattctaggattcgattcttttaccccattgggattttttgaattcttaaaaaaaccaattcgagaacagttggatgccgacaaaaccatcaaagattggtattctttatttcgattcaacaaggtaccaatagcttcttgatgttggct

SEQ ID NO: 26832 - DNA, 867 bp, Oryza sativa
tgcgaatagcttgatgcactatctcccttcaaccctttgagcgaaatgtgcaaaaggaaggaaaatccatggaccgaccccattatctccaccccgtagaactacgagatcaccccaaggacgccttcggcgtccaggggtcacggaccgaccatagaccctgttcaataagtggaacacattagccgtccgctctccggttgggcagtaagggtcggagaagggcaatcactcgttcttaaaaccagcattcttaagtttaagatcaaagagtcgggcggaaaaaggggagagctccccgttcctggttctcctgtagctggattccccggaaccacaagaatccttagaatgggattccaactcagcaccttttgttttgagattttgagaagagttgctctttggagagcacagtacgatgaaagttgtaagctgtgttcgggggggagttattgtctatcgttggcctctatggtagaacccgtcggggaggcctgagaggcggtggtttaccctgtggcggatgtcagcggttcgagtccgcttatctccagcccgtgaacttagcggatactatgatagcaccgaattttgccaattcggcagttcgatctatgatttcgcattcatggacgttgataagatccttccatttagtagcaccttaggatggcatagccttaacgttaatggcgaggttcaaaagaggaaaggcttgcggtggatacctaggtacccagagacgaggaagggcgtagcaagcgacgaaatgcttcggggagttgaaaataagcatagatccggagattcccaaataggtcaaccttttgaactgcctgctgaatccatgagcaggcaagagac

SEQ ID NO: 26833 - DNA, 777 bp, Oryza sativa
tcaagaattggggcttcacaattactagccaatatttctctcatgcctttcctcgttcatggttcgatattctggtgtcctaggcgtagaggaaccacaccaatccatcccgaatttggtggttaaactctactgcggtgacgatactgtaggggaggtcctgcggcaaaatagctcgatgccagaatgataaaaagcttaacacctcttatttgactttttcactattttgaaatacgaaaaagatccaaatccaaaatgcaaaggtcgtcttattcaaaacctcaatcatcacatcccctctctcccacttcacacctcggaacgcactgttcttatagagagaaaggggctttcccatcttcttaacccgaaatgaaatggctgaggagagggaggttccttttggggggtacccccgggaagagatccagtggagacggggtgggcctgtagctcagaggattagagcacgtggctacgaaccacggtgtcgggggttcgaatccctcctcgcccacagccttccaaaggggaagggcctttactttccccctgagggtaggaaaaccatgatcgggatagcggacgtaaagctattgaacttgggtatgctctttccttttgtcgaagtggaatcgtagaacagaatgtgatacgatgagataaaatgcaatagaaacaaggatagcgaacgggttacctactcctaagggtcaaagcaagccctttaattcaattctttattcttacattaaagaatgaatcaaatctccc

SEQ ID NO: 26834 - DNA, 406 bp, Oryza sativa
atatatatatatatatatatatatatatatatatatatatatatatatatatatatatatatatatatatatatatatatatatatatatatatatatgttttaaatttctttgatgattgggctatcacatgaatgtcacattagtaaaaacgaccatcaacattgtcaaggagtttttttgcacgggtttagtggttgctaaataagatcggacctatattggggaccttttcaaaattctaatctgcttctatctaaaatgataagttggttaagttgggcttgaaggtcgaactcaagggtccaaagaaggcctctctgaacaagttgggctgggcccgtaaattctgtgtcgcatttgataatctcattcaaaaggcagtcaacaccctttgtccatgttc

SEQ ID NO: 26835 - DNA, 391 bp, Oryza sativa
gccctttctttaaaagaactatgttctgatcctggttcctcttcctttcactgtacagggaacaccgttacaaaataacatcatggaactgttttctttgcttcattatattgatccggatgagttctctgatccaaaggctgatggattgttctcaccaattgaatctggaagggatttgacaatggatgaaaaagttgctaggattcacaatattttaaagcccaggtgaatactctgaaataagtactatatatgtttaatatcttggacacggatatttttttgccgggttggccggaaggtttggtcgaccaatttcattattaaagaagggtattaaaaacaattgaacacggatcttaagtttcttgtttttgctaggatgttg

SEQ ID NO: 26836 - DNA, 4336 bp, Oryza sativa
tgcagcccgtatgattatgcctctggactgacaaacatcattataatttgcagcctggtgcagatagggtaattatatacggtaagtggttttaaatgttttcattcactgctaattatataatttgcaagtggatacttgcactgatttggccttcctatttccagatcctgacttcaatccatttatggacttgcaagcacaatctcgggctcatcggatcgggcagacaagaccagtggttgtttaccaactcattacaaagtgttctgtcgaggaaaagatactgcagaagtcaaagcagaagttggccatcgaaaatatgttgatgaactcttccaagaagccaagtgctgatgagttgcagtctatattactccatggagcaaagacaattgtggacaggaagatcagtgcaacatccatccattatgacaatgaagccattgagaatctcctcaagttagacccttccactggtgagaaatgctcgtcggatgataacggttatcttggcagcattgtgagctttgctcatggcgtcgaggatgaagcaccttcttccccaaaggttgaggatctgaaagttctcaagcctgctactcccaaggttgatctcggccgtgggaagaggcaaaggaaagtcgtgaactacgctgacgaggttgagaatgaagacagtgatgatatgtatgccccggaaggttcgtcgacttccgaattcagcagttcgtcctccgatgatgaaactgacagcgctctgcagctgcaaatagttacagtaccggacattgatgcagattaggtgtacaactctgtttcttactttctgtttgcgtctttgccttttgggacccttgcctttttagtgaagggatggaaatagaaggaagcttttggataggagcagtatatatttaaaggttgaagttacaagtgaggaggtcgatgtagctattttgggtgttgaactgtaccaccttatgcagaaacctgatgatgcttgatggaaatccattagacagcgtccttgctgcactggtcttggaatggctagcgtataatctgtcttggaatcactttgctgcttgtgatttgtgggattagtatctctgtcggtgtcatatcgtccatttgcaacagagtaatattgtttcctacgaaaccgtaagtttcactgccagaatagcagaaatatttttgtttgacaccccgacgttatataagcccgcgagccgccgccgccgccgccgctgctagggcggacgagcgctcgccatggcggctagccgagcgaggcaactccacgctctctacctgacgagaggatgccgtgacccagacatgtgggccaacctcgccaaggtctacgcctccaactccttcctccgggaggccgctatcatctactcgaaactactgccccatcgtactcaccacctgccccttgtcatcgtcctcctcaaggcaaccgcctcccgcgcggatcccgtcctcggcagggccctccacgcggaggccgtgaaatccgccaacgcccacgaccgcctcgtggggacgacgctggtgtccgtgtactgcaagtgcggcctcctggccgacgcgcgcagggtgttcgacggaatgctggaccggaacgccgtgacgtgcaacgccatgctcgccgggtacgcggcggcgggagacatggtgagcgcggaggcgctgttcgccggcatgggctcacggactcccgtcacgtgggcaacgctgatccgggggttcgcggggaagggcgacatggcggaaacgcggcggtggtttgaggccatgccgctgggcatgcagaacgtcgtcacgtggaccgtggccgtgcaggcctacgttgccgcgggggacatggagaccgcgagggagctgttcaacaagatgcctgcgcggaacgcgtttgtgtggtcgtcgatggtcaccgggaacttcaaggctggcaatgccgacgaagcgcaagcggtgttcgacaaaatccccgtgcgcaacttggtgaactggaacgcactaatagcagggtatgccaaaatgggatgctgcgagaaggcactggaagcatttcactccatgctaaaggacaagatcaagccggacgagttcaccatggcaggtgttctctctgcctgcgcacagctcggttcgctagagcaagcgagaaaggttcacaatttcatcatccagcaccgtatccggaagaaccagttcgttatgaatggcctggttgacatgttcgccaagtgcggtgacctcgctttcgcacgaaatatcttcgacaacatgcaatggaggaacaccgaatgctggaactcgatgatctctgcactttccagccatggacagagcattgaggctattcggttgttctccaagatggagtgttcggagcagaagcctaatgagatcacacttcttgccgtactcggagcttgcacacacggaggatttgtagatgaaggactaagaatcttcagcaaattcgatatttacggggttgctgctgcagtagagcattacggctgcctggttgatctcttgggccgttctggaagattgagggaagcttatgagattgtcaagaacatgcttgttgaacccaatgaggtgatctggggctccctgctcggagcttgcagggtgcatggcgatgcagagatgtctgaactcgtatcaagtgagatccaccaattgcactcccgtcgtgtgtcaaccaacgatgcagagtacatcttgctgtcaaatatcatggcctcgtcggagaggtgggagcaggctgaacgcatgaggagaaagatggcgctccatggagttgggaagaccccagggtgcagttcagtggagctcgagattactgaacaccaagtatgtgcaggcagtggtacgttatcccagctacactgactgcattttttgcatgtcccaaatgttcttccgaaagtgttttcacaagttgcccagaaaagaaaagcccctcatgtgctggatattctattaactgtacttcttatacatagatgattagacaaggacattagattattagacaagggaattatctgttctgttgcatccctttatcaactggtgctggcatagaaataactacacacttcgtgtcaattttatatgctaatatcagtcaacaggcacaattgaattatgtatttgaacatcaatttttgtggttgaaatgttaaaagaaaaatcttcactaacgatatcagaaaatacatttctgccaaatttccaagatcaaaggcaccaaaacgacttcagggtgcagttcggttgagcttgacatttctgaacaccaagtacacgcaggcagtggtacgttatcccaactacattaactgcaattttgcttgtctcaaatgttctggcgaagcggtttcacaattggcttgaaaagaaaagggattttctatcaactagtatgcttcttgtacatagatgactgtacaagggaaatttataatctgctgcatccgtttatcaactggacacgatgctggcaactgtgcaattccctcaataaaaaaacggtcatgtcaattttatatgcgaataatgtcagtgtgcaggcacaactgaaatgtgaaatgtgaaattctgtatttcaacattaatatttgagggttcaaatcatcaaatgtgaaaagaaaccaaactatcttcactaatgataccagaaaatacatcaacgccaaatttccaagatcaaagcaccattaactattaccaatttactgcattgcaaagagaacacaagaacagagatgataacgaaatggcatgatcatctaggactgggaattcagaattcaaccaagacaagttaaactagacaatcacttccctatcatagatccagctgaacttgaccttcctctgctcatccttcttagccctgtcctcagcccgctccgcggcccgccgcatcctcttcgcgagcccgcacacgaagtcccgggccctccggccctcgccggagagcccagtctccagggtctccagcttccaccgcttgacgaggaactcgacgatgtcggcgtagtcgcgcgcggtgtagacgttgaggcgctgcgccacggcggcgaagtggtcgaacaggttcatgtcgcggccgtcgtgcatgaggtgcgcgggcatggtgatccgcttgtgcatcatgtcggcgatggcgagcatggcgccgtccgggtcgagccgcagcagctgctccacgatgcgcccgtacgccgtctcgtgccgcttctcgtcggcggcgatggtgccgcaggtgcgcgccaagacgtcgtccccgtgcgcc

SEQ ID NO: 26837 - DNA, 3968 bp, Oryza sativa
tacatgtacttgccgaggatgtcgccgtggcggttctcctcggcggtccaggtgcgcgtccagacggcccaggggcaggcgctggcgccggtctcgtcgcggacgccgtcgagcgtgttgatcatggtctggtacgtcggcagcgcctcctcggtaatcatgtccccgaccagcacgacgaagtactcgtcggggagccccgcggcgcgcgcgcggagctcgtggacctggtgctcgaacatctccgacgacgagtccggcaggaagtccgtcggctgccagcactcctccacgggcttgagcagcggcagcagcgacgacctcgcccacccttccagcgaccggaacacctccgccttctccggcggcatcgagtgcgtcacgcggcgccgcgtcgccgtcgccgtctccgcggccgtcagcaccgccgcggacacgcggcactgccggcgcgagggcgccaccaccgcgccgcagccactgacacgcacggttcccacgacctgcatgactgccactatcactgtcagtcaactacagtagctagttggtggttggtttcttgatttcttctgcctttctgggatcgccgagctgccgcggcgtggtatatgaagggaggggattcgcctccaatggtgggcgaaaccgaaaccggtgggtggtgcagtggttttgtgcgaacgagccgatggtgtgggagagcgaatcctgtgggtgctcgcggccgttttagccacgctcacagctgggtgcacggctagcctccacggtgtctgaggctcatggcttgtctccatttttggccagtgtatcgggtccacagatcgtagtgaacacgtccgttgctttccagtttccaattttccataccggagatctggctgtccctctcgatacgatgtcgccatcacaaaagggaccggggtcaaacggtactttgtccagctgcatgggacaagtaatctggccggcagtgacgtggccatgttgggaaaaacgagctacggcgagaatttttactgtcaactgtggagaacaaggtgaccaactttgttgaaatgggtggttcgtttttgttctgttgtgtgagataagcaggctggttatggtaaacaccgtggtccgcccctggatttcactaccaagcggaacggcacgtgcggcttgtgcatgtgcagcgctggtccatatacaagtggcatgcatttcgcggacgcgctggctgcagagggattccccgagcccaccaggcgccgccaccgcgcgctgctcgcgaggaaacaatcgagaccaggctggcctgcccctggccgtctggcgccgcgacctgcgacagattcaaaccaaaaccgtatgtaaacccactcgctcaccaagcggtttcgtatggccaagcatttaaccggagatccgcctccacgtcccgtgcaagttagcgtccgtgctcagcacgaactcgccattccttggaattaaatttaaaaatatactattgattcgtttttttttcataaatactcgggatgtaaatttgttagcagaaatatactgtcgatctcgcgcaaccgtttcgcataagtgacgtggacgtgacgacgcaaatagcatctataacaggtgtcggccccgtacaatgaaaccgtgacaccaaacgacgaaatcgaggacgtgcgtgcagacggcgtcagaccacacggtctcgcgcggccaaaccgcgagaccgagcagtctctctcaatcagtgagcgattacgacggttgaaaattgttaattagtgattgattaattgttaattaatcactaattaggataattaatcactagttattattcgataattaggataattgatcactaattaagtagaaccgctggacaagacgttcggtctcgcgatactgcgcggtgtgcgtcgtcacgcttctttgcacaacggttgtgcgagattgatggtatatttctgctaaaaattttatgccacgaatatttctaaattttacgccacgaatatttctaaggaaaaacaaatcaacagtatatttttaaatttaattccattctttgtcattgggttgacgagacgttctggaagccgttcttcttcgttatcacgccgactcggtgactccctggttcgcttcaccgaagcgacgaagatactatgttcggaacgagggttgggaaccgtcactccctagcacgtaaaataaaacgtatgattaattaagtattagctaaaataaatataaatatattaatatgatttttttaaaaaataacttttatataaaaaatttttcataaaaaatacaccgtttagcagtatgaaaaacgtacgcgtggaaaacgaaagaggtgagttgggtaagtagagataagaaaggagtgatcgcatcacaactcacaagcacatcaccggaagttttgcacttccaccatgttgtaaggaaaaagtttatattgcctttcctcaactatagtttaagtccgattcattttctcaccgtaacattaagactccttgaactagggttggacgtttggtcaaaccaaaaaatccggtctcgatctttgatcttctacaagtttcggttatctaaaaatagaaaccaattaatttaggaaaataatgaagatcaagaaaatcagtctcgatctcgatcatgactgaaatatcaaaagttctaaaataatcagggcaagtctaagttccagattaaaaaaaccatacacataaacacacacccacaaaacacaaattgactctcttcgctatcacgggccatatatcgaagcatgctagaggccaaaattcgatttaattgggttgctggaccttaatagtcttattgagccaaaatttgatttgtgcagtttatttagttaatcgaaggtactaactgaattgaccgaatgaaattcggtcctttaacacctgatactgatcaaatttctcagctttttcagtcctagttccggtctttttggttcggtttttttctgtctaccctggcttaacaaataaaatgaggagtgaactcctttgatggtttgctcagcggtttcaaccgacgtggcgtattcacctggtccacacgtgatgagtcagtatacacataagcgtcgatattgacgtagttaataataataataataataataataataataataataataataataataataataataataataataataataataataataataataataataataaagcaattagtccatatgtcatcctctctctcctccccactccccactcccctatcttctcacacatcggccatccttcatcttcgtcaagtgcactgatagcctaatccctccttttgccattgagtgtgtcagcggttggatccgctggggcacatgcaattcaaggttgtcagtaccccaaactgtataatattttacgatactaggatagtatgctacgaattcaaaacgatatcgatctcatctaatatcgtaattttcatagttactcgatcttactatttatttccacacgatcctacgaaatcttggatagtatcccgatattacgatctctacgatcctaccaaatattatttaataaggtggattgaaaataatgtgaataaatatgctcaagtttacataaaaaccaattaaatttatcaaaatcaatattatatattttaatttatacaacatattatatatcttatataaaattatgtaatttctaaaatctgatagtcttacgatcctacggtagtatctagatacttattaccttggatcatggttgcaccgatccaacgacgaggccaccacctccaagcactagtgccggagtgctccttcaatcctctcaccaccaccaccatcgttgatactctctgccactactgttgatgatagcacgttattatacgccttgcctctagctggtctctcctcatgcttcaaaggg

SEQ ID NO: 26838 - DNA, 5093 bp, Oryza sativa
ccagatatccaacgtcccttaactaaccaaaaccagtcacaaatggttctctggtggttttgaccccggttttgtcctacgtagcggctgagtgggccccatatgtcagactgccacatcagcctcctctctctcttttccttcccctcttctctcccttccttatctctctctctctcccttctctgacccccatggctgccaccgccgcctcctcaagctctttgccggtcttgctgtccttagctcccccactaagcgctgcaccgccgccgctgacttccgtctcctcccacgccgaagcccaataaggtggtggttgtctcgccgccacttccactctcactcggcgccgacatcgtctcggccgtcatcgtcatcgtgggcgccgcgtccatcccggacacgcctaacagcttcacgctgcgtgggaggctcaacgaggcccgcgacttgctgtggcgcatccgcagggccggggcggccaccgccgacgtcgacgccgagctcaaggatatcggcgcgttgccgaggaggaccggaggtacgagtcgggcgcgttgtggcggcttcttcgttgcaagtaccgggcacacctggtgatggccgtgctaatcatggtgttcaacgttgatgtggcagcctgatatatggagtccacatgggtcccacgctgactcagccgccacataggacaaaaccggggtgaaaaccacggaaggaccatttgtgaccggttttggttagttaagggacgttggatatctggttttgcggttaggggacgattttgtaactcgttgacaagttgagggaccttcggtgtactttttccaacatagtttcctacaggaataagttcacttcatgacccttaaagagtgatcgaaatctaatccgtaaccctaaaccacaaaaccggatatctcgaccccccaaactcttaaaaccggtgcaatttgactcccttggtggttttggagagcggttttgctgacgtggcgccacgtggcacctacgtggcaatattgaccaagcctttgatccacgtggcgtttgacgtggcacttacgtggcattaaagttaaaaaatttacgtgggacccgtttgtcattcacacacagaaaaaatgtggggcccactaactgtgggacccacatgtcagtcctccttcctcctccctctctcccttctctctctttttctctccccttcttccccttcggccggcggcagggcatgggctgcggtgtggcgccacccggcgggagctgaagcggtccccgcagtggaggagtcgacgatggcgaggccagctctcggcgagatggggtcgtcgtctgttctccgcactagccggcgacaagggtgctgatcggtgccagcgtcaccgtggccttcttgctcctgctcgccttcttcttcatcatcttgccgcgcggcggcacaccgccggaggtggtatcgtcgtccaaggagggcgggatccgggggcgtcgcgatggcggcggcgtattccaggttgagagctatggggagaggtgcgagcacgtcgccgaggaggatggccatgatcgccggcgattcccgcgtggctacgtcgactacctgtacctgttcgactgcgtgttcggtgtggagcggcgggttcttggctacggcgtgatggcggcttggctcgccgtgctgttctacctgctcggtgacacggcggcggtgtacttctgctccagcctcaagggcctctcgtggctgctccgcctctcccgacgatcgccggcgtgacgctcctgtcgctcgggaacggcgcgctggatgcgctctccaccatcgcgtcgtcgcctacggcgggggagagggggagaccaccaccgtcgtcaggaaacttgcaattcgctcacaactcacacgctcaacctcactgaatctctgaaactctgaagattgtaagactgtgaacagtaaactgaaaaaccgaagaacagagttctgaacagagtggtttttgtgctgcttaagtctcaccagtcaccgcagcttctctgttttcttctctatttattcatctccatcagcagttcgttacatgcataactggaaagaacaagccagacttcagccccagccactatatgcatgcaaaacagaaattaaaaagctcaagattgcacatcagcgcacacggcatcatcgccgacgaaccaccaagatcccgacgcgagccagcttcctcttctctcgtcgccatcgtcccgctcccgttcccactccctccccgccgccgactgcctccagtcgggactatccaagaagagccgcggctgagcggggacgaggagcctcgccctcctcatcggtgctgaacgggcgcgagtggacggagcggcagccggacatgtcccccgacgccgatgcagttgatggagatgtggtccagcgactcgcgagccgtcggagaccgcgccggtaaccgcaagggcgaggatgacgagcagcatattgggccgccgccgccgccgttcccctcgtcctcccactatcgcgagcctccgcggccgagccgccgccgtcctagccgccgactgcgctgcgccccgatgccgccagccgccgccgctcaccccgtcctcccgccgctgctggcaatgaagaaagagagaacgtaggagaggactcactgacaggtgggccccactttatttttttaatttatttgatgactagaatgccacgtaggcaccacgtcagcgaaaccgtcctccaaaaccaccgaattgcacttgttttaagagttgaggggtcgaggtatccggttttgtggtttagggttacggattagatttcgatcacttttgagggtcacaaagtaaacttattcctttcctacgtgcaacagatgtgcccaggccggactttgagaacgtgcggtccgtagctgttgggtcggaaacggcctaacgggatccccacggacgtgtgggctgttgtagttgggcctataaaggattgcccgaaggtttcggcctcttagatcaggccatggaacactaacgcgccgcacatgaaagctggcctagatccggcgttgtgttcgtttagaaggcctcccaatccatcagcccatctccggttctcctcacatttaactctgagctgagaatggcagaaaagttgcagacctcccctaaccttcgtgatgtggacagatcatgggcgagtacggtcgtaccgatgaacacttgaccctccgtatggccgttgatgttaccggtagggtgatactccctcggtcccacgatataacaaattttaaattttttcttagaccactcgtttcacctcacctcaccaccgcgcacgaccagagaaccaccaccctcctctcgacaccgccaaagtcaaaaagcaaagcgtcacgtcacgtagcgcagagcggctgcaactcaatgccaggtgggccaggtcatatactggccccacaggtcagtgagcctagaaacctccttcctcctggtatctggaagctctggtatttaaatcgcacgcgttcctcagccaccgccctcctcctcggcgcggagccgtcgtcttcctcctctactcctcggacttggccctcctcctcctcctcgcgccgcgccagcgctgacgtagccgtaggtcgccgggcgacgcgcccactaagatatcgagcagttccggagcctgctcagggggctgggtgcggccgctccggcgatcgccggagaagaagggtggttggaatctggtgagtagccggccctgatcccggtcgtcgtggaaatccttccttcctcttccgtggtgggcagcaagagattttggtgctccgtgatctggagagctgtgcgcgggactggggttaggtggcccccccaaggttcgatccggcccgatttggcggagggattcgaacgcggcgtattgggataggaagccgcgccggtggatttgttcgagcagatttggctgctgggggtttgtgtgatgggagatcaggcggcggcggatgcggcggcgagatggtgaccgggagctttagcaggagcacgtcggcgcggctcacagcgaggggcggcgtcgggagcccgcgggtgtcggcggcggcggccgcgcaccgcaagtggtggtggtgggcgccctcggggccgtcgttcgagtgcgctgccttggccttcttcctttcctccgtcgcgctcgtgctcgcctgcgcgctgtatctgtatctcttccggtaccagggccgcggccatgcggtcgccgagttcgccggcgacaacctagagtcctgcgacgtgttcgacggaagctgggtgccggacaggaggtaccctttgtacaatagctccgattgcccgtttgtggagaggggattcaattgcctggcaaatgggaggaaggacaccggctacctgaaatggcggtggaagccaaggggatgcgacttgccgcggttcagtgccagggatgtgttggaacggctgagggggaagagggttgtgtttgtgggggactccatgagccggacacagtgggaatctttcatctgcatgctcatggcaggggtggagaatcccaagactgtttatgaggttaatggcaatcagatctcaaagactatccggtttttaggagtgagatttgcgtcattcaacctgaatgtagagttcttccggtcggtgtttcttgtacaacagagccctgcacctcgcagtagcccaaaaagggtccgagcaattctcaagcttgataagatggataatatcagccggaaatgggagaatgctgatgtgcttattttcaactcagggcattggtggactcccagcaaattatttgatatgtgagttttcttattgtacttgtacttagcaacaccaatttgttcttagaattgttgtcatatctactgcagttaacttaaaaatcatgaacctaatatatgtttgctccaatacatttgtttttgcgaaaaatccttggatagatgttctgtgcatgccaatggtttggcatataggtagcacagtgtcgctttgaaagatatctgttatttagtatgtgacttcta

SEQ ID NO: 26839 - DNA, 1656 bp, Oryza sativa
atgtctttttccgcacgtatgagccatctcattggaggtgtgttttctcacatacatcggatcttttccagtgtattgttcttcttgtattgtgttataaaggcacctaatgaaaacaagactgctactgttgtggtttgaagaaagtgtaaatgatttgcgaaagacatacactcatttgtatttttttccctttttgcatacttacagtggttcaaatcaaaaggtatgtgaagtaacagaatttcctacagctgaggccaaaggagatgacagaagtgaatttggagatatactcgctggggttgtggtgaacatgagcgttcctgcaactatcttgaatgtgactttgatgggggccttcagaagtgatgctcatatcggtatatggagtcatccttcaaccatacttgattgcagtcattggtgccttcctggagtcccagatgcttggaatgaactagtaatttcccaccttttgacaaatggtgagatcctttacattatcattcttttaacatattatttagagtaaagtgtactgatggcccttaaacttataggggtgtgtcatctaggtctctaaactctcaaaatgcatattcaagtcctagaacttgtcatagtgtgtcatctaggtcccaaatcgccataaccccttcagcatcctacgtggcgttgatgtggcatgccacatggacatgatgtggccatcattttgactgacaaatggaacccatttaattatagtcctattccgttattcttctctttttttcccgattggtctccgttatatgtgacccgagcagaaaaaaaaaagaagaatgagaagaaaatgaaaaagaacaataaaagaagaaaaaaagaaaatacacgtcacgtctatgtggcatgccacatcagcgccacgtaggatcctagaggggatgtgtcgatttgggacttaaatgatacactttgacaagttctaggacctggatatgcgttttgatagtttacggacctatatgacacaaccctacaagtttaaggatcgccaatgcactttactctattatttataacactattcctgtaaagtattgtgtagtaataatcccacaaaaattttcttctcttaagttattttttgttgcaagctaacctggaaccctccagtttttttatatatagtgcaaaatatgccatgtattacttggtacctattgtccccccttgttattttttctttgacatcaaaacctggtaagattgttcggttcataattaaaaaactgaactttgtactagctttgtgtaaaaccaaggactaaacatgatgattgctcaatgttgaaattgggtgggagagaacttacctgaacacaggaatacttccaacttacctatactccacttgtcaaataatttatggtaatcttatcccgaatatactttgaatgtgatagaaaaaatagtatctatactcctttaaaagacctcaatggtggtggtggtgaatctgccaccatacctatgcacttatgtgggttcatgctgtcagtgtaaccacggttgtgcttgaaattcaaatcagtgaatccatcatctaccactctacatcaaaaggtgagccatatgaaccagcataatccattcacatcgaatttcaaa

SEQ ID NO: 26840 - DNA, 1492 bp, Oryza sativa
tgaaatcatttagtatttgaaaatgttgtttgaagttgtcatatttttaaattcaaattcaaacggttaaaaaattgttatatagaaaaatgaccaaaataaaagatatagatcttgatgagttattcaactttgttattgatgactttttcagttgaagtcgttcactaacaaaaaaattctatctgaatttctcaaactttgaatttaaaatatcaaattgtttaaatagagttagatggagaaatgaccaaaagaaaaattttgcacctcgacagctctacaactttggtttcggtgacttttccatctgaaatcatttattaaccctaatttttcttcgaagttgtcaaattttgaaaattcaaaatttgaattgttcaaataaacttatttgtacaaaggaccgatacaatagttgtagatctcgatgagttatacaattttattctttatgatttttgatggttgtgtatgtgaatgaatgtatatgaatgggggatgttggggtgtgacatatcctggcctagggcttaatagaattaatagaatgctcataccaacaagctacaactactcttccggaagtagttctccacaaaaaactttgatattaaacgtgcttggtctggagcaattttaggatgggtgaccgatcgggaagtaaacttcgtgcacacgaataaggacaaaaaaaaaggattggcctgagaggggctggacagcatggcaaggctagccaaaaataaaatttattttttttaggattatactcatcagtgacgggcattaacttaggcccgattgagatgactcatctgtgacgggctatagtttgacatgtcgtcagggtcaaagctatcagtgacgggctttaattagggcccgattaagataggttcatccgtgacgaccgtttgcccgattgagataacttttcacattagtgacttctagcctgtgacggatgccgtacccgattgagatgggggttgccgccagattgagataatggtatccgttctagtgaacacatattctaacattatagtataaaacataagtatctttttttctttataggaatagactcaatttggttaagtcgatactttttgcactctcaactttctacccttgaaactaaccgtaagaacgggtagatggtttatccatcagttcgtagctaacaagggtcgttgcaatttgcaaaaaaataatatcctataatagtaaaaaatagtgataattaatagtattacgtacgactgtgatagttcaatacgatggacaggaagttagattgggacatggaagcagatcatgcatgaccgtctcaatcgcgcgcaacaataatctactctcttcgtccttaaaaaaaaactaaagtaatctagtcatgagttataatatttgactaatttgtcatatcatgggcaagataaagctactagcagatgggattgtacgtgattaaaggcacagaaaaatg

SEQ ID NO: 26841 - DNA, 15803 bp, Oryza sativa
  unsure (1)..(15803): unsure at all n locations
tgttgtgcaacacattaatttggtctttccatctaaatcgcgtcgatgtaacagactttttattttccacaaagatgaactttcgctacccaaggttccgaccaatttctatggccacagtatttaaaagttttcgcttggtattttatatacatataaggagcatatgtaaaagtgagagagtttgctatctatggaaaacagtagttaaatttactagcatttgcaagttgcaatcatgcatggaaggatggaattgcacattccatatatatgagtaaatttcacagaactacatgtactttaaatcaaattatcgtaaaactatatatttaaggtaatgtgtcacacaactataaatttaagaccaagtataaaaaaactacaaatttaataacaaaattatcacaaaactatagggtatgtagtttacatccttacctctaatattatgtttgagttataattgttcaaattttgtgattaaattggtgtaaaatctgtagttttgtgataactttgttactaaatatgtagttttgcgatattctaccttaaatatgtagttttatgataaatttagtgttaaatttatagttttgtgatatatgttaaatctgtagttttgtgatagtttggctaaaatccatatagttttatgaaatttactccatatatattgaatatattattgaatgttggctcctatcgtgcttttctcttctgagggactcttgtatgtatatatgtctagattttggagtaagataagtttaaataactctttctttttcgccttgatcaagacattgcatcaattttgtaaaaaagaaaggatataaggaatataattacatccccacgctatatagctataggacacatataaccataatgtttgaataaggtgaatgaagcaaatacattaatgctttccatgaaacacacaaaaaaaaccatgtattttttatcacaataattgaacaatttctgcactatttctttagaaaatcatgcgatccaactagggcctacacgcacatttgcaaacggtgacatctattgccatgtttattctaaacaaataactcttgtttatcaagaatctatgtaacaccaatatttttttaaggcaacaaaccaaacatccacactttaacgaaatataacggattataatgtatcccccctaaccacctctcatttaatttttactcaatattacccctaaaggcccttccactcctcacataccccttctctaataagtggcattatagttttttccctttaaccttaatctctcttagatgagtacaacatagtatttattaattctaaatttcaaaaatattaaataaaaaatataagtaaggcttcaagttgaataaaactctatatctattattataattctagaagttatttaaaaactaaatttagagtgcataattagtcgacatggtattgttaattaattactaattactatagtaaaacgctggataccacgaagggacatggtagcgatcaagagaggaatgagcgctctaggagtcgaacatgagacgtgcccgcgctccacagcagccccttttgccacctgcactagcacgcagtctcacttcctaaagtatcaactatcaagtaaatacattggaacattaaaataataattgataaaggtactaggatgattctatatacaatttagaattagactacatttgagttttgtatctataaatgcaattatattgtttattatatattaaatggtatttaaatataatccccaataaataagataactgattaacaactaatattgttgttaacgcgaaaaacacgcaatggcctaagagatatgcttaactctagtgcaggtccaaagaaattgccttcaggttctcagcgtgctagctggtttgattgtgcaaccaacaagaaagaaaaaggaaaaagttaaatccaccaacgatagcagatcggctggattgccgatgacgtatcttccggagccatgccgatgtgacttgcatcggaccagcaagggaagataaaacgtagagattattagatctacttgattggctgtagatgtcaatgatacatagcctatccaacgaaacacacttagatcgggtgattgggatagatcggatgttatgccgagacagtataaatcactcaatatctaactgtacctcaaagcagaggttacgtaggttcatagcatagttgatggggcaaacctaacgtgtatcggctagtactccgataccgctttatactaagatatcagcgcagataaaatatacaaaacaaagatcaatatggcaagcagggtgcattaacaaattgatatatagaaagcctaatatgctttaagcgaatgagatcttcatataaagggcagatttagacgatcaagaaccgggtagggaaacaaaacggctaaatcaggtaagatcggctgaaaccccgatactatctctattagtaatcaaagaaagagctagataagacgtctcaagatagcacttaacagatcgaacctaaccgatgcaacattaagcgtgaaaagaaacataagatctaagcaaatcaatgagaactcattcaagatggtagatatactgcacaatctagcttggtgtcgatatctaaatttatcggccgttttcgatgatagaggctagccgatgaagttagatgacgaaatctatctagattatacagcatatatgataactcggtgaatcacataaacaggattagagtgtcataaagatgtaagcactaatccagagaacacaaaccgccatagcaagctttacctctttgtcggagatcgaacccgatgtagcccaactcgaaagcaaaaactcgtcgaaacaatgagaatagaaaagggtggcgatgcgccgaagtattattgaactgtcgttctgtgattacaaggtgtcaggtcatatttatacccgaagtcagggccggcccttgccctatgcagccaaggcgaccgccgggggtgggggggcaacacctaatactagtaatctagtaccttatccgatgttgagatcaatgatttttattcagaattaaaggtattgcaagtgagttttctaaattcttcgatatgatgtccgcgcctgagattctgaaatttgttatgaatgcatatttctatccaaatgtttcagatgcctattgaattctcttaaccgtacctgtgacggtagcttcagctgagaagtttttcaaaattgaagttgttgaagaactatttgagatcaactatgtcacaagaaaggtcaaatggcttggctatgtgctcaattgagaaggatatatcggacactattgatcttaattccgttctggatgattttgcatcaagaaatgcctgaagaagtatctttacataggaagcagtggatacgatggggttctattcttcattaagttaatgaataatgatattagttccaagtttcaaatatattgttattttggtcgactttatttcttaataattaccaggcatgttaaatttaatatatggatgtattacaagaatatgcggatgggccaaaaaaataaatagtttgggccagaaggaaaagaaacagatgtgagaaaaaggaataagttcatctaaggtcccttaactttcaacgaatccgattttcgtccttcaaccacaaaaccagatacaacgggtccctcaactatcaaaaccggtgcagattagatccctcggcggttttgaaggcggttttggctgacatagcacctatgtggctagtttgacttggtcttgatctgacgtggcattgacgtggcgcttacgtggcaattcgatccggaaaaataataaagcccgtgggacccacatgtcagtttcacatagaaattaataaaaaatggtggggcccacgtgggccccacatgtcatcctcacccctcttcttcctcctctctcccaatctcccctctttcctcactgaccggtggagcggggcgatggacggggtggagcggggaggccggcggagcggagcaggttcgcgggcctcactgaccagtggagcgggccgatggacggggcggagcggagcaggttcgcgggcagagcggcggcggcggcatgtcaccctcactcccctcttcttccacctctcaacctttttgtcggtggggagccgacgcggtgactgggcatcggcggcgcgccggaacacaaggcaacgacggcgtggaggagggtggtgccgttggcgcggcaagggaggtgctggtgacgatgggggcggtgggagaggaggagagcgtcggcaacgcgggaaagggcgacgaacggcgcggcaagggaggagttgagcgggcgggtggcgggagagcgagagagggcgacgggcggcaagggaggagctgagcggcggcgcgcagcgggagagaagctgggcggctaccgccgccgccgaggagggcgtcgcaacgggcggcagagagatgggcggctgccggctgccgtcagggagaaggtgcagttccccgcttcttaccattgccgctccggctaccaccgctccgcgtgccccgctctgctccgcccgcggcccgccgccgccgtgctccgctccagccgccccactccaccggcccgctccggctgccgccgctccgcctgccccgctccgctccgcccgcggacctgctccgctccggccgccccgtccttcgcccgctctagtcgtcgccgccccgctccaccggtcagtgaggaaagagaggggagatggggagagaggaggaagaggggtaaggatgacatgtggggcccacgtggggccacgtaagcgccacgtcaataccacgtcagatcaagaccaagtcaaactagccacgtaggtgccacgtcagccaaaaccgccttcaaaaccaccgagggacctaatctgcaccggttttaatagttgagggacccgttgtatctagttttgcggttgaaggacgaaaatcggattcgttgacaagttaagggaccttagatgaacttattccgtgagaaaaatatttgggccaggagacaagaacatccggatgggccaaaaatacagtttgggccagaagaaaagaaacggatgtcaaaaatattaaaaacaaattggcttcgcccggactcgaaccggagaccttcagtgtgttagactgacgtgataaccaactacaccacgaaaccgatgttgtacttcgttgaaaaatttgtttttaatattattttagtacccctaactttagttgctttcagaaataagttctaaatacaaaaggtgctaatactcataattgaattctttcacccgaaattcctatatgctatgcttgacgatcccaaccggaataacgtacacagttttgtccataggataaccatactcctcaagtcccatttgctaaattcagaggtataaaaacagaggggcttgtactagtagtagtagcttgtaacacgacagccaaattacaccagcaactagtacgagtacagcaacaaaagtagtaggagtagtactacatgcataatctcatcggctgcatgcgtccatccgggttcagagctgcgtttggaagatggtgacgtggcgcaggcgctgcgccatgtcggccaccgagcccaccgccgcgagcagcgacacgacgagcgcgccgacgttgagcgcctgcagcgccacccacttccggctgcctctctgcaccttcgcctgcgccatgtacatggtcaccgggaagtacaccgtgagcggccagaacgcgacggcgccgagcagcccgagcacggcgttgaagaacggcagcaccagcgacaccaccgtcgtcacggccacgaacgccgtgcgcagcaccagcttgcacagcgtgaaccgcaccgcgcgcccgccgcccagcggcaccgcgtactcccggtggaagaacgccgactccggccaacggctcgccagccacttctcgtagcacgcgaacaccggctgcgcgtacacctggtacgctccgaccaggtggatgacgacggcaacgttggcgatgtcgacgagccagaacggctcgaggaagccggtgaggacgttcccgggcgcggcgttgccgaacgccgcgtacccgacgcacccgatcgacacgtagaagacggtcgtgacgccgatgccgtacaggctcgccctcttcatcgtcacgttctccgacggcggcgacttcaccgtgtcctggatctcgatgagcagcatggagtaggtgtacgcgaaggcgatgttcccgagcgcctgcaggaagtgccacgccttggtcgacgcggtgacgcctccggcgccgaccctgacgccgaggagggtgccgtgcgccgcgccgtgcgacgcgaccttagcggcgctgaggaagagcccgacgaaggagtaggtgaacgacatgacggcggcgacgacggagatgagcgtcaccccctccaggctcgggcactgggacaggacgacctccgcgaggccgaacagcaccatgtacatcgtcccggacgagccgcaggtcgcgtccggccccttgtagtggtggcagttcgtgcgcaccactgacctgcattctcacggcccaaatcctagtacatgttactgaacaaaaatttgccaagatttttcagggtggccaagaagctggagctaagcttacatgatgctcgtagcggtcgtgatggtgtaacccaccattgcgccccagagaatcgcgtactgcgcaatgccacacacgaccacgtctcgaggcccttcacacgatcgatcaaagcaacagtcttgtcagaaatcgcagagattttgcaggagaaaatgcaggtaagtctcaaaggttcttagctaccgaggcatgagcggacgacgtccatgtaggtgtagttccgcttgccgtggacggggtccggcgtgcggtagcagtcgcagaggaggacggcggtgtagtaggtgatgtaggcgcagacgacgagggcgatggggccgagcacccaccccatctgggccacgctccacggcagcgccagcacgcctgacccgatcacggcggtgatggcgtgcgtcgtcgccgtccataccgttcctgtgaaaaggaaacaaaattcagtttcgtcagtgccattcttgcgttcttgtgagaaaaaaaaaatcctgtgagaatgtctgacaggtcactgtcatttacattacgtgtgacattcttgccttcttggtctcttggaacacctggctgattaagcatgaacatcaataaagatgcagtgcattgaagagattgccatatcagcgcggctaaaaagagatcgccagatcatagatcaattacagtgggcatgatgcaacattgcacaagtcaacttcccagtagtgtaagaagccatcattttttcaaaaggatctccaggattccatcatgtgtcataaacaaagaatccgtttgatctactgcccatgcgctggataccataacgtaaagcagaccaactaacgagtacaaatagagcaacaggttcatatattacgcatgtgatttaatcaccatgtcctaaagcagtaacacttaaaacaactaaagaaatatttgctgtcttacttgtgttaaactaacgaatcatcgcaaatgtataaacagactcttttgaacaacgtaagcacgcacatgaatgaaaacacttatgtaatgctctggtggcctatgtggagtatgatgtggtatcccaaccaacatcaacatgcaaaggaagtatgatgtgaaatcaggcacttgctccctgatgtaaagtactagcagggctaaagtacagtcaaacttttgtccagtaaaattccttaattacaatagacaattgccccgaaatcctattatttgacatgagtgtacttatacttaactggtcattgtcaagactgcttaatggcccgctcttcatcacagcctatgatagctagtcacaactcacaacagtacacccaagataaccagaaaaaggaagtagtagtacaacagaatatgcactatgttttactttaataccatgaaagctatttgtcgaattaggatgcgtgatgtaagtggagagagcacaagctgcaggttaatttgcagccattcatcgatacctaatccattgctccctcacgcgaagaagaaacgttccaataggctattgccaacaaatagtgttttccattgtttctgggattccaatataacattaggataatgattgcacatattgaaattctgcctataatcctggagtattagtactgctgtaccgtataacactagtaaagccaaggccacttggacttggtagggtatatagtagagtagaggtagtgcctgccaagtcattggcgatttggatcttgcaagaggttgcgtgctgtaactatatgggaattaggacccagttcctgcataaatactatgccactaacactgttactatccttcacgttgtcctagtaaaagcagtggtaacagaagcttcacgcaatggatttcgcattttcaggtgttggttttatccaataatgctagcatatacgcaagatgcctctattaaatctatcccgagtttcagggatgttgctgcaatgctgtgacgagtgttgtgtgtaaaacagaagaaagaatatgtgcgtattcgggagtgtagcatctcattagctagacatgcatccaagaaacaagacatgtaaaaggggacaactcttttacatggcatttctttaagataaaacactaaaataggcattgaattcattatatggcagtgtttaataagagaagtgtaaattccctgcctctgcatttgcagtgtgtatttgtttggttcttccagtacggcgcggcgtaaacaaaatggaaaagaagggtttgactttcagtgcccatgcatgcgtgtatgctccatcagacggcttggacagcaaaatcatgcattgactaattccaaatcttttttttttttgcatgtacttggagaagcaaaacgagagagtcctacaaggtttcgaaaggatgcaagacaaccgcatgttccatagcgcgctgaagtctgaaagcgtctttccactgggcacacatctggctagctctcacttgaaagagaggcacaagtcaataaccaccctccaacgtacgccagcaatgcacgtttctgtccaaattcagcaatgacagaggctcgcagatctaccacactcaacggtatgtggtgacaatgaacatgcagctaaactacgatgaacaacggaacagagtttcagaggaaacagcagctaaatactctgcatgaagcatgaactgttcaggtgccttcctagcagaagaaagacaggcagggtagccgtaggatagtagtaggattttcggcgacgacgacgactgtgcaaacgcgaactggaaacagagaggatcctgagaattacctgttctgacgcggccatcgtcgtcgacggccacctccttcctctccaccttctccacgtccatactctctctgtgtacgagtttccctctctctcagtctccggcctctcttatctgagcggaaaggattttgagcgaattctgaagcctgtgcgctgcagctatatatagagctggcgagcttttgcacctgacctgtttcccactgtagattcattcttttaatacggtcacgaaaccccacgaatcctactagtacctcagagtcccctgtagaaaatgaaggttttccacgtcatttttttagtagcaataactaccaccagattatatgcctgttacatttagttgaacctaccaaggtgttcacaaaggtgcagaagttctggtgacttttatgaatctgattagtcaatttgggatgaatctggttggtacttgcctactacattcattccataataattatattcttaagattttatttttcctaaaataattaccacgatagagtattaatatcatcaatcacttattcaattttcccatattctattttcaaccattctctcgtttttatatgtacaccatttaatgaagcgagcattataatctttcttttcaaatcttaatacgtagtacctgctaataaattataattataattattttgggacggaggtagtactttgtaaccacatgattgaaaaatctgaactaataccttctgcagttgagttagtgagcatgttatccgtctgattttggtaatttctaaatatccctgaagagaagacagtgatgctgatgatcattcaggtggtagaaaatgaagtgctggacatatctcagcctctcaggggctcagggcttgacccaaaaggaaagccatcttctgcttcatcatgcggccgccacgaagcacacattgctacaaagctgcatgaatcatgagattgctgctcttctcctctcatctatcatcgtgagatcatcgtccatctcttgacgccaccaaaagaatttcaggttcagaaacaacaaattgtttcttgcgattcactggaaaatcaaacacggctcgtaattcacggccggaaaccatcaaagtttgctgcgtggttccaaaaccatcaacattatgtacaccctgtaatctgcctatatatggattatatttatggatatgtgctgtgtgcaactgtgcaacagcgtgtctttgctagctcgtgccaacgcagccaaacagcctcacgtgtcgtcatatccctacacacagtagattcagggctggtttggtttgaggcctaaattaggcctaccaatatttgacaatttcaatagtgattagtgtctatttggtttgaagccaaattttggcatgccaaaaaaataggccatttcaatagtgaacttaggctattttggcttcaatccaaacgcaactttgccttactaaaattagtatgccaaaacttaccaaaatttggtactgacaaaatttgataaggcctatttaggccacaaaccaaaccaaccctcagtgacgaagctgaacacctaaagctgggctgtatgggccagtttgggtccaaataagaacaccaattaacgccataaggctgtgccacggcccaggcccaggcccaggcccaacccaatcttacaaaaaaaaaaacaagtaaacaaccccaagccacggctccgagaaatacaaacacgaacacggcacacacgtctacgtgagcccacggggattattgttcgagtcaaatatgttacaagcaaacacgtggttgcatgcggcgagccggcgtgcatcgcgtcgaccggttttcagttcttggcggtggtgaagcggtacgaggcgtangagagcgaggcgttgctccagctgcggtggatcagctccgccttggccccctcaccggcggcgccgagcgcgacgtgcagcgggaggaagtggtcaggcgacgggtgcgccaccctnccgtgcggcgccttctcctcgnaccgcatcacgtcgtcgtgcctcccgccgagcagcgcctcctgcagccacccgtcgaactccgccgcccactgcggcaccggcgtgccctcgggccccatcctgcggaggttgtgtgtcgcgctgccggagccgaggacgaggacgccgtcgtcgcggagcggcgccagcgccctgccgagctcgtagtggtacgcgccgtcgcggccgctctgcagggagagctggcacaccggcacgttcgcctccgggtacatgaacatcagtggcacccacgcaccgtggtcaagcccgcggctgtggttttccttcaccggcccgaacccggcttgctccagaagctccttggtcttcatcgccagatcaggagcgcccggcgcagggtacttcagctgtttgcaacaacattattcggtatggtcagatactgatgcgatcatgcaaatgcaacgtcattattcagaagggtagatactgatgcaatgaaattattcagtactatggtcagagatactgatgtagtgattacgttatacgcatataccttttgcttccaggaaatataacgttttccatgcatgatgcatccttttgagcggaatggatttaagttatagtatgatttagtaattgtttggttgcatataagaaaagagtacaaaatctttctattgaaaagttatcatacgccaacaatgaatctaccttcaaccacacgactacaggagcatatatgatggataaatagtactccattcgtcttaaaatataataacttctagcacttaagatttgtcccaaaatataaaaacttcttcactaacattcttttctcaatcaatcacaattcttcaccattcaattttcctacatacctgcacttctctctcccatttaattctgactactttcttaatacttgtgtccaacactaaaaattcttatattctgggacggaggaagtagcacatacttataataatgcatatatagtacctaactaaatacttatgagtagcaactttccttcgacgaaaaggaccaataagctactagatgagtaatcaaatccttatggtgatgcatatatactacctaactaaatattttgtacggcagctttgatgggtgtggtttctccgataacaggttcacccaaattaccagagtacacacccatttttattcgactggcttaaaaacaattgcgtaaatatttactcttggccatcataacctttactagtaatatccacaactatcttatggtgtatatgctagtccttccgtcccaaaatataagctattttggtgaatgtgacacatactagtattatgagataaaatcccttatattttacaacggagggagtaactcaaatgctgaacagagtaatgaaaatgaaactaaatttaattagccatttagacatagctcacagcaaaatccttgctgactgatcgactgaacgatccggcagatgctagtgacaagcgcactttacccacttgtagtagtttggtatgcccattgcccacaaatattccctaattttgctcacagcctcaaacaaaatacacaatgtcatgtctgcatcagatgggatgctggggttggtaaaagttcagatcagctaaacttttgggcatctcttcctactcccatgtttaagtggtaggacctactcccatgtttaataagcatatctaagatgcaatgggacatgtacttcacaaactagcatgaaagatctagtataatactagcatgttttagtctttgattgcgctccaatcagtcccacgtgatataaaatatacaacacgagatacctaaatactccatgcataataatatatagtagtataacatatatggagaagtaatcttcacctttgaccagtttcccctacatcaggcgcggggttatcacaccccagcggtaagtgaggttaccgtgcgatatttgtgacaaaccatacaaaatttatcgaaatttcatttattattttaatttataagaatttgttggggttattgcagtattaccattaccatatccggaggtaaatgcaataaccgtgcaattacggccgattttgtaaacctgcctaaggctatgagcatgcggagaaatggtatcatgctgccatggtgttgcctacgagtaaattcagaccagttgccaaaccaggtttcagcaaccatgtagtgtggttttccgataaccaaggcagaaagatcgatttcttcccatatattctgcgcgatttggaatcaaaaccatccaaatttgacgtcttccctatagcatgtaggaaatccgaatacccaatccttgaggctgtgttcccaacatcttcaacctcgttttccgcgcgctcatttccgaaagtgtaaaatgcccaaagtagaagatgctcgaacaaagaaacgaacgaccaaggtccaattttggcggaatcgctccacgttgtacggccatttctcaatcaagaaacaagggattcgattcgagggaaggagacggacggacggacggaccttgtacatagccttggggaagccgtagaagtcgtggatggtgtcgttgttgccgcggatgacgttgaccgtcggcgcggccgcctcccagtggcccgacacgacgaggatcgcccgcggcaactccgcgcccgccaccgccgccggcagccacgacttgaagaatccctgcgccgcgatggtgtcgtcgatggacagcgtgggcgcgccgtgcgacaggaagaaggtgtccatggcgccctccgccgcgcgcctcgtcgtcgtcctcctcctccccctcctctcggcttcgagggcgctcccctgctgctcgtcttcccccggcgtcggcgtcggcgtggtcgtcgcgcgcgcgtgcaccgcggccgccgggctgggctgcttgctttgcctctgacccatcctcttctcctccttatacggggccggcggccgcgcgcgcggtgcggaggatgactgtttattttgcggtgtttggtaagtttagttggtcgacgactcgacggtctggaccgcggactcggcccctcatttggactttgggatgtcgctgccggcgcgcgcacgggcgtgtaagcagtgacgtaagaaagcgtacttcgctggaggcgcgtgacaagtggagaagcggatttctggaatcggccatggtctggatgttgttggtcatgtgaatctgtgagactgtgatcctaccaacttctctctccttttttaaggaagggtctcatgactctcatcgaatggatgtttggattgatgcttttcagccaaaacccatcgaattgcttattaggctgataaccaccagccacaaaaaatccttatcaagttaaataagccaaataagccaatcaatggtttttctttagcttaaggggaaaaagctaactttggctgatcagctaaagctcttggcttactgatgagggccgaaaatatgattggctgttatatcttgttatacttgtgtctcgcccatcctaggggtaactgttgcactgcgaatgatactacataccgtgttgttactgtatacttgtacaatagtacttcttttttaacgattacactatatatacatacgtgcgcacatattactacacatgcaacaccacatttgcactttcacgaacattttcttaaataaagaaccaactgtttatatctgattttattgaatttttgttgaaggtccaattgcacctactaatctagcttggatggcatgatatatgttactattggctacagtgtttgagaccttgcattgcttgtgtgttggcttcactgtcagctcgtccaatgtaccgcagattattatataggagtagctacttcaatgccaaacaaaggcaaaaaggtaggattgccttgtttcattgctagagaaggtaaaacatcaaccacccaaagaaaagtaaacatcagaacgccagcccaacagacagcaccttatgaacacccaaaacttaacaaaaacagactacagagtaccttaaacaccggacaccaaagcatacagcgaactattgacattcagaaattcgacaaccattttataaattaccatcgacaaacatgtttttttcctacaaaatatcattgtacaagtgtttttgtaaattcccgttaggttttcatttatagacctccgttaagtcttctaaaaggtctattttactctacgatccatagaacactatgtgaggggaaattattttatttgatctcttgagggga

SEQ ID NO: 26842 - DNA, 10981 bp, Oryza sativa
gtctttttcgttacaagatgtagaggttgaatttgaacttgcatgtttgtggagtgatatatcacatgttaatacatcatcccaaattttttaaaattttttcataaccatttaagtgacatgtaaacaaaaagaggggacatcccctcgagaaatcaaaattcacttccactatgtgagcacttactggattagaactcttgaggggagataacataccatccaaatgattatgaaaataaataacaagacagattaatatgtgatagatcactccacagacatataagttaaaatttagcttctacaagttaaaaaataaataaactatgattagttaacttatattcatagtcaactttatttttttttattgcagctattagaagttgaatttaacattacatatttttggagtgatctatcacatgttattttttttatttttttaataaccaattggatgataggcaaataacgaggaaataccctagaatagttctcctcgcagtcttttgcacccatagttaaataacaacatattgcctaattagctgtcaattttttttgactgaattagctgtcaaatttgcacacgcaaatacggttcagtgatgaagctgaacgccctgttgcttcctaccttgctcggtaggatgggccagttcgggtccaaataaacatagcagttatcatagtgatatcaacgccatgagaggctgggccacaacccaaaccaccatgcatgcaagtttattgcaactgaaaaccacaagacacggccgttaggaaatacaggcacgaacgtacgtctacgttaataggagtatattaacgtagatcccacggagattattaattgttaagagtaaaatggcgatgatataagcaagacatgtttcactctttgcatgcggcaatcggtttgttcttggtggtggtggtgaagcggtacgacgcgtgggagagcgtcgcgttgtaccagctatggtggatcagctccgccttggcatcctccccggcggcgccgagcgcgacgtgcagcgggaggaagtggtccggcgacgggtgcgccatcttaccgttcggcgccttctcctcgtactgcttcacgtcgtcgtgcctcccgcccgcgaggagcgcctcctgcagccacccgtcgaactccgccgcccactggggcaccggcgtgccctcggcgacgggcgccatgcagctaaggttgtgcgtggcgttgccggagccgaggatgaggacgccgtcgtcccggagaggcgccagcgctctgccgagatcgtagtggtacgcgccgtcgcggccggtctgcagggagagctggcacaccggcacgttcgcctccgggtacatgaacatcagtggcacccacgcgccgtggtcaagcccgcggccgtggtcctccttcaccggcccaaatccggcttgctccaagagctctttggccttcttcgccacatcaggggcgcccggcgccgggtattccagctgcatgggatgccatgcatgcattattcagttttttttttaaatttttgaaaggagggaacaagctttgcctcgtgatcagatcacaaggcaacaaacatgatgcatgcatggtagggaaggacgaaacgcgaacagttggacctggaacatggacttggggaagccatagccctcgaagtcgtggatggtgtcattgttgccgcggacgacgttgacggtcggcgtggccgtctcccagtggcccgacacgatgaggatggcacgcggaggctgcgcgcccgccaccgccgccggtagccacgacctgaagaagtgctgcgccggcatcgtgtcgtcgatggagagcgtgggcgtgccgtgcgataggaagaaggtgtccatggcccccgcgccccgtagtcccgtacgttgtgtactcctcgtcctctcggtttcggaggccactccctgctagctgcttatcttatctcgccggccgcgtcggtgtcggtgtggtcgcgtcggcgcgcgcgtcgcgtgtgctgccggccgggttgggcttggctttggctctgcccccatatccttctatttatatacgcgccgcgcgcgcatgggcgcgtggtgcgttgcaacgtcgccggcagccgatgaggcgtgcgttggttgcagatgattgggagtgcgttagttgcagatgattgggtcagccgatgaggcaccatcgtacgtactgtacgtttcacagttgtgcagtagtagttggtcgatatgacttccgatctactactccagtctactagaccgcacacctcacctcaagttgccggcagcaaaagctgcgcttgaacagccagcagctctcgcgttctaaatggatgttaagctttggatatagatagaatatgcatgatggagcaaaattctcacatggttgaattaaattaaatattataaattgctaacaaatagtatagaaaaagtggtctaagcattcaagtagatgtttaaagtggggcctcattcattcgctcaagatcataacatgagctacttcaatgccaaacttaaatgtacgtataatgctagctcaacaacctcactagtagaaaaaaggtcttcccttactgtcaaaatatgcctttcccggtggctagactaaccgctagcgtcgaaaggctagtgaaaatctaaggttttcacaagcaaaactttaacagctagcgataatcgttttcgcttgcggtagtgttataccggccgccagcgataatcgaattccgttagtggcagagataatcgattttggggaaagaaaaagaaaaaacccatgcagctgccctctaaccgccagcgaaaataaatatgcccacatgttgctaccctgcattaaaaaatccatagcgccaaatctcaaatcccaaatccacaacaagcacaacttccaaaaaataccatcacagatcctaaatccacaaattcacacaaaaatttcacatcacaacacaaattccacatcacagatcgagcacaaaaattttacatcacaaagattaagaggtgaggcatcacagatcgagcacaaaaatattacatcacaaagattaagaggtgaggatggattcgttgctcccaagggagggcgtggatggccggcagcggatccgctcgccggcgccggctctgctccccaccgcccctcccacgcgccggtgccgccgagcgccgccactggcccctccccccgtgcctctcccgaggacaggcggcggcggatccactctcccgaggctcgccggcgccagatccgcatctcgttgtcgagaaccaccgccgcttccttccccgcgccactgccgcacctccttccttgcgccgccgcccccttccccactcagcaatggagagtgaagggaggctggcggcggtggagaaagaagggaggctggcggcaatggagagagaagggaggagggatagaggagggaggcagagggaccgtgcgctaccgcgcacttgccttccgtcaccgtcgccgccgcgcgctgccgcttgagaaccgacgtgcgctcgcgttttgtcaccgtcgccgccacaagccgctgctggagccaccgcgcgccgtcgcccgagaaccgtcgtcggagctgccgccgccgcctgtggggagtgagtaggagggtgcatctggagggaggaagaggaacaagaggataaggactaggtggataaggagtggtgggtggtgattttttaatgggcggtgatatttttaagtgtgtgatttttttaagtgcggcgtttaaacgctggcggtaggttaagaagcaatagggttattttttgaaatggacttcttaaccaacctcaagcgaaaacggattttcacttgtggtcctagactcaccgtcggcgaaaatgaattttcactaacggttctaaaccctctattcctcgttagaatttcacaagcggatttcttatatgaccgctagctaaaaaaatagagtaccgtcataaaaaatcgtttcttaagctatggggttgggaacccatctcatctacacgaaaaacagagcggtccgttagtacgttattaattaaatattagctatttttaaaaatagattaattttatttttaagcaacttttgttttttttttaaaaacacaccgtttagcggtacatggttaggaaaagcgagagtacatggttaggaaaagcctcgaacgaacacagtcacctcacgctcacagtgacactgacacaagtgcatagccgtatacacgacgacatcatgcggaagtccaagcagagcaacaccgtccccaggcagagcaatcttagtatacctcgtacgcagccatagggaattcgtttttggtcacgaggctttacagtttacagaggaaatgaagtttatctagatgcataattttgactaattgacttggacggagaccccgctgttgaaggtcaagaacgtgcacagtatctcgatccctcaaattcccgtgcgacacgtctgctgcttccatcgcttgctagttacatagtccatcctggttcagctatataacttgatcaatttagagatagtgagcaccaagaatcaatcaatcgagcagaaatttgatctgtacatctccagtcaccatggctgccgccggcagcagcaaaaccgcgagcttgttgctatgcctggcgatgatctccttcgtgcagctggcacagtcctcaccgagcggcgacaaaggcatcaaagggtttcacggcaagaagctcagcttcaccctgtaccagcaggagaccatcaacaagaccagctacatggtcgtcgccggcgtcgccggcgccggcgtcagcgagaccaccacgcccttcggcaccgtctacgtcttccgcgacgacctgacggtgcgccccgagaggtcgtcccgggtggccggcgtggtggaggggacctccgtgacgaccagcttcgacgggctgaggagcctgtcgctgggcaagatcacgctcgaccaccgcggccgccggggatccatgtccgtcctcgggggcacgcacaacacccggccgtccgactgcccggtggtcggcggcacaggtgacttcgcgtacgccgtcggctacgtccggacgtcgccggtgaacctgcggggatcgtcggtcacgttcaaggtggagtttcacctgtactggccaccgtatgctcattacgctccaacttcaaagcactagacaagtcgctgtcttccaccttgatgagcgcgtctgcgtgtgtactcgtttctggcagtccgatattatatcatgcatctgcctattttttttcagtctctcgctgagtagttaatatagagtttgaattacctctgggaggtatttccgtatttggtgtaataaaattcaagattgataatctgaggaattttcatgaaaaaattaaactactacggatgatgcgcttatcggacgcttgttgttcggtgatagtactacttaaaaaagatcctcggatagtcagactttgcagtatacaattatgccaatgagatatgaatcttgagccaattatatcactaacatatgggtattgggttctactttcgtacggttcacatgtcagaaagtcaggaaagcctcatccatactactttcccaattcaatgtttaagttggagatggagaggttgtggattgggatcacatgcagtggctatagccactgcaacttatgcagtcctaaggacatcattggaatataaattaacgtcctagatctttccttgatactgttcacaaatgaccgtacaaagttagtttctgtagcatgtactgtagcaattactgtttaaaacaactgtagcatttatttcagccgttgattgccttgatccaatgatgaaaaatggttccaactgctaaacttgcagtctgtcctatgactgcaccggatctggattcaactctagtcgggcatgcacaactgaaaccgacaacaaactttgttccatttctcaaaccaaacggaaaagttattagcaatgattaattaagtattgattattacaaattttaaaaattgatatatttgattttctaaaacttatatatagaaagttttacatcaaatacactatttagtcgttcggaaaatatatttaaaaaaaccaaagagtagctagctaaaaaaactcagccttggttttttttaactatcatggcacacacctttaaaattgtcgaatggtgtattttgtagaaaaactttttatatataagtttttcaaaaattcaatacattcatttttaaaatttataatagttaatagtacttaattaatcattaatctttcattccattttacgtgtggccgttaatccaggtcaaaaagctagcgaacactgaaagctcccgtgcgccagaaacacccgagaatagacaaccgcacagtaacatacacacggcagcttcatcggttttccatgggcactttcggtgtttcacgattttgcgcacgggttggcccaacccaaaccataccgtgtgcgattttgctatagatttgtcgtgtgattttttctctcggatttgtccttttttaggctgttcgataagtgccaagattcgtgcacatatagcgatgggaatccgcataggattcagtcggacgggttagagcgctaatttctttttttgcgctttaaaaaattgatatgcacgctgttctctctcgttctctctcaattgaaactaaaataaaaataaaatacaaaattacagtcatatataactaaaattatatttgtaaattcagttgatatgacatgtaggtgcattgtaattttgataaaagtaattatgtaactaaatatgtatttttattttcttttgtagtccgttggatgtaaatttaagggtagaaaaaatctgggtgattttttcttagaaatcacctgacaaataaatagacaatccctaccgtgtgtgcttaaacacacgagaaccttcccgtgcggatctagactcccggtaacattctatgtaacggactctttcagacggcacggtggcttaccgtgtgttcgaacagcaataatcaatcaagcagccatctccatggaaagctagtgagcagcaataatcaatcaaaaggattatttagcagttagcaccacctaagctcaaattcttcttccgtttttctctttctctcggtttcaataggccaacacgggaagctagtgaacagcaataatcaaccaagcagccatcgccatggcagctaccaacacggccatgagcttggtgctgtgcctgctggtaatgatcatctgctccacgcaccggttgctgcatccccaaccccagcttgcggcgacggcggcgtcgtcgtcgtcgtcgccgttctcgtcacgcagcaagataggcaaggacatcatcgacaagacggtcagcttcaccctgtaccagcaggagaccatgaacaggacggggtacgtcgtcgtccccggcgtcgacgcgcccgcgcccgcgagggtcgtcgtcagcgacgccggcgagccctccgccgacaggcagcccttcggcagcatgtacgtcttccgcgacaacctgacggtgcgcgccgacagctcctcccgtgtcgccggcgtggcggaggggacctccatctcgacgagcttcgactgcgaggacggccggaggagcgtgtcggtggccaagatcacgctccaccaccgcggataccggggctccgtgtccatcctcgggggcacgcccaacatcaccaggccgtccgtgtacccggtggtcggtggcaccggcgacttcctgtacgccgtcggctacgtccggtcgtcgccggtggacacgcgtgggcggactcggacgacgtacaagatggagcttcgcttgtactggccgctgcacgcctatttcgctccaattccgtagtaacacatcgatcaacgttcttccattcgcgtcttattccaactataattccatgcagaagttatttttggagttaatttgatacatgaactaagaaagatttaaatgattttattgccctataaatattattgtacatttcaaatggtgcattgatagatcatttattcatgaggcacaatattgactaagataatgtaaggggaataaaggaggtcatatgtgatgaggtaattaatttgtttccacgtccattactcctggttaatatagtgatactgaaagttgctcaatccattccaaataattgacaccggcactatttaattttaaatttaaccatcttttgcacaaaaaaaaaagaatacatgaaaaatatggtatactagcgaacaatgtgctgtcaaaaatattatcatacaaatttctttcatcataatataattatttaaaagtatttatggttaaagtgaaccgactgtagtcaattatttgaagaacagaggtagcaaattctgagtttaaacatgaatattttggtatttagattttaccataacatttaccacggaaggttaaatggcctcacacctctttgtgcactcttattatatagattctgtttctattttataaatcggcgggatgctctaggatttacttggatggaagttcaaatgtggggcagacacaccaagggtgcgctccacattatatatgttttgtacaaactttatcatttgttgagaaggaggtggtatggactcacaagaagtgtgtgcttttataggtctggtaataggctccaaacattgatcgatgaaggatttgcacatccattcaatctaaggacttaaatctagctaggcgaaacgagatgcacatcttaagttatgcttagctcccccaattattttttacattgaattgtacattcaagcctgtttttctcgcatgtttccgtatttcaaaagtacggtcgagttgttttgtttgcactaaataaaagtactgctcccaacgttcaaatataagaatttctgcgtgtttcccaaattttgaaaatctcacagaaaacacatatattttggaatggacatagtactccgtagtttcaaccgtacacttctctacaaattttcccagtaaaaaaaactcaactagcatcaacggtagcaattaggtcgaaaactgtgatacgataaaaccatgttacatggatacacaataaagatatggctagtattggactagcgacctaaggtacctttttttttctggataatctgtttggatgctcacctcattttgccacaattttgtgctaaaagtatatcaaggtataaattgtgcggctccaaaattaatggtcatatttgtgtcaaactttggctaagaaaagagcctatgatttgtgggaccaaaagataagaaatcattgcatgctaaaattgtagaaaccaaccaaacactagccatattttaccacattttgccatataatagtcaagagtggtaaaatacaacaccaatgaagcatgctctaaacacttgaatgattttgtaattgttatttaagggtccaaacaaatcaattgactattagaagttaaaatagatttaaaataggcttttaaagaaatttatgtaatcaaatttttatgaaaagttaaacatgaagcatgtcatattaatccatgatacccaatgtgatatttgcccattgtagtggggcctgtctgtaaatatcattgtgctttaagctagtttaataaagtatatactttcttcgtctaaacaatatccaattatagagatataaaaaggtgacaatatcatctgaggcttttggtctcagttagtcttgcaaaaaatataaaaaaaatgcttttgaagtttttcacaaagtttacttttatattgttaaaaacacatatataaaaaatttatttataaattattttttatttataaatataccgtttgtgacttaccagaacaaggagagaagagtctgttcatcggtccatcacggccggacaaacctcgccgcttcgcttcgcttcaccctttttcggttcgctctagctcctcatcccgttatgccttccccacctgccgctaccccacgcccccttcctctccaggtctcccccctccccttgtgcgacttgtgtcgaacaccgcagccgccacccgtagacgcgacctcagcaaccccacccacttcctctccgtgggcgcccgccgcgcgtcttgcccccagatccggcgcccaccccaggtaaaagccctcgcccgagctccgttgctcccgatgcgcgcgtgcagggagggatgggatcaggggaatgggattgggggtttggggcgggatggatcagttgaatcggctgcgctagtttggaactcgaacagcttgcagtaggataggtgggttgaatggtcgcaggtgttgcgcttttctgatgcggttcgtttgctgctgctgctgtgtgaaggtagccggttgttgcttgcacgcgtggatcacttacagaaccatgcggcggtaggaacttgggcagattccagatggttcgcttgtttggtgagctcttgtagcattgattgtgctccgttcgatttcattttggtgcaatccctagcactctaatttttcttgcttggaataaatggtgtaattattagactttatttcagttattaaacttacaatgatcgatagttatagttcagtacttcggttaccctgtttcactgtgctgttttgacttctgttatagcatgctgaaaactgaacttgccaaacaggcaattgatggggactttccttttttgagccagcaattataaacttataattattgatagcaaagttcagtattccagttactcaatttcatactgttcagaatactggctaaataagtcaattcatgttgttctagtcttgtgaggcttccttttctcctgttccaaactattgtcacggttttcctcccgatgtgcaaacattgctttgttttcac

SEQ ID NO: 26843 - DNA, 6627 bp, Oryza sativa
gatgagtcatcagcagtgcatgccttgttcttccctgatgaaagaagtgcagtgaacccaacaaaaggtggaaatgacagtatgtacttctatcctggtagggtgtggctggacactgatggacatgccattcaagcccatgggggtggtattctgtatgatcatatcactgccaaatactactggtatggagaaaacaaagatgggctaacctaccaaactcaccccaagagtacatatcgggttagtataaattctagtataatatcttccttgttttagtgactggttatcttagcaatttgttctgataccaaaaaaaaaaaggtacaacaatggattttgagacaagtctgtggctgattggtccttaagtacgtatgtactgataagtggttgtctttataattttccaggttgacattattggggtaagctgctactcatcaaaggacctatggtcatggactaatgaaggaattgtgcttcctggagaacctactaatttcacccatgaccttcataaatctaaggtgcttgagagacctaaggtgatatataatgatcatactggacaatatgtcatgtggatgcatattgatgatgcaaactacaccaaagcatctgttggtgtagcagtcagcaactctcccactggtcctttcacctacctctatagctttcgcccacatggatttgaaagtagagacatgacaatcttcaaagatgatgatgggtcggcttacctcttctactcttctcgtgacaatactgagcttcatgtcagtccattgacaaaggactatcttaatatcacggtagcaatgaggagaatattaataagacggcatagggaagctccggctgtcttcaagcttcaaggaacctactacatgatcacctctggttgctcgggttgggctcctaatagagcattagcgcatgctgcagaatcgatcatgggcccatgggagacattgggcaacccatgtgttggaggcaacaggtttttccggttgacaacattcttatctcaaagcacatttgtgcttcccctccctggcttgcctggtacattcatcttcatggcagacaggtggaatccttcaaacttgaaagattctcggtatgtttggttacctctgttcattgggggattggcagacgaaccgttggattacagttttggattcccggcatggtcgagggtgtccatttattggcacaggaaatggcgcctacctgaaagttggaagggttatacctgaattttgccctacgcacatgaagtacatacaaaaattacagatgatagatgcaatcatggaacagacatagtttgaagagtttggtgattgttccgaatatttcttgagatatctagtcagtgctttcgtaggcctttttgtaacgcaaaaatagtctgtcaagaaaaattgtataacagtgcagctctcaaaacaaatatttgacttgctgtaacatcctccaaaaagaaagttgaaatagcttgagcgtgtgttcatcccgagattatgctggtaacaactaacaggtagtagtgtttctagttactgtatccgttacatgattgatcccaatgaagcagaactacagttacgcaggcacgcttgaatgtcgaacctgtgatcacacatcttgtttaacatccattttcttcgaaaactcaactgattgaatgcctgaatctgataaactagtctcgctggggattgtttatgttgacaagcagccaacacacatgaactaattcatgaatacttgaagccgatggaaacaatgttccatacttcatagttgcatgtgctactttagtacttaagtcatgtcaaaatattgtcaacctcagaaagaattgacatggaacaacagatcacagcattaacaaaagaacaacaaatgactcggataaattccgttggtgatctaccgcttaagaatctaccagattgggaaaaacaaaaactgcctgttaattgctaaagcaaaattttaagcagtatatgttgagtaccagtgccataatataacatcatttccccaaaatagctagagctgtttcctcttcttggtctttgaccaactagatgcatgtttcttcaatttgtgaagtattgttctctcgctcacccgcagcaccaaagaatgatagagattcctttcgttgacagaagagcatgcttgcagtttttgcctgtcatcttccaaagtgtttgaaccatagaggctctccctcatgtcaacaagggatacaagtgcagaacaaacgctctcattaagcaatagcttcttaacatcaggcaatttttcaagcccgctaatatctggatgttgattggagcttgttactctgacaaccttaagcacactactaatgctgtcgacctcatcatcaccaatcagatcatgagccacgctggccagcttgtcataagcatcagacttcaaggagatgatataaagcaggatcaaaagttcaagctggggctctccatcatatgaaatctcaaagtagtcagcatcttggctggtgcaacctgaatagcccagattatgccagagtgatacccttgctcttgcatatcgacgggagtacttagaagagcaccacttagtaaccagagctaagtcgatgttgacgatgtcatatgagttgtccatctctgtgaagccatatcgatgaagcaaagcagcatttcccatggtaccgtatgtgttaaaaacctacagtggaacgagaggaaacataaagttgcctcacaacaggaacctaactgatatctaacagtgatacattaagcaatgcttttggacccaaataaaagatggtaagcacacatttacctcctacccttcattgacatctctcacaacaatcatttccaaatcttcatcgtcatctcctaccacgtatgaacaaaacaaccataatgagtgaagctcaaaatcaaccaagtacatgtctaaataaggtctaatgatgttacatgcatatggtcatggatgtaacctgaagggatgtcggcagaattttctatagttgactgttcatcagcagacgcattgtttggatcttcaccatcttcactatctgagtccgaggcttctaacactgaagtgaagtggacatgttccccaccagtcttgtggttaaaactgaaacaaattggatggagggcatttccatattaacgctcagacttaagaccagcacaaatacatcatcacctaagtatgtgcacacctgatgcattgtttccaaataaccaggtaaacgagaaataatctaattacatgagtagattgtaacttacaggtcagccaggggaaccattccagacccatgatagctatctattcggaaggacctcgacgaaagtagactcttagcagagaaataattctccaggctaaaatcatctgggtcaacctcaagttctcctgacaaaatgagtggctcaatacactctttccagtcctcacatatgaactgcctgtcttgcttcactatctgcctagaaattttgccgtttttagagccatcttagtgatcagccaataacgcaatatgaaacatgaaatgtgtgcaacaggaaagtacatcatatgcataattagctcgcattatgctgatttgaaaaggaaaaatggccatagttgtaactccagggagccaaacattgcaagatagatcaatttcactgcctaccatcgaagcatcaaggcagatacaaatcgtggaagcattgcaacttgttactacaatagaagggctcaccttatcgagctcggtgccggccaggaggcgctcggcctcatcggcgggccagacgagcggcacgggctcccgctcggggatcaggcggaggtaggcgtcccacggcgactcggcgccgcgcgcgcgctcatacatgacggcgacggcgagcgcgaggggcccgccgagctccgcggcctcgatggcctcggcggcgccggaggtgcgcggggtcaggcacgcgccccgcgggatggtggccacgaggtccccctcccggagcgcggcgagggcgcgcacgtagacgccgccgccaccgtcctcggcggcgtcgaggcggagcgcgttgctgcagacgacgccgtggtcccgcatccaccgcctgaaggcccgtaggcggctgcgcggtcgcggaagggtcacggatcgtagcgcggcgggggagcgcatacagagaagagcaaagcagaggatcttaccgtgcggtggaggtggaggcggaagcttccatggctggcggcggcggcggcgtcgcgaactcgcgaccaggttttcgttgcggaaatcggtgaggcagcaaccgcgctgcaggcccagcagaggcccaccaaggcctgcaacgcgtgtatgttaacaacccttttctctttttttttttaaacacgtcaatatattagaaggaagcagagttatacttgcacgatgtaatcggccagaggatcattgccacgaaaaataggaaaaacaaaagactgttaagaaaaaacgctactcttatataaagggaaaaataggaaaaaaaaaacaaccctcttcttctaaactatgtaatctcgagaacaacgaaattcgatacaatctcaaaagaaaaaaaaagaaattgaatgagaagaagtagaggaagtttttaaaagtgaaagtgaagaagaacaagcgagagagagagatagagatcgacgaggttgaaccaaagctgccaccgctatgcctcgttaggattggtgtatttgcttaccaaggacttgcttgagaagcttgatcatgggctacatcatgggctgggctaaccaatcaacaggaagcctagtgggttcttaacagtgtagtttcccttttgcctgaacattaaatcgcaggtgagagatcggacgggcaatgatggccataattcaagtttggccgctgatcccaattgatttttgccagcagcgctctgtaatgtgcgtgcacctgctgtaactttctgcctgcaggcggccgcccacgccaaaacacagcacaggttgaggtagtactcgtatttgtttcgctgtctttcgctttgctggttggttcgtactgcaaacttgaactcacaccacaggtggtggctttaactaatgccgtgcatcagttgaacaagcatagagtagttcgcttgctcttcagcttgtcggccgcaattgaaatttaaattttaaatcttaattttaaaattaggtttcgatagtttcatcatatttttttcacgaatacgtaaaaagattgcagtcaatatattagaagaagaatagcagagtttagttatacaacgcaatcggttagaaggccgttgccaatggtcaaagaaaaaagaataaatacagaaaagataagctcatgtaaaaggaaaactacaatcgcaaaggagggtggggtaagggtcccactacactccggcctatcataattttttttcaatcaagacttttaagtcatcaaaaatacagataaaaagttatttacttacaaatatacaattagttgtacgtgaaaatataatcgtaccagcaacaaaagcatcttaatgtagccctttgcatgttctactttcagcagtagccaatgcaagagtactactgcctttagccatctgtgaacaagttttcagatagctaaaaaaaactcagggcccctttgaatcacatgaataaaaaaacggaggaatagaaaaaatatagaattctaacatgaatgtaagtgtaaaacagagaagcaaaacacaggaaaaacgtaggaatgaccgtttgattggaccacaggaaaaactgaggaatttgaggagagataaagactcaaaggatttttccatgaggttctacctcttgttaaaattcctccaaaacttgaaattcatagggttcatttctttgattcaaagggctttgtaggaaaaattcctataggaatgaaatcctctaagggcccctttgaatcaaaggatttatgtaggaatttcataaattcaaattctatagaaaattttcctatttggccctttgattaaaaggattaaagctttccaaatcctatgaaattcctatggaatgacacattgcatgtggattttggagaaaatttactaagagctctaacctcttggaaaatttcctttgagtctatctctctcatccgattcctgcgtttttcctgcgctccaatcaaatgaccgtccctatgtttttcctgtgttttgcaatcctctgttttacacttcaatttctgttagaatcctgtgtttttcctattccttcgttttttctaccctgctatttaaaggggctctaaaattcctataaatttcctttgaatcaaagcggcccttatactttcgcccgtttaaaccagcgctagatctgccaggttgatgctcgcaatgtggaaggtgtaacgcaaacactgtaaatcagtaatgatattacagtagcagtgattaggcgaaagtacagtgctacatgcacgagattaggtatgcatggttaccgaaggtacaacccctgctgcctcctgccagcgaagtaaaggaatcagcaagaataaaggggggagcg

SEQ ID NO: 26844 - DNA, 3266 bp, Oryza sativa
tcatatcatttctggattcactcaacaacactgatcaagctataggtgagtgaagcttggaatggatagccaagccagcagctgctcgattttcatgatcttcacacttgcattgcatgctgtgatccatccacgaagcgttatggccgagtgaacacctggacatctagctagctgtacgttagtaggagtagttcgccggcaatctatgcaatgcatctacggtttcattacagcgtcctgcagtactgcttcttgcagcagcgtagctcgatcgaatcgcagtcctgcatgccagggatcgggatggctggctggcgtatcagaagtctagacgctcgagtggcggggaactcgtcgaccgatgcttaggcagagattgtccaggtctccaggaatagctagcttcagaccaggtttctgtggatgagcatttaccggttgtgaaatgctcggggccagccggctgtgaactgtatttgtctcgtcctctatacacctacagtagtatttccaggggggtaaattgactgcctgtagattttggttatacatccttaaaaataggagtatactctctctccgtataaagaaaacaacctagtactattaaaataagacataacttagtaccacaaatataaaaaaagtttgtctagattcgctgctgtattaggttatatccaatctaataatagctttttttaagagagaatctcttatatgccactgaaaattggtcatatcccttatataccattgaaaattggctcttttttacggcattgtttagttccaaactttttcttcaaacttctaacttttacatcacatcaaaattttcctacacacataaactttcaatttttccatcacatcgttccaatttcaaccaagcttccaattttggcatgaactaaacacacccgtatacgtccaaaaaaaattggctcttttcgtgtatgcaattagtccaaatttacgcaccctctcatatcacttttgtctgttgaccgttaactctcaaataaaaaagatgtatttgctcttatgagtatacgacatgcctaacaactcagaatggcaaatacgtctttttacctttggagttaacggtcaacaaacgaaagtggcatgagacatgggaagagccagtttttcctggcatataaggattcttttttttttaatggagggtgcatgacgaaagcaatttggcatacaagcagaagaatactcgtaaaagacatttgatataaaaggttctctctctgtaccataatataagggattttgagtttttgcttacaatgtttgaccactcgtcttatttaaaaaattttgaaattattatttattttatttgtgacttactttattatctacggtattttaagcacaacttttcgttttttatatttgtaaaaaaaattaattaagacgagtgttcaaacgttacaatcaaagaatcaaaatccacggagggagtaggatttgcctctgaatattcccagtcaatccaatccccaatgcttacaccaacaatagctgtagctatgctttatcactgctttcactgtccacacatctcatctctgtccagttcaactcacaagtctgtctccatcactatgacatctcccataaattgcagcaaaattttctcccctctcctttcatcactagcgctattaatttccacagaaaagaggtcatgcagctccaagtcacatttatatgtgcatggcagcagcagcagtaccacctatcccagccactagataaatgcgaaagcctccatggctgcattgctcattgatcatctgcccaccattagagacatcaagaacactctgcactagctcactcaggttgcatccaaagatcacaagatctgaagatcacattgatataaccatgagcagttctgaagaaaggatgttcgagatggatgctgacccaacttcatcaccagaagccagccccaagcaccatcacagtacatgccacatactagaggttgatcaatctgtcactctgggctttcttgtgccattgttcatgtaaatgccttgttagcctttgtttcttgcttactgtgtctgcaaaacacacgtagcagggtctcctcgggaggtgcacgcaggtggagatggagatacaagagagggccatgaagcatgtcatggagattggagaggagaggaagagaagcagcttgaagaggaggctgatgatgaggctgaggaaagatggctacgatgcttctctctgcaggtcttcttgggttgccaccgctgagcatccaggaggtgaagtgtttgttttttttttctttacttttgtttaagatattttttttcttctttacttatcttgttgacacaaaatttttaatgctattttgtccttgttctctgatttctctgttaccatttctgtgggtgtatggttcatctgtaaatatctaaaactggactagttggtctgcagaaaatgctgtcggaacagcatgtttcttgttttggtaaggaaatatgaatcacagaatttccatcttctgcgtgaacttccatggtgatttgctcctagtaactggagtaactgatatatctttcaccggctttttaattatactctttccattctatatattttagttttgtcctaagtaaaatttctataaacttagtttacaataacatatgcagcatcaaatttgttttgttaaatctatcactatatcttgatggtgtacttatttattattataaatgttaatatttttctacaaatttagtcaatgttaatagaatttaacataattaaactaaaatgactttactccgtagtatggaacggagggagtaccatttcacaaccccagtagcagtaaaactttcagaatcttggtactcctacggtgacatacaggtaatgaagcattgacattaattattgacttagatcagtgtaccgtgcatataatcactagtaccattactacccaatcatcgttaatatgctgacattggccacagggtcagcgagtgatcaccgttagcttcctttaatttaagtggccgaaacagtgagctgaaaggttgcagatgcttttgtctcgcaggtgattacgagtacatcgacgtgctcgtggcagtaggccatggtgctgacacgtcgtccacgtccaggctgatcgttgacgtggatttccggtcccagtttcagctggcgaggccggccccatggtacgcccacctgtc

SEQ ID NO: 26845 - DNA, 2706 bp, Oryza sativa
caacgtggtatccagttttgcagttttgctttcgcatcaaccgttgtttagctgcgttgatgttggcatgcatgccgcctgtggcatccggcgccgtgttttgcgttggacattttggaggcttaacgccaagcgaatagctagtgtggtgatcaaagaacacacaatccaaagtcatctatttcaaagtttacaagcatattgtacgtactacaacaactatagtgcaattactgtgatctgtgggtgctggaggtggagtatgcctggtcctgtggaatgacagtgcggagagaggggctagcttgtgggttcttatcgttttactggtggtagtaaatggacgctgtacgccgtatatatgcgcgccggtgttgccaccgtcggcgtcgtatccggcacacggggctccatgcaggaggtgggggggggggggggggttgaacgggagggagtggagctgtgtaaccagccgcagctttgtcaggcttgggtgtgaccggcatgtcatcaccatttcacctcgcctgtacgagtgtacgccagtattgtgtggctgatggaaatgctcttcgtggcgcgagatgattgacctctctactccattgctccccatactgtgcagtcctctactatactatccccatggcccattgcagcttttgcaaggaggaaggagaaaaaggaaggtaaaagaggggaatcctacgcggagaagatagagatatacgtacagtgatctggctaccaataactgaacaacgtgaacacacgtagtacaagtacaaccaggtgttgtgttttccacgcatattttgcctaaccccaacaaacggttgatctactcctccgttttacagttgcaaaacatagtaggagcctcaactgggcctctatggctggaagaaggaaacgctatatctggccgaaagctcaactgggcctctatggataatgagccctaaaagttaggaataagttcactttgtgaccctcaaaagtgacagaaatttaattcgtaaccctaaaccacaaaaccggatatctcaacccctaaactcttaaaaacggtgcaatttgactccctcgacggttttgcagagcggtttcgctgacgtggcgcctacgtggtgatattgaccgagtctttgttccacgtggcggtgacgtggcacttacgtggcattagaattaaaaaatatgtgtgggaccgtttgtcattcacacaaaaagaaatatgcacccactgacatgtagggcccacatgtcagtcatccttccttattggaaaaagtccactttgactcccttaattatcagcagaatctaatccgtaaccctcaaccgcaaaaccggataagatgactccccgaactattgaaaccggtacaatttgactccctcagcggttttggagggcggttttgctgatgtggcgctgacgtgttgatgttgacctagtctccgtctcacgtggcgcttacgtggcattcaaattaagaaaatttatgtgggacccatctgtcattcacacaaagaaatatattatgggacccactgacatgtggagcccacatgtcatcctctctctctcttcttttcaccggtctgcaagggcgagagctggacaagcggcggcggccggcggcaggcaagcgacactaggggtctagggcagcggcagaggcggtcgagggagtggtcggcagcggcggcggtgggaccagatcttcctcctccttctctctcgctcatctctttctcccctctttgtgtggtcggcaggagtggtcggcggcggcgggataacgacgggacggccggcggctgtgtaacgccccgacattcattagccattaacacagctaactcacaccggggtgttatgcattacctgtgatatagtaccagtccaaggatacactagctggtacacacagaataaatatggaatcaaagtaaattactttattacatcactgggtagtagtccttacataagatgccatcatggataggcccatagatgagcaacacaacattacagaaaaccataaaagcgacggcgtagaagcgaacaacgcggagcactaagcgactaagcaactatgcactaggcgaagaacctaggcatctatcttattccacaggcgaggcttggggctaggcacgaaacatctagaaatcttcatactcggcttgctcctacagatactcctcggcggtcgggtcgacgtcttcatcttcatactctatatattattataagggcaagggtgattacttaacgtactcaacaagccaggggaaagaatgacatgtttggtttaaacaataaggctaaggttttatttgcgaaagctgcctttctggcaaagtgatttatttcacaaaactcctagtgagtgagtcaagttttaggtgtcgggaggaggctcacgcctcgacccattccacaagttgctttgcaacaacttgtcacgattaacaacaacaattaatttgtttcctctattagtttcttctcacaacaatacatagtccacacagttatctcagcacaacaacgccatcatcatggccctaacaacatctcggtgtcggacgacaccccaggtcacacagacccgttcctaaccacccaggttagccgtctgccacacaggcggactctggtaacgttacccttcccagtaaccacttctt

SEQ ID NO: 26846 - DNA, 2337 bp, Oryza sativa
attcctgcagcctgcacgctttacccacacgacacgaaactgacattgtttacccgtcagcaacgaaagttcgtgataaggcctttccaaagctaacccatgaaaatcgcatgccacctagttgggctaaaatccatagccgagtatcaggcaatgacaaccgtcatccactcaggaaataccgaggatgccacctactcctaccggtaccacgccacaatagaggcaaaaagacacccatgatgggcaaaaatgtgtaacactccgtctcctcatcctcggcattccacaaccattggcacaccaactcccatgtgaaaacaatttacttagccagaggcatcccataaatatccgtgtggtcgcactgtaacgtgtttggatggatttcccaaaggaatcggtccttaacgataatacgtagccaaaccacaatgactccgcatcatcaccacttttcacaacacattttattttaaacatgtatttggaataacccaagtttcccatacggcaaaacatcgtaagcatggctaagcgaaactacctcggtaatcatataacgataccggtgcaaatatttgtggagttatcaaaggtatggaaacatcaacctatgtaatataaatgcgactattaggttggtccgtcggtcgtataaacgatccgaggcctaaacatgtttttcgtgtatactaagcaatgcatttttcaaacaacatatcattgcaaatataggggcaatgtgatcaaagaggcttgccttgcacagggcgcgggtcttctccctcgaaaacaacgtccggagcttcctcgaactcgggctctaaacgcgaaaaacaaaactaaataagaaaaggcaataaaactagttcaaaacagagaaacaatggttccactgtgtagatctcaattttagaaaaatttaggaacttgaacgggtcaatcggagttacggttgattttctacggattttcaaacgatcaaagcattttctggaaatttatttattggacgacaagggaatattctgttggaatattccgctaagctaacagcaaaaaggggaggcccacctgtcagcggttgttggaggaaaagagacgcgggcccggctgtcagtggcttggagggagtaaaggagcacggggccgggctgtcagcggctcagctcggcctctcttcttcttcctctcgctactgctcggctcggtctgggacgacgacgcaccgcggcggcgagtcccggcacggctaccggcggcggagaactccggtgaggcaccgccggcgacggcggcgctaggaggcgcggcgcagcggctctaggcggcggctcagagagtgatatcgtgagaaagagagagtagagagaaatggagatggtgatggtgtggggaggaggagcttgggttgcttccccttttataggcgagcgacgcggtggcgagctggcgaactaggcgcggcattccgggggtagacggctagcagctagggcgggattccggggcggacgagatggcgacgcgatggcttggcgtcatgcaccggtggcgactcgacggcgaaaacaacggcgacgcgacacgaagtgacgcgcggagagcgggaacggcggcgagacgggggtgacgcacggccgacgacggctatggccgggatttggggcggtagggctagagaggggtgacgcgagcgacggtggcgactcgacgcgagagagagggagagacgcggctcggcggtttcccgggaggagatagacgacaagacgacgaggcgacagcgaagggacgcgcgtccgcgagagctcgggatgggacggcgcggcgtcagcggtggtggcgacgcgacatggcgatggaacggggatgacgaggggtggcgttgcggccgttatccgttggcgtcgacgcgacggcgacgggatggagactcgatggatggagtggacggcgacgggacgggggtgacgcggggcgacgtggctccgtgtctcccggagagggcgcgacggtttttttcgtggagtttggcgcgatgcggctttggcgcggcgtgcggggcggcgctacgtggccctggcacgttgcggggcgcacgggagggtggtatggtgcaacgcggcacgggaacgagggcggaacggtgcggcacttgggcgagacattttgtcgaacacctggcgtgcatgcttgtggctggtctggggaagaagacgatgagcagtgaggggctgggctgggctggcgcaggaagaaggctgtgggccggcctgcttagggggagctgaagagaggagggatggaggggagttgggcctgggagagaaa

SEQ ID NO: 26847 - DNA, 8409 bp, Oryza sativa
ctccaatttttaaatgacaaactttttaaataaaagcacataaatacggatgctacaggctgacgcctccaccctgccgcacagcagccgaccagcctcgtcgcggcgcaccggaaagaaagccctcgccacgcacatcgacgacgccgcaggtgcccatcttgaggtacatgatgggcccgtacttgcgcgctagcgacgccaggtcggcgtgcggggctgggccgacgagcgggagcgcgccgaggacggggacgcccgggggtcccaaggggaggcggcggccgccgccaggggagggcgggcggtaggagcagagggagaggttgaggaggaggcaaaggaaggcggcggagagcacgacggggtcggtgcagagcgcggcgagctccatgcatctggagcgacgaggcagggcgtcaacgacgccgtggggagggatgggcgaggacgtcgacgactcgcggggggagagaaagagaggcggcgagggggactccgctccaggttgggtgaactctggccgggatggggttggaggaggcgccagccaccgccactccggcccccgtccgccgccgtcgccgacgatctagcccccgtccgccgccgccgacgatgacgatctggcccttgctctggccttcgcccgcccgccctcccgccgccgctagcccccatcctacgctcgcgaacagaaagagagagaaagagagggggaggttgaagaaggtagataagagaggatgacacgtgggccccaaatgtcagtgggtcccacatatatttttttaattcgaatgccacgtaagcgccacgtgagatgaagactaggtcaacatcgacacgtcagcaaaaccgccctccaaaaccactgagtgagtcaaattgcaccggtttcaatagttcggggagtcgtcttatccggtttcgcgatttgaggatcacgaattagattctgtcgataattaagggagtcaaagtggactttttccttccttcttcctcctccgtctctcccttctctttcgttctctccccttcttccccttcggccggcggcggggcatgggccgcggtgtggtggcggctggcgggagctgaaccggcggcggcagcgggagctgacgcgggagctatgttagaatctctcctctctgaatgtttaagtactaatcactagcactaacataaacacttgtatttactcggtggacacaaacacacaagaactgaacaaaacacacaggcttttggttgatgtggctaatcacaactcacaccattttcttcattacatagacttaagtacatgcaaaagataaggatcagccaactaatttggccttgactcacgccttactccaacatgcagatgccatgcaacaaggtaactagctagacctattcttccgccacaaaatcacttcgtggccttccagcttgagctgcagctctgcatgcatcttaacacatccaactaaatgcttgcatgcagccgctaatcactagttctacatgctaatgcaacagcctttacacatcgtagatatcggcacgttcgtccggccgcatcgcacagctcacagcaagcacgtttcacacgtactggctcggatcctttgctgccacacactactaccttgtgcaaaacctatacaaaccaaatgcatacactctaaagacaagattattgctaacatttacccccctaatcttggcatgcttcattcagagaagagttggctcctcatcacttgacgctgcggcaaggagcgctatctccttcttcttctttttctcagggcactcatacgcaaagtgtccaagttcttgacagtagtagcacattgtcttggacctgtccggcttcttgacgcggctgcggccaccgcttgtgtcgccggacgtgaaaagtagatgctcgccattcttgtcatcacgcttgcgtatcctttcctcgtatgccttgaggcgaccaattgcctcatcaaatggcatgctgtccaagtcagagaactgctcaattgcagcgatgacatgcagaaacttatctggcacagaatcgagtagtttcttgacttgctcatcatcgtccatggttacaccaagatcgctcaacttgtttgccaggccactgattttgccggcaaactcgtcgattgactcggtgtccttcatgtgcaatgccttgaaatcgctcttcaaggtttgcactcgcgccttcttcacacgctcaacgccaaggaacctcgtcttgaggctttcccagacctccttggcagtcttcttcttcgcgatctgctgcaacacgtcttcggggacggccccgaagagacacgcacgtgcctgcttgtccttcttaatgtccacggcctcatcggccgcgggctcgatggcatcccagatgccttgcgcctccatgttagcctccatcttgatcgcccaggtggagtagttggtggaggtgagcactggatatgggagcgacacgatgccctccctcatcgatcgcgatgcggagtgctcgacgatggccatcttgttgaagcgcaggatcttgggcataaattggctctgataccaattgttagaatctctcctctctgaatgtttaagtactaatcactagcactaacataaacacttgtatttactcggtggacacaaacacacaagaactgaacaaaacacacaggcttttggttgatgtggctaatcacaactcacaccattttcttcattacatagacttaagtacatgcaaaagataaggatcagccaactaatttggccttgactcacgccttactccaacatgcagatgccatgcaacaaggtaactagctagacctattcttccgccacaaaatcacttcgtggccttccagcttgagctgcagctctgcatgcatcttaacacatccaactaaatgcttgcatgcagccgctaatcactagttctacatgctaatgcaacagcctttacacatcgtagatatcggcacgttcgtccggccgcatcgcacagctcacagcaagcacgtttcacacgtactggctcggatcctttgctgccacacactactaccttgtgcaaaacctatacaaaccaaatgcatacactctaaagacaagattattgctaacaagctagctggagcggcggcggcggcggtgggctggaggtgatatgggttctggagcggcagcaccgccggtgtggtggacggagttggtgcagggagctcgtccacccggtcgatggcgacggtgatgatggagacaagggagcggatgaggctgggcagtcggtgctgcgacggggctgaggctgaggctgcggggggagctcgtccttcgaggcgatggccgtggacctcggcgtgatgaagaggtggtcgccacccctcctccggcggtggcggcagtccccggagtggaggagtcgacgatagtgaggccagcgctcggcgagatgggacctgcgtgctggacatcaggctggccaacgccgacatgcacgctggcaacatcctcacctgcagagacgaacaaggccatggcctctccctggttacaatcgacaatggatactgtcttcctgagagtgtaagcactgacgctgatagattttcttctagctaattgatttccattttgttcgttggtgatcatgcatcgatcacgcatgtgcagtttgaggattgcacattcgagtggctctgctggccgcagtgtaggcagccattcagcgaggagatggtggagtacataaggtcactggacgccgaggaggacatcgccattctgaggttccatggctgggacatgtcaggcaagtgtgagcgcatcctgtgcgtcaccaccatgctactcaagaaaggcgtggacacgggcctcgccgcgttccacatgaggagcatcttgtgcagggatggggccagacggtccccggagtgaggagtcgacgatggcgaggccagcgcttggcaagatggggtcggcatcgtggaggaagtcgaccggcgggggttgtccttagcgtcatcgacggccgacgatggaggctgaggtcgaaggcggcggcccacacactggcctcgctcgtcggccgacacagaggcgccaatgctgaccttgttcgccgccgccgccgccgctccggattcagcttgggtgactttgtgttggcatgtcacaacgtgacattgtgaggatctctgccatcaaaaacacatccaacagctcgtttggttgggcccgtctgcaggtcggaaatttagccgccgatccatccgtcccgcgggagtcggcgcccgccgatccaacccatcccgtttcgcctcgcccgggtccggccgtcgccgcgagccagcgagttgttctgaagaacaaatcaaaagcaaactccagtcaggatgcaacaaacagaagctgtttgatgtccataggctgatgcttgtgcaggggcagtgcggccggcaagggcagtgcggcctccaggacgtcccctcctccacgcgctgagctgcagatcacagaagaaaaatgaggccggtccgccacggctgcagatcaccacgactgcctggactggctcggcagcctccatccgcagccgccaccgcacgagggtaggcctggtggccggccgctgctcgcctctactcgtgccggcagggccactgcggccatctcgacacgcgcgcgcggcggcccacggcggcggccccactggagtcccgcgacgacagcccccttccgagcggcggcaccggcccccttccaagcggcggcggtggtggttctgggggattcgcgagcagcacgctcgggcaggaaacggagcaatgcggggtgaaaaactgaggcctgcaggtgggccggcgcagaggacccttggatttattttcaacgccccagattgctctaatgtcacaccgtgccataccatggcaatgtcacagaatctgagtcccgccgctccagccctcgccgcgtggaagagggggaagaagaaagagggaggagtcagtgggccccacaaatttttatgtgtgtgaatgacaaacgagtcccacatatattttttaattctaatgctatgtaagtgccacgtcaacgccacgtggaacaaagacccattaatatcgccacgtaggcacgtcagtgaaaacgccctccaaaaccactgagggagtcaatcacttttgaggatcacaaggggaacttattcctaaaagttactactagtttgagggacaaatgatgaactttttcccgtttggctcaagcccacgcgaccatccaaatccagttggaacgttatcgcgagtaacgtgcggtgcggcccatctgtgtgggccgtggagcgagtagattgggcgcggattacgtgcaggccgtgcggcctgctaatgcgtgggctatcgccaatccggagagcttcgtgccatcgtaggatggccccggagtgattacctgcgctggcccgcgcggtgcggagaggatcggagtaggatatggcgtcaaacgccgtcgtgcgtcgcggactcgcggtcggcaggcggctggcgcgtgttccgtgtgggaggcctgcctgcgtgccaaccagcgcaacgtgtcagcacagcccctaactttaaatgagctccaccgacgacgaccaccagtgtgttgcacctgtgcgtcacctccctgttgatgtcagtaacagtctcttgcgtggtaggcccccgagaagtacttgcctccagagcattgcatcatcagttcatcaccggaatctcttcaccatgcaggcctgcgggctgcggcacagagtcaccaggttgtctgaggttacactacgtttcacgcgtactacgagtgattgagaaaacttatactgcttcccacgtagacgtacaccgtataatcccgcacatcagatttcagaaaacttgtacagtacatcggcccaagttaaaagtcgtcttaccggcccaagctagtcgtatgtccccaggtccaaatcactacaaccgctgtcgcgttccacgtaacaacaagcgagccaggccacaaacacaaagcgttcatatgttctctactctctagtcgagcggccgcatgcagcacgcgcgccggggtgacaagtccaaagcttcaaaccatttccccccaccctcgcgtcgcagccttctcgttcttcgcccccacaaaagtccgcgctcgcctctgcctttcgcacgaaagtggggattctgcgattttactagtagtatctcattggttgtaaaccaacgcgagacgccggcggtgagttggagttggtctacgagaaggaaccatcggctgctcgcatgtggcggcctcgaagaacaatccttttccggctctcggggacttgttaattcgccgcgatgtccgtcgctttcgcggcagcgaggccccctcggcggagcgaaaaagaaaaaagaacgaaaagcgacctacctggaatggcctgtcaattgtgtatccgtacaccagagtcccaaccaaaagctggctaggaacgggagaggcactgtacatagcaccgacgtggtgatgagacgtgaagagccacacacactgtaaaagtaatgaagtgtacagcactttatgttcaacagtgaataaccctattctgccaaacgtggtactccaaacattatgtgggaatttattcgaccgtcgaaacgtattgctgcgtacaacttctcgatataaccaagcatgtactgttacacttggacaacgttttggtccatcgcccctgcatgcagggaagagcagcaataccaataggctttattaaagtgtaaacggctacaggacgcctcttctgtacttctgtttcacggagtaaaagtgtaaaacctccatgttccattgcacaatgtactaatcttctgtacggagtatattaacttgacctttgctaggtcaacagcagattggctgatcaccgatagaaacctaccacagtactatgccgtatacacgcatgttcagctagaataaagtgcacctagcatggtgatgatcgaaattactacgtaagccgagtcagacagagtactagtagcccctagtagcggataggataaactcgccaagtctcatactccaaggccttcaagttgcccagaacttttagttgaagaccagatggagggttatagctactcgtacttaattagtattaagctcatgtcttcatgttcctagttgagttatactactgtacgatgacaaacttttgacctatacgaatctgcatgcgtcccgactccagaacccaatccacgagggtttgaagtttgaaacggtcacggctattgtattctattccgttaggtctctcagatgtcactagtacctaaactaactaatttttgtcacgatgcccagctctaattaaagtttcggtccttatttttggtttgcaatgttaggctggcctgaccataagcacgcacgagtgtacgttgcgtaatattcgtacttcatatagctcggcatcaatttgccattgactagtggtatgattgtataccttccataacgtatggcagggttcaaaagttcggtcccctgccgtgcggagaatgctatgcataatacagcctgcacgactaaatcaaaagttcaaaaggaaagctaaatttaacggtcttgtttcacattccgcaaatctcgggctttcacttgtttgacaagagtactggcattcaactaactttaggtttacacgtaccgaatctcgaattgatgtgttcagtttaaacctcaattttcaagtagtaatatactcctataagacttttagcccacagccccacacctcgtgtgagctctgccgctataaacaaagaacgggatggcttataaacaatgcgcacgattttagatctttgtacatgcaaattttccacgtattaggagtactggggcgttctccaactcacaaacgtccaccattagcagcgtaaacgttcgcaggacagaacattccaaatttgctactagccaggtggccggcgcggtccacatgatcggtggctagtgactatcactttgcgggaagagaccacactcttccaagtaccggtgattgaaaggcccgagacgtcttccccggcccaacgagacgacggcgacgcgtttgtctcgggggctttagccagctaatcggcgccaccgcgcaccgctcggcggcggcggcgtggccaccgtcttgcgtgcacatgttcgcgtgcaaacggccaggctaaacaaatcaataaatcaacatatattgcaaactatacatgtagtaaaacattaaaattattgttaggtctaaccataaacgcatgatatttaaccatgtcagcaagtaaaattttgggctgcagg

SEQ ID NO: 26848 - DNA, 8987 bp, Oryza sativa
aatccaagagtaatatattttttgtaacatgatcaactctcatacgtttattttaactctactagatccattaaaaagatgactctaattgcagctagtgttgtatattggtcaatttggcgttgttataatgttaaagtttttaatggtaaacaattatctaaccatatgtaagttatttttatgtctcttattggcttcaattttagtttacgatattaccacaggaggagcaagatactatgtgcaatagtgctacactaccagaatcggaagccaagggtctcttgttcctctactgttagctaaaaatctatatggtttaacgctagtcaataataaaggggagttgtggatttgttccatcactttattcttcattttaatttaattttatctttacttttttttattaaacttatgacagtgtgtctatgatagaagttgaagatgtaatatatttttattatctaaaatgtgatttgcactaagtgttttcccaacaaatctcggcctgcacactacgggccaaatgggcagccggcttagctggcgggctggctggacgcgtgaaacgcagagagcgatacggggcatacggccagctgcccgggagagcatccaagtgtatccagagggtaatactagttgtagtatcagtagtacatgtcgatcgtactgatgagcaaaatcacacaggctggcggtcgcggtggtgacctagcattgtttgtctgtgcgtcacagatggaatctacgggatgggaagcccatggatgggagtaaatcagatcgggatgctgctcttcatgccccccaccacagccacactagtttaatcaaaccgcaaaacgacgctccggtctgcttattcattgatcggggggagcagagatacgaatattacgatcgatcggcacagtgtactatcacctctcgtgatcaaccatatggcctctcggtcgacacgatactgatgccaccgtacacaaactcccccaaatggtttttgttcagcatcaatctcgtacctcgaaatattgtgacctgaacacaggagagactgatactccagtagtaggagtaaagtattgtcagttatcacatggcatcgccatccgagccgtcaatcttttgattctcggtcaaatatctgttagtaatccggatgatggattgatcattaacttctattaaagagaatagggtttttgtactgaaaccgttcgatcaaacagcatctgccccagcatgttctgtgcagatggaataagatggatgcatggtcctgaccggtgcgagcaaatgatactattaggctaaacagaacaaaaccaatcatagcttagcactatatacgaacctgtacatttttgtgcaaaatgattaatcttgtcagataacgagacaggcagatctgaatatctgatacgtggggagccctcacaggcaattatgcctggacagcaaacacatacatggctagaatctaggcctatgagagaagtttaaaccggatcagattcctggcaagttgcgtgcaatgtgacaacgaattgaagggggagggacgagccaagcgctcaaatcgctcttatcggaaacacatggagcctgattcgtacctgggaaagtgatttggcaccaccctggttttcttcatttaaaactcactgcgatctgcagtatcaaaattaacaatacggttttaaagtacttgtcgcaagtcatagggaccaagtttaatacatccttatcgtatttattcagctgcgtttttttttttggctgactcaacacgtgatcgcaggagcagcaagtacatggtttggcaaaagttccgtagagaaacatgggtattcggggcgaacagaacatgctcaaaaggtatagagaaaagaactggcagctggctagatcttaacttacactaggagtccgggttcaagtatgaacttgtattcttggaggagcacttctgtgtggcagcagaggtgcttcatacgattgtgtttgccttacaatcacaaaacgaacaaaaataaatcccgtgtcaacttaggacagagacagtggagaccctatcgctttcctaatttccttgttccgtgccgaattctagactagacttgctgtgccacgcaaggtcttgacgggcccggactcctgacgacgcggattaattttcacctgctcgattcgttccgataattttattgtctgaacgaacgtgactacgttgatcagcctctggttacttgcgtgctaagagtacacgcatgcacccggactgttggtgctgggtcaatctgggatcgcgttccgattcaggccgcgcggttcacgatcacccttccgcgaaaggcaacgcacgcggcgctgcggagccggaagtccgggagccgagcgcgttttggagggtcatttttttatccccgattcccatgccgccgcgcgccacgcacgtacggatgcaccgccccgcgtgtgcccgtcttcgtgtgccccccccccgcccccgcgcgacgatgggcggcagccggcaggacgcgatcagatcgccatctcacaccgacggcacgcggcatgatgaggacggaatggtctctcgctcctcgcgcgcgtttggtgcggcgttgccgtcggcgctgtgccgctggcccgtccgtcggtgaatcgtgtggtcgaccggtttccggttgcctccgacggccgatggggtacagtacggccgatcctatgtgagtccggtgaaatcgatcgatgtcaggctttcgtcgtgtggcggcggtagatgttactgccgtacggtggcacagcggaggcggtgtcgtgtttggagaaattgagaatgccacgtcttgtccgaatggaacggggttgcacattacgccgaaaagcgagccaacggatcagatcgagctcggaagagtgcggcaagttgccgccgtgttggtcagccgtcgggctcgtgcattgccaggtggcgctgccgtgcgctcctgcttgccgaaaatgacgaacaacgacggtgattgtgctgcgttagccgttagtcactgaaggacttgttcattttgctactattttcaatcttaataagttttgacattgtcaaattttgataaggttgttaaaattttagtaaggttattaaattttggagattttatatgtgcttactaaaatttagcaacaaaccatatagccacttttttaaaactttgaaaaaaaaagtatttttgaaaatggtagcaaagtaaacaagtcctatttttttttattttaccagaattttgaattcggtctttcaacctaatttgttgggtgaaccgaaggaactacgactccggattttcttttgagcttgccgtacgtttttggttacgtgtgtgtaacaaatgtgatatgcctgtcgcatatggttctcagccagaggccatatttatttttctgcgcggatagctcagatcaacctaactgtaagcgacttgaaccagaacttagaagttcaaacttcaacaacgcgcctaattacgatagttccaacctgctgccccgtgtttgatttgtgaacatgcgtacactcctacctgctgggactgcctgcccgtccagcaacacacacacgctgttgtctctgctaccctgcgtcgtgacagcctaacaggttgactgaaaatccgtatagaaaatgctttttatccgtgctgaaaaaaagagagaaaatccatttgcttcaaagacatgtgctacgtttatgcaagccaaaccatctcttacgataatgttcccccctaattttctccagtaatcagaagataggttgaccggttcatctacttccctcttgcaatagcataagctctttaatggtagtgaagggcagctctttgtagaatcgaagatgatgcaaccattcatggatatgaattaaatattaattattatgaaattaacaaaaagttttttttaaaaaaagctatctatctatgccttttttccccgacaaatcgtatttttaaaaatgtggcacgaataaaccgatgataacatgtccatgttagcttatttaagcgtttgtactgtatttctcaaaaaaacatattattagtttgaccagtagttgacacttttctttccgaggaaactttagtacgatcaactaggatatacatattcaagatttttcagttatcttgagaagagtcttacgcttagttgttaagtaaaattatgtaatcctctgagtacatatcttacctaaactgaactaaactcattccttaatccaagtggccgccaaacgctcgtcttgatcaggctgacctcaacggtttcgtcagcatatggttggatcattgacaaggtagctaagcattggcattgatcttaccgagcctaaacacagcttgatcgcttgctccaaaacaaaagtccacagagttcgtcagattgggtgtcctttcttgtagggcgccaaactttaggcgtgcttgcgtcctggttcctgggtaattaaatgccaacgtgccaattgtgtgatatgaacatttactgtctttttgttgtttcctagtgaatcgtcgtcatgttacggacgtacgtggtacggtcggtgagcgatgcgactcgacaaagttgccgcaatgccgccctataggctatagctaagtaattaaggtcggttgatcagttggaattctcttcctccgtctcgcggtcgccatcgccgtcgatcgatagatgggcgggtggttcggctcgttgtacgtggctacgagcagctacatatgcaaacaagatgcaccaacccctgctgatctactgctcagcatgagcactgcaaaactacgagagcagcaacaaagcgagacgacagatctgaagaactgtcacagtgaccgattccaactcgtggaatgtgatggaaacttcagccagtgctcgatgatctgatgacaactcgcagcaatccggtttgctagcctgctaggaagaatcattttgcatgctatagaatggattaaaaaatagcatcacacggccggagagtcgctccgccattgctttccgttccgattcgcatccttgtctgtctcgcattgcattcattaatctgcgcgcacgttgcagctactcgctaactcctgtgaagtaagggactgtttggttggtgctctcaaggatatttgcctgaccagatgtaagcctgagattagccgggaccttgtttggttggtgccctgaccttagtttctccttccctgccctgagctcttttggagcctcattagcctaagtcaggcgaccgttttctccaggacggcgcagctacgctcattaatcctaattaccgcttataataatgtagtataggtactgtagattgtaaaagcagccgaccatataaatatattttatttgtactttcaaggagggatatagcctatccaaatattttattttttttgctaacactttataacaaccgtaataattaaaagcttaatcacgtttagttttcacaggcgcggaagaacaaccaaacagacaagtgttcaggctgcctgagcaggtaaaatttatcatcctatcagatagctctcaggcacctaaatttttcaggcatgttagtgagggcatcaaccaaacaggccctaaaaacgtatcagcggcaagcgtttcatttcatttcaattacgtatagcacagtgtccaagctcgcgaaaggtaaccttgcgcgagcgggcggcttgttggctcggctcgcggcggatggttggagcgaaggccactaggggcatgcaatgcaagatagagacgtttctctttctctttttacctttttaattttaaaaataaacatttcgactatttaatttttaagatatgaaacttttggctagtctaaatagaccgtcgtagtaaaataacaaggtcacgcccgtctaaataacgtgataacattatttgatcacatcgatctgactgtaacaacgttgtaacagcgtagtactgtcatgccactgtagcataacaaaattatcacgtccgctgtgggtggggtaacaatgttattttaccatattaggtggggctcgtgtgaccagaaattttggaactttgaattgtgaaaataagttttactggtgtttatttttaaaataaattatttaaaaaaaataaaaggggataaaattcgccgtgtcgtgcgcttctgtttggagaaagatttctactccaattatttgtggagcgtagctgagagcatagtggacgtattttagcgtgtcatcaccagttatccttagccactcctttgtagagattatatagaatcgcttagttctaaagaaggttgtagttttgaattgttcagatttcatgcttacacacgaaataatcagtgcatgaataatttaacaacattgtattattgttagttggtagtatttcagatcgcagataatatgtttttctagggccgcccttttcactttttaggatactactagacacactttattttcttattaaaaatgattgtttccttctacaaaattagagtacattattatgagttggtacatatatagctagattctacctacgaagatgaagctagttatgccttatcacatcgtgcccacgccattttctgctttcgaagatgcaaacatatcttctacacacctacacagctatgcacgcaaatgactgaaacggagaaaagatgtaaggcgcgtatataatactccctccgtttcacgatgtaaatcattctaacattttccatatttatattgatgttaatgaatctctaatgaatatctatctagattcattaacatcaatataaatgtagaaaatgctagaatgacttacattgtgaaacgaatgaagtagaatacacgagacaatgcaacatttcccatattcatattgatatatctatctagattcatatgaatctagatatatatatatctatctaaattcattaacatcaatataaatatagaaaatgatagaatgacttacatggtttcaattcagtttggtggctgttagaggatatcatcataaagaccaattgaggggagtattgtttttcttcccctcaatttcgaggcatgaaagctatcggtattaacatcatctgcagttctgcacatcagtttgactcaacgtgtacgtttatctgaagaagggatggccccgaaatattgccccgtatttgtaataaatagtccaaaataataagggatatattctctccgttttatattataagtcattttaatttttctctagttactttttaaaagtttgatcaagttaatagaaaaacataataatattttttaacacaaaacaaatatattatcaaaatatatattaaatgtttgatttaataaaataaatttggtattttagatgttgttaatttttttatgtaaacttggtcgaacttaaaaaaatttaaaagaaaaggataaaacaacttataatctgaaaatgacatatcttttgagagaggcgttgtcatgagaaaaaacaatgtagcagcaccatttgggtactcatgggtatgctaaggctgtgttcttcccacacctttttcaagtcacatccctcgtattcggcacacgcgtttttcaaactattaaacttttcaaaagatttatatacgaaaattgctttaaaaaatcatattaatcataagaaaatgtgtcgctctgttttacttgcgcgggagatgagtttccagcctaattttgtcttgtgtttaatcgcaagaaatttggtattaaataattctatcacatttgattttattatatttttctcacactaagatttacgttggatcattagtatgagaaatagataatacggtcattttagaataaatattgccagttaactgacgaaatatgtatacaagatggatataagcatatagataagaccaaaacaaaacctcagggcatgtaggggtgaggtaaaattcagggcctggaaaggattgaggtaaaattcagggcatgcaatgaattttctcgggttctttttttctgtttagagaatttgaattctgtggatatgtgtattttcaaatggtgttagccaaacttcatagagaagtcatctcgaacttgattctactccataatttccacatctttgccagggattagattcttacaaaaaaaaaagaaggcgtggtaacgttgcaaagcaaatcagaaatgtagctttgctaagcatttaattcatatttcatagacgagcgcacaaaacatgtgttttttttaaaaaagaatcaatgtgttgaagcagttggtgcgatattccatcagtgtggtgatgctttcgcaaggactagagaatagtgcttgatattctgccgttccattttagccatgcgatttctgccgacacaaagaagctgtaacagaacatcatctctctcttactaaaggagggcatccatctgcctataatttgctgaggagtaactgttacagagatggtgggctaacattaatcgctaatggttgtttcatgaccagattcaacagtagaatatagtaaatggatgttaaaattaacgttctggggacatcgcagcatcctgccaactttcagctccactgattagttggcggttactggcgagaatctaattaagtttggtgtacaatccaatcagtgagcggagctctctgctccaatgttttggcatttggccaacaattaattcatgcagcgagcaatccatttcagctcgacaaatgccaacacagagataggcacgtccatgctcgtcacatgtggacttcgtttgtcaaaatggcgtgttgccaagagtgtacgtatcagtgcactccgttgcttgtaaacaactaggagaaaatactggtccatccaaaaagcagaagaaaaggaagaaacgagataaggttcatgatatatacaag

SEQ ID NO: 26849 - DNA, 11741 bp, Oryza sativa
cgttcggcgtcccttcgcacacgacctggctacggttctgcgttgcttggttgcttgcctcctagcgcgcgcgcgccccgtcaccgtcacgccgcgcaccacctgccaaaaaggcgtcccaccacgtcgtcctcctcctcgtaatagccggccgttgctgcgcgcgcctgcgcgccggtgcgtctctcgtgtggagaggggccgcggccgctgcgacgtgcggcacgggcggctttttctccgcaacgggtgggcgtggacggggttgggttgatgatgatgatgagtggtttctccgcgcgccggtgcggacgcattgaaggcgagcgtgagacgcgagccggcgcgcgcggtggcggaggcagccaaccaccccacccagcgcccggtgtaaatgtggtcgaatcgcgatagtcagagctgcgttcctgtgaccaccaccgccacgtcccacccagtgcagtgcatgagcccagcccatcgcacttttgcacagatggatggatggatggatggtgaggccacacagccatatcccgttcggggtcagacgcacacatgcctccattcaaagtgccaaactgaccaggcagctcgtgatggacgcgatacacgccacgaataaataccagatgagatgagatattgagatggcagttaaactaaactactgctactgctgctacacgcactggcccagcttcttcactccacgtggggcaggggaaaacagagcatggtactacagtaggagtagtacgctttgtacatctcgcagtgtataaaggacgtacggttagtgggcacggggcacgaatctagaagaattcaatgggccaatggggagtgttaccatctgaatgtgattactgttgccggagactttaaactaaatgatctcaaggcatcgtccagccacggctgctgaggcaagggtatcttgagatgcatcacgcatatggtggcatgatggatttgagctagagatcatatggggggtgtcactagtttaatccgtgggctctgcgagcaactgaattgtttttctagcgcccagtgatgactgatgactactggtcttaaccgaaagcatgtagttggtactaacaccgggactttttttacagtagctttgcaactgtgtttgttaattccacatgagcttatcaggctatgttattaaattgtgatggtataagaggagcctagcaatccacgatgccttttttttttgccttatctaaagctcacatccactggtcttgtgcgatagtttaacaaaagccagccttctctgccaaccactgcccacaatggaggacaattataccaccctttatttgctcagcaccacaagtatatttgcgagttaatcacaagcaacaggcttcgtgtattttcgtgtaatgatgttgtaggctacttgtggtgcccacataaccaatcattacactcgcctggtttttcacttctggaaattggagggcaaagagagcaacggtgctactaacatgagtaatctaatgttatttcttccacgatctcctttccacccgttttggagatcacaggtgtccatggtaagaaaaggggagaacataaaaggtgagatcaaaatagtcggtaggtagcattgcaaattttgacagaaaacaacggtttcgtaacgaagcgtgtgatgccaaaagagtctctcaaaccttaaaggtggacattcggtctgaccaaaaatttctgtcttggccttcggtctttcggtcatttcagtatttgaagagtgaagaccgaattccaacacaaaaatatcaggaccgataaattcagtctcggtctcagtcctgaccgaaattcagcaacattttcatatatgtaaagaaataatagaaattttcaacacaaaaatcacaaaaaaaattcataagcaagtatgaataaagactcttattaggttgcatgcctataagagtagggatgtgaaaattagagtttaatcctattgaacttagtgggttgtaggttgcatttagaccttttttttttaatttggtcttttcggtttattcgtttaaccgaggagactaacagaattgactgaacaaaatttggtctttcactgcccaggaccaaattgatgaccagttttctcggtctcggtctcggtcttgtcggttcggtctttttctgcccatccctacttaaaccaacgccctcttttttgagtgataattaaggatggtaagcgttgcggggccgggttgggctggaacggccccgcccccgaccccccgacttcaccacccggccccggccccgaccatggatgcgggtgaaaaatcccacccgcctccgacccctgcggggccccgcaacccgaccggggacccgcagcaagtagcatcttcatccaatcaacatagaaaattcaagacaattatcaactcagtgcatcacatggattatctcctaagagaccaactcaccaacccatgcatttgggcacactttcattcacaaggcacagttggagacttggagtattggagatggagcaatacctcgcatgtgaatcgcctagagtatttgggagtattggagacgtgaatcgccggccgccgccacgcctgtgcgctgcaacctcgccggctgcgcccgtcgcctcgccacgcccttgcatgtctcgccggccgccgcaacctcgccgcgtgcccttgcctgtctcgcctccccactgcgccctgccgccctatgcgctgccgccgcgccctgtgtgtcgccgccgccctgagctggagccgtggaggggatgggagacgtgaggccggacgccggaggggagattggagaggaggggaggggagatggtggctggcgagtggcgacgccgagatgtggccggcgagtgaaatgttccccccgtcccctccccggccaaatgcggggccccgaccccagcgcacccgcgggtgaaaaatcccacccgcccctgcctccgtaggggcgggtccccgcagaggacccggccccgcgggggaaattgccatccctagtgataatacccaatagtgtttacatgaaacaggtgattaacgacctatcgcctatgaatgggaggacgccagaagaggacagtttcctaattaagcccacaatcgagttaagacgatgtgatagaatttagttagtttcgaggtgtaatgcattcatggcctgagcggcacaagctagctaccttccgtttttattcccctccttttcttcctttccatggtgtcatggcgacgcttagcagcatcgtcttggagaggaaaacctgtaatggcctccatgactcatgagacgagatgagctagcttgtgaacaggtctcaagcagccaatcaatgtgttggcgccggccggcaaagtggcttttttgcgtctccgacatgtgaaagcgcccgttggcccccgtcaatccaggcttgacagccgtttcctttgatggtgtcatggattcggcctggaacagcatcactagcgtttgtctgacgagaagggaagaaaaaaacggacgtaaaagttcaggaataatgcagtttcctaatcctaccgtaacatcgatccattaatttcaacatggaaattttgtttttcaaatgtttaatttgaccctatacctgtgacatggaaatttctttttaaccgtttaccatggaattttctgcagattgtttgatctctgaatgggttcatgcacgcatggcgttgaattaggtttgagagaacacgcattggtcacaactttgcatatataggtagagtagcaaaggacaaaaagagaggatggttcaactacatagcgatcaaagacggctgaactgattagaagttaatagtgacaaaagcttatgtaaagtaatcttgggtaggatgagaactctatggcggggaagtttcctaatgaccactgggttaagcttttccaacctagagagagtagagtgttgtttagctctgtctttaggcgtggattcacgcagagagacgctttgccccaatctaatgcctaagcgcgtcaagctgatctcatctacccgtcaacgtgggtcaaaccagacgacttggatgccattttacacaaggttatgtgaacgcccagattctactccgtagcagtagcaccatgctggcatgcttcatgtaaacttgactacatataagctgattagcatgatggccttggctaggaaaccaaataccaaaagacttgaggacagatccgtaactgcagggtttttttactcgttttagaacataaccttgttataaactcatggaaactcgtacaggaagctctctgtggactttaggcactagtatttgagaaggcagctaatgccaagctagccggtgagcagggtttaccattccgacgaaatccggtcggatttcgcaaaatttcgacgtttcgacgagtctcgaaagtagaaatcatctaagatttcgagaagtttcatccaaatttaaatttgaattgataaaaaaaagaaaaaatcaaataaaatcttataaatactatgatattcatagaacctattgggatataaattttcgaaaaaaatgatatattatgtgtatttaaacttacatcagagaagaaaagaataaaaaaataaaaaaaggaaaacacttacatgggccggattaccgatcgaaatttcgatgatttcgatcggaatttcgcctaaaccgaccggttttcaagaatttatcggcaaactcagagaatttgtattcaaattttggtttgtgaaatttattcggaatttaccggttttccaccggatttcacgaaattctgaattccgccagtgcccaaaatggaagtgcatgtcggaatcgtaaaccctgccgtgagtgtttaagaaaagttattaagaacccaatttccagtttctaatttatttattttaattctatcaatatgaggatttttttaattattttttagaattttatttttttaaaattttattaatagacatttctgaaaattatttctaaatctgaaccttttgtcatggcgtggccaaatcactttgtcacgccacgcgtagctggcgtggcagtgttgtcttgccacaccaccgtggcaggcgtggcaaaacaacgctgccacgccaaatattttttggaaattaataaaactttttaaaaataaaaaaaatccactatgagttctaagaatttgcccgaggaaattgtttggaagcaatagattttgaaagataatacaacagttagaagtttcacaatcacaaacaaggcctaaggtacacatgcagtttgatattgatagagacatggttcgcttttcttttcaactcattgaaaacttgcatgcaacttttgaagattattcgttgaattaatgtaatgaattatctacataatttctaaaataaactttcagaaataacttagaataagttatcaaaattaaggttctaggaaacacatttttagaagcgtataacaaataatctacgaatattttagtgaaataaactgtaaagaaagtactctaacgggaatttccaagcacaccttagattgtgagccaatgattttttttaagatttatcaacgatttttgtgctacgaatgttttttgcaatgcaattcctccgtctcaaaatataaaaaattttagagttaaacacgttactagaagtgaatggtggagggttgtgattggatgattagtggagaggtaggtggaaaaagtgaatgatggagggttatgattggtgaggaagagaatgttggtggagaaattattatatttagaataaatcctgatggctaaagttgttatattttgggacggaggaagtacatcttacctctacgagtatttgaaggttgattaagcatatcagaaccatttcactattgacgggtatattgctaatagtgaaaaataattaatgtaaatacaagtcccatgttaagtttataatttaaactcgagtgtggccatgttttactaccacggacataactagccgagctaagctcagttcgtacttcgaagtgctacaaacactctggcaaaagtaggagatttattctactgtatagtctgttatactatcatattggaagccattaaatttgcaccggtttattttagggaaagttgcttatttgaccctctttcgaagcctaattatcaatatgaccctacttttttttagtttgcttatttgatcctactttttaaaaacgaatactccgtttgaccctgtttctttagcaccgttaagatttcatttaaaaaaataaaagaaataaatttattttccataatgaccaaaatgccctccaagcctatgcacatctaaccctatcctgtgtgcttgggcagcgacgcacggaggggtagcggcggcgggcctctgagggagggaatccgcgccggcgccggctcgcggagggaggacggcgacgccggctgcgggtggaggtagcgtctgtgggtgggccgcggcgatgcgttgaggaggaggggccgctgcgacggctcgacgaggagcggcggctcatggagggcggcggcgggcctccgagggagggaatccgcgctggcgccagctcgcggagggaggatggcgacaccagctgcgggtggaggtagcggcggtgggtgggccgcagcggcgcgtcgaggaggggccgctgccgtggctcgacgaggggcggcggcggcgggccacgaagggagggagggaggacggctgcgtcgaggcgtgaagggatttgccgtggtggcggttgcgggtggagggccgcggcggtgcgacgaagagcggcgtcggacaagggcctagaggacgacgactgtggcgttgctcctcctcgatctgaacaggacgagcggtggcgctgctcctccttgactagaacagggaggacggcggcgacgggcgattagcggtagtgcacaggggaagggaccgccggcggtggtggtgcggagaggagggagcaccgacggtggcagcgcaccatgtgacatgtttttctttttcggtggacacaaatttgcacgagaaactgggttaaattgacaagggtataattggaatttttgtcttgagttaacaccgtcacgttgccttcacggaatagggccaaacctcatcttcgtttaaaaaaaagaaggttaaatgagtaaagtcgaaaaaacagagttagtcttaaaattagggtaaaaaaacaattgtccctttattttaataaagcccagtttgatttggttacaaactaggacgaatatacgccaattttggcatgcataattctccattaacttcttctattccagtccattatcttctttgccaccattgatatatgcctaacaattctcaccgactacgctaatcaccgtgagcccatccccaaatctgggcccttgacgtacacgagattggccccgcggggcggcaaaaatgggcaaaaatcggtgaagaacttcgcttccactccggtctcccccgtctctccccgtttgtttcctgtatataacgcgctcctgctgcctcacacccccttggccgcgagctctgcacagcgagagagagagagagagagtagagagagaggagtgagagagccggtggcacccagctaacccactcggccgccaccaactgcggccatttccgacgacgccgacgccggggcgcgcccgtcggtgctcccaagtccgccttctctgcgggtgcgtgtgctgctgcatccagcatcctcctccccttcttcctcaccgtgtggcatctgcgtgcctcctgttcttgtgttgctcctgggctcttcttgatctggtttgcgtttgatgcgttgccggtgggagttgctcgatccgggcttggtgcttctgggttttttttttccgatggcgatgtggcgccaccatttgctcgattcggtgtccgggttctctctttttttgcgcggcagcagctagcagatttatttttctgttgccttgctcctagccagtggcgatgttggattttgcagctcccttctacttcgcatttttatcaattatttactcttttttttggtgtgtgtgtgtagttgttctcctgggctttgctctcactatgatgctgttcttctcgggaaaatttcagttctttgcctgctactctctctctctcttccttcgtcctctgtggccgcattggattgtttcttttgcctcggtgaactccatgctcacacgaatcctcccttgtttcttgctccgatttcagatgagaagctgctccaccgcggcggcgacagtgtggtcggccaccgcctgagaccggagagccatagctgacggctcgggggaagattcaggtgggctcgcagagaacgaaagagagtccccatgggttctttggagacgacgaacacgcggtaccggccggccggagcagcgtaagatctccctaccaccacgctgtcccgatctgaagaaaggctccacctttgcgtgcctctcttccactgttcttctctctctctctctctctctctctctctctctctctctctctctttagctggtttacatgctttgatgtatgtgctcgcttgctaacccggctactgtggtgcgttgctttgccatgtgctatcatgtgttgcatgtcgagttcgattgactcaaaaactaattacttctacttcttggtcgatgcgtggcgcccggcgccggccatatcgtcgtggtattcttgcaggaggtggtagtggtgatggtgtactggtttttagtacgctgtacaagatgccgttgttctccttttggtctccgttcatcatgctctcctccttaacttccctcatattgtaggtggtgtggtgggtggtagttgtgcagcttttatggcatccatccttccatttttttccatcctcccccttgttgatgctgctgctgattacagctaagagagaatcagagaacagcagaaacgtgctatctctgcatgttttactctctcttttctagtgtgctgctgctcctgatgcgagttggtttgatgctgatgtgtggagaaaatggatgtctgtttttgcggattttcctttatctccagacggaaagttggttttacttttgtggccatctgatcccctttttagcggctgcaatttggttaaattggatgtgctgtgatgtggagccaggcgtcggtggtcatgtgttttcactgccaatttgaccccaatgactgcaccttgcatcgccggtgccattaaaattgctacacacattagttccatgtgcagtcctcagtggtcaccagtctttaggcacgttgaagcgtaagctacagttgttttgtgcctgtgtggcccatcagcgccaaatgggcgagcttagcgtgtgtatagaatgctgggttttggctagttggatgcttcgatgcacgctagtctagtgggttcagtagtcaggggccggctccgttgttttgaatcaaacttcttgacaaagctttggtgttcacagctgggattacccatgagtgcagcttttcgtttcatgtttaacgttatttaaatcgctaagcgcacttttaaatttgagaccaataacatggggttaggtactggagtatctttgtgattagtgatgcttttctttcctaaaagatgtggtgtgactaataaaggaagaatggaggaaaatgaattggcaccacttctttttgctaatctttttctttaattctcagtgcggagaaccttgctattttgttctctttagccttttttctttgatagctaatcaactttactatgatcgcttttccatactaccgtatgagagattaagtactcctttgaaaagatgtgctatattttttttatagatttagtgttactagggctgtttgtccatataggccagccagatcaaatacacacaagactagtgcaaacttctaggaaaacaaaacatgatcaccaagaaaaatgttttctaagctatctttttgggattaactaatgggaacaatggggccttacaattgatatggaccttggctagcaatttttattacttccatgtgctttcgataaaacagtacaacaatgtaagctgttttttggggaaaatatatcatacttatttattcagtagttctttcatatacaatttcttcttcagacagaattcccccttgtgtcttcatacctggtgcaaattccaaagttttgtttcatcttgctgactatcctacattcaggggttgctttctgaattgttctttaccaattattatttgatgcccaaataattactgtaagaagtcgctgtctgactgtttcttctataccttctttcagggatgacacagctaagagaaggacccagaaaagcaaaagtttcaaagaggtcgaaaaatttgatgtctttgtcctagagaaaagctctggttgcaagttccggtccttacaacttctgctcttcgcgatcatgtctgctgcatttctgacactattgtacactccatctgtgtacgaccatcaaatgcagtctagttctcggtgagtagacctatcaaaaggaaacttattacaatattctgtcagcagtagaatatccagtggaaactagaacaccaattcctgctcgcatcacagtggttatgttggagttatatataataagaaattgcgcattaccctttttgaccatacctttcatatgctttacaggtttgtcagtgggtggatatgggacaagaccattcctgatccacgatatgtatcttcgcttggtgttcagtgggaggatgtatataaaaccgtcgaaaatctgaatgatggtgaacggaagctcaaagttggactattaaattttaacagcactgaaattggctcatggacacaattgctcccggatagtgatttttcgatcattaggctagagcatgccaaggaaagcatcacctggcagactctttaccctgaatggattgatgaggaggaagaaacagagataccatcgtgtccatcgcttccagatcctatttttccaagagggacacactttgatgttgttgctgtgaaacttccctgtacccgagctggtggatggtcaagagacgttgcacgtctgcatttgcaactatctgctgcaaaagtggcagtgactgcttcaagaggcaatcgtggtatccatgtgctgtttgtgacggattgcttccctattccaaatctcttctcttgcaagaaccttgtgaaacatgaaggcaatgcttggatgtacaagcctgacttgaaggcactaagggagaagctcagacttccagttggatcctgtgaacttgctgttccactcaaagcaaaaggtatgtcttactgccttcatttttaaatggcttcccatttcatgccacttaatccctatgatatataacaagagagccaaatatgaagtagttaaaatatcgatgttgctgtaagtaagcttttagaatctaccattgcatttctttttcgggaatgagcaagagtggttgctttatcgcagatgtatcagtaatgttttggtgattttgtccggaaatgttagaacatacttttgcaccttctagttttattttcctgcgtggcattgaaatttccactagataacatctttcatctcctttacagcacgactttactcggtagacagac

SEQ ID NO: 26850 - DNA, 9766 bp, Oryza sativa
tgagccttcagactgcacattccagttgttgatggaccacatcaatgagataacatcctacaatggtggtgaccaaggatacctgaatgagatattcacatggtggcatcgaattccgaagcacatgaacttcttaaaacatttctgggagggggatgaagaggaagtgaaagtgaagaagactcggttgtttggtgctgacccaccaatcctctatgtccttcactatttgggtctcaaaccatggctgtgcttccgggattacgactgtaactggaataacccgatactgcgggagtttgccagtgatgttgcacatgcccgttggtggaaggtacatgacaagatgccaaagaaacttcagcactattgtcttttgagatcaaggcaaaaggctgggttggagtgggatcggaggcaggctgagaaagcaaacttcaccgatggacattggcggaggaacataactgatcctaggctgaaaacttgctttgagaagttctgcttctgggagagcatgttatggcactggggtgaatccaagaactcaacgaaggaaaaccctgtgccggccacacctaccgcgagcctcacaagttcatgagatgtgtagatagccctataccagatacaaacttctaagctccatacatacatagcaacagcttgtaaaggtagctatgcttaggtttctcgacaaaactataccttgtgtttgctatcatggcttcggctccactctggctgctttgatagctcacaatttttttggttttttggccaataattcatcagtataggtaaattttctgttcatgaattgtttggtcagtctggggttggttgttgctcggctgcaatagcctagttcgatgtatggtggttgaactgtttcggtgataaaatctggagtgacgcaacatgagattgctgaccagcaaacactgcctcattttgacatgaaatacagtattgttttaaaattgagttggattaatacggtcacggctgacatccacagatggttggacgttggagcagctggggccattttgcactggaagtccctgaagcacacgaggttgtatgtatgctttgcttatatttggcatacttagttaaggcttaagagatgggaatctttgtttttctcatagcaattaattgcgggacttgcaatcaaacatgcattcaaaactcaagtgatgagccccattcgtggggcactgatgcacagctgcacaggcagagaggcagtgccaacctaacaatgcagcattgaaacgcactgctgctcactgcaggtgtggaacatgggcacaaccagatttctgaagagatctggtggcaatgccatgctgccaaagaagaacaacatcataatttcccagtatcaattatttagccatgcttccgttccttcgagatgcagcctttcgggggtagctcatgctgctgcccttttccaacggcaacgcaccgactaaagcagaagtgttaggctgtacaatttctagcagcgtcgttcgccaaagatactcctaatctctctttctagtagtacttcccttgtccttcaagatgggagtagttggaggattgcatcacaagtgattgactagtttacttctcaagaactagtagtggtataatgcatttatgcatctactggtactttactacatactggtactgttcatccacgagcttggcattgggggcagtacacagctaacggagtacatgagcaaattttgtgagagaagtaacttgcaaatgcagtgagccagaagctgaaacatgaggaaaatgtgaattgcgtgagcatccctagctaaatctacaggagtcgtagtaaacgaaacgggtcagctactaaggtttcatcaagctgttgtttatgaggttgctggacttgttacgacttagcacgaacataaacaaattcccagtgggctgcgagacatttcacgcgaatatcgtggaaatcctaccaacccagccgtccagagagagagagagagagagagagagagagagagagaggcgtacggggtaggagtacacacgtggtggtgttggagtccgggtgtcccttgtccgggcgagcacgagagtgtggcgcggccaccgagtgtagtatgtcatcttccgcggccctgcgccacaggcagcacccaccagcgttgtcaggcaaagcgagcggtcgtcgcgcatggtagggcatggaccgactccactccagtgcccactgccctaggcagggagggacccttcccgcgacacgcgtcctctcgtcgtacctggtgccaggccagacgccagctttcgtgctttgaccggctaaagaaaacgggagggcgaagggattaccctactacagtcttgtgcaagccgtcgccgtcgacgcggaggagggccggccggtcctcacgctgggacgtaccgcgtacgtgacggcgtgtgcggggatgccatctgccatgccggtggcagcggcagcggatcgggggcggctagtcagattggcatggggacttcgccgagttcggctgcgggggcttcgaatcggagaagttttcgctcagaaatagcggatcggggcagctcccggccggtgcacccggtggggttggcgtgctgctcggtagccggatggtcgatgggttggcacggatgccacgggccggacgtattggactattcggttggtttcttgctcgtgttttgcgtagtggatatggtggccctcgtaaaggttctcgtgttcgtgttcgagtagtggatatggtgggcctcgtgagggctcagtagtgggcatgtggtcatccggtacagaaggaaagaagcccacaaggagaacgtgtacaaaggatgaaccgaactcaaaggaaaaagttcaatcagagttcctaaaaaatatagatcggatattattcgtacaaccataaaaccagttaagaacgactccctctactattaatacaggttcaaatttacctccacatgtgatttggacaatggtttttgtcttatgtgccggcacactaacctagtctttatcctacgtggcacatctatctattatatatattattaaaggaatagaaaaatgagtctttacgtttgctctcatggtctagaaattttcacattaatcggagaaaaagaaaaaacagagttcatatagaaatacaatttagaaatagctgaaattcggaattaaaaaaaaggaatattagaataggagactagagtccatatagaaatacaattagaaaataactgaaattcgaaattaaaaataaggaatattagaagtaaagtataaagtccatatagaaatacaattagaaaataatagaaattcgaaattaaaaataagaaatattagaagtagagtatagagtctatatagaaatacaatttaagaaaaaaatagaaattcggaattaaaaaataaggaatattagaagtagagtacagagtctatatagaaatacaattaagaaaaaaatagaaattcggaattaaaataataaggaatattagaagaagagtatagagtgaatttaaaactaactaaaattcagaacaaacataataaaattaaaagtagtgtttagagtccgtataaaaatacaatttacaaataactaaaatttgagattaagaaaaatatgggaagaagagtttaaagtcaatataggaatgcaatttagaagtaactgaaattcgaaattaaaaattaaagaatactgaaagatgagtttagagtacacatagaaatacaattaaaaataataaaaatgcagaaataaaaaaataatattataataagagcatagagtctatatagaaatacaatttacagaaaattcggaattaaaaaaataaatattaaaagacgagtctagagcccatatacgaatatatatatatatataatttacaaataattaaaatttgatattaaaaataattaataactaacacgtatataaaatacaatatgaatattacccattagtagtttcgtaaagttattgcaaaatttaaaattatatcattttaatatatttgaataatatattgagaaaacatatatattattattatatgagagaaaatataatgatactagccgcgcaagctgcgcaggccaccatactagttttttttaaatagtggacccacatgtaagtccatgtctcatattcttcatcacgtctccctctctctctttcctcttccttctcttcactcttcctcccatcacacttccaacaaacagtagagacagagagcccgagaggggtggaggtggcgatgaaccggagccaggagggcaccggtgactattcccctcttcctttcgtcctctctcctaggattggggtgccatggtcgtcagaagcaggaagggcgtggaaggcggtggtggttccagcagctccctacgagttgattgacttattattttttaatcatttacatgtgggatatatatatatatatatatatatatatatatatatatatatatatatatatatatatatatatgttttaaatttctttgatgattgggctatcacatgaatgtcacattagtaaaaacgaccatcaacattgtcaaggagtttttttgcacgggtttagtggttgctaaataagatcggacctatattggggaccttttcaaaattctaatctgcttctatctaaaatgataagttgttaagttgggcttgaaggtcgaactcaagggtccaaagaaggcctctctgaacaagttgggctgggcccgtaaattctgtgtcgcatttgataatctcattcaaaaggcagtcaacaccctttgtccatgttccttactacaatcctacagtcgaatagatggtcgtttgccaggttcgaagtggattagcatcgacgatccacaaacatcttggcgcttctgtttacttgacattgactggtgcgtcacggcgcattcgttgtccagtgcacttccgaagtgggtaggcggaggcgcagagcacaactccgaagttggttggtcttggttcagtacttctgctcgttgggtcgtagggccggttgcgcacatctgcatatggggcggtgaagagggcggtggtcggtggacgctacggcggaaaaaaggttgctgcgagtgatggcctgatggaccaccactacgagtgaggcgagatgataatgttctggcgacgcctcagtcatgctaattgcggatagcgcacgcggcacgccgaacctatctgcttgtctgcatccgcactcggccgactcaaaattggaaatttcagctgtttcttttcatagatttagccttcacgttcacggtcggctagcactagatcatacatcctcattgatcaaggaaaaggctttggccaccctttcattaaacattatgcacggcacaatgcgtttgcacagttaaatggctatacgccgttggcagtttggcaccatctcattcgaggggatcacacaatggaccaccatttacttctttttatgctgctctaactaatgtattttgggtatccacttgtcaccctgtatgaagctggcgacgctgtacacgtcgacgtggtccctgggcacctggctgctccacccgatcctgctcccgctggcgccgtcgccgccggggccggcgctctcgtactcgccgtagtagagcgtcttgagcgcgaagtcgccgttccacgccatccacccgcgcggctgcacgatctcggagagcgtgcagccgacgtacaccgtgcgcgagtactccttccagggccggcccaggtagacgtggtgcacgtcgggcttctccctgtacagcgccatgtagtcgtcgctgccgttgacgacgcagccgcggagcacgatccccgtgggctgcgccgggtcggtgcgcccctgcgcggtgacggcgtcgttctcgcccttctccgggcggagctgcctcgggaggacgatgagggcggtgtcgcggaggacggtggccgagttgccgaagacgaagtcgacggtgccagagacgcggcaccgggtgtagaactgccgcatggcgtgcgcgtacagcgtgtcctggtggcccaggagctccaccgtgtccagcaccgtgcggtcgcccgtcgaccggaacgccaccgcctggtgcgcgtcgggcccggccgtgttggagatcgtcaggtcgcgcgccatgaagccgtccgcgagcacgcctggaaacagataagagattaagatcaccaaacacattacagccggattaggattactgtgagcacgagtacgatcacgtctcgtgacagatagtacatctcagggtaaagttaaaactgagagttgtgactagccgaacgaaccatgccaggtctagtcggcagtccacgcctagtttggctatctgtttggcagggaccaacaaaagggaaaggcacgaaaaggtacaatcttttactttgcctatgagtagagaggctcgtgatgctgggacgcattgtcgcttccggccacactaattggatggcctaagaacgaataaaaaagaacgaatgtttcattgcgcgataagccgattgattaatcatttgcaagggggaaaacacaacaagtatttatcacatcccactatcccagatggtttgtactctctttctcctccaaaggtctggagacagagcctaattctgaagaaaaagattgttttagttcagtgccaaatcttgcccttctaaattttgtagtctaaatagtactacctgtgtggtgtttggggttaaatgtaatacttgctacatcaatagaattctctatcaaaatattggtagggccaaaacttacctaaaatttagggctaccaggaaattggtgggccatgtacctaaagatttggaatcatctttgtagtgtatagaaatttcatatctgtccaattgtccaatgaattactctagcacttcaatggcaattagcagccattaactgcatgcggtactaccacaagtttttttttttataaaaaaaatatcaacaccaactaaacacagcataaccagggtttccaaaccgttggggccgggactaccgcgcctcggcggtaagcacggttaccacgcagtaaccgtgaaaaaacccgtacgaaaccatgcaaaatttatcaaaaatttaaattattttttaaatttatttgaatttaaggaggttaccgcggtttttctattaccgtaccctgcggtaaccgcgtggttaccgacggtaatgtaaaccctgaacataaccagacatgcacacaaatatatttgtacatcaaaatttgaactaacgtaggtagagtcatatatacacgactcaccatcacacaaatggcgttcccctactaaacagatgtcctaaaagcgtgaagtcaaaccttgaaaccttacatgcttaattaattaaaaaatatttagatttcacacaaaaccatattgatagattttcatgaaaaacactgcaagaaacttatattttaatatatggtattttttttacaaatatacatagttagataaatagcgataaaaaatgcatcagggattgcgttgatctccatgtaagactagggtagggtagtgtctgactaattatcatggacagtggaaaagagatattgggggtacaattttcacattctcatggttaaataacttcctaatatagacgtagtcaagtagggttcacatcatctattataatgacattcttgttacagacattgacacgtagaacgatagaagggtgagatccatatatcaggccatccacaatgggtgtccctgggtcgtctccctaggaacggccgtctgccctccgttagcttttcagtcggaccttctccactgccaggcgcgcggctcctcgctaggggtcgcattccttagcaacttttagctgagacaccgagccgggagacgcattgcagagggcgtggctaggtgagtgtcccatggacaccgctaccaccccacattttaccgttccacccctcgccctcgtcgttgggagtaggtgacgaccggcgacgaccccgcgaaggcgacgggcggaggaaaaggggtggcggcgcggcacacggcctccggccgaccccgtgacgcgcgagagagagagagagagagagagagagagaaatggatccgacggcgcagcacgcgacctccggcggcgacgagggatccacgcgccactcgccaccaccggcgccgtgcctgccaccgccggcgcctcccaaatctggccgcggggggcccagatccgcccactacggcgccggatctggcgcccccaaccggcgacggcgcgaggcggaggatgccggggaagacaacgacgagcggcgacgggagagagggagagagaggggcggcggtggatgccggcgacaggagaggcggccctcctcatcgtcctcgtggccgccagcgaagggagaggggagcggcggcggcggcgaaaaaagaggagggggcggtggcgacactggcgagagagagagggcggcgaaaaaaagagggggcgggagagagattaggggtagggtagtaaaaataaacatgggactttgtgggctgggatacccattgtgggttggagtgtctctattaagtttcttcagattttgaggagcacatccaggggtgtcctctattgcaagctaagtttccttatgagtgtttttagttagtgaagatactctatgagtgtctcacaagctaagtttccttatgagtgtctttagttagtgaagatactctatgagtgtctcacatctaggagtgtctcacatcgtggatgctctcaataactgtaatggtagtatgtcagaggatcctcacgcatgccgaacgcaatgttcacaaaagccaacaattaatggccgacgtcacaaattcacagaaaggcattttaggtgcagacaaagtgctaaattggctggtcacgagcagcagctaatgacaccgcattgattcatgcacgtaccacgtgtaccaccgtagagaaaaaacgtacgctgtgccagctaccgtatacgtacaaagacaagatagcgttgaaagaaggggaaaaaattacgggtatacgcacctacggtggccgtgttgaacgtggagacgcccggcgtgtcggcgttgaggtcgccggtgatgaccgtcttccccatgccgtccccgacgaccaccacgttcgtcttctccaacggcacgttcaccgtctccttgtacaccccctccttcacgtgcaccacgaacatctcgtcgccgtagtccggcgccgccgccaccgcctcccccaccgtcttgtagtggcaccccgcgccgcacaccgtcacgttgggggggagccccttgggcacgccgagcgcgtcctcgtcggcggcggaccccgccgccgcgggcggccagtagccgtcgcgctcggtctgcggcggggcccaccggaaggtgtcgtcgccgtagcgctgcagcgcggcgagcatggagatgtagttgctgttgacggcgatggtgtcgtcgaggtaggccatggcgtcggagatggtgcgggagaagttgacgtacttgtaggcggaccagcagtcgtagaggtggaggagcgcggtggaggcggagaggagcgacggcgacgacgtcgagggcggcggcgagaggcggtgggtggagaaggagaggaacgtgaggcagttggtggcggcgtt

SEQ ID NO: 26851 - DNA, 1616 bp, Oryza sativa
ggtattaggcgggggcagctgaggcttggttgggcaaatgggcaagggaggaaagaaatgaagaggatggattttgatgggtgcagcagtaatggaaagtactccccattgcagataaggcattgatgtgtgtaaatttgctggtaacagttgaaattctgctgttggttttgctaaccatttatgttgttggattgtgtgttccatttctaagcattgcacccccaagatggaacggaatcagatctcacctgcggaagttccgctagtgcaagaccggtgatacaatgtctctccgcaaaccacagtcttcgtttttactggcagaaagtaatataatgcagataatttcattccactgcattcccttccccacgaaacactgtcatgatcatcgcacgatttggagtttgatagcattcctcacctctacatgctctgccctggtttgcctcgtgaagccgacatgatagacatcttttgaagctacgctaaggatacttgaaattgcccaaccgtgcacggcagacacttccctcttgggttgcatccccgtccgggtgaatctaaagagttcgtttagccatgccatctgccggtcccagcgaacacgaagccatcagtccatcacgatgccgggcaaacatgcacagtttttgtacatcagcatacgttaatcatggaaaactaaacaacctgttgtcagtttgtcacatattcacaatgtagccatgtgacattgtcgttctgtgattttgtcaccacagctcgctccccacaggatgatgtcgcggccgtcgaatagagatgggtggttttttcacatcctcttccacgtagcctactggttccctggacatgatcacgggaatcacagtgcacacaggtgacaggtcggcatctggcggatcagtgtccacttagactgtagagtgtacagtactcgccagttaggcacagccgcatagatgcaaatccggaaatgctgcgatatccttcacaatagatttagcatgaattcaataccactgcagcacaaaaataaatagagcaaacagattatcttatggaaaactgttgattgcattctatgtacgactagcacaaaagaaaaaaatagaccaaacagatttcatgcatgagaaatgactttccaaaacttgcaaatgaattggtgtttacatacaggttgccgattgtgatgttctgtctaaaacgcaaaatagacaatgatacaaaatctgtaaccccggaggcgtgtataaggagcacttgaggaaaaggaaaaaccaagatgaagacatgctgctgtagtgctgtctaagaaaaaaaaatcatggtccgctacttgatagcagacgaagcagaagcagcagaaaaacaaaaaagaaaaagaaaaagaaaaacaaagtataatgtcagcagtcagtcagccagccaaatttcgccaacctgcaaaattgcacgtgaggaaagatcagatcaatatatcaccatttatctccatcaattcaaagacagcagcgcatgcagtggaaatcatcgtcaacagattgaattctgcatatactagctaaatgcccatgcgttgcaacgaaattaaaaataaattatgt

SEQ ID NO: 26852 - DNA, 6384 bp, Oryza sativa
  unsure (1)..(6384): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctgcaatcccacaggaaacacctcatgacggagcagtcaccagtcagctggaatactaaattaagcctccaaagccgcgtcaaacagacgaggaaacaccgtttcgtcagttaagttcaggccccaacagaaacaccgagagaaacacgcggcccaaacggccggcatccccctcaaccgctcgtccgcgcccatcaaccgccaaagacttcccgcgcgcgtctacatatttcttcctctccctccgtctcctcctactctcaaaggcctcgttcgtttaatccctctcacggagagaattgaaggggatttggaggggatttatttcacacctatcgtggtgtgaaattattcctcttcaatcccctccaatccctctgtattgggattaatcgaacaagccctaattcgtgagaagctctgatcgatggcgccgagcaagctccgggcggcgctgggcgcggtcaaggacaggacgagcgtcgggctcgcaagggtgggcggcgccgacgaggtggccgcggacctcgccgtggccatcgtcaaggcgacggcgcacggggagagcgtgcctggcgacgagcgccacgtccaggagatcctcacgctgacgtgctactcccgtgcgcgggtggccgcctgcgtgtccgccgtgtcgcggcggctcgggcggacgcgggcgtgggccgtggcggtcaaggcgctggcgctggtgcaccgcctgctcgccgacggcgacccggcgtacgagcaggaggtgttcctcgccacgcggcgcgggaggcgcatgctcgacgtgtcgcaccggttcccgcaccgatcgtcgcgctcccgcgcgacgtgggacttccacgggttcgtgcgcgcctacgccgcttacctcgacgacaggctcaagcaccggatgaagggccgcgtggccagccagggcaaatggtgctccgacggtcgccgcgacggcttccccgacatcaccgacgggagttacgaggtgggcgaagcggtagccgaggtctgggcgctggtgccgagggacacgccggcgacggggacgacgacgaccgaggagctcgtctccaaggcgcagcatctgaagcacatactccagcggttcatcgggtgccgcccgacggggaaggcgaggacgaacaaggtggtggcggcggcgctgcacaggctggtgaaggagagcgcggtgatgtaccgcgagctcaccgaggtgatggccatgctcgccgaccgcttcgccgagctggagaccccctgctgcgtgcgcgtacactccatcttcaccagcatcgccaagctgttcgacgagctcgacgagttctactcgtggtgcagatccgccacgatctgccgcccgtccgaaatccccgaggtcgagcgcgtcgcgcagaagaagctggacctcatggacgagttcatccgcgatagacaaccggcgtcgtctcggtggtggaggtgcacgccgccggcgccgtccagcccgcttgcccccattgccagcaatggcgacaatagcagcaaggcatcgccagctgagccggcgccggcaggcgcactcgtcgtggtcgacgaccacatggccgacttcctgaaccttggggaagaatcgacgccattgtcgacggaggagcaagaccgggatctgacactgtccctgttcggcgatgacccagcgacgccggcgccgaagtgggagacgtttgacgacgaccaatgcgatgactgggagacggcgcttgtgcagtcggcgagcaagttcgccgccacccagagcgcgacggtgcttgcactgccaccgccacctggggccaccggcggcgaggtcgcggacccgttcgcggcgtcgctggccgtgcctccgccgacgtacgttcagatgatggacatgcaggcgaggcagcggcttcttgcgaacgagcagatgatgtggcagcagttcgagacgcaacaaatggcggcctggagttacagttcattgttgtaagatcgtaaaaaacgaaattaatgttttagagcgatgagaaatttcaatgctaactatgatacacgctaaatgaagctgattttgcaccataattttgtgcccgagttggaaccaaatcaagtgatgcactcgtttggttgagccgaagcgtgcctaagttcaattttgtggcgaaattgactgttttatgctatagctgttgtccttatccagatttaattagtacctatgttttaaaatgttgctaattagtactccctccttatcaaaataaatcaatctcctaatacgaggtggtttatttaaagagagtgtgtaagataagatatttaacaggattatgaatctagacatgagttacgtcctatcaatttggacataagatactattagattcataattctttcccgtttagattcatacataagccaacgtctcgcttattttgcggaataaatgaaacggtatatttgcaaacgaaaaataattttcgaataaattttttatatacgtgttcttagcgatctaaaaaaactgaaaaataattcgatgaaaaagcctaaaaaattagctccaaatttaaggttgaaaattaaaattttggctaataaggataaggataagaaaaagatgaagcctatagttttataaaatatctaatcttctactggctaatattgggatggaaataaatgttcataatgtttccatcaaaattcaccccaccttttttaacaaaaaaaaaactcacctaccactgacagaggggcacagggctaatggataattacggggatgcatcccgaaatccagcgtgaaacctcccaaaaaagtagccacgaaaaatcaacccagataaaacacagcagccgcacatcaccctgacatctctcaatcggacggtggataccacctcaccgcacaggctccccgtgcgctcatccgcaccaaaaaaactttttcctcccgctccccgcaacccagccccttcgacttcccgccctcgcaccatttccgtgaaccagttccaccgaaaaccagaaccaagctcaccgtatggggcccaccggtcggtttcctcacgcgtcaaacaccggttccacgtgaggaagctgagctcgtggaccttcccgcctctcccacccaccgcgagctattaaaccccgtctcccccatcacacactctccccacgcctttgtcccccgaaaccttcacaagttcacatactcgcggcctctcctctctccgtactcgcgaagccacgctccgggccgttgtcttctgtgtcgcttcgaattcgggaagaccctagtcactgcgcggccgccgagtcgggatgccgccggcgagaggcgggaggcgtgggagggggcgaggtaggcgaggtggacgcggaggcgccgcctctagggcgcgaggcgagaacgtcgtagacgtcgagccgatcaagctcggtgatggtgagtaggctggatctgggttctggacgcgatcggttttgggggattttgttcgggctagtgatcgatctgggggttttgggggtttttgttactgtgcgtttggttggttcgagagtttgtaaaatcaaaccgttggggattcggattttattaggggatttctggtggattttttttgggttcaggattgtaaggaagtagcattgctgtttttacgtcctccgatcggttcttgatgaggctgggaacggtttcccccctccatttgtgtgctcttcgcgtatttggaggagagcgctatattctgtggcggaagtatgaaatacatttttgatcaaggcgttcgaaactccgtaacattctgatccccacatatttggcagatgatgcgaaggtagatccacagacgaagtcacctaacgaagaaataacaagcgcggaggtttgcgaggtggagacctctgaggctagcccgcttggtgccccggaggaaggtgagattgaaagttcaaacttctcggacggcacggggttggtaatttgttatacccttatcgtttcggcttaatcccggtttcgatttatgcagatgaggggaagccaggttccactaggaacctgaagcgtcttcggaagacgatcacgatcgattccgcagccgctgaggagcatggggcagagagtgacgatgaaggtgagtgacggagtttgcttagctgacaatttctcggaattacgggtgccgcttgtcctgttaatgtgtagtacggttgtttgcattgtgttcaccttggttgtgctcagttttgatttgttttggcaaaatgaacactatataaaactccagatgttggtatttgcaatattagtctagaatgttgtatagctagtcattattattgtttgttttgacctgttgatttagagtttgatgttcttgccacagcaagttgccaagagttggctccatgcagaaggtccaagcgcctaaggtgcaaaccaactaggaagaggtccaaaccaactgggaagagggatttgggtggcaaggagagtgaagatgatgtatttgcaaatagctcgagcagttcccaggatggtaacagtgttatttacaatatattctgtcttgctgatcctaataaatttgtttggttgaagatttattccagattgatattttacagacgccgggaagttagcttctagaagatcaaagcgtctcagggagaggcttacatctgattattttgatggtgatgtgggtgaagacagacaccctgggaagtagctctgatgattatggtatgttacaattctcaactattgcatgatttctgatatgctgccagtctgctactacaaatgtaaaatttgcattatgtagatgaaaattgttcggctccccgccgaggatcaaaacgccttcggaacagactgggccccagaaatatttcatatgctgatgatgatagcgacaccgatgatagtaagtgggcaccctttgttatggcttgacataattgacccttttgtttgcagatcatgtgattttgtaattaacttcaatccagtttatttgggaaattggataacttgtagtttctcttctgctagaaagtcttaattgacataattaaaaaatactttgaaatattgtttaaccaaggatgcatttaaaacaatgtgaatagagtttttttacggaatggaagaaactatctattttcctcaatgcattctttttcaatatatatcttcattgatttgtgcactatgtgaaacttgcacctttcctatttacacgagcagaaagattaggacctaacagttgaatttattcccttctgtatagctaatatacaaataacataaccttgtttaagcatgttacattaactactgaaattaccacagatcgcaagaagattgtcccatgcaggagaacgtcaaagcgcctacaggagaagcggaaagctcatgatgtttcagaggtaagttaactaacaaaagaactcgacctactgttcttcatgaagtaataaatatctcatcgaaccttttcaggagagttacactgaagcttcgtcttgcatgttgtcgacttcttcttcatcaggtaataactaatcattttatgatcgataaatgtatcacctactttataatttaatatgattttgtggtcaagagattattgcaatcttgcattgtgcacaattaattaatatcaccgtacaaatatgtaaaatacctaggaaatattttgttttttactcctacctgttatacatggaagtgcgaagcatcaatgatccagagtcacatctaaacacattcaatattgttgatcacctttattcaatgcatttgttgttgcttgcatctataatatcgcatgaattgacaaccattccttctgtgcttcttaatgatttgtgtggaacctcagaatgcttgtcgtaaagttgatattacgtcgtgcatgtttcgctaatgacttgtgtctttcagatgatgaattattgcacaattctataaaacctggcagacgtaattcgggtggacctagttgttcgatctgtaaggtttgtcagcagttctgatttattaattttctacccccccccaatctttacatgaaatcctaactgattttttttg

SEQ ID NO: 26853 - DNA, 1090 bp, Oryza sativa
ctgatgtctcatcgaaattatggcactgtcgtttaggccatatttcgagggggagaattgagagactagttaagagtgtaattcttcctccattggagttctcagatttacaacaatacatactcaacagcgttccaagcaaatcggtgcccaaaacaccgtatgagctatggataggaagagtaccctcactagctcacctccgagtgtgggggagtcctgcagaggctaaagtatttaacccaaaccttgggaaattagatcccaagacaataagttgccatttttttggctatcctaaaagatcaaagggttatgatttctactgtccaaacatttatacaaagtttgtagaaacgagacacgctgtcttcttggaagacgaaatgattagggggagctcggttgttcgagaaattgatcttgaggagagggggtgtctgtacctgctccgtcgattcaagagcctttcttctctctacttgctgatgttgtgcctgcaatgcatgacgttgcggtaccaacacctgttgttacctctcctgtggcaacaatgaatgaaagtgaggaacctgttctacaggattcaaccgaaattattgccacaccagaggaggagctgcaacagcctcaaacagataatgtgccggaacagcaggcccctagaaggtctgaaagagttagaagatcggctattcgtgatgactatcaagtttatagtatagaagagtcgcatatggaggctgatcccacctcatatgaagaggccatgagaagcgctcgctcatctgaatggttggaagcaatgtaagatgaaatgaaataatgaaactaaacgatgtttgggatttgaaagaaattcctaaaggagccaaaacagtaggttgtaaatgagtctacaaaaccaaatatgactccagagggaatataaaaaatttgaaggcgcgacttgtggcaaaaggcttcacgcaacgagaaaggattgattacaatgagacattttctctagtctattgtaaagattccttcaggataataatggcactggtggcacattatgatttggaattacatcagatggatgtaaaaa

SEQ ID NO: 26854 - DNA, 406 bp, Oryza sativa
gacagaaccgctgaatgtatgagcgaagtgactcatcatccctttgctggactgcatgtaagtccgcttcttcacctgggcgcggatatgtgccttgaaagttcatggtgaactgttggcacaaatcctcccaagagtggacggacgcgggtggcaagttcattagccaaccccgtgcctgttccttcagggccatgggaaagaaattcgccatgaccctgtcgtcacccccggcggcctcgatcccggtcgtgtagacctggagaaactcggcggggttgacgctcccgtcatatttttcggcgatggtgggctggaaccttgggggccaacggatgttccgaaggctcgccacaaaggctctacagctgacaccaccaaccgggggcacggacggctgatcccc

SEQ ID NO: 26855 - DNA, 2138 bp, Oryza sativa
tgggaattgtcagtagaggtttcgttgcagccttagaagcgaagcccactctaattgatcaaattagagaagcccaaattaatgatcctgatattcaagaaatcaaaaagaatatgagaagaggaagagctatcggtttcttggaggatgagcaaggaacagtatggttgggcgagagaatctgtgttcctgacaacaaagatttaaaagatgcaattctgaaagaagctcatgatactttatattccattcaccctggtagtaccaaaatgtaccaggatctcaaggaaagattttggtgggcaagtatgaagcgtgaaatcgcagagtacgtagcagtatgtgatgtttgtcagcgagtcaaggcagaacatcagaaacctgccggtttgttgcagcctttgaagattcctgaatggaaatgggaggaaatcggtatggatttcatcactggtctacccagaacgtcatcaggccatgactctatttgggtgatagtcgacagacttaccaaagtggctcatttcatcccagtaaagacaacctattccggaagtcggttggcggaattgtatatggcaaggattgtgtgtttgcatggcgtccctaagaaaatagtgtctaatcgaggcagtcagtttacctcaaatttttggaagaagcttcaggaagagatgggttctaagctgaactttagtactgcttatcatccgcagacagacggacaaaccgaaagggtgaatcagattttggaagacatgttgagagcttgtgctttagacttcggtggaagttgggataagaatctaccttatgcggaattctcgtacaacaacagttatcaagctagtcttcagatggctccgtacgaagcactgtatggtcgaaagtgccgcactccacttttgtgggatcaaacgggagaacgtcaggttttcgggacggatatcctgagggaagcagaagaaaaggtgaaaatcattcaagaaagattgcgtgtggcccagtctcgtcataagagttatgccgacaatcgccgcagagatttgagtttcgacgaaagagattatgtgtatcttcgtgtcacgcctcttcgaggagttcatcgttttcacaccaaaggaaaattggcaccgcgttttgtgggaccttataagattgtcagtagaagaggagaggttgcttattagttggagttacctcaatctttggcaggagtccataatgtgttccatgtgtcgcaattgaagaagtgtttaagggtacctaccgaagaagctaatcttgaacagatagaagtccaagaggatctgacctatgttgagaaaccaatccgtatcttggaaatagatgagagaagaaccaaaaatcgagttatccgtttttgtaaagtccaatggagtaatcactcggaagaagaatcaacttgggaacgagaagatgaattgaagtcagctcatccgcatctgttcaccagttcttccgaatctcgaggacgagattctgtttaaggggggtaggttgtcacaccctaaaaatcctaaatgtataaattgttgtttaattggaatttttagaaatgattttaaaagtctaggagagaagatctaattttaattaataaattccaatataaaatggggccagataaaatttcattaaatactttgctttattctataattcctagatttttatgggatttatttgagctaaggaagtatttttaataaatggaattgcatttaatgaataatttaaattgaaaaatgtttttaaaagtctcttttggctttgggccgaaagttggcccaaaaccttctctctctctcttcccggcccaagtcggcccagtctagtccgcagccgcgcgcgcgcgctcgctgtcgctgacaggtgggtcccacctgtcagtcttcgtcttcctcgcgccgccgccgccgcccgaaaccctagcgtgcgccgccgccgtctctttccaaattcggccgcgtctttccttctccggtgaaatcaatagaggggaaatgtttcccgagatctcctctaccttttctcttttggaatcatcggctaaaatcgcttggaaagtgtctgattcgaggtcgattcggatcggtctctctctctccgagccc

SEQ ID NO: 26856 - DNA, 1537 bp, Oryza sativa
gcacgggcccggcagctagcgctggagccagtcgctgatccgaaggaagtagacgatgaagctcgggtggagcagcattgacatgagcgacgcctgctggtggtggttcccggagccgacgaggaggaggcgggacgccggcgtgagcgcgtagacggcggccggcagctcgtcggccgccgcgccgtctaccggctccgtcgtctcgactgcgaagacgccggtgagggtgagcacgcgcatcaggcggcgcaggcacgggatcttggacgggtgcagcgacgtgaccctggtgactatctgggacagggtggcggcgccgccgtggtggtggatggcgtcggcgatgccgaggtccatggcggccttgagggccacggatttgatgacggccaaggtgttcacgtagagctagagctcagcatcgagcaagccagccccgtgctcgttgctttgagtggacgccatgacactgcctctagctatcttctactttggatttgaatatgatcatggacagaggggacacatcatatatataagtagagggctcgaagaatcaccgcatttcgttatggaaccagaaattgctgggaataaagagttcatatgcagtattgtaattcgatagtttttttttgttgaataactttcgaatttataatcgattttgctatatctcactcgaaagattttttcttatctctcactcgattttctcactcaaatttacagtgcattttcttgtaagttacagtgtaatttatgaaacttatactgtaacttttgttacactataatttttgaatcttcgcatgtaaattttaaattttgtattggatttggtctttttcttgaggatatggtaatttagtgtccattatggtgtttcttaattgcttttttctttttattatatctatcggattttaatctaaagattaaaaatctgtgtgatacgataataaaaatctttcgaaagatgtataggtactcccatttataattgtagtagatatcatagtgttatttaattttaaccatgtatatattatctatctattatattaaaagtccattaaatttactacaaacgttcctaggctatcatgtggcatcctataaatactctcaaatcgtcatgtgtcactataacaaaatagtaaaaatctgacaagacaattgattctcatttaaattggtggatcctttaattttggacgttagatttacttcacaaggaaagaaaatctccgtccggacatcagccttggtgcgcaacgatccctccaactaccgttcctctctttttttaatccccataaaaattaaaattaaatacttttttatgggcctaaaaagcccatcaacttactatatctagccaacttttcatatattatctcctaataaatagttcattcaatatcatataaatatttctaaacaaatgtccagattcgttttttatctcttaagatcatcttattttcttcatcctttttcagtttttgttgtactgttgaaagtacatgca

SEQ ID NO: 26857 - DNA, 350 bp, Oryza sativa
aacccagaagaggagtccctggaagatgaaggctttggtgtctagctcgtgcctgccgtcaagcgcctgtggtcgtcgccctagtcttccgctgtttctcgtttgtctttgtgtgtgctgggccttcgctgcccatgtaataaattatctatttacgcttccgcttgttaaactctgaactgtatcaacttttggtgtaccttgcctcctgggacaaggaataatgcacgcacgtaaggaacgcccgttgggttatttccggtcgtgacagagaacttgactaataatttatatattacttgtgataatcatattctaagcaggggttaacataatccaagggtagagtg

SEQ ID NO: 26858 - DNA, 2548 bp, Oryza sativa
aaagcctaaaagtcccccttcccttccatgggacggtccggcccatctccctctccccccacctctctctctctcctctcccccgcggctcattcggcctccctccccgcgcgcgcgccgctgacgggcgggcccacccgccaccctcgctgacgtgtggggcccatccgtcatccccgtcctcccaccgctcccgccgccccgcccgcgccaagcgccgccgctgccgcctaatccgccgcatcccgccgtccccgcgtgcaacaaagtggggggaaatactccccgtgatcccctctccctttccccccatttttcccactctctctcgcgttcaaatgggcggatttgcccctgcaaatctcgccggcgccattgatggcggccggacctcccgcgccagtttcctgcccctccggccgctctctcccccttccaaccctatttaaaccctccccgcacttccttcgcatgtttctaccctttgtcgcgccttctcatcgctggaatcgagctcacgccgtcactctctctctccaccgtcgccgccgagctccggtccgccgccgtcatcgccccggaccgcctcccacctcggcgccgcctacttcggcttcaccacatcctcgccgacctcgtccacctctccgtttcggtcgccgaccgccggagtgccgccgaccccactgacccgagccacgccgccgcctccctccgcttcggccgcctcctccgtcgccgccgtcgaacaggggtgagccgtggaccgtcgcctcatttccccttttcctcccctctctcggccgctgctccgccgtgcctatggccgccgccggcgaccatagtggcgcgggcgtgccgcctcccgcctttgcgccggcgtggccgccttcgggcgcaccgagcggctgccgcgtggggcccggccgtcagccgcccgcgccctcgggtgcggctgacgcgtgggacccacggcgccggccggtgcgagcccgggtgcgcccagtccaccgtggaccgtgaggctgccgcatgggaaccacccccatggacccggtccgcgcgccccctcccctcggctgacgcaataaaccctttttaaattaaaacttaaatgaagaaattcgcaaatatttattttaagagtatataaacttcaaatggccataacttggccatttgaactcggaattggactgttcaagtctgtaatttttccttaagaagtcaagaacccatttttgtgctttgttcctgcttgttatatggagtttattagagtaaaagcccttttatttccgttggtcgtgtagagaggcagcttcgcaagatcctctattcatgaaggttgcccccgatgtttgggaaagcgagcaaggcaagtcacatcatccttgaacatattgaatcccacttataaaattattttgatttaaattattgcattatcgctttatttaaattcccgcgttatcactgttttatctagccatgcctatttacctttgttatgaccttattattgttattggtattatttccttgttcaccctataataaacaaaaccccaacaagtggacactctactcttggtaccactggtatgaatttaggtagatgcttcgctggttaattaggcaacattaggtggttttacatctctagactttgggaattttctcatcacctggacactatggaatggtttgattattgtggaattggattcacccctccccctctattcaaaattcccacaatggttttaggctgggctcggggtgcatggttttgatagtagcacctcggtcatataaggaccggtcttcgggcctctgttgcaaagtactaccatacttccacatgtctagtgggtaaggcttagtttgtggctcagtctggttataaacaaaagtacacggatggagatggacaaagtcgggggtcgatggacatctctagggcaaatgaaggctacacgagctgcggcccggtagtcgagatgtgatggcacagggccggtgtcctgctgctaggggctcagtcctgcctacctgtcccggggtgtcacgcccggaatttctatccaaaattccaaacgcttacatgtgtgtgaaccctcgtacaggaatcagccgaggcacacaataacaaattgataatatagtacaattattactctaattaataagcgaataaaatgtcattatagaggtagatagttcctctcaatcaataaagatctaagcagcggaaaataagataaacggcgcagacgactccactccacaggcagcttgaccaggcctacacctaatcctccacaccatcagcttcactgtagaactcttcctctgatgaatgattgcaacgtgagtatatgacatactcagcaagccacgcagcaaatatgcaagcgcacaagataacaaaggatggcatagtagggtttcatttgcataaacaacatttaataaacatttcagaatttaataaaacagttaagtattaattaaacagtattaatccaacgctacacaacatacc

SEQ ID NO: 26859 - DNA, 598 bp, Oryza sativa
gtcaaccatggaagcagagctgacggcactggatactgctactgttgaggtagaatggctgcatgttctattaatggatctgcctattgttgaaaaaccggtgccggctatccttataaactgtgacaatcaaacggtaattgttaaagtgaatagttctaaggataatatgaaatctatcaggaaattaagaaactccggagttataacgttggattacatccaaacagctagaaacctggcaaatcccttcacgaagggactataacgaaatgtgataaacaatgtatcgaaggagatgggtttgagacccatgtgagttatactatggtggtaacccagtctatgtgatcggagatcccgtgaattagaatctgggaagaacaaaccattagtaaactagaggagagtaccaatctataccctctctaagtgaagatgcatgtactctcgtgagctgtaaggcagttggctatgccttaatgtgttctgttggctttaattagcgaagatgttgtcctgcagagcattcttgaaagaactcacctttgtgagcttgactgttggtcgcagtctatggagattttgggtgaatctt

SEQ ID NO: 26860 - DNA, 3945 bp, Oryza sativa
tgagagaaaaaaaaatcattttaagtttaaaatatgttttgcgtgcatgctcagacttaccatgcacctgctgctggtttgaattgaggcgtctgattttttttcttccgtttaggacggctgatggtacggaactttatacctcagtttccaaacctatacaatttccgaaacttccacagccgcaaccaaccgcatcggagtcgatctccggcgcttgctcctgctttggcctatcgcacgtgggccgacgtggtgctgctcctgcggctcgccctccagccagctgccaccgaagcccaccgagctttcacacatgcatggcacaacacacgtgcatgctgtactacatcctactgctcctgttgatcgatcccatcgaccaagcagcatacgcatgcatgctacagtacctcgccgtactgtagcaccacatactcctctctagtatcttccaatttccttcggcaacaacgacacttctacacacacattgtgaaacccgttacgaagatctttttcacacggtgtccatctatcatgtgacatctcgtatccaagttcgtcacccggtatccttgaccgtcaagaccttaactcctccctgagtctagtcccgatccccatcgttgggcgaagttaacctctaagaatcctgactctagtcaccttctcacatggtatcctaaccacactagatctcttctcccttagtatagtcccggtcctcaccattgaccaaggctgaccttaagtcacctgcacacaattagacaaaacaactatttctggacacagagatcacaacctgacccacattagtcacacgcactcacaccaacattcacacatactctcaaactaattctttaattaaatcatttgcaaagccaattattctcccaaatattaatcatgacaatgattttacagttatcaagtggacttattcttttatagcacaggctgaatctgagtggtgggagtatcacggctaaacgtacgttttatttgttttctcaaatttgttttgaatttctatttaaatttgtaagtacaaaacttatatgtacaaagtttctctgcgcatatatacaaaattgtctatgtataaattattctatatgtaaacttttctttcgctgacacgccgctcaattcatttcaattctatatctgcaaaatttatataagcgtaaaaagtttctatgcccaattatcagtgcagagaatgtgtatatatggataaacctttttaggctcaagagttttatagttttgtaactgagtgtggctgagacccgcacggtcgagcatgctttagactaaccttatataatgagcttgtaataccccgagcaaattacatccacggcgcatcaacttggcagatgggcgcaatttagtacaataacttaaaaaatgagcgttctagtgcaacaacttgacacataggtgtattttagtataagaactttataaattatcatataaatgcaacaacttgcatgataagtacgattttgatacaacaaattaaaaagttacataacaacttaattatttggagcgtttttttatataaatttaatttttaagtacttatttttagtatatttatatttttaccctaataattaatactgaaagtcaattaaactagatttagaaattattatatttcggttgatatatgagaaggtgaagaaaaaaaattcttaaaggtaattggatgtaaatttcactactatgtgcataattcttaaagattaagttcaatattataaggtaatatctgtatgattactttgtaataggatattgacatcgtgagaaaaaactcgtctagcatatgcttagccaagttgataccaaggtactagaacgcacctacttgttaatttgttgcactcgaatgttcaattctcaagttcttgcactatatcgcacccacctgcaaagttgttgtaccatgggtgtaatttactcaaaattcaacttttgaaccgttctttgaatagacgatcagaatctgtggatgtgtagagctcgtcgagttaggaaaaaatagactataagttgatcggagtccggaggaatttatgttgattgaattaatgtgggccgttgatcttcattaggctctctctatttaacaaacagaggaaaaaaaaaagggcaggggataggggattgctagcagctacccgtagcctttgtcgtcctcatcctcgcgtctgttttgaataagacgaacggtcaaatatgtgctaaaaagtcaacgctgttacacaagtgaccatgtgactcctcctccccccacccctctgaacttagggcatgcagatgactgctgttttgcaccatcttttttatgtagtatttgctacgtctttcgttaatggcaggtggatataggccctgatatcagtgagatgtccaaggtaaatagggatcccgagaaattacaaatgacaaataagaaagtggcacgtatacataaagtagttcgactcacacataattatttggttgcgtcacaatttcagaacacaactgagcttgcacacgcttattccaagcctcagcagcaacaaattaacagacatgctccacacactacaacagaaacatcatataacacttttgtagaggcgctttggaaattgcctcttagatcatcagttttatagtgtatagacactttacagaggcactataaaaattgcctagaaaatttttactctagatatactttagaaatattttcagtatattttattagattttatcttgtagagatattctttcggcagtttaaattgtgcctgatatgtaaaggcattttcttgagacactttaaactttgtaaagacacttcttagaataaaaatatgtactaaatgactaatataagtaactcaaggcaaaaacatacaagtaatgagtggggttgagttggttagtgccttgaagataagtatgatttgtgcaattgatcataagtttaaggattgggaaaaacagggaaaatattttattttatactagtttttcatatggttgtagtacaatttaatgtctctagaaagacattttacaaaatgcctctttaacagatacaattcacataaggtacttattaggtattttttaaaatgcctctatagtattgcaaaggtatttgaaaagtgtctctacactgacacttggcaataatcattgtcttttttaagggtaaacctcaatgattgacctggagcctagaactggcatgatcttgtagtcactaaacccggcttcgacgaaaaccttcttccactcttgctcgtctcgctccacaccattgataagcatgatgtatgcatcaaacaaggtctgcatctctaaatgcttttgatcaggtggccctactccgaccaccatgtctacgactattacctttcctccagcatctctagatggaatggctttcttgcagttctttagtatcttgacacattcatcatcgccccagtcatgcataatccactgaatatatatagcaaacataatgagagagtcacgaggtaaataaataacattctgtactatttagaaattacaaattatggcttaggttaaacaaaaacaccatactaattacaaactgtcaattactgatctcgaattttcgctatgatcaaattaatacaataattaaattcagaatataagaccggaatgacttcatatttatgttatttcgatttttctagaaaaattacgtaattgaagcaataaaattggcccgccaagctgagtcatgctttgtaattgttaacttcgatttatgaaattagttataaataataactaagattaataatgagtcgtgatagacacgatttggcaattaacacttcaaaaattggttattcattaacaaggatactaattgagagt

SEQ ID NO: 26861 - DNA, 697 bp, Oryza sativa
actgccacaaatatggttcacagacttattgtagaaatcagaaagggaaaagcggaataggcctctgcactcataacctttactaataaaatatccatgtttagacacgactactttattagactcaaaaactaacttaaatccgtctctagtcaaacgggagccactaacaagattcctgttgatagaagggacatgttgcacgttcttcagctgtacgatctttcccgaagtaaactttagatctaccgtgccaacaccatgaacagaagcatgtgacccattccccaataggacggtggaaccccgtgcgacctgataagaagaaaacaatgagatgtcagcacaaacatgtacattggccccagtatcaacccaccaataagtagactgattaactaaaaaaacagtaggtaaattaccatacccgcttccatctccagtcttgccaatggtcacattagcatacttagaagtctgccctgcaggtgccttcatccccttgcgctgtggatacttcctagccagatgaccaagttggccacacacaaagcaagtcctctcatcttgattaggattgttattgttcttcttctgcttcttgaagttggtggtctgctgagctttgtattttcccttgctcttgttctgggccttgtgcacaatattggcactggactgcccaccatcgccctta

SEQ ID NO: 26862 - DNA, 3262 bp, Oryza sativa
aagaaaaggaaaaaagaaaaaggattttccctggaattaaaatattgcttgctcaattttaattggttaaaaattatttctagagctctgaaaattccactaaaaatcctgttaatgaatttcgacatgtagaactcaagaaaaattccacatgtcaaatccgattattatttgcattactttcttagggttttctcttgatttcacctgcattttcttggggtcgttttagaaattaaattttaggcttgggaggagaactttggggtgtgacaaacctaccccccttaaacagaatctcggccccgagattcggaggagctggtgaagaggtgcggatgggcggctttcaactcatcttccctttcccaggttgcttcctcttctgaatgatgactccactgaactcggcaaaatcgggtgaccttgtttctggttctcctttcactggtatcaagtatacgaaccggcttttccacgtatgttagatcctcctggatatcaatgtgttccgaatcagcctgttcttcaggtaccctttagcacttctttaattgggacacgtggaacacgtcatggatgccgatcatgttggatggaagttctaactgataagcaacttccccccttcgttccaggattttgtatggtcccacgaatcgtggtgccaacttgcctttcgtctgaaaacggtgtactccccggagcggagtgacacgaagatacacgtaatctcctgcctcaaaagtgagcttccttcgacggttatccgcgtagctcttctgtcgagactgggcaatcctcaacctttccctgatgattctgactttctcttctgcttccgctaatacctctgttccgaacagttgacgctcgcctgtctgatcccagaagagaggtgtgcggcacttccggccgtataaagcttcaaacggtgccatctgtagactggcctggtagctgttgttgtacgagaattccgcatatggcaaatttttgtcccaagctccaccaaaatcaagagcgcaagctctcaacatatcttccaagatttgattgacccgctcggtctgaccatcagtttgcgggtgataggccgtgctgaaatttaaacgggtccccaatttttcctgcagcttctgccagaattttgaggtgaactgactccctcggtcagatacaatctttttgggtactccatgtaggcacatgattctcgaaaggtaaagctccgccaaccttttgcccgtatatgtggtatgtactggtatgaagtgagcaaccttagtgagtcgatccacgactacccagatcgaatcgtgacctgacgatgtccggggcagtcccgttataatgtccattccaatctcctcccatttccattccgggatttgaagaggttggagtaaacctgctggtctttggtgctctgccttcactcattggcaaacatcgcagagtgcgacgaattcagctatttctctcctcatgctgacccaccaaaacttttctttgaggtcttgatacattttagtgctgcctggatgaatggagtactgggtctgatgagcctcggtgagtatcagatccttcagttccttgtcgtcaggtacacacaatctttctcccaaccagattgtgccatgctcatcttcgtggaaatcccgggcttttccgactctcatgttctttttcagctctgctatttcagaatcatttacttgagctgctctgacttgatccacgagcgtaggccgtgcctccagagcggctacaaaaccatgttcaacaattcccacgttgagatgctcaaactcctgccgcaattcctcacacatgccctcgatgcatagggcagtgcagtaacttttccggcttaatgcgtctgccaccacattggctttacccgggtggtagtgaatactcatgtcatagtctttgattagttccaaccatcttcgttgtcggagatttaggtccggttgggtgaagatgtatttcagactcttatggtccgtatatacttcgcagcggttgccaatcagatagtgcctccagatcttcaaagcatgaaccactgctgccaattccaggtcatgagttggataattcccttcgtgtggacgcaactgccgcgaggcatacgcaaccaccctgccctcttgcattaggacacatccaagtccgtggcgggatgcatcgcaatagacttggaagtctttcatctggtcgggcagaatcaaaactggtgcggatactaatttcttcttgagctcctcaatactcttatcgcactcagctgtccatttaaacttctcatctttcttaagtaactaagtcatgggtcgggcgattctggagaagttttcaatgaatcggcggtaatatcccgcaagtccaagaaaacttcgaatctgcgacacggtcttcggtggggtccttttggtaactgactctacgttcgacggatcaactgccacaccctgagctgtaatgacatggcccagaaatttgacttccgtcaaccagaagtcacacttgctgaacttggcgtatagctggtgctccttcaacttctcgagtaccaaacggagatgttgctcatgttcttcttcggattttgagtagataagaatgtcgtcgatgaacaccacaacaaacttgtccagaaattccatgaatactttgttcatcagattcatgaagaatgcgggtgcgttggtaagtccgaaagacataaccgagcactcatatagcccgtaccgagtggtgaaggccgtctttggaatatcctcttcctgaatactcaactggtggtagcctgatcgcaggtctatcttagaaaacacttcagctcctttcagttgatcaaacaaatcatcgattcgcagcaagggatatttgttcttgatggtgacctcgttgagtgcgcaataatcaacgcacatcctcttcgtcttatcctttttctccacaaaaatgaccggagcaccccaaggtgaagtacttggtcgaatgtaccctttctgcagctgctcatcaacctgcttcttgacctctgctaattcgttggctgccattctgtacggtctcttgtaaattggagcggttcccggtgccaagtcaatccggaattcaatctctctcttgggtggcatggtagtgaggtcttcggggaacacttctggatactcgcagactatgggtatatattccaatttcctcaagtttttctccacggtgtcgactgggatttccgtct

SEQ ID NO: 26863 - DNA, 1169 bp, Oryza sativa
ttttgctccagtctccttcttggcttgcgcgggcgggcctgactgtgccggtgccattggtgggcgtggagctgcaccgcggttgggctgacctccatggtggttctgactgccactggcgccctgaggaaagttgctaggattgaacgggcggtactggcggacgatcatggtggtaggtccaccctgctgtccgggagtgaagcgcggcctctggtgacttccctgaggtgccctgaactgtgcggccttcctcttcctgtccatcttgttgcgttgatcctcctgacggattgccttgtccaccagcctctcaaaatcagcgtagtccccagatatcagttggttggtcagctcgtcatccagacccgccatgaacttttcctgcttctcggcgtcggtgcggacatcctctggtgcatatcgcgcgaggcgattgaactcatggaggtactctgtcacagtcctgttgccctgatggagcgcccggaattccctcttcttttgtgccacgaccccatctggcacctacgccttcctgaagctacggcagaactctgcccaagtgacttcagtacctggtgggcgggtggccatgtgattgtcccaccaagctgacgcaggaccttgaagctggtgtgtggcgaaagcaaccttctcctgatcattgcactgcaggagattcagcttcttctctatggcatggagccagtcattcgcctccatagggttggtggtgctggaaaaggtgggtggcctgacacgcaggaactcaggcaacttggactgagggggagggggaccaaactgttgatgctgctgttcggcgtgctgcagcatccgctggtgcatctgctggtgctgctgctgcatctgctgcatcatggctgccatcatctgggtctgatgtgccattacttgggctagcgtcggattctcgggaagtggtggcggaccattgccagaatcgctgtggggatgcgccccatcagtgcgctcttcgccgttgctgccctcgcctgtcgcgcggctaccattcctggtgtagaccatctggaggaaaagcatacggggagaagaagaaaaacagatgctcagaaactaagctttattacataggaatttaaactgcaattgttctgatctgaattaaaacacttaaagagcaa

SEQ ID NO: 26864 - DNA, 5661 bp, Oryza sativa
  unsure (1)..(5661): unsure at all n locations
atcatcaataaagactaccacgaacttgtctaggtattccataaacaccttattcatcaagttcatgaagaaagcaggggcattggtaagtccaaaagacataacagtacattcgaacaacccatacctagtggtaaaagctgtcttaggtatatcttcctctttgattctcaactgatgataccctgatcgaagatctatcttggagaaaacagtggcacctttaagctgatcaaacaaatcatcaattctgggtagcgggtacttattcttgatagtcacatcttttagtgcacgatagtccacacacatcctctgggtatgatctttcttttccacaaaaataaccagagctccccatggagattaactcggtctgatgtaccctttctgaagcaaatcgtccacttgcctcttgacttctgccaactcgttggctgccattcgataaggtctcttatggatcggagttgttcctggtaccaaatctattctgaactctatatcccttttaggcggcataccaggtaaatcatctgagaacacatcgggatactcccggactataggaatctcttccaaagttatttggttcagtattgaccttaaagactcagaagacaatgcatgaacagttacaactcgaccatcattgctggtgagagttacttttctgttagcacagtctatcacacccttatgcctggctaaccagtccatccctaggataacatcaaggtctttggactctaacaagataagattggccagaaatggtactccttgaatttctattctgacagaggggctacgttgcaaagagagtgcttgattacttggggtactaaccatcaaaggacatctaagatcttctacttccatcccatgatttcccgcaaaactcatagataagaatgaatgtgtagcaccagaatcgaaaagcactgttgcaggaactgagttaacaagaaacgtacccaaaatcacatctggagcaccttgagcttctgcagcagcaacatgattgacacgggcctttgatgctgatacggtagagttgctctgggcagggacaaccttcacgcatcggggcttcggacacttgtcagcgtaatgtcctgggtctccacagttgaaacacaccacgggcttgctgccttgctccctcttggcaggttgttgctgtgtcgaggctgcaacaggacgtggaacttgattgcggatgttgttgccagcattgttgttgaagaactgacgctgcggacgaacaacagacgaataacctccctgtggcatggactggggtcctaaagtaagatgcggcctctgattattcccctgttgtgtcttgaattgagcaatccggcgtttcttctgctccatgcgattgtacttgtcctcctgacgaatagccttatccactaacttctggaaatcatgataatccccagtcatgagtgggtaagaaagctcatcattaagtccttccaagaacttctcctggtgctcttcatcagtgcgcacatcttccggagcataacgagccagacgattgaactcgtgtagatactccgtaacagagcgggatccctgggtgagcgacctaaattccttcttcttgagagacaccactcccgatggtatatgcatcttccggaaagcagcggtgaactcaagccaagtgataggttcagcagtagtcctattcaggcggaagtgatcccaccattcagaggcagggccatgcaactggtgtgatgcaaatgagaccttctcctgatcagtgcactgaagcaaatccaacttcttctctatggcatgcagccaatcgccagcttcaacaggattagtggtactagagaaagtaggcggcctcacacgaagaaattctgctaacttgttctggggaggtgcatggttatttccctggttctgctggttctggagttgctgcatcatcatgttcataagctgtgcctgttgagccaggacttgggcaagtgtgggattctctccattgttgttgttgttattgttgttgttggggccattcccgttgctgcgagtgaccaccatctggcatggacagggcacaagaagagaaaccgggggaaactacttaggacagagaattaatttgacttttattggtcttaagtgagtttcattattacaaactgaagactctcacaccactaagctcaccaactacctaacactcgaaagcaaacaaacgcatgcacttacatcccatcactgatgtaatcacatgcgagacacacacaaccaaacttaaaacaagcaaactaatacaacgatctaagacaacggcttgacaaggcattctagttcttccgagcatcggagttgattgaaggctcgttcggctcgtcttcatcatcttaagttgctccccactcaatcttggaatgggtgcgcttcgattcttcttcttcatcatcacttacgttgacgaccggaggatccgctagggctggggtaacttctttttcccccacacggacctttggtgccaattgatagcgagggacaaatagagctctcttccttgcggtaagacaaatcctggccttctgcggtggtgcttctcccttcaacgcggctagttccttctccaatcgatccactttgtcctctagcttgcaaatcttacctcgattccgatcttcacgatcttgagctgctaacacagtctctgcacgggtttcatccatagcccacagcatctcaaccaaatgccttgtggtagcatcattctcaattccctcagtctcaaggtagctgccacggtcacttccgtggggttgacgagaatggtagcgatactcagtgtcggccaactgatcactgtagcgatcgcggagctcgcntatggcgatccttgctacctcctgacatgcatggatgtagtttcttcctccagcttcgaacatcactgaggggatatcttcactattactgttcaaagtgactttgactcggcacttctcttcatgacgatcatgaggaatctaggcataaaaaggggcagtcccaaatcctgtggcaaaggacatcgtacgcaactcctggacaaatccctcaacaccaaacaagtactcaggcttgtagcgcggcatctaaagacaagtgaaaggagggagttaagacatttatccaattaatagcacaagtttttggattaatttgaataaagttagaaaatcaaagtaaaaggtaagtaaataaagtaaaccaagcttgcaagataagttgaaacagttggaaataaggtcacaaattttgtacttttgaacaacaggttccaacagagataaaagaaagttataaaatcaacatgctaaatttattttcttgcagcaagattaaataaaacaatattgtaaaacttttgctggtaaaatgagccattagtacagtaatagatgtacagtactaataacactggaataaattttgaatgaggaccattaaaagagattatgaagtgcatgtgccattagtttggtttaattaaaagagaaggggaggagaacagttctacttttccaatatttttagagggcttctatgggtaaccatttggcataacctagggtcaaggaggctctgataccaacttgtcacgcccggaatttctatccaaaattccaaacgcttacatgtgtgtgaaccctcgtccaggaatcagccgagacacacaataacaaattgataatagagtacaattattactctaattaataagcgaataaaatgtcattacagaggtagatagttcctctcaatcaataaagatctaagcagcggaaaataagataaacggcgcagacgactccactccacaggcagattgaccagggctacacctaatcctccacaccatcagcttcactgtagaactcttcctctgatgaatgattgcaaggtgagtatatgacatactcagcaagccacgcagcaaatatgcaagtgcacaggataacaaaggatggcatagtagggtttcattttcataaacagcatttaataaacatttcagaatttaataaaacagttaagtattaattaaacagtattaatccaacgctacacaacataccctgttgcataggcccaaccattctgaacaaccatcccggctgcacagttctatcttcaaaccaggaatataccattccaaaccaggagctaatcaaattattaccaattatagcatcttttattatgatgagaggtgtgaaactaatcacgaaagacattgttagacccgcccataaccgcgggcacggctattcgaatagttttactctgatcagaggtgtaccactgtacccacaatacacagccccacatcatgtcaccatgtgcctcaataccaccacggtacctcggaaaggagctgtgacaatacccctcgcacaacacaatccactacagcgcacctttcctggatcataatcacccccttataaacaaggcatggactccccagcgacccctgtgggcttatctccgccacttctcagtctggtgctctgcaatgaaccacgctatacaaaaggtaaagccgttgcccacgctggcttgtggttggcacggttaatgtttcacaaccgaaactcgtgaaccggtccttaattgccatgagcacgactctcaaaaccatgtgctcacaacccaccattatcaggttttagttggcaagtaattaattaaccaatcacgattgaccatcgtgaactatcattaagccatcattaaataataatgaatcataagttatcccaatagtgtgctaatatttctaagcatggctaagcaatcacacctaatatctagctgaaccaatatataaagcccaactagtcaaattataataacccaaggtatctaggaataaagtaatcaagaacaaaagggctataacaaacaataggttaattccacccaatgacattcgaaaataaatgcaatagttgaatagaaacaatagctttaaacgggatcaacatgctcaaagggttgtttgggatctgtgtgacttgccttgctggccttggaactcttcaaattcttctcctgcgaaaacggactctccggaaacgtcggaatctaaacagaaaagagcaaaaaaaaaccaaaacagcacataaacaagcatgaacagtacatgtggatatttttaacatgtagatctcaattttagaaaaatttagagacttgaaccaactaaatccgagctaagatgaattagttatgaatttttaaagattaaatcgaattaaaacacttatatggattttaattgaattatgacgcaataatgaattatttttgaaaaagaaaaagggatttattgcgtcagcggctagggtttgcggtggaccgggcgcacggcagcggttcacgggaacgaacggccgagatcgatcctatccaaaacgaacggccgagatcgatcgggtctacggcggctcacggcagacggccacgatgacgtcagcgacgacgtcaccaccggcggcggctcggcggctcggtcgcgcaagctcgccggcgaacgacggcgcgaggacgcgaacggagggcaccaggacgtagagcgcgacgtggcgaactcaccgatgaccaaaacgt

SEQ ID NO: 26865 - DNA, 2746 bp, Oryza sativa
ttgacttgaaataggtcactcgtgctcaatcctaccgtacggggctcgggtcggctaaaatcgccaaaaggggcccagaaccgagccgtgccccgggacgtggtgaactccggggggaatcggcaaaaacccacaatcgggtcacccataaccctcggtcaccacgctcccggcctggccagtctcgacatgtggatctccccaggcactagccttgacccgcgccgtttgaggctgggacctgggcacgagcccttgttcaagccaagacacagaaggaccgtggcacagaccatcctcgtctcatacacagaacaaatgaaattgacacaaaaatttcctctttatttgattgcagattaaatcagcctataacaagaagggggcccgaaggcctcggaagaagaaggaaaagctattaagattggcggaggcctgggggctcactccgacgtgcctgggtagccggcctcgccgtcactgtcgtccgcaccgtcgtcaccgcactccttgtcggagttgaaggcaaacgcgaagccgaggggccgctcattattgtcggtcggttttcccttgctgatgcgcgcgacttgcgaccgccgggattctgcccgaagagagagagagcagggaggagaggcccccgagccgaacggtggcccaaggcccccgacggccggagctggccctccgcctgcttgtccgacggtgccaggcgcccccgacccccaggatggccccgaggccactgcgggaaggccgcgcctgtcgccctctgaccccgaggtcgtcggcacagaagccgagtgcgccccgcgtggcctctcggatggagagcgccctggagatgtggcccctgacgaagaagatcagccccgccgaaaggtgcagcggcccgtctacttcgttagcgaggccctccgggacgctgagacccgataccttcaggcccagaagatgctttacgctatcctgataacttcgaggaagttgcgccattatttccaggcgcatcgggtcacggtggttacgtcttatcccctcggccaaatcttgtataaccgagagggtactggactggtggtgaaatgggcaatcgaactctctgaattcgatttgcgctttgaaccaagccacgcgatcaagagccaggccctcgccgactttgtggtggagtggaccccagctcctgagctcgtctccgcccccgaggccagctcgagcccatcgcagctgcctcacaccgccctctgggtgatgtagttcgacggcacctgtaggaaccggccccacctgtcaccaggccttagaagtggcgtcacgcccgaccgcttccctcggggagggcgatcgccctggcataacgccgggggctactgtcggtgacatgggaccgggagtatcatgacttagagacttgaggcagacacgatcacccacgtggcctaaccccctcaggggggtcgggcccgagggtgatacggccgcccttctctttgtctccccgaggggtcggaccgctcccgtctcggcccagagggccgaggcgccccgaccccttgtaggttttgcgccgcgtatatggggtaggtgagcatagcggggctcacctaaccatatttattgcggtttggacgagcgcgtcacgccgcatgtaacgcagtgcagcgcgctcgtttatccggtcagtgaccagtcacagaccgatcagatcgtgggttaggtggcgacaggcggtctgacgcacgcctcgccccatcccgtcaggatgagagcctccaagcactcgtccctagccggagccagcgtgttagctcctggagatggcacgttggtcccggtcagatatataccaggcttcatcctaaccattacaagcaagacattgtatgaagaggggcgaacatgcagattgataaactgacgcgtggtggacaagaatgaccgatttgtgaccggtctgacactggtcatgtcgtcagcagacagccatgttcccacgtcgcgcctgcttccggcggaagtggaggtaggtatgggccgtcccatcagaaggtcattcggacggtaaccatacaagtctccgtctgtttatgaaaagataggataagtccccacaaaaaagagagagatggtgcatgtggtatccccttgaggtataaaaggaggaccttgcccacttagaagagggatttttcggatccagaacgatcagagagggagagagtaagagctctctggttctccagctcttttgtagcttcttcatacatagatccaccaaaacacaggagtagggtattacgcttctcagcggcccgaacctgtatacatcgcccgtgtcttgtgtgtttccattctcgcgaaccttccacacacagactaggagcttaaaatctcacccagggcccccggccgaaccggcaaagggggacctgcacggtctcccggtgaggagccccacgctccgtcatctggcgcgccaggtagggggctctgcgggtgtttttctaagctctcgcattctttcgtgtgcgccaagcttttcctgttcagcccaatggccgaacaagcaaaggcgcacaacctctctccgagtgttagcggtgacaacggggagccgaacccacgccgtagagctcgtactccatcgccccctccacgccaaagtcctacgcgggaggaggcgctcgagagggtcgaaggatccgcgacttcaacatccacgggtgatggggaacggcgg

SEQ ID NO: 26866 - DNA, 44632 bp, Oryza sativa
  unsure (1)..(44632): unsure at all n locations
cactgtccagatttgtaaattacatcaagcacaaatatgttagtcgctataagtttgtaaataatgcttatgcaacataataaatacaatgtccctattttattctaagttgtctagaaagatctgaaatcttaaattgtctcgtaagtgaaaaagtggttgcatgtaagagaatataaagaaggaacaatgttagaaaattgatttcgctgacctgttctttttctgcattgattccagccagctttgtttccccaatcccaattgactcctctgcttgcttctctttacgcatttcaccactggtagctcgtaaagtctcagctgaacaccaaaacttcatgatactcttggctaggattctagcaattgatttctgtttcctttgaatgtttgcttcctcaaatgttgctcgaccacttaaggcaatccagtggcacatctgggaagctgctgcacttttccacaggcgctcctttaaatagaaaacgtgatgttacataatatctttgaatatgtaaatacagtaaaagaaatgttacacgacaagataaaaaacttgcagcctgcatgagaacaagaattgattattaagatcactttagagaatacctgcataaattcatttgccatccaagccatctcctccaggacaaattcccagtgactctttggcttcttctccaaagaaatattgcagagagatcgttcaccagctttcttgatattgacctgagaagtatttattaactttcttctcagaaaagcagtatcagaaaagtatatattctaagtgtacctctattaatcgtgcccttctaaggatagtatcttcatgttccttcttggcaacagtagaatcttcgcattccttcttttccatcattggaatattttcaccagttttattaacatcattgtcagggttcattaatgacacagaactaggcacgtccttcatgagcaaaccagacgccacggtaacagaatccaacttatcagcaatattagaatcaggagaacatttattattttttttcaaattagaacatgcttccttatcgactttgtcaagaccagaagtagcaagattccctgtatccttttgtgcatcaaccatcttgttatggacatcaacgtcatctttggcataaatggtattgctgacttctggttgaacagaattagaaacgccatcaacaactgtgggcatgtcaccaccttctggttgaccatctttgtttccatccttgtcagaaggtatagcatcacctaaatcttcatcagacaccttccctgataagttctcactttttccaggatgttcatcaacggtcttagacacatctgcacatggtatatccgcttcattttcattcaaactggcaatttctacctcagagggaggaacagaactcttgctaaccatatcatctgcatgaacaaccaaatttttatctgagcatccattacctgcttcttccgcagcacatgcttcttccaagacttcattgcatgaagatggaaatgaagaagttgccattaaagcagcttcttttggacttgtgtcaggggattctgcagaagtagttgcagtaactaccaaaccatctccaataagctgtgaattaccattcacactgtttggtgagatttccggtgtttcaacaccatctttgaagtttgttgtttcatgagttgctgcttggtttccttcattagtgttgtccatctccatcgcatcatgatcacctaatgaagcaacctttgatgtgttgttccgatctggacttgctggttttgagttgccaatagatgaggcaccatgatcttctgattttgtttcttgtattatcccttttgcatctttcccttgagaatatagtggggaaactggtagagacccaacagacgcagtggcattctccctgcttgatttcgatctgcgacgagcatacgcctggttctttgccccagggcggaacaaactagaatcttcagcctcttttacattgttttgaccatcacagcgcagggacacatcaggttgagatacattagttcgtttagtaccacatttgacaagtttctccccacctgtgttgctggtatctccatccaaaagcataagattatcagctgtgttggcatcacggcatgatgaacttcctggcttgccactactttcaactgaatccccatggggtgaggcagcaaacgcaaagctgcccttagcttcactgtagtgcaagtgagaaaagaggatcgtatcaaacaataatggcagcaccgttatcatatgacaaaccatgaaaatcagtatcaccttatcacattttgttcggttatatgatctgcaacagaagtggactggacactaagtgatgctacatgtccaagtttgaaatccaaggggttacctccctgcaataacagattaataaatcaggacaaatgatctaatgcaaagtcaacatacactccaaaccataaggatccgattgcaacataccttctctaaaaattcaagctcccttcttcgttcttcacggacatcatattcttgcctgaagtttgtacagaacattaggaatccacagaaagcatatacaggctcataataagatggccgtcaatgtacctaagctcctcttgagctttctctatggccgcacggcgtggcgaagctttctgatcaatgttcacaccacattctgcaattcctcccatagagcacagctcagtatccacacaggatcaggatatgcaaaggcatcactgcaagcattatctactcagcttgccatgtcatcactcatcaatggacatgaccttctcaaaagtccgcaaaatgtgcaacctgtttcctgtaaaaccaaaccatgttgctgataacaaggcaacaatatgcaaaaaacaatagtagaaactaaatatcataaaggtgacggcgtcctcccatatcaagtttacggaaaacgcaatccttattaccaaaaataaaaaggagacaaaataaatgcatagcgccagcattttcccagtcaagaatagagcatgccaagtccaaccacacttgcccaatcaaacacgcacacgcaaacggttcgacagccttatggcctgatcgaactaagcgcgcacataacgacagaacgtgccgcgaagctagaaagtctttctttcactaacaaacagaccacatgccatataaggcacactaaaaaatcactttttttaagcagacccgcgaacattccgcgctatcagagctcaaaccgtttacagcgttgctaaaccatgaatgcttcagttacagcgagcgcgcgaagctgaccacacgtaccccccacactccattcgcaaactcgcaaatgcagcacaattaaacggctaacagcagtagcaccaccagcccacctcacctcaccacacacaaacacacaccacgagaggccgggcagccccctccaagggcacacctcaattgcggccctaggggacagccacgagccctaaggaggccacagggagcgtcgtacggagcaggagactcacctaggcagcccccgcgccgggggtgggctagggctagggttagggtttgcggggagcaggggagcccccacctcggggccagggcagtgggcgccgggagcacgcggcggggaggggggaggcacgcgggaggatctccgggtggtggcggcggagacggcggcggcggcggccggggggtcgccggagatcggtggcgcggcgcggcggggctcgcgggctcgcgtgggggggtggtggtggtggtacgtcgtatatacagaaggcagaggccgcgagggagggaaggagaaagcagattgtgtgtttgcgggtcgggtcggggttgcgaccgggtgaggctcgcgcgaggtggtgcggtcggacccggtcggtcggtcgtcgcggagtgagagttcgcggaaaggaagatgaatgcaaactaaaagtgtttcacgtaaaacgatgtggtaataacgtgtgattagttgagttctcacataaaacgcactgtttaacagtttgaaaaacgtgccactttaatccaaaagttaatccattatttttagtggattcgaacggggcattcgtttggcaaaatttgctactacctccgttctaggttataagattttctaacattgcccacgttcatatagacgttatgaatctaggcacatatatatatgtctgaattcattaacacacacatatatatgaatgtgggcaatgctagaaagtcttacaatatgaaacgggggaagtattagacatttaaattttgtgtaatttactaagatatactgtaaaaatgtgtcacgattgataggcatcgtaaaaactggtatttgctggaggacactttcgactcaattgaagagggaaattctttaaaagatgagaatgttcttagggtcttttgagctgaggttggagtgaagatgaaatataatgtatgctagtgatgcacttggggtgatggtaaatttaaagttgcataatatctaacttttttactctaacgtcatgtttgaagcatgtggtcctaggagcattctcgtctttcttaggtctctctaattaagccgaaagtgtcatctagcaaaataatgtctctcagccatgacacatttttttatattgttcaacaaattaaacaaattttaggtgtcatatagcaaaatttgtctttgatcaatactcattgtttcgattatgcttatgcttcttaagttaaattttaaaattgatttttttggctttttcatcatagattgtttacaatattttcttttaaattgctaacgacacatgtataaaaggcttaaccacaaattattttttagttagtaataagatgttcggataagcatatgaataagggccaatcatcactatgaatacgtgagtgacaatagatttatcattaaggaagagtgttgtgagagattaaaccaatatgataaagagtgtcaaaacgttaaatcccttagagaggggagaggaagagctgaatatcatgtgcaccaccaagtgtttcgaatatttactttttaccactctagaggagtggagtggtaaaagatttgctactcatgtgagaggggtaaaatggatgtgtggtgaagagtggaaaaagttaaatcctctagtagtgttgtgctataggtattattaaatttacaaagtagtacatccaaagtaactctttcatcgtcctttgcacgtatggttgtaatgcgggtgcgtaatcaatgcattagtggagcccgtctaaccaggaaaacttcccgttgtgtttctgatcagcctgactctaagtcagaggagtaataataaataaatacttcctacgtctcaatatataaacctgggtaattcatatagttagcatgcaaagatgatgaattgtcgtactagaaataggaaagtgatgagtgtttaatcaatcaagtagcattcatcagccaaacatgctattggctaaaccaaaatttagttttgctcatccatatatggtaatgatagaactaatataataacaattgttgttcttctaaatagaaacaaatcttgtttttaagtgaaaaaaaaaacagtttcattgccctcatccaaacaacccctttggttgtgtttggatatacatttggattgggactgaaacaatatacaagtacatgagatagtggttcatggtttgggatatgagacttttactcttttatgatggttgtgatataatggacttatgttacccactctaccaacggtagcccctagcctcgatcccgtggacgtagctatcagataccgaggttggggcccaccatgttagtgaggcgacgtcttgacatttgctcttctgcagcccaacttgccattcccgacccaatttcttggggcgaaagcatctgatcctgatggatgtatggtgtttgtgtctttgagtttgatgaggtccatcctttcttatatgttcctgaactcaggtgccctacttaggccctgtttgattcagcttagaattattataatctagattactaggagtaagttgaaacaaacaagtagattattatgctacattattataatctataagccagattactataatccaataatctcctctagaggagctttttttagattgttgagtggctaaagacccactacccttagatgcctctaataatccagagaaacaaataactcgtagcttattttatgtcagattattataattcagcttagagtaatctaatttaataatctagattacaataatcttaagctgaaacaaacagggccttagtgtcttcaagggggtttttatgtgggtaataggttggatggctacccaaacctagccagtgatacctactcacaagaagcgctgctgccaacgccgtcgtgccgtgcaccacgaggatcctcttcaagcatcgccaccttcaacgtctcctcaagcttcgccttgtacaagtctccccttcggtgttggtgcctccctaaagctccattgcggatgtcacctccgcctccatttgaccaagcttgttttatttaaaaatgaatatcacaaaaatagtgcaatgtttcatattgatatagcaaaaaaaattgcaagactataaccttgggaggcttataatcaggaaaaaggaaaaaaacacatcaccacatgctgacatctcctacacacaccaatagacgggtaccgaatgtgacaccactatgcgtgaccgaacgccaccaaacctaccacgaaactgtcactgacccacctgctcttgcctcatgcctctaaacagctgaaatcacgatcttttggacacacccgcgagaagggttgcagagggagaaggcgagagagaagagagagaagaagatccactcgtccctcatacaaacccgccgccttacaaaaaataccccatttgcttgagagttgagacagagaatgcgagaaacgggaccgctagatggcgccttcaagaaggatatgatgctaagagcatagctgtcgctcgtccaagggttctgaaccctattttccctcaggggttcccaccaaggagagaactgggtgccttaccaatgccctcaagaaggaccacaacacttagaaagttccgccgtcaagcgagctcagattgaaatgctacaaaaggtaatgaatacttaaacagacaaaccatgtgtggttcaaccattgaaccgcttaaagtagaagattagttgtgcataagtgcgtgcattagaagatgccagatttttcttccatcatggatctaagattcccgttctgcagcaagaaattttggggggaaattttcatcagttgtaggatagtgattcattctaatttccatgagcacaagaaactcgatcgattcagatcgcaatcatgattctctcatgaatcattggagagatatataatcagttgtcaacaagtttgcttcttgtatggatgacagagggcgtaggaggccaagcaagatgaacgagagagatgaggtttgtttctagtttcttggtatattttgttgtatgttgaaattgattattactttttttgtctaaaaatatagcaacttagtattgggttagacacatcctagttactggtaacaaacaaccttgctctagctattggatcatgattcattcttatttccttgagcacaagaaattcgatctatttggatcgcaatcataattctctcgtgaattgttggagtgatgtacaatcagctgtcaccaagtttgcttattgtatggatgacaaagagcgtaggaggccaagcaagatgaacgagagagagagaaaagtttgtttatagtttcattctacatttgttgtatgccagaattgattattacctctctgtccaaaaatacaccgatctattatttgattagacacatcctaatactagaaatctgaacatagacaatactaggttgctatatttgtaggattttgggagtaattcttgtgttataactgttggaaactagccgttgtggtttgtgagagggtcaggcaacgttgctagatccagcaccgcacacccatcacctcataatatcaacaggaagttgcacgatcctctggtttttggcaatcaacagagtaggtatgtatttagattcaggggcaaaaagttttgatgtgtcacatcagatatatggatacacatttaaagtattaaatatagactaataacaaaacaaactacagattccgccgataaaccgcgggacgaatttattaagcctaattaatccgtcactagcaagtgtttgctgtagcaccacattgtcaaatcatagagcaattaggtttaaaagattcatctcgcaatttacacacaatatgtgtaattagtttttttgtctatatttaatacttcatgcatgtgtccaaacattcgatgtgacagagtgaaaagtttttgcgtggaaactaaacagggcctaggttggtggttcatttcctgtgctgcactatcattcacaagtccgaactgtaatcaagtgcttctgaatgatacatcatgtcatcatcacctggatgttgtatcaaaagatccatgactacaacaacaattcattgtacaccatgttccattctttcgtggctacaatcacaatgcttacacatttaaccattcaacttatttaaaaattttatgcaaatacataaagatatttttagtgataaaataactcacaacaaaatagatgataattacataattttttttaaataagactaatggtcaaacgagtatcgaaaagttaacattgtcatctatgaaaagaaaagaaaagtcttttgacctgttatgtatgtatttacatcatgatgcaactgtcacagcatgataaccttcaatcatttcttccctgaggcgctggaggctgttgggtagatcctcctgaaagcccagaggatgctgcatccaatctgcttcagcttcttctccttcctcacctgatgttcatggcttcttgctgcactggccacagctgcttcgtacaccattgctgcagagaaaaaactgctgctttttttcttgtgttcttgtcaagaacagagtgacaaattgcttgcctgcttcaggagttcaggtgactgaaaaaaccaggtagtgaagtctgttatttgtagtggttgatgatgcagcagaaaggaagaattggcttggcagccaaggaattgaaaactgacatgtgtctgaattgaatttctgatggagtcatcggtcaaaagtattgactcaaatactatttcctaagaaaaaaaactcaggttaaaatagcctcttcctggaacactgggagggtcagctggaggagtcaagtgcattgcatgatgctgatggatttgtatctttgtgctttcttcagagttgcaacttgttttgacacgtttggttttctgtgtgcttcgcccctctttccgtcgttaaaataaaatctgattatatttcttcagaacgtgcaaaagacccagctttcatttcgctaagatagaaatataaagttagtggttgcaactggaacagtttcagatctaaggcttagttcgaatttggaatttagcttacatttttaaaaaacgggataagccattagcgcatgatattaattattacaaactttgaaatggggtttatttttttaaaaaaatatatataaaaagtttttgaaaaaaagagtttggatgtttccgtttggaattgcagaaaagaacaaaaagggaactggcggatgcatttccaacttgtaaaatcactcctttattcacatgatgcctcacaatcacaggttctgaacctgtgatagatacaggtaaagtacatttcagcaaagcagcgtccagtgagatacacatgaacaaagcatggaaatcaacatttaacaagtttttttctccagtttcccaccaaattggaactgaactctgaaactcgttgcaattacaaatctttaatccatcaagaaatattagacttgacctttgggacactattttccctgaattcgcatagagccacccacaagactcaactagccagttcatgatgcaaggaatgttgattgatgcctgccatgttcttgggttcatttcaccgacgcagcagaatcaacatgcagcccatcagagcaaggataataataaaaccaactgcttacttatagcctatctatcagctcacttatatagtggttaacttttcactataaatatatagtccacctgtctgtctcacagattttattggttcttgtgcctaagccggctgtaaacttacaacccgcttctcatctctctcctctcctctctcatccacctcagcattcagctttcttatagccctctattatacttgctctcagccacctagaagagatggccgtgcaagcatgcatatactcaccttccattgcagattgcagttgtgcttatgtcattgttggccatttgtgacatactccattaaactgttgctctgtagtttactactgagtatccatatgcatgcaaaatggagcctgcacatgctgcatctcaagtcaccatgtcatcttgtaaaaagtaaaaatttcacatcagagtcacatggtaataagctagtactcgtttcggacaacgataagttctccaaaacatatttttgactatgattttttctattataatacagaaaaaacagtaaatatttaattttatcaaagtattttttaatagtaatctatatgtcttgttctagtgtctacaaactaaatattttaaaagttattgatagtcaaagttataattatttgacttcaaccatgtctaaaagactaaaacatcaagaattatatagagccagagggagcaaactattaaagcaaccagctgtgttcttctcttcttggcaactctttggactttggaactagctatactagctagccatggttaacaaatccgcacgtctttgatggatcctgcctaggtctaatatattcatggtggagcactcacattgctgcctgctgctccatgaatagatttattcatcttgcctggagatctgagaagcatagaagaagaatctcatttaatgccaatattatgatcaatgttgacttttcacaagattggatggaggaagaagttacattaccgcaagatagccggtttgactgacaatacacttccaatcaatttctacaaactaaaaaaaacggcacttcctacttgcacattttgaaccttcagatggcttagctcattctggaccatccggtgcatcattagaccatccatatgcagtcagtagtaatccctcccgtagctaatactctgcagtaagtgcaagtcaatggacagaacatcttttattttttttattaaggctatgatctttttttttatttatgccacagttctagtgacattgagggagaaaacacatcgttttccgcgcgcacgcttccaaaactattaaaccgtgtgttcttttgtaaaaattttctataggaaaattgctttaaaaaaatcatattaatccatttttaaaatttaaaatagttaatattcaattaatcacgagctaatagctcacctcatttcgtgtatctttctaattttctcgatcccctcctcctcaaactcccctagaagtacttcaaggtcatgtgcatcgatcagcaaatgagtgcatcacctcaaaggctcatctctgttccctcctccatgcacaaggtagtctccaaagccctatagtgttcccaaacccaagaaagaagctccagctccagctctagcttctttcacaatttgctccaaacaaggtagagctcctccaagatcctgcaaagggatcactgcgagaaggcggcgcaaacgggagcagctggtgcggcgtgcagaggagaaggtgaaggtgaaggtgatggatgggagcaagtacagggcgaagggctctgccatggtcgggccagcaagaaggttgcctatgtccttctgctgctgctggcgctggccgccgccgcgctcagcgtcgtcgtcctgcacaaggtcagggagcgccgcgcgtttgctgttcttctccgggagcgcgaccggcagctcatctccacgcggatcctcctccaggtacggtgatggatcatgatgcactttactgctatttccatgtacctgcattgcacaatgtcttgcaaacctgttagtttctgaggtgtcttgtttaagcgaacaaagaagcatataccagatggtcatatctcagttgttatttgtaataactagaaggtgcaaaggaaattattcttcctcacaaccaaactccaaatttttaaaaattaagtaaatgatatatttttaaaaatatcttaaaaagagtaaagttttacaagtttaaagcagttgacgacctgacaagctgttcttactaacaaaccgtaaccattctttgttctctctctctctaataggatgatctcctttaaatcacaaatcttgaccatgatcaccaaacttaactacagcattcaatatattggtgttaaaagaccatttctcactgcacaagaacgtccttttggagttggagttttaacaataccagcaagtacatttgctgactctgaaatgtgcacttattttatatttgtgacattactgaaatgcataattttaatgcagacacttatgtattgaacaatattagcaacacaattttgggctcgaagcataatatgaaccgaatcgagccaactatgcattacttcccgatgcataaagtctgtcaactgtaacaattagggtgctctgttttgaattcttaccattgagaatgctaaactgaacatcattctgttcagtgctagaccttataaataatctgtgaaaaattagtcccagtatcgccagacaagaccatttcttttcaagggtatgtaaatcagagcgctatgcattacacactacttgaattacccccaattaatatgtaattgcgacactgaaacctgtttgtgactgacaaccatctattaaaaaaaactaggttatgttttcttcgtgcttcccacagtccatgtaactaagaatatagtgttccgaacatttattcatttactatttagaaatttgctaatttgtatgaactgtgttccagaaaaatggtttgatggtaagagtgtgcgtagcaaaatattatttggcctggccagcttctgtttttgttttaattcaacaattatcccgtgaatgagtagctaactgcatgaacactgctacattatccttccagaaagagaaggcgtttaacaaggagatgaagaggaagttggaagaactgaaggccacaacatcttccctaaggactcagaagacagacctgaaaacgaagatcaaaggactagaagccacagccacaactctgaagaacagagagaaagaactggaagcagttctcgcagagaaaaatagccgcgtcagtcaaatggaagcaactctcacagataaaaacagccacatcagacaaatggaagagagagccgcaggcacaaatcctgaccagatggcagctctgatggagctcctgcagcagaaggaagccgagcttgaagagatcaaggtcaggttccaggattacaagacaacggaacggaagagcgtcggcagtaagagcactcatgttcaatcaaacaacgcaaatgcaagacctgacaatgctgtagtcgaaaaggtcacaagctccagtgatgctacacccactagagcagaagaaaagagttctaagaataccacaacagcagaaagtagacacccaaaagacacatctttagaagaaaagcaagtgaaatctgcaactagcaaggaagaagatggcttacaagacaaaacagatgatgccattgaagatattgatgatatctacggggaaagtcattcaaagaagatcgaatttcctcggcggaacaaaaagtttttgactaacagtggagtagacagccaagatgaagaactgcataggatagaacacccagggaactccctagaccaggacagtgatcgcgtcaggtacaataaactgttggagaaggaaattgataaagtttctggtgaaaccaagaataaaaagagtattgatggtagtttggaaaagatatccaagcatagcttaggtgatgccaataaaaacggattgaaacaaactgtggaagacatggctggtggtactgctgctgtgaagcccaatatgtctgtaaatgatgatggaactcaacaacagaataagagacccaagaagaagaagaccagatccaagaagaagatgatcgattctgcaactactaatagtagtagtgaagttacaaaagaaaagtaagtagatgccacatcaatcccagagtgagttttggatttgaaaattcactgcactacaatgacagaaaccatggctgaagcctgaagggaatatcctagattttttatagcagttgtgaacaccaatgctatttgatatgctggaaaatctcggagaaacgaaggcccaggagtagctgagaaaatgtactgatgaatttatgtctcagaacagcgtataacatgttttctacaacatcatgattggttgttgtcttatatggacatggtaacacaatgattttataccttattttgttgagaaaacagttttacaagtaactcaatagctcatcataaattttctacaatgttggaacatttgggtaccggaaaaatcaccctgcacctcatgaacactgcaagcaaattttgtgaacaccactccattgtcgaaactcaaattactccagcccacaaaaaaatttggtagttttttaagaaactactgacatgtcacatccagaacttgttaagaaatatgtatcagtgtgacaacaagtttgacatggaacagaccacaatgcagattatgggacatcaacgcaactaattacaagcacaaagtgaacaattttaggccaaaataatgtctagaaacaaaaagaactagctaactattgccattcagatttacatataacatcaagaaactaatgagcattcacatagataaatacaagtcgcacaagaaaaagtgtatgcattatttattgtgtttagaagcgtgcaagcccaaatgttgttgctgttgttgctgaacctaacaaaattcaattatatgcagcatataatggcgtgaccttcttcagatcttgatcactcactattgatatcaaccataacaagcataaaagcagctccaatataaatttaacaactaaatcccgtctgcaattgcttttcttcacaattaggtgagcccaagaacacggcaataacaaggacagtgcaatccttagttgcaattcatggtgaaatcacataattaaaaaaaatcgtcgcggttaaaataaactgattttaacttactacacacgatggaaacacgattgggtatggataaattcataaatcccccaattccatacaaatcaggaggaacaaaaagaagacagagacctggagagcgattgaacagtcccgccaggatctgatctttccgactaaactgaactccccggcatccacctccgggactcccgtggcctcccgcaccgccgcatcccgtccatccggccggccggcggccgccatggtcgccggctcgccgccctcctcgtcttcctgcggtctggggacccgttggtaagagcgggataaaaggagggtttcgttgcaaaatctctcttccccatcgcctcgggttttgatctgagccgcacaggggagatcgaacggtcgagatcctgtcacgggtggagtagattgataatacgggtgtagttcgagggtctcttcggaattaaaccagtcgcgtgctcgagtgggatcgtgaggcccacttatcggtagcacccggtggcggcaactcgccggagaccgaaccgctcgccggagaccccccccccccctgggcgccgtgaagccacggcgccgccagagctcgcttctaggagtcactgggttctacaccactcagtccaatcaaaccaaggcgaggggagtgccgctccgcggtggaaactcagagatcgagggaggaggaagatggccggttggccgccgccgccgccgcatctcacgcgccggcggccaggtggacaggccatggcggcgccgcccattctgctgtttgctcggtgagttgccatagatgcttgctagagctaggaacccaactaacaagatggtcatcacattctttgtttcagtaattgcaaactagtctagtctccttggatgaaccggataatacatacagattcagatatatataaagattcaattaaattctcaaaaggaatagaatgtagctgaaggcttgcatcagctatccattttggccattgatctcattcccatcctaatctcatcttcttcttatggctccatatctgcctgctatctgctagacagagagcaatatcttcagataacctgtacatagcagttacaggagataacttgaatgtagttctgaatatatccatctgaatgttgctgactactacaaaatagtgacaacagagaggcaaagctgcagagaattttacttacaggagctttgcctttcttgccaccatcatcattgttcttcgacggtgcggtacggtagaaagaactcaagtctgtttttctccttgaagattgagagcctccatcgacaggagctggcctcttctggcttgcttgttgagagtgctccttgtccttgatcatggaacagcaaaagcagttcaagatgacatttggcaatgatactagaattgagctacaagcctacaactggttgacgatatttgcaacaagagaggaaaacaatgcatacagaaatttcgataagttcatctgattcatgagtatcttgttcctcatttgatgagcacttcaattcctgaaacgcgctgagcgcgttcgttggcaggctctgagagcacggcatgatttctgatcctcccttggagaggaggggatcttcattcatgcgctcctatggagtaagaattaacaacaccctttttcgctatctttatttttggctgaaatcaaatctagtatatgcagaaatagagttcctctgtacctgcatacactgatccagttgaagtactatatcttcttcagctttcaaatcctttgttgcaaacgtcaactttttctgcaatcccaagcaaacagttttttcattgcaaatatgagatatcctgaatggaactatatgatggtaatatcttacttttgctgcatcaatatttttgtccagacaagaatgaaacgccatattctcgtccttgttgacaaaatcatgcagtgcactgtctaggtcatttttgtcaagaatctgcatattctgtaaaagaaggattaaatgcgccagtgtatttttatttgtttccactaacctggaattatctaaaggaatggatatctgaagcaaaatagacctggccaccatgaattaaaaggacaccaacatgatacactactagacttagaccaggagaatgttaaattagtaccaagttactctctgcaattaattcttcaatactttgctgatctagctcatttggttcacattcttcagaactaccagtgtgttctgcaatataaagagagagtgaacaacacattactcaacaaagattaagatgcatttttccagtcaattaatatcaaaattgttcctaattcctaattattttagtgcagttaacctgaagtatattcccatttttcatgaaacataaacaggtacctcgtgttcgattctgttgagctgatcttgagaagagaataatgtcgtttgggtttgcgacctgtaaagaatacaccagttaaagtatatgataaaggattcaataaaaaaaaagtatatgataaaggaggtatgcatcagtaaatttcatattagtggttgaggtacctttccgacatacttctgaccaaaccgctgtggagttattgtcgaaaacccagagtagtccaccttcagaaatttgacataaagaatttatacaatattttaaaggaaggtaatattttctgaagagcaccctattttacctttactctgactaggggaagtttgggctctgatccactaattgctgttttatcgataagattgctcacctgaaataactctgtattcaatagtactgctgaaaactacaattcgcaaacatccaatttctaacatatttcccatttaacatgaggacatattcagacattcagtgaaaacgagctaaatgttggaaactcatgaaaatcatacctagaagttttgtaaattcatgaaacaattactagaggtatgtgtatatatgaaatacattctcaccaaatcttaagttcaaactcaactttatttgggagtaacaaaaaagacaaattttgaatgaatattaacaggacactatttatctgaaatttgtcatttttgtttctctcaaataaagttgagttttgacttgaaatttggtnagaatgtatttcatatatacacctatatctagtatttttttcgtgaatttacaaaacttttaggtatgactttcacgagttttcaacacttagctcgttttcataggatatttcccatttaacatatcattattgaactccaattgaatgatcaatgtcctggccatgtttatcaagaaactgtgtagaagtatttttcgaacaaaaactatgggctcaaaacttacaatgttatccaaatgctcataaagagctgcttcgttattgagctcaacacccaattgatcttttaattgaacctatatggtatgctactgatgagaatcatctcattgaaagtaaacatgaagtaagtagagagtgaaaatggcttacttcggcatattggaaaggtctaactgattttaatggtatattagtttgcttgtattgcattccctgattcaagggaaacatatataagtgattagacaatgataaaatagtatgatcaatacaccattctgcagtagtgttaaccttgatttccaacaaaacaacattctttggctttgcttcagcattgctcagtgaggtagcaactgaagaacctggatggataatgtgaaaatcttttccagaaacctcctgcaaagtttagctagattaaaaataaaaataacacttgacaaacattagtaagaaatttgcagtagctcaaaatgtgttacctggtgatcaattaggcattcatgctcatggccccatattaccaagtcaagaaaacttggcaagagctgttcattgatgccatttgttgagcttccctttctcctgccgaaattagagagacaaattgttgctaggaagcgcaagtgaaaaaagacaacaaagaataattataatcatgagccactttgcataccttttctgatggaaaacaaaaagattgaaccagtcatcttcactgtctgctttcatccactgtattttgtaatgtgtctgaaaaacgatatatgcacatacatgtgaaattattcataatcaacaagttaacatctccatgtgcacaacacatgagaattcttcaaatcgtaatcatgcgctctttttttattattataaatacctgtaacatcctgctcaatttctcatcccgaatgttaccaagtccatatagagcaacagaagttgcaccctgaatcaagtagcacaagtcacagaattattatcttacaattgttgattacttggagttgtgtatagaacaaaataaatttactttttttataaatactggacaaactgatatttgatcaacatcagaactgccaggatcaaccttcccaaaatagttcacaaaattgcaagcagaaaggatgtcagtggcagacaggccatcctacaaatagagaaaccaaattcgttataagttgaacaaagaattaagaccttgaggatatactttcatgagcagaaatgcataagtgtttgtgagatttcaaaatttgtccaaatagtatttactatgtgttatccataccactcctgctgggccatcatgagtcccatgtacggtgaaaacaggcaagccaatgttgaaatttgggtcttcaaaattcactcgaccaaacctgaatgacatcataatgtgttaagttctgaataatagttcagtagccaggaataaataattggcttggccttcttaatatataattagatgatgattagctaaagcctagtgagataaagtaacaaagttgagaagttaattcagccatgaaaagatcaaataatttaatttactgcacctgttctgcagacaggctgcctggtcactgaccacctgaaactgcacctgatggtcattcaggcagtagcttcttatgatctccatgctcttcaccagcgtagaaatcgaaggtttgttctcgtggaacaaattcccaccaagaaggatgaaatcaacctgcaaatttaacagtgcatctccaaccatcatatcaattatcaaacaactcggattatttaaggtagaagatggaagcttttcatttgttattttcagcttaattatgaaactgaaactctgcattctatgtacaaagttttcttgatgtggtccatttgtttcagtatttttaggtcataggaatataatggtggtgtgcattctcgttaatccaaacaccaggagttattcttctactattttaaaaaaatcaaacgactcataaacctgatcatcacaaacataagatgatatttaacttggcaaaaataaaaactgaattaatatcaattttcgataagatatttttcgaatatgttgggatactaaggagaaatttagcaccagtattgatagagaagaaaattgtgagaaaacctgggtttgagggggatcaaactctggccaatggcatgcccctggtagctctctaccagccaggctacacgttgttctcattttttgataagatataccttgtttataactgctaatgagcagatctcctcaaaagtatcaaatgagtcgaatcttcggatctcgtccttctctaggtagccgagatggcagtcagtcgccaccaatatgcgcagcatgctattttcttcttcatccctgaagaacaaaacacatatatcattgcaagtaacaatttagatcattgcaaaagaatagtattgtaacaaaagataacttgtttaagaaaggatagaagaaaggggaaaaggaattaatgccgattttgtgctgatgatgaaacaattgagcacttatttttaaagtgacccttggcaatatttatttggaattcatggtagcttgtacctttaatctgaaaccaggaaattatatagcccacatgtgttgggacctggatgcattattttgataaagaaacacagaaaatgattattggaggtgtggtgtcaatcatttggtctatctggaaaacaagaaatgcaacatgtttgcccccattctttttagctatttcaccgaattattaccacagattatttgctccacgcctctaaaatacgctttctaaaaaatatattctactatttgtattgcttagactacttgctttaagatttttgttaactttatttatcaaaatattcaatttatccctataagcaagtagataatccactgccataattcattcaatgcatgatttgtttcaaacgggcacgaaatgaactaccaaatgttccaattgaactaatacactacacttgtttctagctagatttcatcttggtcaaaaggaggaggaaaagcaaagaaaggtgcaaatgcaggacgcaactattaaagcgggtggcttgtgaagtacatggatcaatgtatggttgagggcttaatgcaagacaactgcaggaaaccctagctgcactgtttggaagcttcttgttggaaagttgaaatgcagctcattttgagcttctcatgtgtgcataaaaactcctttgatgtaatgatgtagtgtggtaattttgaaggatctttggcttaattagactttgctaggtatgcagaatggtggatttgactctcacgctgaatggtgggatttatggtaccaagttaccatgacaaatttaattgtcttcgcaaacttttgtcttttaaccttcatttctagtgacagaaatgtgagaagtgtgcctctcttcctaaaaaaaagatcattgcaactcaattcatgcaggagtaacttctaatgaaaggagttaattgaagtacatgttcaaacctatggattgtattatttaatataaatataagttctaataaaaggagttaagaagcgtacttctacataatgtttacaaatcaacccctcagtaccatggacactagctttagttgctagtaaaaccgaaaaatacataataaaactatgattgcatcgaataatatataaaatatatgtaccatgatgcaaagctagcatgcattgtgtatgtacaagaaaatatgtttttattttacactagctgcagacccaaacttaaatatgtgacatatatatgtcatgttgattgagctataaaacattgttcaagccatcatattgtatcaaatggagtgatctgccagctaccattttcaaatgtttacaaatggactagatatccagttgttaataattaattgtatatatatatatcgatatatttcctatatgcttgcatgcggtacatatgatacatagcatactatattcatcattgaattcgtgtatgaaatgacaagccatgcaatatcccaaccctatcttgtgatctactagcttaacttgttccaaattaattagggggtttctgactagcagtagaaaaccaaactaataataaagcgataaacaattgattatgtatatatcttaattacatttcggcgtctggtttataatggcatatatattaccattataaatatatattttcaggtatatatacatttacatttttacactaattaattagctgtgctaacgatcatttgtatatttggatgttagtttgagaagttagttttgcatatattaattacacgtaaattaattaatttaccacaggtactcaactaatagatcaggacaccagaactgatgctggatggcacatcgatgctcctatagatacatatatatctagctaggtaaccccaaataatgaatgaactcacacatgcatctaggagaaaaaaaaacaccccaattaactctaatataatatatacgagcatatgcatacatagttgagcatatgagtatatgacagtatttatgcaacaataatgcaagtgcaaattaattaacttgggggggggggggaatcaatatatattcactcagatcgatcgagctcacatttggtattatatcttacgccttaattagctcgatcgatcgatctgtggagatcgtcaacgagacgacaagaaacaatgtgctcgatcgatcgttcgaccgcgtcgtcgctgcagccgtcggcgctagctgacggtcgatctgccggccggccgcggagatcgctcgccgatgcagctagctagctagctctctcgctggccggcagcaaatcgatcgagagaagaagagaggaaacaatggcgattagctagttgcgcgcgaggggagctggatttcgatcagatgagcagatctcctaaagaagaagaagaagaagaagataaaggatagctcgcgagctagcttatatatgctcgtatatatgtagctgaatagtcagtcagtcagccttccagcttccagagcaagcctcgctcagctggtgatagctagctagctggggctaccctagctaccttacgggctcatcgtttcagggtgtgtttagattcctttttttttttctaaaaatgtcacaacaaatgtttggacacatacatgaagcattaaatacagacaaaaaaaaactaactgtacagtttacatgtaaattgcgagtcaaatcatttgagcctaattgcgccatgatttgacaatgtgatactacaataaacatttgctaatgattcgtctcgcagtttacaggcggaatctgtaatttattttgttattagtctacgtttaatatttcaaatgtgtgtcgtatactttaaaaaaattttgggcagagaactaaacacggccttagttgattttgcttatcatggaaaatttgaattttcagttgattttgtggttttctcattttagtttattttttagtctttgcttttaaatcgtcaagaacacatatatgaaagttttattcataaattattttttattttttgtttgcaaatataatgtctggctagaataagccaaatgatgggggctagatcggagtagcatttactgcagatgcatttcatactcctccgagaattaatccaggattaagtgtaatcatttcatttattggctgattataggatatatatagcgcttattattggaaaaagttatggacgagatttttgtatatgtatttttaacgacttaaaattactaccaaaataaactaattacgatcaaaagaaactttaacatcaatattaaatttgtgggtagaattttggatatgcggtttggctgattagccgtttggcttgtggaaaaagatactcaatttacgtattaaatgctataaacttgaaaaatagaaagatttattatttcaaaatcacaccatttgacagtttggaagcgtgctcatgataatctagcagctaaaaaatatataaaaaaacaatggtcaatccaccaactatttaattaattccttggatctttttggaagatacttttaatttagagatctctttaatttatggccgcaacgcttgtaagagtaatagaaggttataggcggttagctacaagtacatgtggaggagagagaagaggagaaagaaaaaaagtgctgcagatttgtagcccagctataacacgaactttaagataagatattgtgtatgtataaaaagtaggccaagtattaatggtgcaatatatgtttatataaaactatacagaggctattaaagtggttgtagatgatatctaaatttttagggaaagaagttggctacactattaaactcgctctaaaacgaagatatgtgataaagatgaataatattttttatgaagaaattttatgcttctaagggccgggtacaattgaggacggagaaaaagtagcggcaaaaaaaaactaattacctttaaaattaaattctaaaactcaaaaaccacagcttaaggtcctttttgtttattcaataaaagttggatgtaggggcggagccaggattttgagccactagggtcatagtttttacttatactaatgtcgtgtttaaaactctaattattctcaagaattattttgagctactttcgtgtttaaaatgacattagctcaaaattattttggatctagagctatgaggaagttgggattgtttcattttgttaaaaaaatgtttaaactctatattctataagaatgtaggagtatttttaaggtccaaaaaattaaaagttaagactataaaactaggcatatcaaccatgtgtttttcagacataaaagtttgttctgaaagttgtttatcacttcctctatctcaaaatacaactacctactctcttttttaaaacattaatgttagggtgagaaatagttatggttggttgaaaaaaaaagtaggtgaaaaaattaaatcagaaaaattgtgattggttgagatggaacggttcatagaaaattctattagttgtattttatgataaattttaatattaaatgtaacatattttgagacggagttagtagcttaaaaaacacatctaacatctagtagttgattagcaaaactacaggcctaatgcattgatatacacaactcatagctaaaacaattagttggttaatatctactttagatttgaaacatagttgacaaaaaaaaactttaaaaaaattgtcatggtttggatagagttcatgaaagagtcaacccttcttctattttcgttgatttttagtataaaaaatccatttgcccccattaagatatagtaatttttatgttggtttttattatcatacttttcaaattgctaaacagtatattccatgtgaaaacattttatatataagttattttaaaatacatgataaatcattatttcaacttagtaataattaaaacgcaacactttcttgtttttcgtacctaactttatctctacctttaataaaacaagataatctttttattaggaaaaaatattattatcttcgctccaaaatatattaactttccattataaatctaggcaacattttgggacagggtagtatcgtatattcaattgttctcactagagcaaaaatagttcagttgttcatcacattaattgcgcaaatcctaattggcgcgcacgcgcccctggcgcgcacgcgccggcccacacgtctcatcctcagccattctcagcgcttgcgctggcgagacgcgcgtttatttttttcggaattttttctctatacgtataaaactgattcggttagttctaggtaatgataataattaagataagatttgtcttttttccgaagattattttaagtaataaattgaaaagaaatatatatgtgaagtcaaattctaaaaactttcaatccagatttgaaaactttcaatctagatttgaaaagtttttgaagttaaattttaaaaactttcaacttttcatcccaaatttaaaacttttcatcctagatttgaaaaatttcaagccagatttgaaaacttttaactcaaatataaaaactttcaactcaaatttaaaaactttcaatacaaaatttaaaaactttcaagtcaagatttgaaaactttcaagtcaattttgaaaacttttaactcaaatttgaaaattttcaactcaaattaaaaaactttcaatacaaaaattaaaaaatttcaagtcaaaataaaaaactttccaattctacatttgtaaagaggtgtgcaaaagattaaaaaaaaatcggaaagaaacggaggaaaaaaaacgcgctcagagaaaaaaaaagaggtgcgaacatgaaaaaaaaatgtactgcgtttttttacacggtaagcgctagggttagtaggaacacgcgcggcttcccgttctggcgcgtgcgcgtgcagtaggaacaccccattaattgggcttcaaatcatacacattgaagcaattaggcttcatctctaaaatgggctgaaggcccaataagaaaagtcctccttatacctctataaagtgattgcgagaaaaagaaaaaaaaagaagaaaaaaaaagagaaaaacacaacaccatcaacccccgcatccgccaccgccgccaccaccccctaactccggtaagccgccgccgccgtcgccggcgggcgccgtgtcttctcccatccgtcgtctcggatcttgcagcgaaatttgacaaagtttccctccttgcctcgcagatttgaagcgaccagaggccgcggctaaggtccgggatggtaagttgtaaaccctcttctcccctcctggggtttcgggtgctcgattggatcgatcccgggtgctagttcttggtttggtttggtgggattgattccggtttcgtgtcttggtggagcagtcggggcgcaaggagacggtgctggacctggccaagttcgtcgacaagggcgtccaggtcaagctcaccggcggcaggcaaggttggttggtttcatcaccagtttaggtctggattcttgaatactcgtagatgtgggtatagttttgtgccaagaaacctcagtggcaggggcaggaaatcctaggtctgcagcaaaattgtagagtagggtatagccagctcgaacagcctcattataagtgaaacggtttaattagcgattaaaaatataatttatgggtaaaacttttatatatgagttcttggtgatttaaaagcaaatgctgaacaaaagaaactacgatgaaaaatcaccaaaatcaactctataatagttttaaaattcaaattttcacttacgcttataagctgaaggctaaatgatggggttggaagaagctactaattatttcagtaaaattcactgtgcgcatcagctccagtccacagtaatgatctgagatgtcgagcgcagcatccatgtggctagttttaacatgtcctctgaatgcttatagcacataattgtgagttttcaagcatggtggttggtaaattaaggttttgtcacaaattggtcatcttttagcatttcttgtgatggatcctgctgtccaagggccatccgccacccagttaaaattaacgagtagcaactttatcaattgacacttcctaattccttaatattctttcataatgaataagtctggaaatgagctccgctcaatcccttaaacattgattccagtgttctgtatgataccacatataaaccagcattccacttgcattcattcagaatttcagcaacaccaatatgtgcatgtggagaggatttggccctactagaagcttaccgccttctcttccagttttttactttcaatctgtatgctcacagataccagattctgtgattgcatatttttgaattacaccttgtattctgtttgtagctaacctcatctagatagtgaaggcactctcatggttggctatcctgataactatatgatgacttttcacctttattttttttcttttttcagtatcattttacggacagagtggtaaaatatcatatgctaactgtatattgaaatagaaactccgtcaagcagatgagcggccccttatgtaatatcttaagttttgacattgtttatagtagttgcaaggaggttagccattagcattgatattaagataaagattgaaaatagactaaaaaatgacagtagaactgtttcaatttccagaaaactcgtttttgttatcctgcagtttgttataatacactaataccacatcacaggccataactttggtatttctacatctgcagttacagggactttgaagggctatgaccagcttctaaacttggtgcttgatgaagcggttgaatttgaaagaggtactgctgcatatgttgatacattgcattgttttgtttgatccccattggtttggagttttgagtataaatcacaaatctatgtatttggaatcttaactaagaagaaatttccatccttcatgcatcttgtatgtttatgtggtgctaatctactgttatgtacaaagaagattgggctggaatacagcataataattacacatagactaaattttagttttcccattgtcaaacaatcatgactggagggagtactacttgctaatgtaggtgtggtacagttgtagataacaaatgccttattaaatcttttcctgcaaagtttagtgaagctctcatacatactttctcattttgtagagcaagatgatccattgaaactatcagggaaaaccagacagcttggtcttattgtaagtttctttgcagtattgatttcaatatccaggactgtattgatttcaatatccaggacttatctttgtcctatattatttatattgcttgccgattgtagttctgatagttcttttctctaatacacgagatgtgtgtatcatttcattaagagaaggaagctctgagagtttttatttccatgctatacgattattttgcactttgctgaaatctgcactagttttttttttttctggaaatgttgattcgatcagatttacaacaaaacagtgattaaacaaaaataatctcaaaatcaagagcttggtttcttgcaaactactagtttgtttctgccatttgatttctttttggctggtttcatcatcctgacacctcagctccaacgactgtttgttgcaggtctgtaggggtacagcggtgatgcttgtatcgccaaccgatggaacggacgagattgccaaccccttccaatctgatggtgcataaacctgcaggagctgatggttctcctagtcaagatccatgctctcccagtagagaggcctttgtattaactcatgtaatctggtgccacagtctcttatgactcgtgtctcttatgaacaccaggtggtggtctgttctgtaccactcgaaactgatttctgaagatccttgctttgtgtcagatatatgaatcgcattatgctcttgttcggtttgttcatatactgtgcatggttggtttctttgcttggttcagctttcacctttgccccatctgtgactgtgagcttgcttgcagtctcttctgcataaactgcgtttgcaacagtcggaaaaagacatggaaaagaacagagttaatttaggcatttgagtgaccttccgtttggtggctgttcctgcatcaggtgattcagatcattaccttaagcagccatgtgaagcttcatagattgcatattcttctgccctgtttagaatgagttcctgttcggattgtgtattattcaatcgacagtagtgacaggaatctgttaccggatcatcaaaatctgctcacgagcgataccatcagatttcatggaatctgttactaaacatacaaactggtgaaatccaaataaattgtcaaaaaaaaaattcagtttgaaaatttttgaacttgaccgaaaaacaagtggtttgtgttttcgacacggtctggaaagtctgtacttcgcgaaattcaaaccggattcccctggaatcctgaatcaacaaaacaataagcaaggaagagttacagagttaaataaatattatacacgaacgtactaacaagttgagatggccgagttggtctaaggcgccagattaaggttctggtccgaaagggcgtgggttcaaatcccactctcaacataatgtttttttaccattttatttttcctaagctattttccaatccttccattttatttacttttttcacaatgcaaacaaaaatgcccctgttaatttctccttttaattcacaataaagtccactcaaacaattttgttccactcccgacacaactttgttaccctttttttgtagctatcttcaaatccttagcaatgacaatctttatttactttttttttggcactgcaaacaacatagcccgtgttattttctcctttcaattcataaattgaacaggcaacagaaatagctgcagtatccctttgtattttgttatactgccaatctcaatctgtacctcgttacacggatctactcgctgcatcacctcatattggctcaaaaatagttaacagttctgtagtattgctactgggaacgagcataattgctagcctccagttctaatcattcatccctacgccattacacagaaatttagagactatctcctcccactgaaattaccatgtcagcattgcagttcaagctagcaaacatgctggctaactgtaaacttggtgaaacttgccccacattcgagtcgttgggtctgaccatctgaatcaactggaaatagaatgttgccacatagcttcactccgataaaagttggtgcaatgcacaaattactctcgatcgcaatcactaggtcataggaagttcgcctgctcttgaacttcgccaactgtagaaaggaagatatcaggtgcaacactaagtcactgtaacagcatgcaaagtgaattctgaaagcaatttctcaccaggaagttcaacggctaagttagcttgagcatcagcatccgtgttaaattcctacataataataagcaaacgtgagtggtacagtgattgaagttctcgcttccagtagtttggagtgatttttaaaaattttaatagtacatgaagaagtgtgatgattgcccattggagaggcagtttcagaggggcaaataagggagttgccaatttccaatggaaaataaagagttaattcaatataatgtaatgtggtgccaaaattcatatgccataccggaatgatagctgatataaaataaaatacagcaagcgtggaagacagcaaatatatggaacacctaccctcaaaacatggttgatttgaaatgtatgaaatcttcccttaatttccttaacccttttgcacaagtcagccatagtatcatgcctagcacgccatacatctgagacctgctccagaaagtcaacatgttacttatgttaagaaacgttaaaattgatagagctgccacctgctagaaaagctcttcaacgagctgtagtgattagttccaacagagtttgttatccattgaggcattgataatcaaggccttgattcaaaatatgtactgatgcctcaacttgcacttatgttgatggatgcagcacagataatttgataaaaaaattctttggtgaggaaaactgaagaacatgacagatcaagtaaagcacagattaaaaattttgcttttaaaaaattctatttgttggaaatttaatgtttgaatagaatgatagactgtgcatagtcacaacaaactgcagtacaacattcagttatctcctgatgattctaggctaaagcatgaaaaatagaagtagtgaaggttcaaccaaaacacaaacctggttacaaacaagcttagaatctccttgagcacgtatatacttgaatcccttcttggcagcatatgttagccctaggatcaatgcacggtattcagcagcattgttggttgcaatacccaaaccctcccgtagttgagcaatctccagtcaaacagtaaaaacacatcaccagttagtcatgataattgaagattaagaaagcaccccagtatagtactgtaggtgtactgtgtacataccacagttccatctagtcgccttattactgctccagcacctgctttcccaggatttcctttagaagcaccatcaaattcaagaagacaagagagctgtataagatgaagtccactggtgagaacaagtcagcatttcgttgtagtgaagacaagtccccaagtacaaatgttagtactgaatatctaggacaaataaccaagcaagaaggcagaagcatttatagctagcacattccattgttcatactcacagaactattaggtaatggttcttgttcggagactttgggctgtttctttgacggtccagtttccttcagcaaatgattgttggtgagagaatgtgatatgtaggcaacacattttctacagcgggcactttttaacacaaacacatcttaacacttagcttgaaaatgatcgatactcaccatctctagtggcctttttaaagtagaagtcccagttccatcaggttgctgaaacaaaaagcggcacacagtatgttatgggcaaacacagaatcaaatagtaacgcaacaaccttggtggatataacttaatgatcaactcaacattcaaggtatgagaaactacatgtgagaaaaactaagaccctgagaattgggggcagtttggcattcagtatttaagtatactatattaatcatgccattatactctgatgatgatcatatatgtctttctaatataatgtgtagcatgattgaagttcaaacagataatgaaatggagtgaaatggtaataaggtcaaacaaatatatagaaaatgcgaacataattaaggaagtggtgcttggtaactggaaaggtaagatccattataaatgtctaggctgaaattgctgtacatcaacaaattagcattgcacaatacactatgggggcacagagaatgatcctttaataggaaacacgttaacatatctatgcaacattggcaagtgcagaggcatatttctgaaaaaaagctgaaatcacaaacatacatcgtctttacctggaaagggcatggaactaggtcatcaaataattcatctcttgcatctgctgcattaatggagtaaagaggatttcttaaaccgcgcgcagcgaggtattcttctgtctctttacgcaaagaatagcctttgtacaccgtcacagaaggatcacatacctagtaagatatacttcacataagaaatggctcttgactacaggtacccgttaatgtcgttgtgttaccagcaagagaaggttaaattttgcatcaatgacactcatcactcttatctcctaatctttacttctctacccactaccacaacaataattttagtatcctgcgaaacgcatgaacaaagctgcataatgcgtactataaagcagtagcccatcttttcgttcaaggaatacagctgagctacaatgaagtgcaaatgtctgcttatggtgtgacattcatagcaaatgaaatgcgacaggagagcaagtgtttgattcctgtacttctgtatttgtgaggagagatggtgaatgcacataaacataatgctagaatgagcagtcaaagaggacggcgtcgcctttaccgagttgctgacttgagcctggcaatcgctgaggctcttgtagatgccgatgacgtcacccttgcggacgacatagaacggctcacctccgtccatcgacggcggcggcggtggctggctgctctgcttcgcggcggcggcggatctcttggcggagcgccgggatgaagcggagaagaagcgctcgagggcaaggccaatgggcggcggcgcgggtggcctgagcaccaggtgacgctgctggtggtggtggtgctggctcagagctcctccggccaccgcgtgcctcctccaagccactctagaaattccacagagagaagaagcgcaactcctcattgggtagctgccagggtgaaacccagtcagggggatggagcttaccaccttgctccctccccggcggcggcccggctctcctcccgcgttgctgctgctgcttggggagcgcgccgcaatcgattccggcgaccggcggccggcgtgtcgtcgggggggaaaaaatggtggccccggcggcggagtagggttccacttccactttggaatgcttgcctttgctgggcttcgtgtcgggtcgatttgggccgccctattgggccggaaattcgaactatatttcggcccgtttacattgagagaaaaatcaagaaatgtacttgacaaacatccaagtcaaaaaataccatcggtgaatgctagtttcacaaaatacaaggtccgacaaaaattgaaccgagaatacaaataatctttagtatcggtactaacaatagcaatgtgccgttagacattttaaccgatgctaaataccttctttagcaccggttcttaagaaaaccgagatatttgtaattttcgccgatcgagcaaaagatcggtttttcagtggtgtacatttctatcgtatgtagttcttcttacctgctagaagggttcagaacaccctatgtttttttctacttaagtttcatcgtatggccaaaattgattatagcttttttttatttagtgaatccaatgactaatattcatcagatatggtatattttagttgtatgttgggtttcacttttcattagtcaggatatatcatttgtacaaacaactttgtccaaaaatactattgtcgttagggttttattgccatccctctgttaagtgctataggattaacaatgtatttaatggaaagggacaaaactctaacaacaacgatatttttaggataaagtcgtacgatgacattgatagaactcacgtttattgatggtatttattggaattgggcactcgttgtttattgaattctcttacaataatgggccagagtattgggcttctgaaattgggccacggcccatgaaggcgtggctcgtaaaacctctcctccgtttagcccacgggctgagccgtctcctctccgcaatcgcatcgcctccgacgagctcgcggcggccggccggcgaggcgactgcgactccgacgaccatggacgccgccgccgccgccttcgcccccggcgggcagctcttctccgtcgatcccctcgagcggcacgcggcgaggggccatggcgtggtcacctccatggctgccggcagcgacgtcatcgtcctcggcacctcccgcggatggctcgtccgccacgacttctccttcgaggacgcccatggcacgtcctcccctcctcgccctcgcagccgccatcttcgccgccgcctcgcgcttccgctgatcgctcctctgctgctgcagatctcgacctcgggaccggccgctccggcgagcactccgtgcaccgcgtcttcctcgaccccggcgggaagcactgcgtcgccacggtggtccacccggggggcgccgagacgtactaccaccacgccaggtggccgcgccccaagctgctcccccgcctccgcaacgtcctcgtcaatgccgtcgcgtggaaccgccaaaccatcaccgaaggtgagctaatactactgcatatactgttcctcgatcgaattgtgtctcgattccggcagtccgtgctgtgtatttgttcttgattgtggagttgtttgtggtttcggtgctgtagcgtcgaccaaggaggtgatcctggggacagaggatgggcagatcttcgagattgcagtagacgaggccgacaagaaggagaagtatgtgaagtcgctctttacgctctctgagctgcaggagggcatcaagggcctgcaggttcgagtttgttgccagaggccatcgagggctgcggttctgtacttgtgttgtgttggtgttatttggttggaatgagcgtgatggaggaatttggttgtgcagatggaaaccgccgtggttgggaacgccacaaggttctatgtgatggctgtcacaccaacacggttgtactcattcacgggcatcggttcattagaagtaagtacaattgctcaattttatcagctccaaatttcggagacatacaccattatagaatgtaatgggagcaatctagatcgaatttagtgaaaagaaagacccagatttttcacttcggatatcaaagtcctcatggacggtgtttcttgatttaataacgtgactcagtaacctcgaaagtgctatactacgcgaagtcagtatgcctcttttcttacagagagatatgcgtgattagaacagcttgtgatgccttttgccattttagagagcagcattgcatgccaacagtttctatagaagattttctcttggtttccagaatttcagccctacaagatttatttgtttactcattttctcttgatgtaatatctaataacaactatattgcacagactgtttttgctagctattctgatcgtgcgatacactttatggagctcccaggagatattccaaataggtgagtataagggcaagtgctatggtagatgtgactaccacctccaaatttatctattttattcactcataaactaagaggcaatccatacaatgtatcacctctagtacacaaataccaatatatctaatactctcacatccttcttgaaatttgtgtggaggttgcctcttgatttaggggtggctcatcatctctctcctcacttctttccttcacatcatcactcaatccaatgtggcattcttaggggcaacatatgggtcattatagtacttgccctaactttatgtgatttatacagtactatacagtggtaactacagtttgtgccacccactagaatactttcttttagtgagcttatgacaatgtatccattgcatggaatccagtgaattacatttctttatcaagcaaagaagggctaagcattttggatggctttctggagctggaatttaccatggtgaactgaattttggagctcaacacaggtgaactgtagtttttggatttaagttgattccatcatgtaacatgtaactgaagtggattattaacttatgttttctttgttatctaatccaaatgtcattgaactgctaagctgctagcattctcttagtgggcatatttttctaatagactgagccttggtgtgccttttgaccttataagaaatgtggcaagtaatgtaatcccccactcctaaacataagttctttagggaaatgtaaagtagctactttggcctcaggaaaaacaataatagttttctcatcaagataatcaaattgtcatcttactaataatataaatataaagtgtggtagaatgatgatagtcatacaagaattaatgatcaatgttatgccttcaagaacttgatgtcaatcatgtcactggatattatctatgaacagaactataggactacatgagtaccttagaagattatatctaatgaatgttcagggttttatatattgcaaaccttatgcacttcaaacttgataattctctgctagctgtttgagcttctctttagagacatgcatgccaatctcactgagccaggtgttggcactggcacactgcatgtgtgcaccttcttacttaagtgtattttgatgattatatataaaagaactacttttacagttttatgaagttcggctccatgaactcttaggatctcaatatgacactgttttttctttcctttgggataacttgcagcacttcttttattagtttgtctcccattctataataataaccatataattacttttttctgtattttctatagtaatttgttaaactaaatttagttttgcagctctacaagtggggatgagaactttgtcgaaaataaaggtttttttgactactcaaaattgggagaatctggtatcaagccaaggtcatttgcattgtctgaattccattttctgcttctcatcagggacaagattaaggtacaattctttttaaaaaatctatactgttttcactgtgattcattttgctttctgtcactattttgtcttccctgttgttttatgtattcctttacaaagcaaaagcataacctgtgatttttaggtagtgaacagaatcagccagcaaatagtggaggaacttatagtcgatagttcaccagaagttacaaaaggaataattggactttgtagtgatgcatcaactgggcttttctatgcatacgatgaaaattctatattccaggttagagactatctgattcttgctttgatgtaataattgccttcagagtccagaattgtgttgctgatgaagctatatatttagatttcatcatctgatgagggtcgtgatatgtggcaagtatacctggacatgaaagaatatgctacggcactgtcacattgtcgtaactccttccagagggaccaagtctatctagtgcaggtgatgtttatttgcacttcgatcccatgcactacttttttctcctttattattttcccctctatgataagctggaccttttttgttttgtgatgatcaatgacttctgttattgtataaatatcttctcttttgtaggctgatactgcattcaatacaaaagagtactatatagcagcttccttctatgcaaaggttaaacccacactgtttaattctgttccttatttttttaaaaaaaaagattttgttgtcctgttcacgttgatactaaaaaatatattctcttggtttcagatgaattatatcctatcatttgaggagatcagcttaaaatttatatctgttggtgagcaggtagtttagtctgaacttctttttttcttttttctttttttttgtgaggagtctgaactttctaatatggtatattattgcatgtttgtgtaagatctatctttctaaaatactcatctgccatttgatattgtcaagagcttctctgagatatctttgcttattgatgtattcaattgttttttttttccctgatctttgtcactgatgcaaagttcaagtgttgctagttccaagattgataatttgaaatataatataatgccgttaacattgtgaaaacatagaggaaatgttctgtcatgctttggtacaatctaagattcattctagtgtaactatttacatgatacatgagaatattgtgattttatttatgaaataattatcttcctcaacttgacaggatgctctcaggactttcttgttgagaaggcttgataacctaacgaaagatgacagaatgcagattacaatgatctcaacttgggctactgagctgtacttggacaaggtaccaattgtttgtttttcaaccttctaaactaatataacagtcttcatgacaagaaggctggtgtcctattttcattgtttgtacgtatcctttttttcctgctcttaatacaaagatacacagtcctctgtattgttgagaaaaaggtaataccagggccggccctagggggggtcaggccgtgcggccacccgaggcccccaaaatctaggggccccctatgcacatacagtatatatactatgtattgtataattctagtccacgtgccatggatctatattaagttagatagctgaatagcctaatacagaaaatgaaatttagtccatcgttaggcctgttttaacgaagccgaagcaatcttcatttgactcctgtcgctttgccttgatcacatcacgccactcacgtcatgccgcctcgatcacgtcacgctgctcctgcgctctcggtgacttctcggcgtctcgcaaacgaaaacagcaagttggcaaatcgcgactcgccagtaaccacgctcgtgtcaatcgtccgccggtcgacttctctgctcgctactgctatttatttctcattggagttttaaaatgttatatatagataattttgtcacatcgaatattaaatggtatgtgtttatcagactatataaatatataaattagtttatgtatatatgtaggggcctccatataagtttttgccctgggcccccaaaaccccaggaccggccctgggtaatacaagatatgttccattgctattggaaatctttcttcagtcttggtttcagtatacttgtacttgtgattattgcgggggcttatccagtatatttggtgcaatatttgtagattaatcgcctcctgttggaagatggcacaggagccacgtcaaatgctgtagcagattctaaagactcggaatatcgttcaatagtaaatgaattccgtgcttttctaagtgatagcaaagatgtattagatgaggcaacaacaatgagactgttggaaaggtatgtggtaccattgttgcacaatatgcttcactggtattttaggttgtttaaattctcatatatgtattgtacaggtaacttacatatctttggatagaacctgcataattttaatattccatacattaatactatatttaaaattgttgaacatttgccaaacaaaggacctgatttaatgtccatttgctttaaactcagggctttgtgtacaaccagtaggatttgttctattaagaaggatatcatctttgagccttcaatagctcatttatttaaaaggggaaatgcagcaagactgcaaactgcatcaatggatagactataaaatatttcattatttagtttatgcaattctgttgacttgtcatgaataagatggcggtgtgttctctccatttgttgtgttgctgattatatgtgttccccaactggtaccttgaaaccttttgcagttatgggagagtggatgagctggtttattttgctggtttaaaggagcaacatgaaattgtggttcatcattacattcaggtcagtgtcaggcatttatcatctaaaggtgttaaatactaatttgtgtcgagcataacaatagtaaatagtataatctgccaagtgctagctagtattaacattatgtttgctaatatgtttgagcaagcaaagatatgcataccttgattatcggcctataatgggtgataagagcttgtttatgccacaaactaattgattattttatagaacagttcatgtaacatgtgctgggatggggcttgtgccagccagatatttcaggctaggctatgctttgagcaggctcaatgccagcatgatcttgcattcttaccatagtctaacatcaaatttcccttctatctgttctcttgagcaactgtagtttctatatcattcttctttgtagaatagttggaaaggaaacatttataatattactggagttcgttgcacatctttctttgaagccaattgcttcaaaatcattgcattcagttatcttgaaaatacaagttttttacttattatatgaggtaccttttgcacttggaacccattggcattagctgagatgtcaagtccttatgcattttctatttactttgtcagcaaggagaagcaagaaaggcattggaagttcttcagcgacataatgttctagtagaccttgtggtacataatggctttacatttattctttgaatgctgcagtatagaactcaaaataagtttattattgattctaccacaacaaggttacattttctgttttacacaaaattacacatttaatattttttaattctagccgttgctctttaacttgtttttgtgcagtataaatttgctccagatttaatcatgttagatgcttatgaaactgttgaatcatggatgatggcaagaaataagttgaatccagggaagcttataccggcaatgatgcgttatgtgagcgaaccacatgccaagtatgatatgctaatggcttcttatacgttcctattcccctattgctataatactatatgaatcctttaatattatgtgatatcttaacagttgacagccttaccgtcttttatcacaccagggaactctgaatgctatatataaaaacattgttactattgaaacgaattttgctactggtggaagtgaatttagatctgttacacttaaatcccatatcagatagtgataattcgaatcaaacctaagaatgcctaaactccctatgttcagaagctctggaacaaactgcaattctatgtagccaacttgatttccataatcaggatgatgtgatgaattcaactcttgcaggaatgaaacacatgaagttatcaagtacttggaattctgtgtaaaagatttgaacaatgaggatcctggagtgcataatttgttgctctcactgtatgccaagaaggtagctcttccagtagtgcattatttgttgctcttgctgtgtgtgaaattacactttatattcttacaaagtaggaaaaatatcatgtaattaattttgttgtgtatgtttcttttttatgtgttggaaacattaaactgtaatagcagtaattgcttactttgcactcaattcatcattcatgtttctggtggttcttatgaggttgtcaatgccataccagtcaagcgtatatttgtcaacacatataactaatgattttgtatgtgtactctggtttattcatgtgcaggacgatgagtctcagcttttgcaattcttggacactaagtttggtaaaggacagacaaatggccctgagttcttttacgaccccaaatatgctctgcgtctatgtcttcaagagaagagaatgcgtgcttgtgttcgtatttacagcatgatgtccatgcatgaagaagctgttgcacttgcattaacggtaaacctcattcctcactaagtctcatcatttctttaagagtctactaattccattcaataagcatcccttgcgctttcgcatattgatggtgtaggattttgaagtgttcttatttttatgaggctttcttattcctttactcaatttggtccttgctaggtggacttagagcttgcaaaagcagaagcagataaagttgaagatgatgaagaacttagaaagaagctgtggcttaaggttgcaaagcatgtcattgagcaagagaagggagtcaagagggagaacataaagaaagctatagaattcctatcagagactaacaacttgttgaagattgaggatatcctgccatttttcccagacttcgtattgatcgatgactttaaagtaagatataagtccaggcagtcagctgctttacagaaaaattcctcctaatgtccatttctctgttgaagatccacaactgcaattttcttattaacaaaaaagttatctgaatgaataaatttcgttgttaattattactagtccacattttctgcattacctcttttctcagcattaacagtgaaaaatattgtctaaacaggaggaaatatgcaaatctctcaaggactatgacagccaaatcgatcagctgaaacaggagatggatgatgctactcgtggggcagacaacatcagaagtgatattggtgcccttgctcagagatacactgtaattgatcgtgaggaggaatgtggggtaagaaactgctcacgatacccaaaatggtgtagttt

SEQ ID NO: 26867 - DNA, 6225 bp, Oryza sativa
actaactgtcttcgctgctgtatcatggtgttaactcctcactgtgcattaacaggtgtgcaagcgcaaaatattgactgctggaggactgcaccaggtaggaagaagctacacatctaccggacacatggcccccttttatgtgtttccttgtggacatgcctttcatgcgaattgtttgatcgcacatgtaactcgttgtaatagcagccaaacacaagtaagtccctatgcaacatttcaattgttcatttccttattttgatagttcaatctcttgtaccaattagttacggatgaattcatttacctgtaggctgaaaaaatactggacctccaaaagcggcttagcctaatggacaggaaagcagcaaaggaaaatggcggaaacatgaatggtgaatctattatcagtgcgacaccaattgacaaggtttggtcacatccaaactacgaaatcccgagatctgcatttcttgtactaatgccatgcatgtttcttgtgacagttgaggtcccagctggatgatgctgtagcgagcgagtgccccttctgcggcgatctgatgatcaaggagatttcattgcctttcattctccctgaagagtctgatgaaaaggcttcgtgggaaattaaaccgcaaccaacgggtcagaaaattcttccaatgaccatgtctatatgattctactagtaaaagctgagatggaatagaatgtttttcgagtttgtatgtgattttgtaatgctgaatatatgctctttcatgtccaatttctggttgggtggctttggtttttgataattgcccagctcgtgtatctttctgacgagcagaacattagctatcctatccagaatagtttgtgtacagaaacatcatcttccacttcacttgggctcttgtacatgcctcctttcatcaactttgctcataataaagttgcgatttgttagggcatataggcgctgaattatgtttcctcaatatctgaaataagatttgataacttcagaaaacaaaaacagaaaagcatttttgtgatgtaaacctgcaagaaacaatcgcaaaatggggcactatttgtcacttgattttttttaattacttaaaattaaaaagcacagacgtcctcgttggaaaaaaaaaaaccttcactccggtgctttttactggaagtagaaaataatctaaaccgttgatctcaatggatccaagggtttagatctatttctactaccatctcatataacggtagtagaatcgtggaagggtaatattgtctaggaaaaaatatttgtggagaggtataattgtaattatgcagtaattgtggaaaggccaagaaagaaatagtaaaagtctaaaaatggattgaaaaggataagactggcattacaattaatcaatcttaacccacagcatcacatgggtagggggtaaaagatgggtaaataaaccaactgtaagaacaaaccaagagagaactgtctctgaacaaatgctcctaaatttagcaacttgtcaggacacaaactacaagaacagaaatagaaagaacagtctcatccatcagtgcagccattggacagcattgcgacgctgctttctctgcccataaaaggaattgaaccccacaccccccctcctactcttcctcctcctccctcctcgccggagcttggctgagcttgagctgagctgagctgatcggcggcggcaatggcgggcggcgcgatggtccagacggtgggtggcaagacgtacccggggaagatgaccgcgttcgtgttcttcacctgcctcgtcgcctcctccggcggcctcatcttcggctacgacatcgcatctccggcggcgtcacctccatggactccttcctcagcgagttcttcccgtcggtgtacgcgcaggcgaaggcgagcaaggacaccaaccagtactgcaagttcgacagccagctgctgacgctcttcacctcgtcgctgtacctggcggcgctggcgacgtcgttcgtggcggcgtgggtcacccgggtgttcggccggaagtggtccatgttctgcggcggcgtcaccttcctcgccggctcggcgctcaacggcgccgccaccgacgtcatgatgctcatcctcggccgcatcctcctcggcatcggcgtcggcttcgccaaccagtccgtgccgctctacctgtcggagatggcgccggcgaacctccgcgggatgctcaacatcggcttccagctcatgaccaccatcggcatcctctccgccaacctcatcaactacgcgacgtcgagcatcgagggcgggtgggggtggcgcatcggcctcggcctcgccggcgtgcccgcgctcatcatcacgctcggcgcgctcgtcctcccggacaccccaaactccctcatcgcccgcggctacgccggcgacgccaagcgcgtcctcgtcaagatccgcggcacggacgacgtccacgacgagtacgacgacatggtagcggcaagcgaagaagccgcctcgatcgagcacccatggcggaacatcctccatcgcaagtaccgcccgcagctcaccatcgccatcctcatcccgtgcttccaacagctcaccggcatcaacgtgatcatgttctacgcgccggtgctcttcctcaccatcggcttcgccggcgacgcgtcgctcatgtccgccgtgatcacgggcctcgtcaacatgttcgccaccgtcgtctcgatcatctccgtggaccgcctcggccgccgcgtgctgttcctccagggcggcacgcagatgttcatctcccaggtggtggtcgggacgctgatcgcgctccagttcggcgtcgcgggcgtcggcgagatgtcgcggtcgtacgccatcttgctcgtgctgttcatctgcatgtacgtggccgggttcgcgtggtcgtgggggcccctggggtggctggtgccgagcgaggtgttcgcgctggagatcaggtcggcggggcagagcatcgcggtgtgcgtcaacatgatgctgacgttcgtcatcgggcaggcgttcctcaccatgctgtgccacctcaagttcggcctcttctacttcttcgccgggtggatgctggtcatgaccaccttcgtcgcgctcttcctgccggagacgaagggggtgcccatcgaggagatgaaccacgtctggagccggcactggttctggggcagctacgtcaccgcccacgacgtcgccggcgccggcgccggaggaggaggaaaccgcagaagccacaacgtctagctcttacatatactattaccgtttacgagttacgcgagagagagagaattaatgggtaggttgtgtaattaggtaatgcaagaattaattaaaccaattaatttcaagggacaggtttttaattaattaattaattcggggaggggggagctttagaatttggtcggggcaggttaatttcagggtatttgttgtatagattttgaattttataggtgttttctttttatgaaattcttatgtagtaaattctttggagagcgctacaaatatcgcatggtgttgccgcgcatgtagagtactgtttctctaaccaataaaaaatgtttcaacaaaaatgtatcagttatgtgtatcttgaaaataaaaaatgtttcgttactcttgagaaatgtttcatcgatcgggttaaacagttttaactatagatgcaacacttgaaaactacttattgcaacacaaagaaaacaatacgtggaatatccaataaaaaaaatacaatgaagcattataccacaacctggtgaaacaaaagcaaataatggattgcaattatcgctgaactccaagagaaaaaaaaaacaacaaactttgccttcttcttctgccccagccatccctcagaactcacatgtagttcttgtcggtgagatcctcgactgtagctagagggcattgtgccgggcctcgtcgtacctccgatgacaaccagccaccaccatcgctcccatatccttctgcatctccttctcttgttcgtggtattgttaggcgtccatcacttcctttctctccacgtttgccgccaccggcgccgctgccgtggcctcttttaaaaaacagagttacacctgcgcaaatatttgttagtcctaggatttgagtagtaggtaacatgagttgggataaacagacactagctactcggtttgaagttttttattttatttttttgaaaaataaatttcagtgagcattccttgtggtatatattatggtaacttccattgaaatacatattattttggacaaactttttaaaagctaaaagtgtcaatatgttctaatcaaggctaaaggcatgcttggcacaactccagttctagctccacatctcttggagttgagctggagccaagccaaacagtttcaactctacataaaatgggagtggagctaggcggagtgctatcacaaaatgaaactagagatgtggagctgggtttagactgctccacaactccactccaggcgcaactcctgaataacccgtttgatagagctccaactcctaaatttaactttaggagttgggtctgtttggtagagcttcaactcctaaatttagcttcaggggttgaatctgagtggagttatatgaagctgtctaaatctagctccacctctttaattcattttgtgatagcgcaccacccagctccactcttatattaggtggagctaaaactgtttggctgggcttcagctccaagagaggtggagttggagttggagctgtgccaaacaggccctaaacctagctacacatctctagttcattttgtgagagcactccacccaactccgctctcattttaggtgaagctgaaactgtttggctgagagctggagttgtgtcaaacatgccctatattatgtagagtagatttattttgaaaaatacttaggtgttccatccgaattcatgaattttacatgattttttaacaagttagtccaattgtaaaaagaatgataaattcctcccttgcaaaaaaggtaaaacacaatacttaagcagttcatttcattagctatcctactaataccaaagatttgagaagtagtgaaacaaacactccctattttttttctttatgttctgttttttcaaggacttattaattttatttgggaggatctttttccaaattttgataattcccactcacctagcccacattcttctttttttttaaaaaaaaagaagaatataacagtccacaaacccagttccatctctaccaagaatcagacaagccattaaatatttatttcctcgccctcagttttatattacaatatgctttgatgtttttccatagtcaaatttatttaagttaagcaactttataagaaaacatagcagcgtttttaataccaaacaaatatactatgaaaatatattaaatgttaagtttaatgaaactaatttgatgttataagtgttgcttaatttctccatagatttggtcaaactttgtaggagtttaaccatgaaaaaagggtaaaaatatcttattaactactttaaaaacaaacatagttgctctccttctaaaaaaccgctccctcttcttcaaggaaccgtatcctctgacattacacagcaatgtcaccgcgtgacattccttcgatccacaccatccattctaaatcaacggccacagactaattggcatctaactaatcaaaataactagcagatcatgtaggtatatgtacttaataggtgggaaggatttttttttgttagcactaaagcagtctcttcatctttgaagattcagaattgccccgttttgacggaggatggcagcacaaaattgatgcacagggattcacttcctccaggataatgtgctaatcgctacatctaacaagtaagtgaaacataattatcatcatatgtcgattcttccatcggtcaacgatgtttgcctcttgaaaatgcaatatctgatctagggacactacacaatctactaattagtttggttgattgcatgtcaaataatctacggccgttgatttataatggatggtgtggattgaaggaatgtcacaccgtaacattactgtgtaaatgtcagaggatatggttccctccttcaaaaatggattgggattcggtgacattcccccgtgacattctcggtgac

SEQ ID NO: 26868 - DNA, 34222 bp, Oryza sativa
accctaatatcaaaaccagcagggctgtgtctgcaaaagatgaggtggacctggttttataataggggggaaggctgcgcaagggaatacaaacttgaaacatgttcacgttctcttttcttggtccatcatgtcctcgcagtttcactatgttctctggtagattggtactatacatgaatttggacaacttgtgcaactttctggccaatattagtggttcaggcatcagattgtgtccattagaagtttgttttgcatcttgtagtctggtctcttatcacttacaaagcattcccgtgatttcacaggatttgagaaggatatgtttaagctgaagaacgagaagcaagcaacggagcaagaggcctacctttggtctgtcgcagatatgtgagcatagctgttcttcaaagaagccaaggtagcttgtgtgccttgttaaacgaagtagtatactgtaaaatgcttggaaggaaggaagcacggcctctcggcgtagcacagcgtgcttgaaaactcaaatgtagaatcaaacttgttgtgcattggttgaaatctttttggcatttttctctttgccactcttaaaaacattttgtaacatcgatgaacatctttactcggaattagaagctgatcttttatagaaaaaatagttctgaaatatgtttctagtcatgtttaattacagagatacagttttcattaacctgattgtggatggcctgcattcttctggtcagcttttgcagtcaagcagacggcaaatacacaaatttggcaaagacaatgtggaaaatgttgaagcatatttgtaaccaccacaatgacttctctggatgcaaacaaagccaaacaatctgtaaagaacagcaattgaaggtaattaaaccgtttgtgttagaaacggacgcgcattaatcatgcaaccaacaaattgcccctggtatcctggaaaccatggcctgcagccactggttttatcatagctacatacaggcctgccagtctcccacaactttgctccttatccactcaattaatccaatccaggagtctgaatcattgattaaaaaaagggtcatggttattccaaccatgtggctgggaactaattaagaaagccaacatgcaacaagtttccaggatgcatgcatcatatcaggcgatttcttatagttcattactcactcagattcttaataactgacaattttaacttctccatgtgaaatttgaccattaactgcccttatattgttagatcaaagtgaagaaaagttttatatttatattttgggcatacccactttaagaacatggtatcatttccagtatttgaagtacttaaaaatttaaaagtgaatagtatttttttttaaaaaaaaacataaactgattttaaaacataaactgagatactacctcagcaaatcagcatatagtatataagcaaagtgggaatacatccagttttacagagaggtcccttgagaatgagcaaattacacataagttctgaaaaatgcaaaggattcaacaacgagaagaaaaagcaatcaggtccttgactttgcatctcttgcaactgcaacagccagaactcagataacaacgataggagcagaaaaaccatggcaagcggcaaaagatgaaacccagttgcgaacccaaatgggacctccgaaggatggaggttaaagcaacctagacaagtagagatacacttcagttgcccttttaaaccatcgtcgtagtcgaggaagaagaccgtcgctagagcaggagggtcgccggagaaggaacaggtggctgacgcaggagttgaactgactcattcccatatgccttgtttgagctaacaagcctcttatttaagctcacctttaggtcttgttggagaataacaatagtagcgaagaccaccaccaacatcgcccaaagaggtccgaaggaagaggttcatcgatggcttgacgacgacctcgagctgatcatgaaaagggaaactaaaggattaacctgaaaacaagatgaacccgataaaatctaaaactaaccctactagtggatgagagttggaccccctcccacctcactgacgaccggaaagtcgctgaagatggaagggaaggggtcagacaaggaggaacgcgtgttgatcaaaagtgaatagtgcccaatatctttattataaaactgaagaagtattactgcctccttacctataatatacttataagatttgataaatctcttatacccaaatctagaaagcattgcacattcctactctgaacctgtgaccgttgtgcaggatgaaagcagggcaggatggcacccacgcggcgccggccatggaatctttagtgtttgacagcatgtggtttaagtccaacaacatagattagtaaaactaattttggacggctgcagttaaccaagtgtcggtcggtggctctgtctcgtggaccaatcatttcattagcataacaggcgatttatgtctgatccgtgagtccttttagcagtccagactctagggtgacagtacaatacggagttaactggtaaaaatggaaaaggatacaaaatatttctacgatttattgtccagatgttgtctaactcgaagaaaacaaaatatagtgtaaggcttacattttcagcattagcaaaataacttataacaatagatttaagcaatacggtataagaaactttttttttgagaaaatatatttttaaagacgtggagtaaataatccggtgaagtgtttcagtgacaaaaggggcgaaaaatgccgttctctatagaaaaaaacgtaaggggagaaaaaaaactcagaaaataattatacaatcaatcaaatactgaaatttaaaattggtatgccctgtttatgatttgtgcacctgaaaaacaaacaaaaaaacagaagcatagcgccaaatttagcagatgagatgagtgacataagcagatatctccagcctccagtttcttcagaaaaacggcaaaaaccatcgcctccccgcctcctgtttcgcccacgaaaactctatataaactccactcttcttgcacttctcaatccaattccatctcgatcatctcctcagctactactgcttcatcgaatcgtcgaagcatcaacagctatagatcaagttcgagaggttgattcagagaggcattgcaaattagcaatggcgagcgcggcggcggcggtggcggcgaaggcgtggtggacggcggcgatgagcgtgggcgcggtggaggggctcaaggaccagtcgggcctctgccgctggaactacgcgctccggtcgctgcacggcgccgccatggacaccctgatgctgcaggtgcatggcggcgccggcgcctcctcgccggcggcggcgatggcggcggagaggccggaggaggaggggatgaggagggtgatgtacctcagctgctgctggggccctagctaagattgtcatttagattgatactatcctgcttcttttgctgcttgatttcgtaggtagttttgaacttttgattacttgggaatctgaagctggctttgcaagcatcaagatgctgattaagtgattcgtgtctgtaaatgttccacgatgatgatgatgatgatgataaattgagtcgcaaattgaaaggaaacaaaaaaaaatattcctctcatgtcgtgaattttaatttagtatatatccttgctgagatgagagaagcgttaaatctccaaaactactgctgttttttttttttggcatatttaaactgtgatctctgcttgggtcgaaatgagaatggtggaacggcatttgaaagaaaaatttgttttgttaggagatagtaataaatacttcctccgttttacaatgtaagtcattctagtatttttctatatttatattgatgttaatgaatctatatatatatatatatatttatgtctagattcattaatatcaatataaatgtgagaaatgttagaatgacttacattatgaaacgaagagagtaacatttaagtttctactacaatattttgccacttactcttaatataaagatagcaatacttttgcatattaaaaaaaaaatattttgccacttactacaaagtaagtatccaaattaaagcctcttgtttataccacctcattatccaaaagaattttatcggctgctccgtctcgtttcagtctttcaaagtagtaaaatgcatttatttaatggatcggccataattatggcgatagattttttccacaaacgcagtcgaattttcaaccttaggattggcatgaagattcgtgctcacggggcatcagcacacacgctttgctgtattggttctgacacggcgtagatgcatactgatatgctttttaaactttgttgttgttgtaaattatatatttatataaatttacataatagttacacctcactaatacactatttacatatgtaattttaggatttacatatgtaattttaagacttacatatataattttggggcttacattgtaaatacactaaaattacatatgtaatttagtgacttacaatgtaaacacatgccgactatattttgtgaaaaatatgacgccataaatatagctagtccctttatttaataggaaacatagcactgattatctcgtttaatgatttcttgagcaataagcatttcttccatttatacatattcttgtccagcaagttgcaggatgcgatcgactgcataaatcaccatgaccttcaattcagagattttttttttgtatcaccatccaaaaacattacacattggagtggtgaatccatctcagaataaaaattcagtaagtcctctgatcattttgctgctcgatcttctactcctcccctctaatctttcagctcaaaaaacacaggaaaaaaaaagattcagcctttcagatcaaacactcaaaaaacaaaaaatattcagcctttcagatcaaaaaccaaaaaagtttcagtgtttcagctcaaaaaacacaggaaaaaagaagattcagcctttcagatcagaaactaaaaaagtttcagtctttcagatgcagtggaagcaggagaagatagatttggcgaggtgagcaagcagcataaatctctgaatatctgatcagcaatcaatctcccagatacagagcgggatgagcctggcctacgtgagcaggctgtgcgccagggcggtgcaggccgccgtgcgggcggagcagccggccacgacgcgccgccggccgccgcacgccgggcggccgccacctccctcctccggcggtggatcgccggccgaggtggcgccggcggcgaagtcggtggcggaggagaaggcgaggaggttgaggaggagggcggagaaggacgagaaggtgatgcatctcgtctgctggggaccaagctagtgcaaaacctgaagaatgcttagtttcagttatttctgcatatgcagtttctgaagatcaattttccttttcttgcctctgcgattaaaaactacagagcttggttgtggccaggaagaccaggattagttttagactgtgtttatgtagatcctgggaattttgtttaattacatgtatatatgttgggctgttggccagattagtgcagagatctgaagaatgttcagacagttctgcatatgcacttgtccagttcaagcagaaggtagattcttgaaagattggctgcaaaaataatccgagatttagtatttaaaacaaggcaatctttagtcgcaactcgcaaatgtgatgtgttgactgctattccctgatcttacattttactgatcaatactacatatattttattgtcaggttataacatgctgcacttcaaggcttcaagctgagcaaactcagtttcaaagcagcatagttgttctggcaagccacaatccgcattttttggacttctgttcctgtaaatcctaccacagcttttggtgaaatgtatgtaaatcctactagaatttttggtgaaatgtatgtatgcatgctggccaagctagtggagtctggagagccctgaagaatgttcagttctgcttctgcttgtgcatatgcacttgtgctgcagtttctgaagaaaggtagatccttgaaacattggatacagccattagtcgatctatgatttcgaataaaagatccttgaaacttcttttgtcgtttgaaaagttaaaagcgcgccacagttcaagcacatcaaactcaggttctgagtttcgcaaaatttgtcaatgaaacacatcatattttcaggcaagaactggagatgaaaaaactaaaaaccttcacatcacatgctttttccgttggcaaaaatattcacgtctttgatccatggagatcgaggaaggcaggaagaaagaaatcaagaaaacaaaaatcacaagcaaagcccaagaaaatggacatggaaatggatgtggcctcaggagtttgggccccagaaggagatgaacatgaacgcccgcagcgactcctcctccctcttcctcctcctcctccgatcatcctcctcctcctccgccgcattcgccgccctcatcgcctgcctcgacgacagcgagccccccgccgcagccgccgccctatccttcgcgttccacgtcgtggcggcgcctccgtctcgcgttttccctgccggcgccggcgccggcgatggagccacccgagcgccgcccacgcgacccgccaacctcacgctcatcgccgccgccgctaagctcttcgcatttctcggtgaagtgaagggagaggaaggggccgcggttgccgtacttgtaggcggcgcggtgcggtgggcggcgccgctggttacgccggcgaaacggcgggccaaagctcaaacctgcccgcggttttctccccacgccgctagctgacgtggcccaaatgaatggcccagattttctggaaattgtcaccctcattgtttggctgaatttttttgaaatattactatcttaatggaaaatcgcaaaaatggtggccgttggagatttttcaaagagtaaattgcacccacagtacaacaacttggtaggtgagtgcgatatagtgcaagaacttgagaattaaacgtacgaatgcaacacttcacaagtaggtgcattttagtaaaagaacttgacaatttagtattttggtgcatcaactaagctaagcatatgctaggtgagtttttctcacgatatcaatatgccattacatagcaatcatacggatattaccttgtaatattgaattttatctttaagaattatactgcatatccaatttataaccaattacctttaagaatttttgttttcttcacattcctaaatctcaaccgaaatataataatttctacatctagtttaattgacttttagttattagttattagaataaaaatataaatatgcttatatacaaatccacgctagtatattatcaaaataagaacttaaaaattgaatatgcataaaaaagtgctccaaataattaagttgtcgcataacttcttaacttattgtatcaaaatcgtacatatcttgcaagttgttgcatttatgcaatcacttataaagtttttttagctaaactgcacatacctgcgaagttgatgcactagaacgctcgtttctctagttcttgcaccaaattgcacccacctgccaagttgatacaccgtgggtgcaatttactctttttcaaaataggggcctatcgaagtgcggtagttcgacaggaccctatcgaacggccgtgtagcaacaggcgggtgctctcgaacggcgggaggttgacagaaccaatttaaccacgggaattcgactgggcccacagtgggctttcgaaatgtggcttcgtaaagtggatcgatacggcgagagtaacttccattggtgcaaggataacacaacctgagatgaccacacaattattcaagcattgatggagtatgagcgccaagtgtagtcaaacttacactggagatccaatccattatgtctacctgaatggtttgagcatccaaaatgcggttgtagagatcgctgccaaattgctacatccttttcacaagagacatttggaaggtgatattccgtctgtcccaacatagacaacaacttagttgtatgtcattgcttaattttttattttcatttttgctcgcgtttccataatgcaatacatatcccattctataatttgatttattcctcaggagaacccaaggatgtgtggattcactttgtagatcgacatggtcaacccgacgtatgatggcggaagagtaactgaagctaaaacgcaagtagggataggagaataaaggagcacgaagttgcggcaaagccatgaaaccaaaaatggcaatgaaaataataaagaatttgtatataaacaatacctcattaatccaaatattttaagaaacaaataaaaactacaactagcaaagaacaataaaaactaccgcagttcgacaggcccctattttagtgaaaaatcttcgatgaccaccatttttgcgatttttcattaaaataataatatttcccaaaaaaattcttgtttctcttactcgtatgattaatattcgaatcgcttaatatcaaataaaaaaaatcatttctgagtaaagtttctttatatatgttattagcaattaaaagcagatagtgtaaaataaactacaatgaaaaaacaaaaaacaaaattcaaaattgagttctaaaatttaaattttggcttataacttactccctccatcccaaattatagggcgtcatctttttatggaaaattaaactcagtaatttttttactaataataatataaaccatatatatgctaagtattatgcgtgttatatcactaaattcacatttcaatgtactttcatgtgatagtaacttcatatttgttaaaaacataacatgaaataaatggattgtcaaagtatgttactgaatatcgtgtaaaaaaatataggccttatacattggaaccggggggggggggatataaacataagcatgagtcattatcttctcaccacatttgaatttgaacacatttcaaatggtacacaaatatacaatctagaaaaataaatatcaacagtttaataactttattttcttcccaaaataacacaaatttctgctgaacaataaacaagaaatcagaaatgttaccaacttgggttctactatagatgttccaaacctatggtctatacattccaaattttgcagtgaacgaattactaaattccactcttataatgttgaaggaatcgaagacaaaaatcactttactgaagaagattatgaacatcaagaatgcaacctagaaaagataccaattctgagttcagctgaggtgagcaatgtcaacctcgtcagggatcttgaatgtatctgcggcaccaaacttcctcctgccatcctcccactcatcttcgtcctccatgctgtccttgtcgtcgtcgttgttgccatggccgctgtgttgtgcgtgggaggattggtcgtcatggacgctcttcgacttgcagggctcgttggcaagcatggtgacctgaccaaggtgggagatctccacaacaacggtgtcgtcatcttttgggaggggctgcttccatggctccccatcgatcctcatgaaggtgtgctctgctgcgcctttgtggaactcgaaacggatcctttgggcctgattttgaaggatgtccacataagcttgaatggagaggactatactagttctagttcttgacgtagaaaattatgactacggcacaatggggaagaagtggttttcagttctgggatgtcaaatggacaaaatggaagcacttttacatatacttcatacctgcgcaaggcgggtaccatgtccatttggggccagcaagacaagtccgtgccaggcatcacggaatccaacaacctcaataagtctatcatcgacaaaaggtgccgtcagctccctctgtagattttgttttttcaagacagaggtttgattattagttcctctgaagatttccagtaaataatctgtgaatagctacaatgcgaaattcacgtgttgaatgacaagcgtagtgcatgtaaactcacctcttctactttccttgtgccaggtgtgccccaaggattcagacctccagagaaactaggcaggttgagacagacgattgatcgaatgctgcaagaggcagtagtacacaggtcacaactttgctcatagattatggtagcatcctccatcaacaagcagaacataaatcagaaatgttgccaacatgtgcaagcaagaaatccaaggaacatattgtaacttgcaaggaagcaaaactgaaacagtatatccgagtttttcttctcttctgttttcttttcttttcgattcagttctttttacagctttcaaagtaatgtatactgcttccaatcttaatagaaaagatacgcaagccttttgcgtatcccaaaaaagaaacagtataagcaaaatattccaagtgcaaatgagaagctttcttgtatcatatcatactagtaggctcaaataacagtacacgggggaaaaaataattcatagtacaacaaaaggaatgaacaatgtttacctgtggtgaatgttaagttcttgccagtggctaccggctcttttcatgattttcacacttgcaagttgagcaatattcctggaaatgaagcactcaaccttacaaccaaaacgaaaagaaggaaacaacttgaacgcacacaaattgattacaccaaatttcaaatttaacattgccaagtacaggtttaagctttgacaataaattttgtggactgaatctataaactgcaaggatggtgctaatatgaaggaacaaaaaagggcacaaatgaattgattggtgtagtttgtaaatgcaatgtacattgaacacccccaaaaatgctggagtgggtatactccctataacttctctctccacattactcacagatatttataggagttaggtggtataatattaaattagagacaccttgactgcaaagataacacaatacaagtatacaactagcacaacaggtataccatgaaatatgttaatgataaatcaacaagctaccttgaagatggatgacttaaagaagcacaaaaccatccttgtttaagtccaaccttagcatatgtaccctgtatagattaaatggattaacacctggcaaagttaagtcattcagccagattgaaattgactagagggacatttatctaaatcaatatagaagtaaatttcacatatttacaggtatattagctatcaaggattacatatttaggaatcaatttgacagaactagagatgtaagtgcaatattttgtaacaactacagttaagaattccagtaacatgcaatgggtattggtcccattcgacacttcctcacttctcatagctcataaaagttctgtatagtaagatcccacaggaagacataagaaatgggtgttgagcacatagagaatctaaataaggtcaattgtacgtctcaagtctctgcctgccaaataaagaggcagttcagttggaacaattttaaacttacgagtaattcagaatctgcagcacagcgaaacagtacaaaagaaatcatcacaatgcacaataataagaatataatatacctgatttgtcagctggtttttgaatttctctggatttttcttcctttcagaatgaaatccgtaagaaatttctgcatccatacctgcaaagatcatcacgtatgaaaatttgaatttctgagtcattgaatcaatatatgctctaggttcttgaagaaacttgggatcttttttccaaatataataaactacgacagtagtgatcatgagtcccacagtacttgccgtacatggaaccagcaggtgcctgcatcttcatagcacaaactagcatgcaacatcaagttccacggtaaactagaaaccaaaccatcagactgtttagggtccataactggaagtggccatgaacagacaaagccttacccatactaaagtaattccaaaatcctccacggaatgtgtggtaaccttcctgaaggggaaaaaaaaagaccaattgaggaaatgaattaaattcaatgccacttgggtcttgacatataacaattttcgtcaacaagaaacatagtaacttagaaaaactggacagattgtcttaccatattgagggaatcactacttgacacacggtgaaatgcatgtaatgaatgaggcaactctaagggggcgattggatcacatggaccttcctttgtagctcgcatcctcaacatgatatgccagctgaaacattcatgtgcacattacattgtagtcttctgttgtgtttgaatgaggtataaaagggaaatcatgttttagactgggaggaaggacaaacagatttgaagaggtaattattcaactacttaaggttcattaaaagagttcagtattgattgattgcaagtttgggggtttatggcaaatattaaataagttaatcagccgcttaacccttatgagcaggatcaaggcaaaagtcaaagcttaaagtaaagtgatatctttatggcattacctatcaattttcatctcttttgcatgcctcactagcccaaggaatgattttactgactcttggtcagtacaaggattcttctttccctgcgatgtttaattcagcaaaagtatacaagaccatgatcaggaacaggttaaagttcaggcaagaatcatttaaaagatcatttaacacagaacaacttatacataatggactctagtttaagtacatcacttttgccacctcccttcaaaaactaattgacacaagaagatgatttgttaagtacacattaatttctgaccacttacccatccaaatgaaaatggaaggttgtttccggttcccagaggcacagtagcaattggaggagggtgtgaaagcttgagatcactgactaccccaagcagccagcttgccgtaccatcgccacctgcaacctaattgaaacctcttttaagtcaacagaaatggaaatggaaagccaaagagacttcctactctgcaaatctgcataatataacctcaaagcatcatcactcacaattattctgagagttctccaaatttgaacagcaagaatgtctccatccatcttgagcttctcaaggttgacattcaaacggtgcaacactttatccggagcctcttcggagacatcgaaaacctgaaaagaacacagcagccatcaacaactgatataacaaaagccacattcctttcctgacgccacaaggcaagaaaggaaatcacatttccaaacacgcagacgatatacctgcgcttcaccgagaagttcacggtaggttttgatcaggctgctcccgagctgaccaccagatccagaattgatgaacaccagcacggggcacgggggcgcatgatcaagaagcacccgctgcgcatccggcctcaggatgtaatccggaatgcggtaatccgtcagcggcccgcatggcttggatgatgaacccaccacagtatccatctccccttccatcctgctcctgcaaatcgattatgacacttcaattcccctaaaaagaacaccacaacaaatgccaccaccacaaattcaattccttctcctgagatgattcaggccaagaaacagtcgaatccaacacaccaaacccacaaacacccgtgtcgatttgtctcgcaacagatcataaatcgcaggaggccatggatgaaagggaaaaattcgaacttatcatccacaagagaagataaaaaaagaaaccgcctttggatcgttacccaggactggaaaaggaactacctttctcggccggtggcgcgggcgccagtgtcagatcgccggcggcggcggagggaggccgctgtcgccgggaaatgggtggctcgcgagcagaggcggaggcgggaggccgcgcggggatgagggaagaagaagagagagaaggagaagtgttcgctcttctccgcaggatgaggcgcgagtgattaataattagaggcaacccatgtaattagtgttaatctaatagtactcaattaaacccttgtaattagtgttaatcgttttgattcttttaaagtcaaacttaaaagaagtttgatcaagtacaaataaccgaatagacatgcaaccatagcaattgctcctagtaagcgaatagacacactgcttagatatgatcaatttgagaataactcaaaattcttgtaggataatcaaaatgagatgaaggaagtactaattaactaaacccatttaattagaatagttcgttttgatttttttaagtcaaatttcaagaattaataccattaaaaccaacaattaatatatttgaataatagatttgttttctgtcgaaaatatcgctatactttttataaatctaattaaacttaaaaatatacttagtagaaaaatcaagctacttatataatataaaacagagggaggatgaaattatttgctgcaattgctggccagatatgagacgaaatatgggccgttggattgcgcggattagtggctaaatccgtggatggacggcacatgttgggtcaacccaagtctgggctggacttagaatcatatagcaatttggtacagatattgctatctgaaacagtattgatgataaaattataaatttatttattgcataatgtcacatcagatgggtatgtgctgttatgagaatgtcaagtggcttgaatagttgaatgaggcttaaaggctgtcgccttttcgcatctgaagcgaagttgattggaagatagaattttgctaattattctgctggagtagtgcaaagtagtagttcacttaattaattgtacaaatctagctacttttgtctctaagattggggatgtatctggtacattgatggtctagacagtgtgttctaggcaggtaactatagaactccctccgtaccataatataggattttgagtttttgtttgcactgtttgaccgctcgtcttattcaaaaaattttagaattattatttatttttttttgacttactttattatccaaagtatttgaagcacaactttttattttttatattttcataaattttttgaataagacgagtggtcaaactctataggtaaaaactcaaaatcccttatattatgaaatttttttaataagacgagtggtcaaactctataaataaaaattcaaaatcctaatattatgagacggagggagtagtccacagcaaatagggtaatttagatacatggacgcattgcacgtatggtcttgtctcttgtacagtaggttgatcattttgaaaggtcaaactttgtctaatcaggctgaaactttgacagcttcatagtgtggttcatattttattctagaagtttcacgtagggtctattcatgtaactatcaaaatgaacattttcacaatttcggtacgttaataatattatcaaatttttgtaggataggctaaatatgttgttgttaaaaatctttagtcattaccagtattttagtaacaaactaaatgcatccatgtatctatcaattttatcaaaagagatggtatggtttaaaatgacaccaatctaaacaggcttatagttttgactttgatactatgtacttttataaattttgacaatttgaccctttgcaaaaactatttttacaaatgaaccgttgccaaaacttatttcaaatctgaccattttgctcaacgccaaatcgtgtggcgctaaacttagacacctcagcgccaaatagcatggcgctgaatgtacgttggcacgctgacttagtctcccattcaccgtggcacggcattcagcgccagctgacgtggcgctgaggtgtctaagttcagcgccacatgatttggcattgagcaaaagggtcagatttgaaataagtttagacagcggttcatttgtaaaaatagtttttgcaaagagtcaaattgtcaaaatttgtgatgtacttttgccatcgtcggtatgagatgttaattaccagtttaccactgtatttcaaaatcatattgtcttgtttgtttaatccctcccatagagaaatcgagggggatttgaagggaatttaatccacacgtattgtgatgtgaaattattccttctcaatactcttcaatccctctatcttagggattagacgaacaaatcttacctgagaaccaacggaaacaaacataacctttctattttcttagggatacttaggtgacaagataaaatacagatatataaaaaaccaacagaatgcatataggcacataagtaactttttaaaaatccataacctctctgttttagctaattctacctgcctttcgttgagaatcatctatctttgatggttagctaagtttgtaattgaaaaataattgattatgctgctatcgatgtaatttctagtagctatagagaagactatatatattacatctattacttttgcaaaccacatctccgcaacttgtatttctacttgtctcgaaattagtacatttcaaaactaagttatgtgtaacagttatgcagccaaagcatgccaccgtatgtttgttatgaatatgacatgtcgttaatgtaactagtacttagataatacactttcaaatgtcgttaatatcgtattattcttttgtttatttaataatacactttcaaataaggaaagcccttttttaaggtaccatggtaaatttatagtgtatagatccacctactgggatttaaagtatagttttcataattacaaacacccaagtatacaaagttactacttatgtgcctaaaaaagttccttaattaacacatcttaaaagtggtaaatacttaaatgtccccaatttaaataggttcatggagtgcctccttcgactaggccgatttagatcctcttgggccagggcaaccaccggtgagcccaataagattgccaagttcaccaagacaaagtctacctatgatcaaaacagaccaattattttaattttattctttggatttcttatctctattttccctcaccagctcctttgtttactccctaaaagggcctaaacccctaaaccaagggaatcaagcaacaataattggagctatatttttacaattcaaatgcaaacaacatttatacaataggcatgtaccatattgcaaaatgttaagcccaaatctggttatgaatacttgaattgtaccataccaatcatgcccaaatttgtttttcagtgcgcagattgaacttagtagtgcatgttagtggagtggcttataacattataatctatgttatcgatatttttcttaaaaaatcatggctatttacatgagatatctacatgcgcacttaagttgcaaaatgagctgcagatttgtagcaggtctcttgtggtcttctactcctgttctcaaaaatatactgatgtcgttttgacatgtctcgaagttaaaaattctaaaaccatgacatcaatatatttatagggggttgatgtatgaaaattccgtacagattcgcctccaaggaagtagcattccctctattttataaggacattcccaacccaagacactaaacatggtttccataaactccacatcattaagaaactagtactagacactactcttccaatgcaaacaccaatattccatacttaaatttaatgttacttatctcagatgatgtcttggatgttgcgtagaaactatgtctcatgcaagatatgatttccttctttttcctcatttattcaattgccacatcatttttcattctaagtgacagcttatttaatgctatggacaccatcctagtcattgggttgggaatgccctaatacatgatgcctctaaattttgacatacatttatcattcatcttatttaattttttgtgaaaatataaacaataaaatcatacttaaagtaaactttgttaaaaaaacaaatcacaataaaataaattattattattattattattattattattattaaagcgtatagtcaaaacatatttcttataaaatcaaccgcgtcaatattacaattttaaattcctattgatgcccagcacgatttatttttatgccggtgggagtagacgtcaaagaacaaactcactctgtcaagagctcatgccgtgcggtggatatctagtggcctacatttccctgttcccttgtgcaaagatcttttcagatcggcaactgatatggttcatatattttgcatggtccacattccctaggatttctgccctgcagcagcaaaggttgtggcaaatgttcccctcctctccattccatggccatggatggccctcccacccttcttctttcccttcaattcaattcaatgcatcctccctcctatggttggcagcaatggagagggaccaatttttttgcaaggactgtccttaggcagagtacaaccccttagaaccacatgatcgagtaacccgtgattgggccgtctctttttgaggatcaatctagaggcgcacgctattccctttgtacggatcagtttagtcgcgtactattctctttctacgaatcggttggtctggtttaattttgtttttagatctccaataatagggaggtattataattcatgtaatttttttaaaaaacaaacaagtctatatcaaatttcactattactgtaaaagcaaagtcgtcctctttccatccccttctcccaccgtgctcagtgcgtcttcgcttgcataaccactggatctaatattcatcaatcacccttatagtatatccctaattatatggacatgattggttctaacacatggacatgctactagtaataataaaagcgtgtaatttaagaatgacatgacttgaaaaatctgtggaaatagtatggcgtgtaaacgtacaccaataaacaggaagggtgtaattcgtggaaaatttctcaaaatacataactgtgtatcaaattaattatacatgcttttaaaatgagacgagaggttagccatgtgaaatgagaggtcttttaaaatgagaagagggtcaaatgataggacctattatccccttttccttcttgcacggtcctgagctcctattgacccaaacccacttatcttattctccaagtggatcatttccaagcaaattctaatctccagatcagtttcatcaagcatgtggcatgcatgatgtcccccttaccaaacgccaatggatctctactactttcacaccacaaagcaagcatgcaatgcatctttctttatataatttttattgtcctttttttctgtggtgagggatgtgtgataatgacatgggtgatgggggaagatcaggatgaagaatttgatgccctgaacaaggaaaaggaaaaggagacttagcctcaatgttattagcacttgtgtgttgctttcactgacctcataagagtttcaaccttgggcaaagtttttcagaagaggttacttatccatttcttccaccaagcaggatttttccatttaagaacacactgaaatcgaccacataaatatcctaacaagaatcccatcctaatcccacaaagcctacctggaattagagataagttcagtagaatatacatgtggcattttgtgcaaattgtgggtaacgtgtattctctttctggctccagtaaccatgagaactacagaaattcgacagccatcgaatttacagatttcaacacatttcagccaagattgtgatttctgaacaagtttgagactgaacatagggcacaatggaagcattcagacagtgaaaccatggaagaatggcactgcaaatgcaaacctatatcatttcttaagttagccagaacgcctcatccaaaaggacaaaaagggatttaaacacatgaaagtagtgggggcacatatacaagctccagcaagccgtcgcgattatgaatactaccgagttctgggatggccgcgtgataagtcgactctgcaagttgtcgacggaaaagatgtgaagatgtgtgtgctcggtggaggtttgatctttgcagtgatccacatctccccccaaatgcctggatacaccaaaagtgaccttctaatgtagttagcatcagcatctacatcattgtttcagttgcctcaggaaaagctgcataacaaaaaggataacatcagttactaccttgttaaaataaaacagcactcactaactgatcaaggttgcccaatttttgccgcaaaaaggagaacatggaaatctttcgacctagtgccaatcttaatacagatacatgcatagaccctttcaagttaaaaggttggaaagataagcactaaaaacaggactacaatgttcgacacgatccgatgccacttcgacaccgcactggctcacctgccatgtacatggcaatatactcaaactggatgaaggaaaagtagatttgcaatgctcttggaatctaaaagctagtttgctatcaatcaactacaacagtagtgggattgcagagcactccaagcatcatatgatggcgttcagcaagcaaggcaagcaaagctatctccttatgatgtaggcatatagccatctttttcagcagtagcaacttcatgacagtaaacctagaggttgttatcaacctctcactacaacttttacatcaaaaatttactcaccctttttttttccctttcttgctcacttcttgatattttcacatcatgcttgcactggtccataaaaaaaatcttgatattttcacatcatgcttgcaagaacactacatcatcgtgccattgttcgataagttgaatttttttttctcttgcttttatgaaattatggttgctaagcttaggaattcttgggaatagtaggattgtgaactcactcatttcgaccaacgaccgcattggagcaattcctcccctgcacgccgctcaccgactgcgccaaccccgaccggcggaaatccgagggcgatctcttcctatgccgggaggcaaggaatcggccgccgacgccaccgccgtccgggaggaggtggcctcgtcgctccggccaccaccgccatggtgagccgaggacgcgtaccggcacaagctcggctgcgacgtcgagcacggctggtcctcctgcaagagacacatcgatcggcatttgcatcagacacgaagcatcaaaaccttatgcaagaacgcgtgatctttgcctccgaaatcggaagaaatgatcaaccgatcgatcgatccgaatagtgccgtgccgtgattgtgtagcccaaattggcgagagtgatccaggtttgcaagatcagaagaagccaaatcaaaggaagagggagaaggagaagtgagggcaccttgacgcggtcggcggcgttcgcgccgttggcggcggcctcccggctgctgctcgacgtggagctcgcgacgggcggcggcgtggcctccgcctcctccgcccacggcaccacctggttctccccctccccctccccctcctcgtcttcatcatcctcgtcctcctcctcctcgacgaccacctcctcgtcctcgtcctcctcctcctcatcgccctcgccgcccatctcctcgtctcccccaccaccacggcctccaccaccagcagcgcctccacctcctccaccaccacggccaccaccgccgcggcggacgcagcgctcgcagagcgacgcggtggggcccagcctgggccccgcggcgcgccacggcgtgggcctcgcgcacccgcggcacagcagcgcccgcgcgtgccgcgccaccaggaagttggccccgtgcacctgcgcgtcgcacccccagcacagcgtcgcctcgtccgccccgcagtacaccctcgccgccgccccgcacagctcgcacgcccccgcacccgcaccaccacccccaccaccaacccccttctccttcccctccgccgccaccgacatgatctctctctagctagtttagcttgtctcgagctttctctctctacctcgacttgtactagtatgtttgattgttggtctgtttgtttctctctctagggtgggggtggtgtggttttgagcctggaagggaggatcgtctgcggatgcgctggggacgggcactactggcggtggaggctccaggtggacattccctcccttccccctgctttcttttatttttctctctctgtctttcccttccctttcctatatgctttgcttgctgttgttcctcggtcaatttttggccccttgttcacgccgtgtttagattccaaatatttctttaaacttctaacttttctatcatatcaaaacttttctatacacgtaaacttccaatttttttcgtcatatcattctaatttcaaacaaactttcaatgttgatctgaactaaacacagtcagtttcactgcaaaatctaacttgctttcccataagcagtagaggatctattaaaggtttataagtgattgtttggtttatggtcatgcttctcttatgtggatttgaacaaaaatattaaaattttgtataggatgtttttcctattggataatttgaaacgaagaattgaaaactaattgaattctatgaaatttctgaggaatgtctcgattcatataaattttttaggatttttaatacgaggtccaatctcataaaaagtagttttatgagttcatctgtcctatacaattcctacatctttttttcgatccaattaagcgatcatttctttattttttgtgtttcataatcatatgttttgcacgttgattcttgcataatcctttttttattgctccgttttatcaatcatgtgtttcaaaggaactctttttatatttggttgtgtggtttatcatactttttcaataacatgtcccatatattattgatttaattttttactaacttttgctgctagcaatttattcatcatacttttatatactacaacttgcgtaaccttagttgtatttaactgtggctgacaactaaacaactcataaactccaaacaaaagttgattatggatagtaggagtatttgttataagttacagtatttcagctgttctaatcagatagaatttcaaggggatcgccaacggttgcagcgtagggcatttaaccttgggtctgaaaattacagttaacctaattcttgtattatgttcatgagctctcctatcgagtaggtagtattgtactccctcagttccacatttatataatgttttgacctcttgatttctccaaattcactaatatttatataaatttggacacatatatattcatacataaatgtattaaaacctaaaacatttagtgtgaaatagagcaaattaacataatgtaatctatgttactcaattatcttttatatttaagtgatcttatacttttggaataaacaaagagttatccatatgttgaacggaatatcagttgacccactattgtttgcagttgcctcctaatattagtatgaggcgtagacagtcaacatgtacctttgcaggttttattttatgatgtacaaaacaataccttaatttctttttcaaaagataaaaccaaggaaaaaaacaggacattggaaaatctaatgaattgtcggtgcgaaatggcactccttgatatttttctcatgaaaatcaaatatttttttaaaaaaaggttagctaaaattatgaaataaaatactccagggtagtacgaacagaacacgttcctgttttcacaataaataaataaaaaaaaacaactcttttaagtgttgtgtgcatctagtttactgatgagtactaatttcattgatatattttatgacgaatgtattactctttcatttcaatataagcataataagtatatatgtgatatatcttacgactatgaattcgaaccgttatgactaaaataatagttctaagatattttattacgtgttaagttgtagtactacgtatttatatttattggaatgaaaggagtaggctgctagcagtcgtagatggtgggaagaaagaaattaaaaaaagaagaaaaaaggaaaaggaagaagactggtggaagccgtggacatgaggctagcaagaggggagagaggcggcgagcgaggaaggccacaaccacaaggtgcggcggacgctgaggtggtgggggtggcccacgtgacgaccacctcgtattcctcgttccccacgcccccctccccttcctccagatatttttcgactctctcatctcccatatctctccgcctacaagctgcctaccaccactacatcaccctggcctgccttgattaatctgctttctctctcgctaaccaagttgctaattcttttattaggcctgctacaagtactaatcgtgatttaatctcgtttagttagctgcccacgatagtggctgcgtagtggagcattctcctgcatctacatccttttcgtattgaggaaattaaaggaggcacaaattaaactctcggtacgaaaccttccaaacatctagtgcaagctcgctctaaactcttgttctgttatgccggtgttctaacttatgtaaattggccacgtctgagtgcctcaccctctccctctcaattccaaagatgtgtttagagtgaagtttggtgtcagctgtaagggttgagttttgggcgatctcaattgtagttcctttgttgacctagttgcaaccggtcacgtttagtgatgactggtctagtgctagccttctcttgggtcagtgtgttggcgttgttggtgcgtgggtggtggttatttttttctttattttcctagctatgacctcacaagatcgtaatattgtaatttttttctgctataacaatatgaacttagcatctagtgcaagtcgttaaaaaaaaactcccggtactcaccactagctccgtccatgttcatagctattagtaaaaaaattttaggatggaggatgtcctctggtttattgcgttcacttcgaagttcttcttttctccgtcctaaattccttctcattttctctattttttctgcagagtcacatccagggcacataatttttcattctaatttcggctaaaaggttggtcctcacgaccactaacccctggaattaatttctataaatatcgaacgaaattcactgactgcaaacatgactgcaaaaaaccttggttacatcgtgagtatctactttccttttttttttgagagagagagtggggatcgcagcatctctacttggcatggctaaatttgaatttttcaaatttgatttaggattatttccatgagttatttcatcaaaccgtttttcttcttttcataccctgatatcagactgtaaatttcaaaattagctcaaatgaatgctcgatatagctttcgcttttaagcacaagcttatttgaatttttaaaattaattcaattttctagggtgtacgattacaatttgttttcaaatacgggtgactcataaaaataaaattatgatgaaactgtgaatggtgggatggaagtattaaaaatagaataccatatccagtttcaacaacaaatttagagaaattcatgcgataaaactaaccctgcaacagcataattatatatgtggcctcatttttatgttttgagactgctttcaattccttaatttggaccaattttggccttactactgacccattatacacttgcgacattgttacgcggttggatcttagtttacctgattcgatgactgatccatcagattccgtgtcaaatctgtttagtagtactattatttataccctactctctctgtttaaaaaaaaaaaaaggcaaacattagtttttcgtgttcaactttgattgtccgtcttatataaatttttttataattcgtatttttattattgttagatgataaaacatgattaatattttatgcgtaacttgtctttttatttttttcataatttttttaaataagacggacacgttggacacggaaaccatggtttgtctttttttaccgagggagtactaagggcatgtacaacccacagataggggttcgtctccaagaacctcgaagttatcatccagacagatataaagacagctcatacagcccatagacagaggatctgtctgtaagctgtttaatgcttttgcatgtagctttgatcaattgcaaatacgtttgtgtataccattgtgtggctatatatttgaaataatactatcaagcatgaataagatacatgattacaataatttttaggaaccataaatataataattatattacaatgcctttagtctaatttcgtcgccaaacttttcaatcaccccttcagcaaattttatagtataaaagtgaggcttgaattcacgttcacattcacagaaacgggcatgcacataactgaagcattcacataaaggagcacatatacataatgcctgtaactgaagcatgcacattcacattccagaaagaaactgaagggtacattcacattcacataagcaaataagtcctctcggcactccaacagaaactgaaactgaagcatgcacattcacattccaacagaaactgaagtgcacattcgcatttacaaatcacattcacattaattcagaaactgaaactgaatgagacctctcggcactccaactgacctcacaggatgtatatgtatagagacatacactgaacctgctgaaagattaaacataactgcatatgtatatagagagagtacaaaaagaaaaggaatgcaataaaaggctaatatgcccatctttttccctagattatatatactccatattagtagtatagtgtatcactgaacaagcaccaaaataggcttagtggattgagcatgaacaaaaattatataaactgagacatacactgaacctgctgaaagattaaacataacttgccaatagccagagtttaggatagaaaaagtggaaaagttggtttaggatagaaaaaacagcaagataatttggcattcaccagatagccaaagatagtagcctccacttgcaaaattgacatatctgtatcaataacagtaaggttcatattagacactgaagggactgcctaagacacttgtaatcacacatatttgtggcaataacatgtaagtttcagatattgcataattgtttacctgttcaatcagattcagggaaaagagttttcataagacacttcatcatactaactcgctgcgccttttcctcagcagacattgaacttgtatcttgtgagatgaggctgttataagtctccatcatctttgactctttctcaagcttccttccttctttgtactcttgtgctgtaaggtgggcaatttttgtggcctctagcttctcagaagatattttttcctgtctgtccaatagtttcatgcgcttgtcattgttttcctcctggaatttgctatatctatcaaatttgtctaactgaataggagactcctttgagtgaccatcatcactactgcccaaaccatttgacttgatttttgcatctagagctgcctttttagcggccttctgacccattggtcgctttggcatctcatcaaaagtgtcatcagcttcctcagagtctccttccaagtgaaatgatttccttttacgtgcattcctcatgttttcattgtatgttttccactttgagacttctcggcatattttccaaacctccattagcacaaagggtcctagctttgcctctttattgtcatccacataaaatttgtgtgctgcatcaatccacatttgattagaatatccacttgtaaaaattctacgagcctttacataagcacactcaaagagatccgtccacctattaatcttgtgccatctatccttgcattgcttcagatttctttttctgagaggtggggtagtcttgttgtacgattcaacaacttcaccccaatattggccacctcccttatctgctccacatgtagagtcagttgaatgctctatccaagcactcatcaatctgatatcctcttcctctgtccacagtatcctcttctcagtcctaacattgccattgccatttccatcatcattgccttgtaaaatttccacctctggtggtgaactagcatcagcaatgtaaataggcgcaccaaccaaatgagagttttgtgcatgatttccaaaatagctcatgaaaccaccacgtggatgtacatctttatcactgcaggataatagcatatatttgaggcaaataaattggataatatcttagatcacagggataatctctgcatttgagtttggctcgcttttgcgaattatctcatggcagctagttcatttcagttacagggttctagctaactactgtgaccatataacaaaggaagggattactgacattactaatcaggtagtataaacaaagtaacatctagagatagcttcatccaatccacaagaaattcataatataaacaaccatcagatttttatttctctcaaaagttgaatataacctcaataacattaggataacatgctacatgatgcaaaaaattccagagtcaagtaattaaattgtagaatgccttttccaatcagtactaaattagcagttataaacatttaagtaaactgtgaatggttaagttgcagaatgcagagaagctcatcacatggcaggggatgtacaataaagcctgatttttatgactttgtaacactaaaattagttctaacacagaacatagtaggcattcagatgggaaaaaacaagcatattctatgttctcttgtgatgtaaggggcaatttttaacccacaagaatcattagcagttcatgaatcaaacatccacaaggaaacaaatcacacaagcatattctgctagaacagagaacaagaataaaagattaccatgatccaggagaagattcatcaccaccggacgcatccaaccaagctgaagagctggggaatccacctctgtaggatccatcaaaaggtggagggaagggaaatccatccatggacgctgaataactggggaagccgcctggagggattgctgccactgctggcccgccaccacggccgagagagcggggcggcggtgctaacccgacaccgcggccgccacgactgaaggggagagccgccgtcgccgacccaacaccacaacctagggtacgggctggggctgccgccgccgcatctgaggcctcaggtgtgcctcccttcttcttcctacctgcagccgccgtggacatctcagcagcacccaaatcaagcgaggggagttggagattgggagagattgctgcgctatatgctggagcaaatttcctggatttcgcgggcaaatttcccggattgggggagtgggaggggagttggacgaacctggattttgcggggaaatttcccgcgctcgcgctctccgcgcgggatcctgccgcgccgtcgcctcgggacgacgagctcgtacaacggtgctgagcttgcctcttccgcctcggagcacgggtcgtcgccgtcgcctcgcgagaggacgcagctcccgtcgcttgactcaaccaggggtttttttgcataaaaggcatcacaaagacggggcaaaaagacccgctgtacgtgccctaatcttctcgtagggagtactaatcttctcctacgatttgatccaccctgatctggattttctgcaagctgtgtggagtacagcacttgggctaggaatctattttattccgatccgtacatccgcattctcctagcaaataaaaatttcgggcattccttttttattttagtactgcatatttcatatttcaatgtatgacgccgttgactttttaaccaacgtttaaccgctcgtcttatttaaaaaatttatgcaaatataaaaatacttatgtcacgcttaaagaatatttgatgataaatcaagtcacaataaaataaattataattacataaatttttgaataagacgaaaggtcaaacgtttttcaaaaactcaacggcgtcataggagtagtatatctgattgcactactttatttttattatatggcggacaaacccgtacacactgctacatatgaaacaccaaacccagtctctcacacactatcaatacgtctcccaacacactgaaaaagacaaaaaaccaacggtatatacctaatcttatttaaattatatcgattggactgcattaataatatagtgttgtatattgtacggagtagtgcgttaataaattctatcgattgtaccaagtattcaggtgttaaatttcacatgtttgtaaaacaaagataaactttgatatttataccttctctatacaaagataaagttgggtgacaaaatatatagcaacccctcccccaccggccaccccaccaaaaaaaactctcaaaataaagttctaaatttaaaacataacacttaggctgtgttcgggagtgagggttgggaacctcactccctagcacataaaacaaagcagcgtttatctcataattaatcaagtattagctaaaataaatttgaaaaatgaattaatatgatttttttaaaaagtaactttcatatagaatttttttaaaaaaacacaccgtttagcattttgaaaagcatgcgcgtggaaaacaagggaggtgagttggaaaaacggagataagaactcagcctagaggcagtccaaaggggagtggattctaatccctcgaggggatatctattggtcgcgtaggctacgatagcataaatcaaaaatttctatcgcgtaaaccaggaaccatgcaagtattagatcatagatcgttaccactcgacgcgctgcgcagcggaagaagacgctgaaaagtcgaaggaactctcgcgaagtagcacgcgtcgatgtaaaggaagtagtcgatcgcaccggctcgaccttctcctccttgtgcgtactcctcgccgtacttccacgccgatcagcaccgcaaaccaacggcgcctctaccggtatccacacgtacagggacggaacgccacgcacaaatgtgctagcactcgcgcgcggctagggttttgctcggggagggaattgacggctagggtttctcacgtgatgcaatacctccgccggtcacacccctcacgaatatataggatccatcactcgggcctccaaggcccgtaggactcctattcggatctctatctgaattaagctcatattggatctctatccaatccccttattccggcccattaagcgtgcgaccctataagttcatatatactcggctgtaacccgaaaactccttttcggtccacgcgtcaacagcggcccctagtagaacgtattgacccaccgggcatacataaagatcatatcggctgaacctctagtgtatacttgtatgaacccctttgcctcacgatatcgattaagctcaaggctagatttgtgccatcctcttatagctcaatcattcactcgaatctgttgatagattatataacttgcgattgactcctcaatcacctttggcatggccatgcacttctataatctacaacatcgaggggcccagagatatctctccataggaggggcaaatcccatcttgattattcatatcccactacatgtttcatagcatacccgaaaactacttttataactacccaattacggagcagcgtttagcagtccctaagtaagctactacacatgttgggaaccatgataatctcaggtctaaggattcaacactaacactaaatgagatcattgatgacacaacacacatggctcttgcagtgtcttatgttgggtctatccaacaatatgttcaccaacatgtgtccacattattaatttggtatctctataccatgatccatgagatatgatcatcaattaatacatgtgctgatcatataaacatatttattccacacatgatatttgatcagggatcctttagaaatagcgacacataacataaagagtctcatgaaataatcacatatttattaaccaataatgagtttatctatttcaaggaacaaagtcggataaatatgtaaacatagtatgtgatacaatcatctttatgattgcctctagggcatatcactaacagtatcccctcgtatacctttttcttccaaattcgatgctaataattatgaaaaattctaaaaaaaattgacaatgtagagtataatgatacctactagtccaccaaaattcatgttcaaattcgatctatacatcgagaaaaaaaaagacaaatttagatataaacaatacgctactattcatacgctgaatttgtcttttttatatctcgacgtgtgagttgagtttggacttaagattttgtgaaattgtatatatgtgttgtatgaatgttgttaaatttttccagaatttttcataaccgtttagatggtttttgagcaaacgagggaacatcctcttgagggattagaatagtttcccgagtccaaagagatgatagtacggcagcatgactggggtggcactgttgaggcaattgcatagagacaagaagaccaaaatgtgaatggtctgctagtgagggcgaaaagttctaacgacgctagaagatcacgatgtatagatcccgaaaagaggatatgagaagtgaaagaagatgaggacgaacaaatggccaaaggaggcacatcattttgccatgcatagttttataaatttcagccacaggattatattactcttgtacaatggatggatgatgtttatgaaccttaaagcgataacactatcaaattttgatctacacatggtttttgaagggagctagcttgaagccactcatttgttccaactaaagctaataactattctttccccggcttctctgaaaagccgactcatggtcaaattacttatctttgaacatgtcattctcaaagccatggaccatttgaccttatcaggaatatcagatagctggttcacatcagtctcaagtgaagtttcccttaccatccatggagaatatcttcacccctttccccttcaccctcttagggtgtgttccttgtcaaatattttcagtggcatgtaatacggaaaaagctattaaagaattgttaattgagtattaaatattaaaaatttaaaaaacatttatttgatttaaaaagacttatattttttttgaaaaagtaatatttagcagtttgggaaacacgcttacagtaaatggaaaaaatagtttagctgagttgtagaattgaactcagcattagtccattgtgtcgattttcaagcggacaatccaaactgttgaaaacaacacatgcatcatttgaactacaaagctaaattattcttgaatcctttttttagagctagctttggcatgataagaaaaaaggaagcaacttttgagcactgcacaactaatcacatatacacatgtatgtactctcatcaagagtgaggaggaaaagtgaaaggaggcaagacaacatcaatacattcatcctaacatactacacccatgccagccactagtctcaagttctcaaccacttgatccactttgcttgattttgaacaaatatgtgtgtctcccatgattatcaaacaacccttttatagcattttaatttcgatacaaacccaacactcaaacacattacttacataacatgagtattaattactccaaaaaacatattagagagaaattcatccatatctctgagtttttacttagatcgccttctataaattgagagttctgctctatctaattttcattttcacacattggtcttgtttggatccttcgggttattaaatagccctccggaatcttgctatttatgagtattaaacgtagattactgacaaaatcaattccataaaccctaggctattttgcgagacgaatctaacg

SEQ ID NO: 26869 - DNA, 9603 bp, Oryza sativa
ttctaaagtatactccctccttcattaaaaaaaaagacaacataagttgatgattttacaccgtctaaagcaaggaatctaaagaaatgatttttcatatttatcgttttagatggtgtcaaatccccacttttaggacgaagggatcggagtactatactttatttctaaaagcacgatataaacacagttatgcatacactcacaatacgaatacgatcatttctacgaatgtacactcgtataccttatccttatgagcattttcaacaaataaagccgatatatattaagattgatgaaatcaccataagcatctcgttgttaatgggtacatcacctaccattgaaagattaaatagccataatgcgagtctagaatttgaacccgagcggatttgtttcgccacaaggaaactagctagttaaattacattcacttctcaaagtctaatgtactcctccattttctttcatgaattaaccaatgacatattaaaatgaaaaaagagaaaggagtatttttctttcaataaattatatctaatgttttaaacttttatctctcatttttcgtacgcatgctttttaaactactaaacggtgttttttttgcaaaaataaagttctatagaaaagttcctaagccatttatcaagttaattttagctaatagttaattactcactgcgctaatgagctactccgttttttctgccggaggggaggttccatcggcacaaatgaacgtagccttagtgtggagatgggtgctgcaaagagttggatgtatcatcttgctcgatcgcatcctcacgtacttaggggagcttaagatttctaaaaaacagctggtttatagctagcttctgagaatttaggaaagctagttttttttagtttctggtctctagtttagtttctaaattatacataattgcagcttctcagaatctagacgaaaaattaaactgtttggaaggggggttttctgattacaggataagctgtagctgctagaagccctcccaaatagacccttagatctatattgggcctcttcggaagccatggttgccacaaccagttgaaacccaactatcatatgcggcatacagtgttgccgaacgaagccattatctatagagttacaacctattacattctaaagattaacatgcaaagatgttacgttatcattcattagcttttattacatgttaatcctcatacaaacatgctatatcatttatatttagttatattttaaagttataaaatacaacatgttaaatcatcatcgcacataatttacataatattttaacgtatatctctccatcattttctacaatatccttatatacttcatcctagctaatgttttctatcttctctcattaaatctcaattgtttctatcctctagatgattaatcatagtccaaattattccccttattttcttctctcgtaaagccacatcaccttacttttggattatcaatctatttactatttaaattatcaaaaaccatatcaactcaagtggtttatactcttttccaatgatcgattaaaaaaaatacaaattctattaccttacgttgtctagctagctatattacacgttatttctactattatcatacggaactcccacgataatgtactgggttttacatagtttattataagtctttctcctgcgcaaaaggttaactaaatctcctccataatcacttaatccaatgcatttgttgtgacccctgcaaggctgcaaacacagcaagattgtttctacaccaaaagaaaggaaaaaaaaatcaattcctgatgaattcagtagtactagtaccaagtcagcagatctcgattccgtcagaaaggcatcgatctgttgcttgcttctgctactgctagccactggcccttttggttggtgaatggtgatctgtcctgcagacacacacgcacaccaaccaacttatcctgaagaacttatcctctgacatgagatgggatctctgtccatcccaaccccaaaacggaatctcctgcagatgagattatgcaagtttggtccaaaaagcaggatcagattaattagcaacaacccaatgctgagcatcaggatatatatggagcatttcatcgtgcaatctgcattcccggtaaccgtctgctcatgctgtggtaaatcagagtgacattttctgagtggatgagagtagctgcaacagctgcctgcatgcgttttgcgctataaaatgatccctccattgaaagacaagaaacaattggtttctgaattactgaatcaagagtttttcttgatttgttgttgatacaatgacgagtagcacaactttagtaccgcgtttagcaagggtagaatcaacttaagagctgtatgcacatgtttagtaccgtgttgctagtttagcagggtataacgagtttataagagtttgtcgcttcaaccatattagtttgtgctgtgtaagtggggccactcatcagatgggttaggcagtgcggtttaattttggaggacaggttgttatacagtggatctgtggcaatctcagaggacgggaccgatggggcacgaacttgtagatctcctctgtctccactaccacagtctaagaggttatgcacggagctgtgtcgacagtgacactcccctcaggcgcaccactgcttttccatcgcctcgtcgccctccctaggcatgaggcgagctgcagcagcaatgaagctcacgaaggaggagcgaggtagcgacgatgattgaattagagtggtgaaggttaaatggaaggaggagtgagctgccatgcttcggtcgccgtgatccatcatcgcacgccgctgccctttgtagcagctcgactaccattaggttgctatttcttccgcaacaacctctctcgttgaggtcaacggacacattagtgcctccgcacgtgatacttggacatgttagcgtgtgggccagcgaggtcctacacaagtgcccgtgtcgaccagtgagctccttgactttgtccattcgtcctcccgtgtgagaagatatagacggaagatgacatgtctcactgatatgtgggacccaccatatatatatatttttagattagagtgccacattcatccgttcgaataaaaaccgggttaacttttcacgtagacaccttatcaaccaaaattgactatctatactctcgtggaactagatttaccttggttttagaagttggagtaccctttatacttttttttttgtggttggggacacgaatgaaactagaccaaaaattggagggacctgtagtagactttttgtgcgcgcgccaaatagcagtcgcgagccctgctaatttggcatagtaggcagctcagcccaacaacaatttggtcggcccaacatctgtccgtacccaagccggccgaaacgcctcgtcgtcttcgtcaccgtgctgctgctccggcggcggcgccgccctccaccccaccccaccccgggcgcgcgccaccggatgagcactaccatggccgtgccttaccgcggttccgtttcgtccttctccatttcgaacaatgcaaccaccaccgccgccgccgccgccgctgtgcggccgacctcgcgtggtttcgccgcctcaaccctcaggtcgccggccaccaccgcaccaccattcccgaccactccgacctccaaggtcccccccccctctcacttctgtgtgtgcagcaatgattccttttgggataactttacccttatttttttttgtacaaaaagattcgtccggctgtggagtgtgaacatcaatgttttctccttctctgcttatctctaattggtcctccctacacatcacctaaccaaattttaacgattttttttcctttttctctgactagccgatgcgtccgttcttgattcttgtatgtatgcctcattcgtgctgcatagtgagcagtagagattgagacttttttttttgtttcaggatcagagaattgagggggagtgattgggcttgatttcctcctgctggggaggctcatatgagttcctggcaaggtttcttccccttaggcagcagcaactcaagcacaaggttgttttttttaggagaacgacgacagaagacctgccggaattttaattgaagggagaaaaaaaattcaaaagcgcaaggttgtatgttggcatttggtacaataaacatccccaaccgcaccgtcgtctgggttgccaatcgaaacagccccatcatgaatcaatcgtccgcgatgctgtcactgaccgaccagggcgagatagttgcgtctgattcattaggtggcactctatggaagatgaacagcagcaagaacattgctggtggaggtactagatcatccgcgacggtgttgcttaacacggggaacctggtcatccggtcattcgatggaaccatcatgtgggagaactttgatcgcccaactgacactttcctacctggcatgaaaatctggttgctccgtgatgatcatattgccgttgagccctttcatttcttggaagagccccgatgacccttccaatggtgacttctcccttggtagtggcttgaagccataccctcagctctttgtgcggcatggatttaatccctgttggcgtggatcaggctcaacgtggaatggacctttactcaaaaagctttttgttgtatttggctcctatcagggataagaattactcatacctgatgatctctacatcgtacagttcaacaagtgtgcgctttgtactggacagctccggcaaagtgcagtttctgagctgggaccctggtcactcactgtgggcagtacagtacatcttatctgttcaaggttgcggtcgctatggctcatgtggcccatatggtcattgcgacttgacaggcgtccatacatgcaagtgccttgatggatttgaacctgtctccggtaactcctcacaaggctgtcgagaaaggaggagctgcgatgtggtgatcatgagcatttcttgctgttgcctggcatgaaattgccagataagttcgtgtacatcagtggtataagctttgaggagtgcacagtgttatgcagtaggaactgttcgtgcacagcttatgcttacaccaattcaacaagtttacttccaccccagtgcttgctatggatgggagagcttattgacacagcaaagcttggtgaaaatggtgagaatttatatctccggcttgccagtccagttgtaggtaggataaaatgtagttggtgtgtgaaatttgtattggatgttctcctctaccttgatgttggtcacttcgggcatatcactaaatggcctgcaggaagagagaaaaaaaggcatgatcaagttgtttattctgaaaccaaggtctgttctcatgaagacatacaaaagaaactatgtggatattacttattaattaacatttgtgtcctcttgactttaattcgaacccccacaagcaattgccagaggatggaaattggaataatatatttttcatggtaaatgtttattatgttaataaataaaaattcttgatgtttaaattttctcatagtagatattttgaaatccttttaaaaaaatattttgaaatcctgattctcaccaggaattaatttcggaaagagcaaatggaggataatggaaatagtactgcctgttgtgtcaagcttgctgatgctcttatgtctatggcttgtatggatctgcaactgcaaaggtgaagcggagtttttagttatattctgatccgcttatcctttttttttctctccatgttgtctaactgcagttgcattagccacttcactttttaacagtcatgtactcatgttgtccttgtgaattcacaagttttttttaaggcattgcaaactattcttatcaggcaaacaagaaaactaggagatttcaaaaagacaaatgcaaagagctttgagtgtttcagaaggacttgggggaaacaaaggtagaatttcctgttataagctttagagaaattactgttgcaacccaatattttgctgattccaatattctcgggcgaggaggttttggcaatttttacaaggtaatgataattcttatattggtagaaagtttgtaggatatacttgctctattaacttatgcccattttatttgtttaaatgatatgcaacttggcagggaacattggaaggtggtactgagattgcagtgaaaaggctaagcaagagttctggccaaggattagaggagttcagaatgaagtgattctaattgccaagttgcaacacagaaacctagttaagcttcttggttgctgtactcgcggagaagaaaaaatattgatttatgaatacttgcccaacaaaagcttagatgccttccgtttcagtatgttctggtgattatgatggcaaagatagatcagacgataaggtcttctctaaaataaactcctgtaaaaaagttatagagattctaaagaacttttattaaagcaaaccacccactttgttacctacttactgcttaatttctttaaacttacgtaatcatctccttttggaatgcataaaattcttttcaataaataattagttaagtaacatgcatggctgattatgttttttttattgatttctatccttggtagatgatgcaagaaaattctcaaacgcagatgcaagaaaatcaatgcttgattggccaacaaggtttaagacaataaagggagtagccaaaggacttctttatctccaccaagattcaagattaacagtagttcacagggatctcaaagctagcaacaaattgctggatgctgacatgagccccaaggtatcagattttggcatggcaatgatttttggtagtgcccaacaacaagcaaatactaaccgattagttggaacatagtgagtaatttcatacgtaaattgtacttaagtttaataatcttcactgaaaactaaatcaattgtgtttctttctgggaaatgattcatcaaacagtggttacatgtcacctgaatatgcattggaaggcacttgttcggtgaagtcctatattagcttcggtgtgttacttttgaaaattgtttctggcttaaagatcagccatccacaccgaatcacagactttctcaatctcatagctttcgtaagttctgcaaaatgttcaaagtctcaaaatttattttaacttttgtgcaattaggctttgtttggcaaatgggattgggaaataatatctcaccctctaaagggcaatattgcatcctaaccatccattcttcacacctcatttaatcctagccattcatccatttccattttctaatcccacctcccatatcccatttgccaaacacacccttaagaattatatccttttttttatttattcaggcatggagttcatggaaagatcagaacacaaaggatttagtcgactcgtcaatctcagggagttgctcacttgatgaaatttcacggtgtatccatctggggcttttgtgtgttcaggacaacccaaattctcgaccaatagagaacttacatcagcagtataatatcaattgttctttttttttgcggggataatatcaattgttcatattctagttttctaacctttttctgaacttgctaaaatataaatatgtcaattgttcccagcttagcaccgaagatggatctgaacctggatggctttcgcatgggtaagttgctttgctgtaaaataaaccagatgtttagcctattaaatattataaatttaatatgctattaaatgaaacctgtcttgttctcatttcctacaagttgcctagtagaaacttgttagtttatctgaattggattctacttaacacacacaagttttaatctcttcatatacctttagttccatcatgtgaatatgtagtagagaaggaaatctggaaattattgactaggaatgatgattaaatgaaccttaccacctgaaacctggaaattattgactacgaaacctgaatctttttaactttcagagaaaatacgttaagacctttccctccagatatttccctaattccgtggtattaaaaaactttaagtgacctacaaggctacaaggaataacttgtcttctttctggtgtgaattttttgcttgaaatgatttttctttttgcatttaacttaaaattgaggggatgagtagagcattcagaatgtcacatcatgattagtatcatttccagaaaacagttgacaataggagccagtaccaattttagaacagcttaacttcccttttgttccttggttctggcttttaaggcaacttgaccctttgattgcttctatatcccattagcatccatggttgcataacccatttcattacaagcagggcaccaagaatgccaatgtgttcccttcatgcctctaccatgatttttcttctttattggatattcagttcaattcatctctgtgcatccgacaaccgccttgtccctggtaagccaatctctcctggtagcaccattatctctgatgatggaacatttgccctgggttttttctccccatccaaccccaagaaacactattatgttggcatatggtacaataacatccccaagttcaccgttgtgtgggtagcgaaccgtgccgcgccaatcactgttccttcatctgcagtgttcaccttgaccaggagctccaacctcaccttgtctgatggcaatggccatgtcctttggacgacaatggccaaaagcagaatcagcatcagctccccccgaaacaccaaaaacatctcaacagaagccatgctagacaacaccggaaacctcattctccggtcattggctgacaatgccatcatatggcagagcttcgaccacccgaccgacactctcctgcctggcatgaacctcaggctcagccacaatacacacccactgcagcgcctcatttcttggaaagacatacgagacccatcccctggtcccttctcctacggtgcagaccccaacaacctgcttcagcgcttcatctggcatggctcggtgccgcaccggcgaagccctgtgtggaacaactacctcctcattggtaaatacatgaacaacctcaattccacgatttacatggcgataaaccatgacagcgatgaggtgtacatgtcctttggcatgccaactggccccttcagtgtgctgatcaggatgaaaataacctacctaggcaaggtaaatatgttaggttggcagagcaacatctcagcatggacaaccctgtactcggagcctgtgcatgactgcaatatctacggctattgcggtcccaacagttactgcgacaacacagatgctgtcccagcatgcaagtgccttgatgggtttgagccaagggaggaggaaaggcggaccaacaacagaagctttttgctgggatgccgccgcaggaaggccctaagatgtcaccatgggaacagtttcttgacttatccgagcatgaaggtccctgacaacttcatctacattcacaa

SEQ ID NO: 26870 - DNA, 670 bp, Oryza sativa
tcagattttgcctactcgatagcgttgttcttgcttaattgccttgaacaaactagtgatgttgagttgaaaatctccctccctctcctcactgtatctctgtgtgtgtgtgtgtgtgtgtgtgtgtgtgtttattaaatatgtttatttctttgtcaactgtgaaggtgtggaaacattcattgcaaatatttataatttgaacttgttttgcatgtagggatgatcctgagctcgacaccatgctaaaaaacagaatccggtggggtgatcctatggctcatcttgtcaaggtagctgccacttttgattttgagtggttcagttgaacccttgaacaccttcacctggctaattgctgatttatgtgtacatatgttgcagaggaatgatacagacctccttctggaggacttgggagatgatgaaaagatgaaagaatctggcttcattgttccccaaaatatacctagtcacagctggctgaagcgtggtgtagatcctcctccaaaccgctacggcataaagcctggtcgtcattgggacggagtggatcgcatcaatggtatgtgcttttcaaattcattcccaattttcttttcttgctatttaacatcatgtcgcttggaatgacaaaaagattagtttaccgtttactccctccattccc

SEQ ID NO: 26871 - DNA, 3005 bp, Oryza sativa
taccccccccccccccccccaaacacagccacgccaccccgcgcgctctcccgcattttcgcccaaatcatgcgttgagacggctcgccgtgtttacgagggtctcctcgattcgattcgggcgaagagtgggagcgatttggatggatttgctttcgctattattcagattgtgcaaatatatagagccattagctgatactgtagtattcacttaatgtggtatttatatagctctagaaatctgtggattttggagaattgccgtgactaagatgaactggtaccgtgtgcacaaacaagcaagctaagtactagtgcctccactgtttgtgttgggtggttctcgggagcttgcttttatttgtttccaaatacattaagccatctaatgtaatattagtatgctatatacattatattttgctggaatggaaataaaataatacacgctgctcttcctcttagcatatagtgtcttttttatgcatgctctatgaagcaaaacaatattgaccagagcaggcataatggtgccgaaagtcatgtgtaattgtgggaaagtaatttttcaaagcaaagggtactcaaaggtgatggtctatcttccaccatgattagtggtatgtatatgttgaatacatgtggatcacataattcaaattgcatatcctgtttaggattcgttgctccctatagtaggattcaacccactagaccttgactcaagtttagaaattgttgtctaaataaatagggccaagaacattttttcttcttatgttgcacattgcgtactgaaatatttttgcctttttgtttgtgctcattgtttaagtgaggaagaaatcaccaggttaccactgcggcaatggttgacatcagcctgtgttttggttcaattttaaggtcctcagatcattccatgtatgtgctaagcatgtttgaattgactaacatattcatataccactacaagttagattcagatataagtgttgcaggacatacacatgtcttcattattaatgtgctgcgatctggtaaataacgattgtggcgttgcagaaatcactgtcagggctaagcaagtaagcatgaaagttaaggagtgtcatttgtgaaaattccgcaacatcgaaccaagttctgcaaggatgaatccaacttctgatatttgtagtcaaaataattttatagtagagatggtagcagtagcagatattatcagggtcaggactactggactagtaaatttttggaaatgtgatttctttttggtggtggtacggataccatatgcattggagcattaagttgccatcactgatggaaactgagtggcttcttgggtttaatcttgaacaaatagttgtctatttcatttttgaccggaaacagtgagggaggcccccacggtatatttttctttatttaagtctgaaattcgctcccttggggagttgaacccaggacgtagaggtgctacttgagcaatgtaaccgctagaacaaataattgtctgttaaaccaaattactttagctttgttctgcactgttcaagtttatttgtgatgctctgatgcatactatcgtgatacttggtgtcagtcctcactttagatgttttcgatttcagtgctgtgtttaagcttgcagaaaaggatgttggttgtgtttttgcaaagacaggagaagttaatattgaaaagatcaagtgttcaaagtattttcaagcacttcttcagaaatccaaaggacatgctgctgaacaaatggtacaattcaatttatgttgttaggctttacgtgctcaaaagaccttattgttcgtacttctcattcttaattttcttccttcttgagggacatctaaccattgccccatttttcttaattctttatttacaacatcatttctgaaaggtgatttaactctttttaatgttttttttgttgaagcaccatatgaagaaacacatagctttcaacttccaatgttaattgtttgcaaattgtcattgtttgctggctgattgtatcatcattttctctttttgtgacatgaactgaaatacagaagaccactgattgccaagagtccaccattgaagaaggtccgcatgtagaggaaaactcaactgatatggaaaatgagaagcttagcatcagggcttcaaaattagtaatgcaaagaaaactaacatcactgcgtagccataagcccctgaaggccaatgttgtacaggatgggaatatgttcaaatcagtgagtaacatatctaatgagagtgttgctgtcgaaaatggagtcagaacaaatcatactgataacaagtatactgcttatatggatcttgaagatgatgacagaccccgtggactgttgcagaatgcaaagcgaaagcatgcaggattcagaagcccaatctgcgaacatgcaaattctccattaagtaatgatgaagccgatgcccctgccaatgagtttgtgactgccaggacaaagttggtacgctcagtgcttttattctatattgtacaattttggtaaatatttagagtgcctctattattctatgatcctccaacaaaaagacatcgtaagcactagtggcatatgatagtaggtgtatttaacttctgcatttactattcgtgccaagactctttctattattttagcatcgcatagttttgaaaatgggtagcttctttgttatgctcgtttatgcttgctggtttgccactgtgccaaatcctgtgcatttcttaatgaccattggttgatggcaaatccatatcatttaactgttctttttttttttttacttttctctgtctgctgcatgcactgcagtcctgagcattctacacgttacctaagaaagcatcattaggtaacagttagctaaagttagaaataaagttctacttatggcatagcttgaaaccatgatatgtattgcagcatatcctgtgcgaatattttatttgtaaaaac

SEQ ID NO: 26872 - DNA, 1066 bp, Oryza sativa
actgacaagcaaatgggtctgtctgctgcttgttttaattttcaacatagttccatttgtatcctataaagtcaaggctagttacatctttctggtctgcatatctttaatcaatcataaaggtgctacggaaaacaaattcatttgtttatatgctaataaatccatcttattaatgttttcaaagaattatagtctatatggattagaaccaagatttagtacaagcgtggaacatgcttgtactccctacaattgtttgtgatctctctcacttgctaattctctcatcccagcctttatatgccctctcctcagaaagtagaaatcctaatctctgtcaaactatgtttgcccattttgtgcacagtaattatgcaatctttttttttcaaaaaaaaatacattatgacatagaatgtgaaggcatacctttagattgataatgattgttaattctcctgctgtgcagattggcgagggtgaaaagctagttcgagcactatttggggtggcctgttgtcgtcagccagctgtcatatttgtggatgagattgattcactactatcacaggtttttcttagtgaattgtttttgttatgcacatacatgttgcatcagttgacacctaacacccttacacatgatttcagcgcaaatcagatggtgaacatgagtcaagtaggaggttgaaaacacagtttctaatcgagatggaaggttttgacagtggaaatgatcaaattttacttataggtacctcatgcgttaaaaagatgaaaatatcaagtgtgatatgcattaatgtatgtcatggtaggaattacaggatatttatatgtatgaggtttgagcatcaacatagtatgtgcttttctattgtccttgtgaaatgcattattgcatatccatctttgcctaaaggcctatgctttgaagttgtgttgcatagtctatgaggtggatgttaaatgtggggtcataaccaatggtggaacttagattgggctgatgtcatggagaaaaaatgatggcaggagcaacaaacagacctcaagaactgga

SEQ ID NO: 26873 - DNA, 1386 bp, Oryza sativa
ccaactttcataactttattagtttgtcatttttgtttttgatccttgcacatgatgacagtacctctgaggtattgtttcactttcaccctaaatttacatgaaaaatcctaaatgcaatttgttttacctatgtaaatgatgcaagatgcaagtgtaggagctgaaaatttctctttcagggaccaagaagaatacaaacttaacagttagttataatcataagattatatattgtgtttcattttattatcattaaactgatccacatgatgttcaagtgattacagaaatgcatagatttttttaaaagttgggtttgatagatgtgtagaattccatgccgccatcagtgatgcctcgcaagcaagccacaatgtctgcacctaggccttcagcggctccagctactgcgtgctgcagatggtacccttccattacagtgagggggtcttccagattagctatcacggtggttccttggtgtgcccatgggcatctcaccaactgtttgatgaaatgcatggtcgaggtgcactcctgttactgtttgaatccttattattatctcatatttactctattttgcactgtatgttgtgattgaaagctctgcctatgtaaactaaaactgaattgttccttggtctccaatacttcatatgttgcaggcaaatatttcatttctgcagggtagaacaccatattattttagtgtatagattttactatgagatccttgactttttaatgactattggagtcatgtcagtatgttaatagtgatatagatatgttaacctgtccaattttaccttatattcccaacacaatagctttgtttcttgactgagatttatttgtctcatgtttctactgcattcaaaagtttgcagatcaattcatatttcataatcaatcagcaaacctggacattgtttcaagggacatgtggacttggctacagtatatctatttgcttgatctttagttgcatgtagactccttttgagatttatttattttaacccacaaaaaaggagattatttattttaagatatgtccctttattgttcaactgcaactaatttggaagttcatagataatgagatgtaacagatgggccattaaaaactctctgagtccgttctatgaaatgtaaagtaagatgccatgcccttcccagtattaccttattactgttatctgccttcttttattgataaaaaaaagtcatgtgaatcttggagtggaatattaaaaaaccactgcatacaacattgcattatctggatgagttatcatcaagcatcatactgctatttctaatcagtgttgcacatgtatttcatcaagctcctttgttactttctggctacatgaa

SEQ ID NO: 26874 - DNA, 758 bp, Oryza sativa
acagaagaaacattttgcatttcgattggtgatggtaggatgcaacatactactacattaaaagaaaattccaagatatttactcaatgaaacgaaaagacagaacaaaatgttctacggtgcatcaaggttgccagctaagaatcagaagtgggaaaaacaaaaggagtgattgatacttagacagtccactgcaatgagtaattgatctaacgaagcagcaacccattagtaaagcagaaacagactaatgattaagaatgtgtagttttgctttggagtacagaagctccccaacttatctttattggaatattaaatattactaccagcaacaaatcgccaatcactattaaggacctatgttttctcacatttttcttggttctcatacacaatatgataacaagggcacgtgcaagtattagtgaaggtccaatatactgagtaaaagcatcaaactacttatcttttggcatgactattcaggttttacttactttcaacatctccctgcaaattaatttgctaagctcccaaattgcctgttccattcttcataagttcccagttcacttgaggaaacagaaggtctaacctcctgcaaagcagtctcaaaatcctacagatccaaaattcaaaataagcttttaaaatcggaatgctacattttgggaatgattcatcgcaacaaaggacacacttatttgacaatgcaatagacaatgcaatcattgtttatccttttagtgatcata

SEQ ID NO: 26875 - DNA, 492 bp, Oryza sativa
tctatatttataggtccttatatacctggaactaaaatttcatgaaattccatggtacacttaaataccactcgaatttgccgtgttcccttttctatcactaccgtccaactccgttatttgttccgggttttcttttcttatttgtgaaaacatttgtgttaagtaccagagctgcccctcctggtcaagaattgggaggcaagttgtgacccttgtcgctgtctagctccggtcaccggatcatctccggctctcttctccagtggttggtcagaggagaggcagcaccaaaaaaattggaccaatcttttcattcagttacagcatattacacatttattgccgagccaaaaacaatgaaaccagagcaaacaagactgctgcagtttggccaagaaaaaattgcatcattaatctttagcgacacaagaatacatttgaagaataaatcggctataagaattcatgtcatcatacaagattgagggt

SEQ ID NO: 26876 - DNA, 518 bp, Oryza sativa
taagtactattgtcctgcttttggctagtgtgaagcaacagctggcccaatatcaatgcatagtattctaggaagaagatattatactgctagtgtaaatagtcgttttgacatcagtaatatttcaatttcattacacttcctgaaccttgttttacattttcgaatgtgaaaaggttgtatttatctccagtggttgcttggcacaaaaaactattttgtagaatatctgatggagcgaacagaaataatgagtaacgtgttgttaatttaaaaggatgctgagttattttaatccatgacaatgttcaggttctccaaattttggaactctaccgaaggatttatgaagaatttttagcagttccagtttctaaagggaggaaaagtgagatggaaaaatttgctggtggactgtatacaacaagtgttgaggtattaatatgaaatgtttgcttcattccacccgattagtttttctgtagttaccctgatgaagaagagtacttatctttata

SEQ ID NO: 26877 - DNA, 2867 bp, Oryza sativa
cacatttgtagtattgaccctatgcttgttttgcagattggggtgatggtgatgacacacggagatgacaaaggtttagtgcttccaccaagggtggcacctctgcaggtcattgttattcctgttccatacaaagatgttgacacaacagctattgtaaacgaatgcaaaaagactgttgagacactggagaaagctggtattcgagcagacttggatacccgcgaaaactattctccaggatggaagtattcccactgggagatgaaaggcgttcctctaagaattgagataggtccaaaagatatggcaaacaatcaggtacagaggtcacaccatttaatttattaacttcattgatcagtggcacattaattactataatgcttctaggactcttcataaagtagttaatgataaattaataatgccttccatatccatgatagaatccacaagtttattagtagatcagtgtacttgtataaattggtttttcttgttagcataagatgaagtgtaaatggcttctttgttctctattccctatggaaaatatgattaattaatggcatcaaaacagtaagtagctaatgaatatataaactaagggcacctttgttatcatgcattttcctgaaaactgctatatctttactgttagagaaaaagagctagtggtggtggtggtgatggtaagtctgccataccaccaccatcaccatgggttctgtgcatacatgcacgtgtgtttcttttatctgaataattatatcatttgcacatgtggttcgtaataataggatcatttgtgaactgatgatcaatccgaagtctatatattgttcttgagttcagattttatatttatcctagatcgttgcaatgcatgagttggctagttcatttaataacctatttctcctctttctacttaaaatatgttaatttgattcaattaagcaactttcacatcttttccagtgactgaatggtgccctcaaccatttctcatataggtttggcatggatggagtaactttcattttgttgtgctgtttaatttgctactattccctgaacctttattccaactaatactccctccattccaaaatataaagcacagctacccttagcccaaagaccaagaaataattattatcaccttatagtttggattaatctaataaatgtaattcatgcacccaataaaattagagatcttgatggtggagaatttaaataataatattttagtagagaagatgggttagttaatggcatgcatgcatgcatgccttatattatggaacaactttaaaaagtagttgtgccttatattatgaaatggagggagttaatgaaaacatcatctgcttttcaggcccgtgttgttaggcgagacaatggtgcaaaagctgatattcctacggctgacttggttgagaaagttaatgggttacttgatgaggttcagaaaaacttgtttgagacggcgaaacaaaagagagatgcctgccttaaggttgttaacacctgggatgaattcatagtggctctgaatgacaaaaaattgatcctggctccatggtgtgatgaagaggtacgtgagacctttttatgagatctccctctcaccatgttatttttttagcactagttaactatttggaatatccagtgtgttcatgttctcttctacaaagttttcttttgattgctggggcaaggcgtatttgtatatctttattatatctgttgattgtggagggagaatgggaaggtaggggtaacaccagtgaccaatagaagtttaaagcaccgtcgagcttagttcaaagatgggagttaagtagaatggagaacgaaatgggatagcaaggagactcaatgaggtttgcaatgtcttggtcgaaggtcacattcaatagtacctgcaaaataatttattgcactgtgatatctggagttctgttagttactaccaaatatactcctgtgttgcactagttattaacataacattatgaactatttacactggattactaacattttctactcaacatgggcatcttccattttcgtgctggttcaggaagttgagaaggatgtgaaggctcggacaaaaggtgacctgggagctgccaagacattgtgtacaccatttgaacagccagatctcccagaaggtatgctttgcaggcaatagctaaaatgccacaaatagcctgggttcacaatctcttttgctcggtcttttactgcatttcttgcaacgtattcttccatgcacttgtaactaaccttttctgatgcggtgcaccaaaattcaggaaccacatgctttgcttctggaaagcctgcgaagaaatggtcattctggggccgcagctattgatctgtaacggatctcggttgtgatcattcattcctgctggcgaagccgttgattcaccatagacatgtattgcagttttcatactagcaaagcatgatacacatacatctatttaccgtgcagttttgctgcttgtcagaaatcttgacattggaatgtttaagtaacatcttgtttggttcagaatcttgtttacccagcaacttaattgaactaatcgttgacattgtgttttccgttacgtgtggtcatcttgatcgaccagtccttcaaaatctgatacacgtgaatgtggtgctctcatatagggcagcatgacaacattgaagaaaatcaaacaaaaacaaaatgcgcataattcatttacacgcaaaggaaaactgcttatcccctttttttcagtaagctgcagaactatgccagtcccacaacagaaaacacccgcatagcatgctctttcttt

SEQ ID NO: 26878 - DNA, 2267 bp, Oryza sativa
caaaaaaaatgcattattaatctggagcgtctttgaaatacgagaataaatcggctataagaagttcatgtgatacaagaggtattttgggtggcactcttagatcagaggcttgaggatttcagatctacaaaggcgcaaagctgcaaacatgaaaacttcgacaaagatactaacagatattcaacttacgactgagaaaatggtagctgtctcctgcaaaaacagactacagaaaatagtggtcgaccggttctgtttccttatcgaatttcttcagctccagcagagcgctccaggtggggattcagaattatgcaaccgcgggcatgtctttgagccatgcatcaagcggcttgccgatagagtagacaatgaagccaatctccctgagcttctcaggatcgaccacattgcgcccatcgaagacaaatgcaggtttctgcatgttgtcaaagatcctctggtagtccaaggtcttgaactcgtcccactcagtgaggatgcacagtccatgggctcccttggtggcctcatacgcatcccagaccacactcacctgcttaaaagccgtggggctagttggctgcaggtgccttgggtggtcccaatcaaacttggccatggaaaggtcccgctggatctgatcttcagttacctgtgggtcgtagatgctgatttgagccttgtcacccaacaggccatggcacacatcaatggcaggtgtctccctggtgtcaccggtgtccttcttgaacgcaaagccaaggcggcaatcttcttgccagagacagtgttgaagtggacttctcaacaacgatcttgtcagacttggagacatcagcaatcatccgagcagcactttcccagtaggtgaggtcagcagccttgcctgctccaagtccacgggtcttggtgggggtgttgacagatacaaagatgatgttcgcctcggcgacatgcttctccacatcagtgctgaagaagaggttcctgcctctgcactccttcacgacctcatcgaggccaggctcgtagatcgggagctgttcgctgttccaggcatcaatgcgaggcttggaaatgtcaacaaccaccacctcgattgctgggcatttgagggcaatgacggccatggttgggccgccgacatagccagctccaatgcagcagatcttcaccatcttctcagcttagttctgaaactgtgataatgaaaactgattttcaggagattgaagaataagcactaaaagtaattatatagatcagaacttgtaagcagcatttttgagttaatagaagctatctagatacacagtttacaagcacaatgaccaatatgtcaaaagaaacatgcaaagactgctaggctgtgaaatacatttagtcaggttctgaggaacacaattaaactgataaaccaatgagcagttcatgataataatatgtgcctattggtgtcaaactgcatcaggagaatgacagatggagatccgtcaccacaacaacactaacaaaaagtttagctaacgaattcaagttacgagcagaataataatgcctctaattcatcaacgacgacagcactgtagcaagcagtaaaataaaaggaaatagttccaaacaggggtgaaaggaaacaaatttaatggcacaaacacagagtaaatcaagttactgaatctagcaagggatcatatatgtgcaaggcatgaatctcaagcaaattcagagattcacagcattaagtatcttgagatgaacaactaaaacaggaaaccacacagcttgcatggtccatactcgaactacagatcaaccgcagaagtatgcacgagatcatgaagaatcttaccagatctcaagaacttaagacagatcttgaggagaacaccgacagagaagagaaatgggaggcagcctcttgtatgcagagggaagctgcctacgatatgcactcagagggaggcctcagctccttatatgccccttcccacaaacccagcagatcagatctaccccccctccgaaaaatttaccgtgtcaaggctggtcagaaatctggaataaatgagcaggtgtgagttggtcttatgctttgccaagaggccaccaaacctccactaatcaaaaaaggttcccatgagtccatgacacaccaccaaacctctttaagctaaccaattaagaaaaaagaacagctaattaaaaaatggttgctttgtcattatggtataattgaacagcatgtgatcagatttgcc

SEQ ID NO: 26879 - DNA, 1063 bp, Oryza sativa
aaacagctttcctcaatgaaaatctcgatgaggatgtgtacatgacacaacccaagggatttgttgatccacaatcagctaaaaaagatatgcaaattgcagaaatccatttatgggttgaagcaagcatctcggagttggaatattcgttttgacgaagtagtcaaggcgttgggctttgtcaaaaacgaagaagagccttgtgtatacaagaagattagtgggagcgcactggtgtttctaatcctatatgtagatgatatattattgattgggaatgatattccaatgcttgaatccgttaagacatcgttgaaaatagtttttcaatgaaggacttaagggaagcagcatatattctgagcataaggatctatagagatagatcaaggaggctaattggaagccagagtacatacattgacaaggtgttgaagaggttcaacatgcaagattctaagaaaggtttcttaccgttgtcacatggtattaatcttggcaagaatcagtgtcctcaaacgactgatgagcgaaacaagatgagtgtgattccatatgcttcggcaattggatccatcatgtatgccatgttatgtacacgtccagatgttccatatgcacttagtgcaacaagccaataccaatcagatccaggtgagagtcactggatagctgtaaagaatatcctgaagtacttgagaagaactaaggatatgttcctaatttatggaggacaggaagagctcgttgtaaataattacactgacgcaagcttccaaaccgacaaagatgattttagatcgcagtctggatttgtgttctgcctaaatggaggcgctgtgagttggaagagttccaagcaagatacagtcgctgattctacaacagaagccgaatacattgccgcttctgaagcagcaaaggaggctgcttggataaagaaatttgtttctcaattaggtgtgatgactagtgcttctagccctatggacctctattgcgataatagtggtgccattgcacaagccaaagagcctagatcgcatcgaaagtccaaacacat

SEQ ID NO: 26880 - DNA, 2173 bp, Oryza sativa
  unsure (1)..(2173): unsure at all n locations
aaatcttccaaggtataacttcaactaggcaaacctcttcctcataagcaatatctacatgatgttctactataaaatcacatacattttggcctctcacagatttcaatggttcataagccaaatcatactctatcaaagcatatgcccacttgccaattctcccacttagaattggcctttgcaacatgtgtttaataacattggcttgacaagcaactatgcatgtactagataacaaataatgccttaatttggtacaagcatagtatatgcatagacaaagtctctctataaagacatacctcgtttcggcatccaaaagacggcggctaaaatatgtaataatatattccttgccatcttcctcttgtgtcaaaacggcaccaatgactttgtcttcggaggcaatatataaccgaaaaggctttccagctttaggcgcccgcacaacgggtggagtagataaatacctcttcaactcctcaaacgcttcttgttgttttgccccccatgtaaaatcggcttcttttttcaagcgaagtataggaacaaaagcatcgattttacctgctaggttagaaataaatcttctcaaataattcaccttacctagcaacttttggacctccttcttgcatgtcngcgctntgaaatcacgaattttttctatcttcttaggatcaatctcaactcctctctcatgcaccaggaatgctaagaatttccctgccgtcaaaccaaaagcacatttaagtgggttcatcttcaaaccataccggcgcatcctctcaaaagccaacctcaaatcggctatatgttcctccataccatccgatttgacaacaatatcatcaatgtangcttctaagataatacctagtaaatcatggaagatcaaattcattgccctttgatatgttgcaccggcgttcttcaatccaaaagtcatgacaacccactcaaacaaaccaacaaatcccgggcacctaaaagtcgttttatatatatcctgttccgtcataaagatttgattgttgccggcattaccatctaaaaaactaatcactttatgacccgaagcatcattgatcatcatgtcggctataggcataggatattcatctttgggagtagctttattcaaatctctaaagtccatgcaaactctaatcttaccacttcccttcttctccaccgggactatgctagaaacccactccgcataatgacatcgcctagtaaaccccgccttcaacaactgatcaatctcctctttgactcggtcatatagcaaaggattaaaacgacgaggtggttgcttgtaagggctaaaacccggttgatttgagagcagtagttatcaaggcttgtgtataagaaccggcatctaatggtactcccacgcagagcaagcataacactctgtaagtagcttcagatatgaaccttttaatcggctctcatatttttgtttacaaaagttggccttggtttagttccatctcctgtgtctacttcctccaatggatcggccgatgtaaacccttgtccaagtttctccacttcatcgaaatcttcaatagtctcaccaatatcattctttgtagaccgatattcttgcaccctcttttgtaaccactctaaattagccctttactcattatacaaatttatatggcttagctgtgctacactagccggctttacagaggtagatacaaatttgccatcggaaatactaataaaatcatagctagaaagatccatccccgataagcattgaatattcccatgatgccactcaaaagtagcatcagccattgcaacctcggccgatgtatccgcttgaacaatctcaacatcatcgctgtcccattgaattaaacattgatgcaaggtagaaggcactcaataattggcatggatccaacaacgacccaaaataacattgtaattaccttgcacatcgacgatgaagaaagcggttggtaacgtcttgtttcccatggtaagctccaccgaaaagatacccttcgcctcctttggttcaccattgaagccattgagaatcatgttggtcttcttcaactcattatctccacgccccaacttattgaacaacgaatacgacatcaaattcacggcggtacctccatccactagcatccta

SEQ ID NO: 26881 - DNA, 1729 bp, Oryza sativa
tgccaattttgataattttactattagacatattgctaggcatgataattctagagcaaatgacttggctcaacaagcatctggctataatgtgaagaagggattatttctggtattggaagagccggtgcttgattttaaatctctgtgcgaaattggcgaaattggagaccaggggcggtctgaccgacgttgcgcggccggtctgaccggtgaccaagtgcggtataaccggccacatgccgccggtttgaccggcgaccccgagcggtctgaccggcctttgattcgatatttaaaagatcccacacttaaggttgatcggaaaattcgatatttaaaggattggagaattcctttgattcgatatttaaaagatcccacacttaaggttgatcggaaaattcggtggcaagcactcaaatgcacgttgcttgatgaagatttatatcccgaaatatagatggtgtcttgttgaagtgcctagatgaagatcaatctaaagtggctatgggagaggtacatgaaggaatttgtggaactcatcaattggcccacaagatgaattggttgcttaggagagcggggttctactggccgaggatgattgaggattgcttcaaatactataggggatgtgaagcttgtcagcggttcggcaatgttcaattggtgcccgccgccgtgttgaactctataatcaaaccatggccgttccgaggttgggctttggattttattggtcaaatttatccttcgtcatcaaaggggcataggttcgtggtagttgctacggattacttcaccaagtaggccgaagctgtgccgctgaagaatatgacttatacggaggtaattgcctttaatttgaagcatattattcatagattcggtatcccgcaaacattaactacggatcaaggtgtttcttttatgtctaaggaagtaaagagttttaccgaatcttatggtattaaattgttgagttcttctccttactacgctcaggctaatggacaagccgagtcgagtaataagacattgttaaagctagtgaaaaagaagattgaggaacacccaaagaggtggcatgaagtgctttccgaagcattgtgggcgcataggatatctaaacatggtgccactaaagtcactccttttgagttggtttattgtcaagaagttgttttaccgattgaggtaaatcttggttctcttcgttatatcaagcaagatgatttgttaagtgaagattacaagacatttgttaagaccttgatgatgtcattgacaagcgtttgaaggctttggaagagatagacaaagagaagaagagggtggcctaggcatacaacaaaagggtgaaagcaaagttgtttcaagttggagacttggtttggaagacaattttgccttcgggtactcgatccagggagttcggtaagtggtctcctagttggaaaggtccttatcgggtatgcggcattgttcgagggaacgcatattttttggagacacttcaaggggagcgttttcagcgagcaatcaacgggaaatacttgaagaaatacttcccgagagtttggcaagacgcttagaaagtactatggccggtaaatggattatcgtttttcatattgcttttagttttctcttaatttgtccatctttgtcagtttgcgccgtaaaccatccgccgccgctgcgagagtgcgacatctctttgtag

SEQ ID NO: 26882 - DNA, 3140 bp, Oryza sativa
aaatatgtgtgacgccaaatttttagaaaaaaacggaaatgtacttgagagaattgcgagaccaattaatataccttgaggaagacagcgtttgccggtggaacactctcaaacatgtcgccggtgatgaactcgacaccggtgccaccgggagcctcggcgacgacgtgggcgaggtccatcacgctgcatttcacctccgggaacgccctggcgatggcctgcgccgccgtgccgttcccgccggcgacgtcgaccagcgagctgatcccctggaacacctcgccatgctccctgaccaggatgtccatcgtgaagatactgtccgacgccatcccgtcgttgacgaccgtgttgaacgcggcgtcgtcgtcggccatctcccacaagctccggccatgggtgtgcttgaagatgcacgggccaggcagctcgcgctggagccagtcgctgatccggaagaagggggtgatgaagttcgggtggagcagcatggacatcatgtgtccctggttcccggcgccgatgaggaggcgggacaccggcgtgagcgcgtagacggccgcctcggcctcgtcggcaggggctgcggcatcgccgggcgccagcttctggacggcgaagacgccggagagagtgagcacgcgcatgaggcgacgcaggcatggaaccttggacgggtggagcgcgaccctggtgactatctgggacagagtggcggcgccgccgtggtggtggatggcgtcggcgatgccgaggtccatggcggccttgagagccatggacttgacgacggcgaaggtgttgccgtagagctctctcagagcgtcgagcgagctggtggcatcactggcttgatatccattgctcttagcatgcgccattgctgtaatgcagtgagggcactaatgtttttttttttttcggtcttccttttccttcggaatgggatgatggcactactgcgctataagtagaggtctgaaacgcagcacaactcttctttaattttttttaaaaaatttacgcagtacaacgcaatcactcacaacacacgtagactcaaccctatgaaggcacacagcaaaccctacccctatgagcaccacttttaaatactaattatggcgagtctagaactctggattgtatgtggtatagaatatatttatagattggtatatatttattattggaatagaatccatagtatattttctctgggccgataatacttgtcgttctatacaagagtgaggttaaattttagaatctttaattatgaatcatttctaaaatatttttcattcaaatatagtgactacgtgtatagattagtcttaaaaaatattttaataaaatcatatacttcctccatttcacaacgtaagacgttagttctatatatgtgtctagattcattagcatctatagtaatgtggataatgctagaaagtcttataatatgaaacgaatggagtatttgttaacagttttatacatattataatagaaaataattatcaaaattggtttttaaagaccgtgctctaaatattatcaacccagagaaattacaagaaattgaattctactcttgacgattagctttccgcataactgttcatgaaaacctgctagctatatatcattaccagaatacgtactacgttttaattttttggagtgagaactttctgggataccaaaattctaaaaagaatcatgtcaaaaaaattttcaaaaagaatcagcatctatctattattatataaaaaaaatcattaaacttcctataaacgctcgcaagccgccatgtggtactcctacaaacgcttctaagatgtcatgtggcgctctaataaagaagaaaaaatcttacaaattctgagaaaaaagaaaaacatccaaccctcgattttcattcaattcggtggacccactattttaaaacaattatatagatttatttaaaatacatcccacgtatatatactgtcacgcacagaaatttagcccaaatttccggaatatcttgtgtattaaatctctgtccaggaatcagccaggatacacaaaacaataaattaatatatagatccaaacgtaaataaagcgtaaatacttacagaagagccggttagtcctcacaccgaaaagaaagtgacagaagcgaaaaaaggcgatcctagcggggggcttcagctccactccacaggcaaaactcaactagggtctgagccttggtcctctaacttcgtcttcagctcaaaagcgctacacttctgaaaagggagaataatagcaaggctgagtaccaccaccgtactcagcaagccaaaccaacaatcgatgcagacatgcaaggggatacaaagaggggtttgtggctattgatataaaggtggttgcaaagcattttattgagcaaacaatagaacattcgattaattaagataatattatgcctgcactgaacaacgctacaccacgttgaacatgaccaaccatcccacctgaactaacctatgcattgagtcgatttattaagagtgagactaatcacggtgattctggtcgatcgcccataaccacgggcacagctatttgaatagttttagtttggccagaggtgcacaactgtactcacaagacacaatccaccggcatgtcaacgcgcccggccggacacgtcaccatgttgagtgattgtgacgagacccttcatataaccccctctgaccaagcacaccacacctcaggtttcacccccactcctcaacaggcaatgagcagcccccctcgtggctaggcgaatcagcaagccgcataggccatcgcaaggcccatctgaactccatcacgcttacccttgcctggatgcgtcagccagaggaaagctatactacagatcaagcagtcacccattcccgcttgtggtaagcgcggtaagtcctctagtgcatcccgcgaaccgcttcttaattgccatgggtgcgactatgtcacgtcccaaaacgaccctaaaatacatcctctaaattatgcctagaataattaaaatccgtgtgaaagcctccaacaattaaaaggtgcaaagttaaaagtcaaataaggcttggaggatttttgtatatttc

SEQ ID NO: 26883 - DNA, 2917 bp, Oryza sativa
cgccactcgccgccctcactccccgtcgaaatcgagctcgcgccgtcgctctctctttccgccgtcgccgccgagctccggtccgccgccgtcgtcgccccggaccacctcccccctcggcgccgccttcttcggcttcgccgcgtccccgccgacctcgtccacccctccgtttcggtcgccgaccgccggagcaccgtcgaccccgtccacccgagccgcgccgccgtcttcctccgctccggtcgccgtttccgtcgtcgccgtcgaaccggggtgagccgtggaccgccgcttcgtttccccctttccctcccctctctcggccgctgctccgccgtgcctatggccgccgccagcgaccataggggcgcgggcgcgccgcctcccgccgctacgccggcgtggccgccttcgggcgcaccgagcggctgccgcgtggggcccggccgtcagccgcccgcgccctcgggtgcggctgacgcgtgggacccacggcgccggccggtgcgagccccggtgcgcccggtccaccgtggaccgtgaggctgccgcgtgggccccacccccgtggacccggtatgcgcgccccctcccctcggctgacgcaataaaccttttttttaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttcttcctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattattttgatttaaattattgcattatcgctttatttaaattcccgcgttatcactgttttatctagccatgcctatttacctttgttatgaccttattattgttattgttattatttccttgttcaccctagaataaacaaaaccccaactaatggacactctactcttggtaccactggtatgaatttaagtagatgcttcgctggttaattaggcaacgttaggtggttttacaactctaaactttgggaattttctcatcacctggacactatggaatggtttgattattgtggaattgaattcaccccgccccctctattcaaaatccccaaaatggttttaggctgggctcggggtgcatggttttgatagtagcacctcggccatataaggaccggtcttcgggcctctgttgtaaagcactaccgtacttccacatgtctagtgggtaaggctttgtttgtggctcagtctggttataaacaaaagtacacggatggagatggacgaagtcgggggtcgatggacatctctagggcaaatgaaggctacacgagctgcggcccggtagtcgagatgtcatggcacagggccggtgtcctgctgctaggggctcagccctgcctacctgtcccgggggttccggccgtaggtgggattgggtcggtactcttgtctatggctaggatgggttggaaactatgtcacgtcttccgtctgtataccgaggtggtatgtggcacgtggctacacgtgaggaagatgtgtcttgtgggtaaagatgtacacctctgatcagagtataatctattcgaatagccgcgccctcggttatgggcaagccgagcaatgtacccaagttagtgttttaattcttaaaacctgtttaacaactaaaatgtggaatggttggcctgggttggcttgggaagaacctggacccaaggtcgggttgccagttcggtctgaatcatcgtaggccttgggttaaggcaggctcgtgtgggttcacggccttgtttaataatattgtatagctctaggaccgtatttacaaaatagctttgagcaactaagtgtcttttaatgctgtttacggtaaaccctaaccctttatattataactcccttgtactcccttgcatttattctgcacttgtgggtgtgtcttgttgactacggtggttgtactcagtcttgctcaatttttcccaaacccagaagaggagtccctggaagatgaaggctttggtgtctagctcgtgcctgccgtcaagcgcctgtggtcgtcgccctagtcttccgctgtttctcgtttgtctttgtgtgtgctgggccttcgctgcccatgtaataaattatctatttacgcttccgcttgttaaactctgaactgtatcaacttttggtgtaccttgcctcctgggacaaggaataatgcacgcacgtaaggaacgcctgttgggttatttccggtcgtgacagactagaaaaccatgcacccacagctcaccattcagtcgcattttagttggataactacgaccaatgaaacatggccggatgtctcgagcacgcagctcgccatgatactaaaaggactaatactgcaattatcccatcaagtgagctagtggtaattaagcattgctaagcatatagttctaactaggtcaacatgagtatcacgagctagataaattatcacccaaggttgacaaggacgggtaacaagtaaacatggcacaagcgagcagataggtaaaccctattctcatgtaattggcaaaacatgcatatttatttgataacgataaaacatttgtaaactaggatcaaaatgctcaaggggaatgtgtgacttgccttgcttcttcaaaacaaccttatatcttttcctcgcgaccacgatcttccaaaatggcagaaactacacactggcacgcaatataaggaaaaacact

SEQ ID NO: 26884 - DNA, 6755 bp, Oryza sativa
  unsure (1)..(6755): unsure at all n locations
caattcattccctcagctcttctctcttaacttttgttttggttttcttttttacttatatatccattaatttacactaatatcttctttttttaagagtcaagtaagatgatcacatgttttaaagtctcatttctttcatgcaaccaatatttgtaaaatttagtgtaaattatacatgttaaagtgtgattgttttttatgtttaaatctttgaaaaaatattgacaatcctagatatatatatataaaggattgttttgcagtaggtagtacgcattcataatgaatcaaatctccaagatttatatatgtcatgtatttattatttactaagctaggacgctctaacatcaatagacaaaagcataaacaatatgaactgttatattaattgtaactggttgagattatgatggtgtagattataatcgacataactatacaaatataagtggatatatataataagctgaagcaagaactatgtatataattcagttatacttttgaatatatatcttcacatataattacaagaaaatcagctagttagtctaatttcaacttgtggataaatcattgaagactaaaaggatagcaaaaacaagtacacctggtatatttgttaggcctagtttggtttgttggccaaacaaaccgtatccaaattttggtatgcgaaatgttggcccattttggcatttccaagtaattttgggatgtgtttggtttgatgcagttgctaaattttggtatagttttaagagtaaaagatttcagaagtactaaattttggcatcatatatagcaatggttaatatgtgtttttgtttgttgccctaccaaaatttgatagtaccagaatttggtaaggttaattaatgaaaacatgatcattgggactaattaaccatgtttgctaagtgcggaaggatttcaatgccgatgattaaatgtgatataatgattcatccatcaagaagttattcatcccggtgattaataaatgggcgtctaagatacatactaaaggtaattatccagtcttcaacaagcaaagtgaagattaaggactcctattcactagtttaccacatcgaaggagttgggagtgatgtagtcattgaatagggttttactccaaactataaagaggggtaaagttagtagattgtccaggaagctagtgttagtaactcatgttactggaccttgggttgaagctactagcccactgtggcccatccgattggaagaatgacaatacaaaagaacaagcatcagtcagggagaggggatcgatcgatcagaagaaccggacggcggcggtggtggcgacttgaaggccggtgggctccttgtcgatttcttctccaccattcctcctacctccacccccttagttctagaaccccttctagaacttatatcccttttcttcttcccattttctccaccaaacaaagagttgtactgaatatttgttgcaatttcgcttagagaagtgggtctctaagggtctctaacagctaggtgtgatgcacactagcgccgtgtttagttccaaaataattcttcaaacttccaacttttccatcacatcaaaactttcctacacacgtaaattttcaacttttccgtcacatcgttctaatttcaaccaaactttcaattttggtgtgaactaaacatagcctaagcctttttctagcacaatatctatgctttttccctagtggagttgagccggagcaaagtttggattgcgaatcattaattgtccttgagtctcagtgtaccggacggtccagtgccacatcaaacagtccgtctaacggatcatgtgttgatgaaagcatattgtgtgtacgtgtcaggtaggccgttgttgactagatagtccagcatgttttcttccaactggaccatgtgtcgatccaggccataccgtgtgtacggtccagagaatccaactgcgtgtcagactgtctggtggatggatcgttcgaccagaccatgtgttggtcctgaccgtgtttgtgcacatggatcggacagtccgacagatgacggatcgtgtggccaaacaatgtgtttgtctgagttaagacattacatttactggacagtatggtgaaaatcaggcaatccactcaaatcacatggaggaggcctaaggattatatggattggacaatctggtatgcaaccggatagtctgccttatacatgggtcggatatatagttttgatatgagtaaattgtccggctttttatggtctaacggctagttacatgtgatgattgaaaagtttatataaagggacaaacagtcctacaatacatcggactatctaaatctatgctttttttttttttgcaacacacttgcaacgactagtttgagtggttagggttataaatacccaattgtttagacttcccctctagctttctagatatagtgttaatacaaggaagcatcatcttgttattgttggcatctcgatgcgcctaaacggttgtggaggtggttcctgtgatctctcaagaatattgtggaagactcgggtgacgtgtggggcttggagctcgctatccaaagttgagaagagctagctatctctcgatagtgctcgacttcatgaccatgagacttttgtgtacagtactcaacgaggactagtagagattgccgaatttccgatatctcaggaaaaactcgttgtgccttggtgtttgcaatatctctttttctgttcttcacttgatattcttattagtttcaatatttagcttgttctagaattgttaggatttcaactaggttgtagaacttgggctaactagcttttgaacctaggcacataagctagattttggagttgctcatattgatgtcatttcaaactatactatttttttaaaagttatcaaatatgtgcatccatttagtttttttttaccactctgttaaaaacataagaaatcataccaagacttagcaatattgccaaaattttgacaatgctaaatttggtaaggtttatttgactataatctgaacagaccctttattttctgaatttaagtttaaattcggccacatctttgatccacgtcttagagcatatatcgttattccccccctgacctacccttttctttgtacgcgttaagcccaatgtgttgggctggtccaaagttattgtaaatactccctccattttaaaatgtttgacaccgttcactctttagtacatgtttgaccgctcatcttattaaaaaaaatttgtgaaatatgtaaaactatatgtgtacatgaaagtatatttaacaatgaatcaaatgatatgaaaagaattaataattacttaaattttttgaataagacgaatagtcaaacacgtgctaaaaagtcaacagtgtcaaacattttgaaacggagggagtatattttatacacagaaattttatatgtatgacaactttatgcatacaatgtatgtataaactttgtacatatatggaaaattcatacatgagtagtatacgcatatatacgtacatttttttacgtacaaatttaaaacataaaggcacttagaaaaaaaaattaattactgtaacattatatccgaactttgcacgtataaataaactttatacttatggatcttaaaaaattcaaaatttattttgaaaaaaaaaacgcgcaggtgggctaacctccctcgaattcggtatgatctgtaaacactaaaaactgccaaaatccatatagaaaataaaaaaaaaagcttgatcgttaaacacgcaaaaactaaatgtggcccaaatagcgcgggcgaaaaaaaaagaataagttcatctgaggtcccttaacttgtcaacgaatccgattttcatccttcaactgaaaaaccagtgcagatgaggtccctcggcggtttggatggtggttttagctgacgtggcgcttacgtagctaatttgactcggtcttcatctgacgtagggttgacgtggcgcttacgtggcaattcgatctgaaaaataataaatctcatgggacccacatgtcagtttcacccaaaaaaataaattaaaaaatggtggggcccacgtggccccacatatcattctaacccctcctgttcttactcctctctcaccatctctcccctctgctccctccaggcgccacggggccacgggaaggtccggcggcggcggccggcgacgcgggagaagggcagtgggcagggcgtcgncggcgggagcgctgggtcttcgctcacggcgtcggcgcggactccgcgcgggggctcgtggaggagatcggggccgcggcgccgcccgtctccgatgaactgagctcgtgcgagcgcggtgccgggagctgcacgaccgccgacgagaagcagaggaggttcgaggtgtacaggagcaacgttgagcttgttgagaagttcaactccatgggcaatggctacaagctggctgataacaagtacgttcgccgacctgacgaacgaggagttcagagccaagatgttggggttcagacctcatgtcgcaattcctcagagcaatgcctggagagagcagtgatgatattctgccgaagagcgtagattggaggaagaaaggagcagtggtggaagtgaagtaccatgaagattgtggtgtgtgagaaatagcatggtaaagaaagattcaaacctgtaaaaatgttggagattaatcgatggaaatctgggtgttgtgtggatgcaggttcttgctgggcattctccgccgtggcggcgatagaggggatcaacaagaacggcgagctggtgtcgctgttggagcaggagctcgtggactgcgacgacgaggccatggggtgcggcggcaggtacatgagctgttagagttcatcgtcggcaaccacggcctcaccagtcaccacggaggcgagctagccataccacgccacgatcggtgcgtgccaggcggcgaagctgaaccagagcgcggtcagcatcgtgggctaccggaacgtgacacccagcagcgagcccgacctggcgagggccgtggcggcgcagccggtgtccgtcaccgtcgacgccggcaacttcatattccagctctacggcagcggtgtctatatagggccgtgcaccgccgtccgccgacgtcaaccacggcgtcaccgtggtgggctacggcgagtcccccaacactcctgccactgacgccccgcccttccccgcgtcgtcggccgccgccgccggacctcccccgtgaccccgtggcgctggagagaggagaggggagagatggggagagaggaggggtgagaatgctacccaccattttttaattcattttttttaaactgacatgtcccatgagatttattatttttcggatcgaatagccacgtaagcgccatgtcaatgctacatcggatgaagaccgagtcaaattagccatgtaagcgccacgtcagccaaaaccgccatccaaatcaccgagggacctcatctgcactggttttgatagttgagggacccgttgtatctggtttttcggttgaaagacgaaaatcggattcattgacaagttaagggatgtcaaatgaacttattccaaaaaaaaaaacaaagaatcagagtgatcgtgcgtgcgggccggcggctgatcgcgaaagcgatttcgctatttagaggctgagttggactctcttcgctaactttcagcttaaggaggtaggaaaaagtacaccgtagttcccttaacttgtcatcgagttgcaaaatcgtcccccaaacacaaaaccggatacaacgcatcccctaatttacaaaaccagtgtaaactaggtccctcggcggttttgactctggttttgtccgatgtgaaagctgactcagcgtgggacccgcgtgggcccacaagtcagggtgtccatgtcatcatcatctctttcctcatcttatctccctttctcctctctctctttcccagttttctcatacgggccgaccatgggtgcgaggaaggaaagggtcgccgacgacgagtggtgtggtggtgcggcaacaccggagaaggggcgacgcaccagcggcgagtgagatgtcaagaccgctcttggcgagatgacacaagcgacgggaagggctctgcgaggttcactggcacgggggacgacggcggcttgggggcatcgaggcgccacgctcggtcagaggccacctcagcgtgcgcaagcaggaggagcgctggcacaaggtggcgcgccgagagcggtattgcccaccactgccactcgcccaccgccgccacactcgcccgctcctctgctccacccacgtccagagccgctgcttacccaccgtcgccgctccgtagccgcgctcgcccgccgacgtcgccacttcgcccgctccggccgtgacctggcgcccactgcagctctgccgagagacacgcggtgacggacagggagatgagtggaagagcgagcccatatgagccacagtggaagagcgacccatggagaagagctcgccattgtcgtcgaagtcgagccctaatgagcagccgctccggccgtcctcctccgtccttgcgccatccctcccacccctcaagctctcagcggcggcgctgcttgcacggctccagtagcggctgctccgaccacgggcggtcctcgactggccgcgccgccgccatgttcaagcccgtcctc

SEQ ID NO: 26885 - DNA, 196 bp, Oryza sativa
tttcaaagcccctaaaacctgtttttcggttgggtttgggtgcatgccagttgtgggaagtagcaccccggccactataaggactaagctcgggcctctgttgcaaagcactaccgtacttccacatgtctagtgggtaaggcttagtttgtggctcaatctggttataaacaaaagtacacggatggagatggac

SEQ ID NO: 26886 - DNA, 542 bp, Oryza sativa
tctttaactagtacaaaattggaaggaactcagcatatattaattgttgaagattactattgaacaaaaccaaaaggaattgttgaaccaataataacagtgatacaaatataacactttggtttttaaggatagaaaaaacaagtgatctaaacatcgtatgcctacagttatccattcagtgtctcaacaaaaatagaatagaaacaacagtgtcacatcttaccctgagcacctctgtggcattgcctgcactgtagccattgcaaatctggtattccccttgcaagccataaatattatttactacaaagactgatgggtcatcatttccccaatttgtgctagcaccatgatctgcagtgactgaacccatggccttcacctaacatctcaaaaggagaaatatatttacaattgacgatgcagttaatctaatagaagtacgtgcgactgaaagaaaccttaaaaaaaatgatttgcataactactacacaacttgcccgctttatcaaaccaaatgcagttctcgaatagccaca

SEQ ID NO: 26887 - DNA, 2022 bp, Oryza sativa
ataattggcttgttaatttctgccatgttgctaaacctttgttttttgacttattttttgagtcgatgcaatatatcctatatatcctgtcttatattcattgataaaactagaggccagtgagtctcactgtgctgaactgtccctctctaaattgttattagtcaacaaatgacagtgggactctgaagaagcattcctgaatgattagaaggaaagcaacaattgcatttctttgtatacatattataatcacaaatccttctctgataactactagtacataattttccctttagaaaagttactaatgtatcttgtgtagaaattggtaaacatcttgtcaggaagaatcatagcaatgactatcacattttctgaaattgtatgttttgcaggaacattggagcacatacatagttgagagtgacttcgaattcatctcatcaagcgggctaaatgcagtgagaatcccagttggatggtggatcgccagtgaccccaatcctcctgctccatttgttggaggatccctccaagccttggataacgcatttaaatgggcagagtaagtatctccatgcagccatttatttatgaataagcacctcttaccctgatggccatgtcgggtgaagaaatataacacagatggttttagtctcatcttataaagaggacattggtgcttacattgctaatgtgcattgaaatggcaggcttgtaaaaagttcaagcaaattttccacctttttaccattaactaaactttttgttgaactgttggcacatgtatataggaattacaatattggtgtcattgtggacttgcatgccgctcctgggtcacaaaaccattgggagcatagcgccacaagggatggatcactagaatggggcaccactgatacaagcatcacccaaacagtgcaaatcattgatttcctcgcttccaggtctcttaacagaattcaccatcatccttaaacacaccatacaaatctatgattttcttgtaacgctatttttcaccttaattaatctacagatatgccaatagcccgagtctgctggcaattgagctactcaacgagccatggggaccggatgtacccctagaaaagcttaagaaatattatgaggatgcatacaacgtcgtgaggaaatacaccgcgaaggcctacgtgatcatgtcaaaccggctggcaggggagtccaacactgagcttcttgatttcgccagtaggttcccgggcgtagtcatcgacgtgcactactacaacctgttcaatgacgacacattcaaaaatttaaacgtagagcaaaacattgaatttgtgaagaacagccgcaaggctgagttcagcaacatcacgaagcaaaagagccctctcacgtttgttggtaagtagtgaggtggctctaacatctctggttgatttcctcttcctattttcttgcttgaacggtctccctcttctctgctgactggcatatattgaaaagttggaaattgcctttcaatcagaatttagacatcagaaggtttttaattctctaaatgatcgagaatttgaaattgtagaagaatatacggtcaataggtcactgaagttattgttccggtgcaggagaatgggcggcagagtggaaggtaaacggggcatccaaagaggagtaccaaaggtttgcgcaagcacagcttgatgtatatggaagagctaccttcggatgggcttactggaacttcaagaacgtcaataaccattggagcttggaatggatgatcaagaacgggtatatctcactgaaaatatagaaatagtgccataattctgtctggtgggtgaatacacattacacctaatgcaaaggccagaagcccagaactgtaataatgattttccattatctaaaacgaagtatcaatcgggttaacacgaactagaataagtctgtaaatcttgtttaattacggccaataaatcagttctgttagccaggtggaagcatgcatccaga

SEQ ID NO: 26888 - DNA, 20750 bp, Oryza sativa
cgtgtgcatttgttgtgtaatcttaaaaaagaatatcaacaacagtaagattgtcatatattatagtctgaggaaagggattggtcattgtcaaactcttataaattcactaaatagggcatatgcgagatcctgcaggtccggaggatcgtatggaagatacgtggggtacgcatcaacattccaaggtcttcgtacatgactagatccttagacaaaaagatggcaccaatctttgcagcttctacatcagagggatatgttatattttgtagaggagggaacctgcactctaatgttaagatatgacatgttaaaagacccgagtcataaatataaccattctattttagtgctaagtgctggcaacttttttaacaagttgacaagcacgatcgcaacatcttaaacgccttgcggtgatcctagagtcaccaaccaccctaatctagcaagcactaaatcaagatgggttttcataaactaaaccggctagcggagccgatttagatgaaactatggataactacccgtttcgtggacaaacggaaggttttcaggacaaacctacaaagaggtgtcgcactctcgcagcggcagcggacgatttacggtgcaaatcgacaaagatggacaaattaaactagaactagaagcaatattgaaaaaacgattcgattgattgattgtagaatattttttacaattgaaccggccttatccccttatataggggttggtcttaccttctacaggctctcctccacatccaactcaggatagaaaccaaaggaaactcgaaacatgccttcccaagcaaggaaaacttgagacccgacgaaagaaactcgggctcggactctgccggtcagactggctctctcgctttagggtttatgccggtatcggctaaattgctttactagattagattagctcgggtatctatcaccctgaaaatcagtcaagggtttgattgtataggtattatgtttcttttcatacttagtgttgcattagttaagtttcatctactaagtcgtgcttagaatcataatctctagcctgtttgttgactgccaataagggtttcatcagggttttagctgatgagttatctggacgttgcattggcttacaaggattgtatatataagttggatctagccgatgacaacagatgtttcattgtttaatctaatcttgtggattttatgacatcggacctccagccgatatattctttaaccttcggatcagtgcttgttctattctatcaaatcattgttagccaatttgtttcttctggattatactgttatattatattatcatcagccgattgtctttatattggtatttacatcaagtgtcagaatatacattggacgcatggccgatagctcaaaaccctatcggcaccaactagtatcggcatcggctggattactacattggcttatcagccgatcggctatttgatctactatttacatatcttgttagttgcaggatcaaactgactagcacgcctgcatctcatcaagttttggacctgcactagacctaagcagatctcccaaaccagtgtgtgttttttacatcaacacaatgcaatttatttttttcctttcctccaccaaagtactcgagtagcatactaaattaatgtgtggagagaattggagttttgatggatggacgtagttaacgagggtccttcaataattttacattaatcctaaacttgtctcgtggatctaggaatcgattttatttaggacgaagggagtattatttagcagtttggtaacaaactcctaaaaaaaattgtcgcttggagttgccaatagaacacattcttaggtccgagaatgctttgcatcagtcgactgacggggaaaaaacaatcaagagctcaacagcccactcatcctctacatatatctatcttcctctgcattcttatccattctctctatcttcttgtgtcgtctatgagcagtgggggcgtcttcgccatgtgtctccgatgagatcccacgactttttctgtagaggtgaaaacgaagcggattcggacggatagtggtcataccatatcctaaaccatattttttgagcggatttggagcgggtgcggatagtatacggatgcagatgaggagcggattgtttcggatgtcggaaatggtgcggagtctgtgcggaatcggttcggaaacggattaaatttatcggatgttacgtgtatatgcaatcaatgcatcattgagttagcaatccaatgaacaataatacaataatcaataaatgacccatcgtaataattatatgattaagtgctaaacaacatgaacgcatgatatccataatataaaaaatatagctacgtgtgtgtgacatgagacgataaacgccttagactaaaaaatctttgttaattgatgaatgagggcactggttgtacaacttatgttatatgcaatagatagagtggttatatatgttgataatttcggattatctgggaaacaacttatcggataattcgacaaaaatgtcggataatccgcatccgccggattttagagataccatatccgcatccgcatccgcctcatactatccgcatccgcaaccgtatccgccggatttctaaaagctcataccatatcctcgttttggacggattcggatcggatattatccaatccgttttcacccttatttttctgcaagcggttcttttgcccttagatgttgtgggcattactgcggcatgctttggtgcaatgaacatggtggcgcggccggccggagggatggcttccgacgaggtggcaaagaagtttgggatgcacaggttgtgggttttgtggggccatgcggagcgccgacgttgtgctctagtgctcattgattagctagagaaagatgatgaccttatgtggaattggaggtgtcgttcgccagcgaagatgacacaacgagggcctgataccaatgacgacgaggtgaagaaagcttgggagcagcggctacccacatcgatggagtagaagaataacgtctctacatgaatatgtagtagaaacttgagaagcccatcgaagagaagaaataaaattaggtttgaaccgatacttttttatgagtatgtgatgtttcagctaatgttgcacttcatgttttgatggtgtttcatattttagtacatgactcttgtagtttggtgatgtttcagctcttgaagcttgatgtttcatatgtgagaataatatgtttcaatcgtgattaacatgtgtttcaccattttgataatctgaaatatttttcatttaataatgaattttttttaagttgcgatgaaacaacggtcaaaaagatttttcaagtaaaacatcgaacgccctctatttgtattctccgcagatttaggtcatacgaataaaatattcatgccacaataaatatatccgtcacgtgattgattgctgtccaagaaccggaatcatttcgatgcctctactgtctcactcaccttaactgcttttggctttcctgtgctactggctagtactgctatagtgtgagctacgattggggagcggcaaccacaccaaccccatctccatctccctcccagaccgacctcccaccgccgcttttgcccttccctctccaatcgtccatcgctcactctcctcaggtctcatctctctctctctctctctccacctggtacttttgctggaatcgatggcttacatatgtttttagaggattttagggatagatataagcatgcttgttgcaggccaaatctttcttcatttttggaattaatactgcacctgaactttttttggataaaaaagaaagtgtatcagctttgaatgaagcctactagttctttatgagtagtgtgtggtcattttcccctggttaaattgtgggatggatgtttgcttcaaagaaataaaagaaattgtgggatggacctgatggttcaaggctaattttgttttgacacttcatttcttaggtttttggtgtgtttgtgttcaagattgaataggacaagacataggggttagctctcaatttaaatgcccaagttaaaaagattgtaataattgtcaaaaaaatttgcatggaatgcttccttctctagaaagtaggaagtctgacggtctgaccccccaaaaaaaggtcagtttgtcctcttctgtttttatgataattactttcctaatttcccagctgacagaagggtgttgcttgcaagaaatagttgtttacagaattatgtagtcaatagagttcatatataacttccagtaccaaaattgcgtgattgtgctaatcaaaatgcagaattggatatgagtaatcaatcagaaaaagtgcgagtgatatgctagtggcctaatgtcactgaattttcagaagaccaagacagcacaaatgggtgttgtcgggtatgtgatgcaatttgttagataatttcttatttatcttctaacaatttcttatctcatcattgcccacatagatggcttacgaaaaattccttaggtgcaagattatactgaattaattgcaagtagcttagagtcgtcggttttcttccaacaaaattgctgaagaagccagaggctcaaatggaggcatctgatgaggacaggccactgattcatcacctgcctccacaggtattaatcgataaccttcccattatcttttttttttttttgcctaggtaggtaccaaacttttgtatctccatgtgaccccatgacatgtacagttgatactttgccactttggcttcagtttgttacacagaaacaaaaaaaatgagttcttgcagtttcttgttcttcagcgaatctttgcatatatttaatgttaaatcctgtgcaacatacattagttttggcatttgtcattcaggaacaatgttcaaaatacacatgcgatggaacggttaatattgacagtaagcccgcgctgaagcagagtacggggaattggagagcatgtttcttcattttaggtacttctgagaagttcacaaaattattctgttgatgctcataaacttccttcttcaacatacacaactgacctattgagtcctgaacatgtcctaggtgttgaattcactgaatgcatctgcttctacggggtttcaaagaacttagtcacatacctcacaagtgtgctccatgaaagcaacgtcaatgctgcacaaagtgtgtcgatctggatcggcagttgcttcttcacaccactcattggagccttcttggctgacacatattggggaagatactggacagtagtaatgtccatccttgttatcatccttgtaaggccaacaagcagagcagcaactgaaagatacaatctgtagttagtttcatgtgtcatttgcaactctgaaacagttctattttgtcagggaatgatcgttctgacggtttcggcatcaccattgttcctgaatgcttctttctacaatgggggtatttctcgtctaactgtctacctagggctctacctttttgcccttggaactggaggtataaagccaaacattccggccttcggagctgatcaattcgacggcgccgacccggtggagcgggtgacaaagggctcattcttcaactggtactacttctcaatcaacgtgggctcgctgctgtcgtccaccgtggttgtctgggttcaggacaacatagggtggagtgtcggttttgctggcccaatgctactcttggggttcggcctcgccatgttcatcgccggtaggagggcgtacaggtacaagaaactgggagggagccctctgacaagggtctttcaggtgctggttgcagctgtaagaaatcataggctgaacttgcctgatgatagctcactcctgcatgagcttccaggagtgactgaaggtgactacagaactcaacatacctatcaattcaggtattgctcattgcatcaaaattaccacaagagttgtcggacaaaatagtcaaacctgttttaatttactatagaacaaactaagtgaattagtaggaacaaattccactgtcaagaaagattcttttaagatattgccatgttattctagaccataatgttttagaagttccaatggttgatttgactcctatcatgtatgagtgtgccatcacttatcaatcaagggtaatatggactttccatagttataaaaggaaataaatgatatacttcgattatgatggtaaatctaaaaacgtagtaaatcttgttatgttaaattgtgtaagtttctataaattgattatttaactttaacatttccatgatgtccaggtttttggacaaggctgccatcttgtcggacaagaactgcgcgccggcggcgccgtcgagcccatggaggctgtgcaccgtgtcgcaggtggaggagctcaagatgctgctgcggacgttcccggtctgggcgtcgctggtcggcttcttcatggtgaccgcgcagatgacgtcgaccctgatcgagcagggcgtcgccatggacggccgcgtcggccgcttcaccgtgccgccggcctcgctcgccaccttcgacgtcgtcgccgtcctcgccctgatcccggtctacgacgccgcgctggtgccgctggcgcggcgcgtcaccggcagggacaggggcgtctcgcacatgcagcgcatcggcgtcggcctcgcgctgtccgcggtggccatggcgtactcggcgctggtcgaggcgcggcgtctggcgatggcggcggcggcggcggggacgcggatgagcatcgcgtggcaggtgccgtccttcttcgtgctgggcgccggggaggtgttcgccgtcatcggcatgctggagttctgctacgagcagtcgccggcgtcgatgaagagcctcggcacggcgctcgtgcagctcgccgtcgccgtcgccaactacctcaactccggcatgctcagggtggtggcggcggccacggcgcgcggcggcggcgccgggtggatcccggacaagctcgacgagggccatctggactacttcttctggatgatggctgcactcagcgtgctcaacctgctgcagttcctgcactgctcaatcagattcagaggcaacaacacactgtcatcatcgtgacgtactccattcttccgtctcaagggctcatgccctgcgtatatactcctgcaaatgtgttctcatttcttgttctgtctccaggattgagaaaacggagtaacaggaagccccggattttattttaacagaaatgtaagtgcaaaacaaataattttataatataagagtaacacaagaatgatcgattaactagactaaagtaatacaggaatgatactcatgtttaaattcctctaaaacttatatggatcaaaagtaatacaggaatgatcctcatgtataaattcctctaaaacttatatggatcaaggcattcctaacttatatgaattgaggcattccttatgaatttcgcaatgttggagggatgagctccggcagatgtaggagacctcgagtttagatgaaccaggggttctaaccgagatggtgagcctgagtgtgctcggaagcaaagaacacggaacaactatactggtttgggcctgttgaaggataacaagcctactagtatttactccctccatcccaaaatatttgacgccgttaacttttttttaaaaatgtttgaccgttcgtcttatttaaaaaatttaagtaattattaattcttttcctatcatttgatttattattaaatatacttttacgtatacatatagttttacacatttcacaaaagttttttaataagacgaacggtcaaacatgtttgaaaatgtcaacggcatcaaaagtttagggaagaagggagtacatcactatgagatgaatgttcgtacaagctgggagctctcgagctagcagatctagtccttgccgattatgaagaacctaacactttctaagagtcccggttgggtttttatatctgagaagcgcattacactatttacaatcattagatcactttctgcccttcgagctccacaccgatttagccaccgatgtaacccgcctgtgaaacttcacgtcgggcccatctacaaggttatcattattgtttccattatggtagtgtgaaaacgagatgcccatatatatataggttatctatccatgttaatacaatgagacaactcgagaaattcaataatatagatagacacgagagccagcacaacacatccgatggaggcgtagcatcctgtaagatacgcctccaccattctctagctaacgagaacatcatgctagcccttcccgggctaatgaggggttcccacggtgaaacacttcacacttgaagtgtgggactggcctcctttatgggacagtcacgtgctaagccctggagaggactgagccacgtgctaagccccaaagaggactgagccacttgctatggttagctacatgaaagacgcaacacccttggtagttctcgggcaagccaggatatgggtctcacctccaaatgatgtaacaaccttgttcatgggtagaaaaccagatagtcccatgctccagcagaggacacgtagtcgtctccgagcaggtctagggccacctaccagactctcgaacaattccagcttttccttaattgtagaattggacggcaagagaacatgtgaatctctgcgtaaggtttttggcttaaagtgtggcgaggatgtgatggcccactaatcgcgtagatacatcgacttgcctttctaattaagcaaactggtaaagtagggactccttgaccgaaacgctaacacgtaggtttcaatactatctcatcctttgttacaaactatcgtatagaaaaagtcctacaggattggaatcctacagaattccatgttttctttcaaatcaaagtaatgtattggggatgctaaatgcagattttctaagaaaatctaggctagtggaggtactttacccgaatttcatagaagaattgagataaagactggaaagctagcatatgaccatatggtctgaaaggttcttgaggatcggtgtcggtgacatgggaccgggggtatcgtgactagaggcttgagtagccgcggtcacccccgtggcctgaccccctcgggggggtcgggcccgagggtgacatggccacccctccctctgtctccccgaggggtcgggccgttcccgtttcggccccgagggctgggacgccccgaccccctgtggttttggcgccacgtgtgggttaggtgagcacggcagggctcacctaatcgcatttattgcggtttggacgagcgcgccacgccgcatttaatgcagcgcagcgcgcgcttatccggtccgtgaccggtcgcagtgtgtgaccggtcacagaccggtcagatcgcgggttaggtggcaacaggcggcctgtcacacgcctcgccccgtcccgtcggaatgatgagagcctccaggcgctcgtccctagccggagccggcgtgttaactcctggagttggtatgtcagtcccggccagattcattccaggcttcatcgcaaccatggcaaggaagtcattgtatgaagaagggcagacgtgcggcatgctaaactgacgcgtggtggacaagaatgaccggtttgtgactggtctgacgccggtcacgtcatcggcagacaaccatgctcccacgttgcatctgcttccggcggagtggaggtaggtatgacccatcccatcggagagtcattcggacagcggccattgcaaatctccacccattaatgaggaaatgacagggttatcccctgtgtcaggcgagtgacggcactgagcctcactcaaggacaagctgtgatttagcttccaggcgaaggcgcaagccaagttttggtgaagatagggtgggtccccacccaaaagaagagtaggtagaagtggtgcatgtggtatccccttgagatataaaaggaggaccttgcccaccgaaaaaaggggggacgaggaggggactctcagacgactcttgctctccagctctctgtaactccttcacacacagatccaccagaacacaggagtagggtattacgcttctcagcggcccgaacctgtctacgtcgcccgtgtcttgcgcatttgttctctcgcgaactttccacagatcgagggtgaagaacctcacttagcgcccccggcggaaccggcacaggggggcctgcgcggtctcccggtgaggagccccatgctccgtcatctggcgcgccaggtagggggcgcaagtgtctttcgaagtcctcgtcctctttcgtgtgcgccaagcttctcccgctcagccaaaatggccgaacgggcagtggcgcacaacctctctccgagcgctagcggtgacgacggggagcagaacccgcgccgtcgagctcgtactccaccgtccccctctcgccgaaatcttgggcgggaggaggcgctcgaggaggtcgaaagatccgtgacttcgccgcccgcgggcaatggagaaggacggcaagacggggagcgtcgcctcctcgtctacggcgatggcggcacgccccagggcgcgctccaggctgcgggcgcgctcctgcgtcacccgcccgtcgtctccgatccagagactccagcccgacgttggctggatgacgtggccgacttggtcatgacgacgcagcagcgcctaggtgccggcgggcggtcctccgccaccgggacctctggcgctgccgccgccggctccaggtcgtcgaggcggagggcgcggcgagcggcggccgttacccgccgttcgtccgccattccctcgtcaacgcctccgacccaagaagatgtgcgtggggggccggatgcccgcctcaatatcgagcgccggcgcaatggtcgtcgtgctgcccatgcaacgaagggcgcttcctcgtccggagcgccacttcggtccgggcacgggggccagcctcccgtgtccccggttggcggtgccggctgtcgagcctttgtggcgagccttcggaacgtccgttggcccccaaggttccggcccaccatcaccgaaaaatacgacggaagcgtcaaccccgccgagtttcttcagatctacacgaccgggatcgaggccgccgggggtgatgacagggtcatggcaaatttcttccccatggccctgaaaggtcaggcgcggggttggctaatgaacttgccacccgcgtcggtccactcttgggaggatttgtgccagcagttcaccatgaacttccagggcacatatccgcgcccaggtgaagaagcagacttgcatgcggtacagcgaggggacgatgagtctcttcgctcgtacattcagcggttctgtcaagtccgcaacaccataccatgcatccccgcacacgcggtgatctacgcgttcagggggggcgtgcggcacaaccgcatgctcgagaagatcgcctccaaggagccccagaccaccgcggagcttttccagctcgcggaccgtgtggctcgcaaggaggaggcctggacctggaactcctccggttccggtgtggcagctccggccgcccccgggtccgccgctcggtcagagcggcgggacaggaggaggaagaagaggtcggcccattccgacgacgagggtcacgtcctcgccgtcgagggcgcatcgcgggccacccgaaaggggaggcctgcgagcgacaaaaagaaggaggccggcgctcccagcagggagcgcccgaccggcaagtggtgttccgtgcacaacacctccctccacgacctcgcggactgccgtggtcaaaagtttggctgagcggacgaggaagtgggaggaggagaggaggcaggagcgtcgtgagggcaaggccccggcggctcccgccggcaaccggcgaggtgaggccaagcagaaggccaccgccgaggacgtcgacgatggcgacgatgacctggggttccaggagcctggggccaccgtcgccaccgtcgatgggggagcgtgcgctcacgcttctcgctggagcctcaaggccatgaagcgagagcttctggccgcggcccctacccataaggcgacgcggcgggcgcgatggtcggaggttgccctcaccttcgaccagaccgaccacccgccgtgcgttgcccggggaggacagatcgcgatgatggtttcccccaccgtttgcaatgtgaagttggggcgtgtcctcagagacgggggtgcagccctcaacatcctttcccccgcagcctttgacgccatcaaggccccggggatggtgctccggccgtcccagccgatcatcggtgtgacgccggggcacacctggccgctgggtcatatcgacctcccggtcaccttcggtggtcccgccaacttccgcacggagcgggtggacttcgatgtggcggacctcagtctgccctacaacgcggtcctggggaggcccacgttggtgaagttcatggtggcggtccactatgcctatctccagatgaagatgccgggccccggtggccccatcaccgtccatggcgacctcaaagtcgcgcttgcttgtatggagcagcgcgcggaccacctcgccgcggcgtccaagcccgcgggcagcgacgagaggctcagcacctccgtcccggccgccccgaggcagcggatggtcacctgcgacgaagtcccggtcaaggaggttgccctgggcgacggcccgtccaaaaccacacgaatcggtggtcttctggacgacaaataggaagacgcgctcgtctccttcctgcgggcaaacgccgacgtcttcgcctggagaccggcggacatgcccggggtccccagggaggtgattgagcaccgtctcgccgtgcggccgggcgcaaggccggtccggcagtaagtgcggcggcaggccccggaacgtcaagccttcatccgcgaggaggtggcgcgacttctggaggccggattcatccgtgaggtcatccatccggagtggctggcgaacccggtcgtcgttcccaaggcgaacggcaagcttcggatgtgcatcgactacaccgaccttaacaaggtcctacttttcaacgtactactcgaatttctttgggtagccagctaggacgcaatgttgaggcctatgttgatgacttggttgtgaaaacgcgcaaccaagagaccttactctcggatttagcggaaactttcgaaagtctccgctccacccgcataaagctgaaccccgataaatgcgtgttcggcgtgcctacgggcaagcttctcgggttcttggtttctgcccgaggcatcgaggccaatcccgagaagatacgagctatagagcggatgcgcccccccagcaagcttagggatgtgcagtgcgtcaccggctgcatggccgccctaagtcggttcatatcgaggctgggagagaaggcgctatccctatttaagctcctcaaacgctccgggccgtttacctggacggaggaggctgagcaggccttcactcagttgaaggcgtacctcagttctcccccagtcctggtcgccccggagccagatgagccgttgctactctacctggcggcaaccccgcaggtggtcagcgcggcgttggtcgtggagcgcaacgaggacaaccctcactccgcgcatccccaccctgtgtcgactcgacccgggagagagcagggaggagaggcccccgagccgaacggcggcccgaggcccccgacggccggagctggccctccgcccgcttgtctgatggtgccaggcgcccccgacccccatgatggccccggggccactgcgggaaggccgcacctgtcgccctctgaccccgaggtcgtcggcacagaagccgagtgcgccccgcgtggcctctcggacgaagagcgccctggagatgcggcccctggcgaagaggatcggccctgccgaaaggtgcagcggcccgtctacttcattagcaaggccctccgggacgccaagacccgataccctcaggcccagaagatgctttacgctattctgatggcttcgagaaagttgcgccattatttccaggcgcatcgggtcacagtggttacgtcttaccccctcggccaaatcttgcataaccgagagggtactggacgggtggtgaaatgggcaatcgaactctctgagttcgatttgcactttgaaccacgccacgcgatcaagagccaggccctcgccgactttgtggcagagtggaccccagctcctgagcccgtctccgtccccgaggccagctcgagcccctcacaactgcctcacaccgcctactgggtgatgcagttcgacggctccctgtctcttcagggcgccggagcgggggtcacgttgacctcgccgagcggagacgtcctcagatacctggtccgcctcgactttcgggcgaccaacaatatggcagagtatgagggactccttgcgggactcagagtggcagctggactggggatccgccgcctcctggtgttaggcgactcccagctggtcgttaaccaggtctgtaaggactaccgatgctctgacccgcagatggacgcttacgtgcgccaggtgcggcgtatggagcgccatttcgacgggatagagcttcggcacgtgcccagacgggataacgcggtcgccgacgaactctcaaggctcgcttcctcgcgagcccagaccccaccgggcgcctttgaagaaaggcttgtccagccgtcggcgcgacccaaccccctaggggagacggacgcacctgaacggcccccgaggcccgtcggagtccaggcctcgggacccgaggggagcgctcccagctcccttagattgattgcttggatcgctgagatccaggcgtacctcgcagataagactctacccgaggaccgcgaagggagtgaacgcgtccaacgcatctccaagcgctacgtgctggtggaagggaccctctatcggcgcgcggctagcggagtcctcctgaagtgcattcctcgggaacaaggcgtcgagcttctcgccgatatccatgaaggcgagtgcggagcccactccgcctcacgcaccttggttggcaaggcctttcgccagggtttctattggccgacggctctcaacgatgcggtcgacctgttccggcgttgcagggcgtgccagtttcacgccaggcaaacccatcagccggcccaggccctgcagatcatacctctttcatggccgtttgctgtctgggggctcgatatcctgggtccgttcaggcgggccccgggcgggttcgagtatctctatgtcgctgtcgataagttcactaagtggcccgaggcttatccggtcatcaagatcgataagcactccgcgcttaaattcatcaggggcatcactgctcggtttggggtgcctaaccgtatcattacggataacggcacccagttcactagtgagctcttcggtgactactgcgaagacatgggcatcaagctctgcttcgcctcccccgcccaccccagaagcaatggccaagtggagcgccaacgtggaaatcctcaagggcctcaaaaccaagaccttcaacatcctcaagaagcacggcgactcgtggatcgaggagctgccagcggtgctctgggcgaaccgaaccacgccaagccgagcaaccggggaaacgcctttcttcctcgtctacggcgcggaggcggtcctcccatctgagctcaccctgaggtcccctcgggccaccatgtattgcgaggctgatcaagatcagcttcgcagagacgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagttgcctaacccatggaacatcgaacaccttcgtcgcttctacccctagtgggggtcgggtgtcaggtctcgggctcgggccaaccccgcaccccctcgggcgtgcagggttggccgggggccaccacatgcatatacttatcttttttctcttccgtatttcaataaaagttttttcgatttcctaaggactatgcctgtgccattgtttccttttgaagaatcttggcttgaattagcacactcgtgctcgaccctgccctcggtggcccgggccggcggaaatcgccaaacggggcccagaaccgagccgtgccccggggcgtggtgaactccgagggggaatcggcaaaggcccacaatcgggtaatccataaccctcggtcaccgcgctcccggcctggccaatctcgacacgtggatctccccaggcactagccccgacccgcgctgtttgaggttgggacctgggcacgagcccttgttcaagccaagacacagaaggatcgcgacacagaccatcctcgtctcatatacgcaataaacagaactgacgcagaaatttcctctttatttgattacaggttaaatcagtctatacaagaagggggcccgaaggcctcggaagaaaaaggaaaagctattaaaattggcgggggcctggaggctcactccgacgcgcccgggtcgccagcctcgtcgtcgccatcgcccgcaccgtcgtcaccgccctcctcgtcggagtcaagcgcgaacgcgagtcgaggggccgtaccgtcgaagctgtggacaatgtggttggcggcgtcccggacctgtgcgcgcgcgccgtcctcggttccgggagggaactcttccagcgccgcccacggggagaagtcagggtccctggcctggtagcttgccagtacgagctccaccgccccccgggcgaggtccctcgaggatgacttgatcgtctcctcgagctcctcggggagccgctggagggtcccggccatctctgagaggcgctgggcgaggcccccctggttggcggcatacttcgcgcaccgcccgccccagaggcccgcttgccgcccggcgcggtctagacgggagacggcgtcccgaagcatgccgggccctacctcgcccgccaagcggagggcctcgacctccccggcggacgagtccagcgcgccctgcagctcggcgatgctgtgttcggcggctgcgaggcgggcggctaggtcgccgtcgcccacggccgccccgccgctatgcgctctcgcatccagctccttcgcccgagcctcgagctcagcgacccgctgatccagtgcggccctcttggcgcgggcgccttccagattgcggcgcgcctgctcctcccgcgctgcctcgcggaggaacaggctatccgccagccgctgcgccgcggcctcggcctcctcgagagctcgcccccgctcggtgagcgtgtcctcgcggaggcggagtgcagattcctcttcagcgcaggcggcctcgtgcgccgccagtgttgcctcccggatggcgacggcggcctcgcggtccgccatgtccctctccttcgcgcgggcgcgctcctccagcgccgtggcgcgagcctcaagggcctcttcgcgctgccgggacgctgcctcgttctccgccgcccgccgttcccgtgcagcagcggcgtcaaggactccccgagcggcgtcgagcttcttctctagctccgccgcccggctcccgtattggaggcggaggtcgtcccgcgcctcgttgagcacggtggtggcgatgagggcagtctcccgctcctcctccacctccctggcgatctccgccaggtccctacgacgggcctcgagctctgaggtgtgccggcggtgtgccttgcggcccgcctccaccatggcctccaccgagcgccgcccctcctcgacgcgcgcccacgccgcgtcgagctctgcccgctctgcctgcaggacctccatctgggcacttaacccgtccagcaccgtggtgttcgtggcggccaaggcctgcaggaggggctccgcgctcagtggggcagcggaaggcagaggggagagccgcctcggtgtgggtgccgcgcggctcggcccgccaatcgacgtgccggagtcgggggcgccccctgaagctggctcgtcccaagcgtcgcccgaggggtcgggcccgagcggcgcgcccgcggcctcgtcgtgggtggcctcggaagtcgtcgtcgcctcgggcggagtcgggtcgggggcttggcaggccgcctggcgtgcgcgcgccgcctctgcctcccggacggactccccggcccggcgaagtctggcctcctcccgagcggcctcctcagcctggcgaacccggacggcgtcctgggcggcctcctcggcttcccggaggcggtccgcggcttctcgccggtcagcttcccgcctccgggcttccgcggtcgccgtctcctcggcctcagaccggccggacttggaatggcgggaggggcgcgacgggatctcgctgaggcagaagaaaaaccagaagacaaaaagaaacgggtgagtgaaaactcgccttgggagatgggagaatgaatacggccgcggcgagcgcagggacgaacctgcggggaggtcggctaaacgaccacctcggagacgagatgaggttcccccggcatggctcggtccccccatcttgcagagccgtttcttctttcgctccccctcgggctgcgacgtcggcacggcaccctccgggcgcctgctgctggcacgcaccgccccgccccctcggggaggagatggggaaggggtaccctcctgcttcctcttcccccgggcgtcggccgggcggctgccccccgggcccccgtcgcggggcccagaagcacgaccccctcctggggtagattgttcccccctgcggctcccgcccgcgccatcgtggcctcggagggcccgctcccccgacgccccgacctcctgcatgatggtcaggatgttggcgcgctctggatcgcagcagagggggaggacctcttgggggatgagggatgcctccacggagctgagatttagcacccgttggaccaccatcctgaagtcctcagggtcccagtcccatgtgcgcccctggtgggtcctcatggagtcctcgggccaggtgtactcccaggcgccccgggcgcgccgctggagcggcgcgatccggcgacgaagatagtcgccgaacaccatggcccccgtgagcccctgggatcgcagacccgccaagcggtcacgaacggcgtcgtagccgtctcccagatctaccgccgcccgccagctggaggcctgcgctggaggctggctcggaagtcggaggcgcgcttcgtcggcgaggggggtgtagaaccaatcgctcttccagtcgtcccactttttgcggaggacgcagggaatgtagcggttcagcacctgcccccgcggctggaagtagcagccaccgactatcgtcggcggcgacaccggctgcacggtgaagaaccaccggaacagccggagagatgggcgcaccccgataaacatctcgcacaggtgcgcgaagatggccaatgtcattatcgcgttgggggtgaggtgcgccatctggagatcataaaactccagaatatccatgaaaaaattagagaatggcgggaccagcctagccattgcgaaagagaggaagaagacggaccgccctgggtagtgtggcgccgggcgtccctcgcccagcgcgaccacctcccggccggtggcagattccggcatgaatcggcgcggcagcccagcctgcctctcgctcacgatgcgggaaggcagcagcacgctaccatcgagcggtgcggagccccgtgccatgacgccggcggaggaggagcttgagagcgagcgagtatggcaagggtagggcgcaggaaacgaagagtcagagcacaagtggcgaaggcaaggggaagagtggcgagaggaaggaaacgaatcccttccttggcgtctttgtacccttgctatgcctggctcctcgcttcccgcgcccactacctcgccccctcgtttctcgcgcccacgcctccactaaccccactcgcccgtttgcagcgcacgcggcagatgtgcggccgtggcggttgagatggggcagattgtgcgcgcattaactgcgcttgccaatcgtgaaaagcgccatcatcatgtctccaggcgaaacgaaccggctcgtcccgattcgcacgctgctcgagtaatgttgcggtcttgaagaggctgctcattattgtcggtcggttttcccttgccgatgcgcgcgatttgcgaccgctgggtttctgcccgcctgtagagaccggcccaacctgtcaccgggcctaaggagtggcgtcacgcccgagcgcttccctcgaggggggcgatcgccctggcgtaacgccgggggctactgtcggtgacatgggaccgggggtatcgtgactagaggcttgagtagccgcggtcacccccgtggcctgaccccctcggggaggtcgggcccgagggtgacatggtcacccctccctctgtctccccgagggggcggg

SEQ ID NO: 26889 - DNA, 5933 bp, Oryza sativa
tcccctgtgtcaggcgagtgacggcggtgagcctcactcaaggacaagctgtgatttagcttccaggcgaaggcgcaagccaagttttggtgaagatagggtgggtccccacccaaaagaagagtaggtagaagtggtgcatgtggtatccccttgagatataaaaggaggaccttgcccaccgaaaaaaggggggacgaggaggggactctcagacgactcttgctctccagctctctgtaactccttcacacacagatccaccagaacacaggagtagggtattacgcttctcagcggcccgaacctgtctacgtcgcccgtgtcttgcgcatttgttctctcgcgaactttccacagatcgagggtgaagaacctcacttagcgcccccggccgaaccagcaaaggggggcctgcgcggtctcccggtgaggagccccacgctccgtcaatcggatatgtcatctagagggaggaggtgtgaataggcgtttcttgaaattttaaaaacttggagtggaattaagcctaataggatagtccggaactacgttgaacaatccaactatatatatataggtagtcagatagttcggctgctcaaggatagctctgtcaatgcagtgacaggatctctcttatcttcttcatatatgcttgaagtcactcgctcttagaccagctatggtggcatagagagacggcaacatcacggtttgaggtcagctagcgatagtggcgagatcgaggctacattgctaaaggcgacgaacgcgggaaccatcaaggctggtatggcgatgctagttgtggagaggcagagcgaagggccgtggcatcggaagcttaatcaagagcttagggtggagtgcaggggcttacatagaatgggtctcaattatttgccattttgatccacgtatcattcacctatatatccactatcatagaatcgactttttaaatgagaccccttaaaattgtagacggaccataattctcatgtatgtaaaaatcgattttccaagcatagatcaagaaccgcgtgtgaaaatcaattttcgcaggcaagcctcttaaaaggcccctactaagagacccgcatgtgaaaatacatctctctccccgctctttttttttctcccctcctctctctcactaagtcccattaattcctcccgtccactccactcgcacgcctctccccactcctcaactctcttctcactcctcccttatcttctcttgtcctctcctcaaagcgatcgtggatccccctctccttccttcaccgtggtcgcgatgacggtggtgacagccacgaaaatgacgatggcagcaagtgggcagacgggagtggcctacgccggagggattcggtgacggatgggtgggagcgccgggcaatagggagggcggatgcaacggatccggcggtggcagtggatacaacgatggggagggtggcggcagtggagagcttgttggcggcgggaggcttagcggcgttgtatcaatcatggggtacctcggttggtgtcgattaggcgcggggacctccttccccaacgaggtgatggcggacgagggtggcgggcttgggcgagagggatcccaccgtcggtggcaacgggagggcactacaagaatctatttaatctgtgacgaaatccggcgccccctccccctctggtgctgatccggtcgccgctccacctcccatgtgtgcgaatccaccgacggcagcgatgggaaagacgggtccgatgccccctcccccttccgcatggatcccgctgcctctccaccacccacacgcacagatttgccggtggtttcgagcgatgatgacggtagcgacagtggcttcaagcgtcgacagtgtcggcggcttctaaaattctagtgttggggtttcagggcaacaggaaattgaattttgggtttttttttttgcgactcttcgttttcacagtcgaacggcttatacatacacatgccaaaatcggatttgcataaacggttgctctatccacatgaaaaatccgattttcacatatattttggtgcatgcaggctgtccagccgtcagtgaaaatcgattttggccatgtgcaaaaaatcaatttgatggtagtgatccttcctctgattgtaacgataagtaatcaaaggggcaaatagttagagcgacaaaacgtcaaattttcagccactctgtctggcttgtctccactctccggatgcatgcatgggatcgtgcacgtctcacgggtcatggcggagacgtgcacgtcttatggcctcacgggccgggggagcatccatcattccatataggctcatagcataccgctggcgcggaatggagggccgagattttctgacacacaaaatcgaacggcacggatggcgcctgatcgatcgacatatcgtcgcgatcgcacatatatatgttcaagcctgtcagtatctgagattccttgcattttttgatagaagctttgcatgcatgtttcttccgccagggtgtagtacgctgcacatgcgaatagtttttctcttagagattgatttttaaaaaaaatctccctcgttgcaaaatatagtaatttaaaagattttaaaatttatctaaaacataacaacttttccaccaacaaacgcttcttaaccaatcataacctttttcatgtttaatttcttcgtcttctcttttttttccttggtcaatcacaaactcgcttcatttaattacacatactctcttaatatttaatatcgtgtatccagactcaaagtttattatattttaaacaaagcgatacctttcatatctacgtaacacactaaaaacctaaagcttaagatgcaagcataacaattattaattactccctctgtttcgggttataagacgttttgactttggtcaaagtcaaattgctttaagttcgatcaagtttataaaaaaattagtaactttttgaacccaatacaaatttattatgaaaatatattcaattattagtatgatgaaactaacttagtattataaaaattgttatatttatctataaacttagtcaaacttagaacagtttggctttaaccaaagtcaaaacatgttataacctaaaacggagtaagaagcatgcaaggaagtcaaacgcaccaaacactaaaacataaatataactacatacatcatctacatattattacattttaaagctcagtatatgaacatgttaaatcgttatttctcatgtcattctcacaatatttttatccaaattcattcatcatttctacgtatcagcgccggactgactatatatatgtctacctgacaaaattaagaagctcacgcagccaatagaatttgcccgcgccgctgaatccacacccctggatcggaactaatccgtatacgttatccaatctgacgattatctgaagatcgatgcgatatccgttcgatgagcatccgacggccaccggcggagtttgacgggtcaaaccaaatggcatccggccagccgcaccatcgatcggacggctgcggtcaaacgtcaaagcagcttcattattaagcgtgcaggacgccaacaacgtcgcacgtaggcatcaagctattcaactctggatgtccacatttttattctaagcacgcacgtctatccattaattacgcagttcgtacacgcacatgcatcgatcgctgcactacgttgtgtatatatatacattggcaagctgagctaagatagtcatcaagagctgaaaaatcttcgtcttcatcatgcgccattttgagctcctcctcttcctcctcctctgctcgccgtgcctcttctcagtctccgatgggaggacggtgcggcccgcgaaacggggcgccccgtcgccccccattcgggcggtgaaccttggaggttggctcgtcacggagggctggatccttccctccctcttcgacgacattccaaacaaagacctcctggtaagtacatttggatgattaaaaacttcaaaaatcttatcaaatcttattctaaacatcaaacatttatgatcagagaacacgcttttctatgcattttaggatggaacccagctgcaattcaagtcggtgacgcagaacatgtacctgtgcgccgagcagggcggcggcaccatcctggtggcgaaccggacgagcgcctcggggtgggagaccttcaagctgtggaggatcgacgaggacacgttcgacctcagggtgttcgacaacctgttcgtcaccgtcgccggcgacggggtcaccgtcgtggcgacggtggcgtcgccggggcccggggaggcgttccagatcgtgcgcaacggcgacaagactcgcgcgcgcatcagggcacccaatggcatgttcctgcaggtaattaggacgccgaaaaattgattgatgtcactgtacaagagtcacctcttgcattgcataatagtactccaatggcaacaagtagctatagctaagttagtagtggattaggctgggatagatatatacatgtgctgatgatagctgccaacttgcgagcatggtccatatgcatgttggcttgtattgttctttgaacaatattggtgacaacgacaaatgtggccagcgcatttcatgcagatcaataaagatcaagctagctggaggatcaaataatgtagtgctaaaagatagttaattagtacttagtaataataagtgataaagttagggatggcatgtttaaagttaaagcctgttatgagcccttaaactatgcaagactgtcatcccatgtgacagttgagacaacaaaacctctaaccattaattttatttatctttatttccttctttccatccttatgcagctaagttttaactttaaaaaaattaagagtcgttgttaatcgtagcaacgatgttttatctcctatttctttcttttttttcagcactaattagtatagctaagagtgttattataataactgttctacatgtcctaagtgataaaatgagaaacatagttagtaatattaagtgataataaagctagctatagggcgaattaatctactttagcatgatggtgacggcttcctgctttttttttagcaaagagaagtgagccaatgttcctttggactatctttacatgggtcaaagggattcaacgtagacaaaataaactcgagcttactaaatcaaagagtcaaagtgttcggcagtcaaattttatacggctaaaattaattgtttttttcttgcccgctaagcttgaccaatactatatatattagcttgaaacatttttcggtttttgttgactaattacatatttagtctaacctgagaaggtatatttaagagtagaaggttagttagtcaatttgcttctttactggttaacttatgtcaagtgtaaaggtagaacccgataaaaactcttaaacaatacacattaaatgattgtacttacaacggtcataacaattaataaagactgaccattaatataatataaaactattactgttctgttctttttccaaccatcatgtagcaacaatatttatctatccactcattttctctcttttgtatcagcaaatattcttaactagtaagattaaaagccatatgcctttgtagtggtaggttaagggttccacttgagtcctagttttgaggattaatttaggtttcttaatcccttacaaaccatagccactcgttttctttgcttggatgcatagcataggtggaatacaatatatctcttgtagctgaatttaaatagaaacgaaatattgctaattaaattcagcaagtcaaaataaatttttagtatgccttgctaaatttattctaatccttaccaagattatttcttttggtttgatgcaa

SEQ ID NO: 26890 - DNA, 504 bp, Oryza sativa
aagtgaaacatatggtgctgctttttccattgggccagttcggtttttttctattgtcatggcacatcacatgccttgtcgtactagttaggaacatcccatctgcaaactcatatatttttataaatcaaatttcaagtattttccataattcatctaacaagtggtcaagtggagctgaaccaaggattcatatcttaccctgagtacttccgtggccttcttcatgccatagccgttgcatagttgatactctccttgaagtttctccccccggtttatggcaaatactgaaggatcatcatcaccccagcttgtaccctcaccatggtctgccgtcactgaaaccgtggtcttcgcctaacatttccgaaagaaatttcgaccttttatttagtgacaaaaccctatctttcacaaaaataaatactccatatgtttcaaaatatagctaacttatacttcatccgtttcatattataagactttctagcattctccaca

SEQ ID NO: 26891 - DNA, 1037 bp, Oryza sativa
gaatataccatccaaagtcacaaatgtcaaaaatgcttggtaccggcaacgaagtcgaagtcgccggccaagcctcccccactcagccgccacccaggcaccggcaacgtcgtgtcccccatgacaccacaccaccgaggtcaccggccacggaaccccttcccgccgccgccgaggccacctgccaccgaggtcgccggcgacgaagcccctccatctcgatgcctccaccgaggacgccagcaacgccgccacggggatcctctccctcgcctaccactaccgaggctgattcgccggcccagccgagctatcgagatcgatcgagcccccctccccctcccgccggcggtggaagcggagagcggcggcgagcctcggtggcaccctcgggcaaagggaacgaactaacgaagacaagtctgtctgatgtatcggttgcgagggtagaggcgtcttttcccctcagttttttttttttttggcagcaacaactaaatctaaaaatttccattcatttctacgaagtttttatgactgtagcaattacatgtttacgaattccgtgacatccagagtgcaaataaatgatattttcaacgaaatagtactctctctattctttcgtgctccattgacaactaaaattaagagtgaattacacttttggccacattttattgggtggtcctagtacgcgatcactcgctggagggagggtcaagcgataaaaaaaacgatcagcaccccctatagcgatacgctcctccctcttctcccccttcctccttccatttttcccttcctactacagtacaccacaaaatattttttaaaaaaaacaaaaagttagaaaaatttatatatagaaatactatatataaaaaatttgaatttaaattcaaatttgaatcgggtatgtaaacttttgacttataaactttagatctataaactttaggtatataaattttagatgtatagaaatactatatatagaaaatatttgaattcaaattcaaatttgaatatgatat

SEQ ID NO: 26892 - DNA, 12375 bp, Oryza sativa
  unsure (1)..(12375): unsure at all n locations
nnnnnnnnnnnnnnnnnnnnnnnnnnnnnnnnnnnnnnnnnnnnnnnnnnnnnnnnttgataagatcccatacggaggcagcccataagtcatcaataataattaaatacctggcaatattttatgcatattagatacattttttcagctaatatagtaacattcatgagaaatatataaatcgaataagtaaataaatgaggaagcaagttttacaggaagagatgtaatggaaaagatgttcaaattttgacccttcctataaatgttgggttcactatagagtccaaactgttatgcaatagtgtctgtctacgtattgcttgacggtatatgcaatagaattcaaatgggccagctaaagtggccaaattggcttattatcaaaaaccacatccccattaacatagctgtaggtatggcccttgagaatatgtatccccaataatcaatggtcaacggtcattctattgagcagttttgcaagaatcattaaaaatagtaccatcattaaacagaataaataagagtggataactagtgtatgcacccctgtgagtaattgaatgaaaataaagaactcgatttcggaatgtacattagtttcagtttggataatctatatataagcataggattatatacttcaaacaaattagaatctcaagatggggaaatcattgcaattatcatagggaagtctagagacttagaccatatcctatttattctctagattattttgcttagtactccttccgtttcatattataagtcgtttgattttttttctagtcaaactttgttgagtttgaccaagtttataaaaaaattagcaatatctaaaatatcaaattagtttcattaaatctaacatgtaatatattttgataatatgcttgttttgtgttgataatcctaatatatttttctataaaattggtcaaacttaaagaagtttgactaggaaaaaagtcaaacgacttataatatgaaacggagggagtactatctatgtacagaattgatgcatggactattggcaaccaaaggatctgatgcattttgtgatggattggtttctttggcatgttccaagttctagcactgatataaaaatggacacaagaggcactacttagtaaagtataccttctatcttgaagatactccctgatgctgtcaataagcgcaagctccttataatcgtcaggtggctgcttccgctggagttgaaagaacatctcgcggaaaaccctcttcatatcaggcttccgggagatccggacgaaagctcgacagtcaaattgtcccccaattctgttgtacaacagtttggcaagtgtggtcttaccaatacctgaagatccaacaacagacaccaccttgagcttctgatcctcatcattggcgagccgctcgatgaactcgctcacccggccatcaatcactagctgggcatcttcttccccatacggcctagatggcaacatagggccaaatgacacatatctccgcctgtggtcgcagcaatccagaccatacctcccatgccgctcaatggcctcctcaacataaatcctgaactgcgacaccatcttccccatctgctggtgcctcttgagcctcttgggaagacgagcaaccttgacacggccgattctgcagacgaatctggccatggtgttcgcgcggcggccaggccgcggcgctgcgcagaactcgtcgatgtagtcctcgatgtcgtaggacagctcgcgcacctctctcatccagcgcttggccgtcgggggagggtcctccagctccgacagatcggcgaggtacgcggcgaccactccaaggtcgcctcccaggaggagcatccgatccttcacccccttgggtagcctgctgccatcgggagccacaagcagctcctccatcttcccaagaagggatcccatggctccctgtgaagcacaaatcggggcggcgaggggcggggcctccatccctgaggacggagatcgaatcaaccatggagtacagattgaagaactgggaaaatggggagaacgatgatggatatactcaccgagctgcttgtatcaagcaatatagagaaaagcaaattggatgagattcatcctggacggtatcgagaaaatcgcagcccaatgaagatacgaacccagctatcggaacttggaagttggaagagcactggtgaaggccgcagagaccaaagacggatcggcgcaagacacagcaagagcttttcgttcccgagggacatgatcatctaccttatcagcatgttttgacccagtacaatgggtcaacgtctattactttcaatataagacgctttgatatttttttaattaacttttttttcaaaatttgatcaagtgtatataaaattttaatgatatctatgacaagaaattagttcaattaaatataaactaatgtatatattgcttggtctttttttgacagagcgagtaggagagatagcaagataaccacagtcagatcgccagatcaatactacactcagcggatacaatacctaaacaagagtaggatattacctctcattgagagagtatgaacatgtctaaatccttatctccgcatccatacacttttaggtatcgagggctaccccttttattattgccgatttctagaatcaacagttggcgcaccaactaggggttgcgccgagtttcctgtcgacaagtgcgacggagccaatcatcgacgtcgttggattcaatttcgccctagggcgaaccttccactttgggagcttcgacttctttgccggcgacttaggcgagcttcccctctctaactcggattctgttactgcaaaatacgacagcccgggagatttgcttaactccagtgcaggtacaagacttgtctcaagtgtcaagagcgtgctagctgatttgatcctacaactagcaatgaaacaacaaatatagttagatgaacgatagccgatcgaccgataagccgatgtcgtatcgttagggtttagccgatgcagttaaaccaaattggctcaatctttatgatgaactgaacaaagcaaaccctaaatatgtcccatcggctataataccatctatcttgtttttatcaatcacgtttcagattgtatggtataagtcacctcttgttgagagatcgcaaccgatgccccgacttgaagcaagaactcgtcgaaaaacttaaaagaaaaaagggggcaatgcgccgaaagttgtattgattggatgttcgtccctttttacatgatcttgggtttatatttatacccaaattacaaaacctgtccattatagacacgactcaaactttcctaaagacaaaaggaaaaacaaaaagactcaaatttaggagataaaaggaaaaaaacaaaaaaaaagtccatatggcggactcttaccatatctctaattcaagccggtatcaatatcctaattaatagatataattgcgttaaatggactctatctctatacggcaatacatcagctatcttaatctaggcccaaaccgagcccaagtgaaaccgtatcggctgtcttcccatatcggctcatttgaatccgactctgcttccagccgatgcgctctctatctcaaatctgctttgattttcctcttcatctctgaatctgatgctaattttcgtggttaacaaattcaaactagtcaggaaggctcacgatcacttcaatcttgtttggtttcccgtatgtcatgaggacttgctccaagctcgttctctccaactcggattcaatccagttatggagatcaatcttggcgagttcgaatatttaatttccgatattcctgggtttttttcccttccactttatcattgttcattagattgatttctaatcaccgattaatcacatgtgatgttgcggcattattgctgtcgacaagtggcttcacctccatggttggtggactccgccgccatgggagtcttcgtcttaaccgccggccgccttcacctccgccaactagtgtttttgccttcatggctagcttataatgccaccgactagtgatcttgccttcacggctggcctattaagttgccgttgatgggcgtcttcgtcttcacagccgaccgccttcgcctccgccgactagtatcttcgcttttactactgccctattctgtcgccgactagtaatctcaccttcatggctggcctattacgttgccgttgatgggcatctttgtcttcaccgccagctaccttcgtcgctgcagactggtgtctttaccttcacgattggcctattatgcccccgctgatgggtgtcttcatcttcactgccgtccactgctgactggtgcctttgcctctgtggctgcatgatttcatcgttgctatgcgtcttcatcttcaccgcccgcctcctttgccgccaccgactagtgacctcgccttcacggctggcatattacgttgttgctgatgggcttcttcgtataaaccaccggccgcctttgcctccgctgactggagtcttcgctttcaggtcctctcgatcatctgccgttgatttgcatcctcgcctccacggttggtggactgcgccaccgccgttgatgggcaacctcgtcttcactgtcggtcgcctctaccaccatcaattggtcttctcgcctccatggttttgcgactttgccgtcattgcttgataactttatctttgccgccggccgccacaactgcttctacggttggtgtcttgaacctgtctaaattattgtcttcacatccatcaacttttagtctcatgtgctatccccttttattattatcgatttcctgaatcgagggtgcgtttggtgggaaaattataaagagggaatggaattttgagatgcggttgggggaattgaggagtgaccccttgctttttaatacctgctttggggtgggagttgggagactatctcagcccttgatcatcacaaaaaatctagacccatcgaatctctttagaaattctaggcattcctagcaaacaagggatcgagactagggtcctatttaatttgtaatcaaaacattcgaatttttgagaatttcaatccagcagagaaaaatatattatgaaggcatttgatacaaaatatttaaacttttatggattggataatcgtattgagattttgaaggatagttagtatgagctccaacctgcctaattaaataccatccctataagtttttcctgtgttctgtaaccttatattttttttaaaatcctatggtttttcatgtgttttataacattgtattttgcacttgtatttctcttaaaatcctatgtttttctattaattcgtttttttttccaatcccactttttaaaggagaataaaagaaaaaaaaatcttgcctacgaccaaggtgttgagacttgagcgttctgtctgttgcccgttgacgagcttaggaattaggattaaggtgtcaagagtcaactctagcaggcatggtttcctagagagaggtcttcgttgctgcctatcgttcttgtgtgtcctaaaaaattcgagtggagagggaagaaccagtagcgctagcgcaagcagattgtggttggcggccatggagaccgcggtgctgagcgccgtgctcagaacgctggggccgaagctctacgcgttcctccgtgacgggcacgacctgttgcggcgggacctggagcgcgacgtccactacatccggaacgagctcgccatgatcgccgccgcgatcgaggagcacgaccgccgcccgccgcccgccgcaggcgacgtgcggagcgcctggatccgcggcgtgcgcgacctggcctgcgacatggaggactgcgtcgaccgcttcgtgcaccgcgccaccggccacggcctggcctccatgggcgcccgcgccaagttcgccgccgtgatccaggagctcaggaggaaatccgaggagctgtcccgcctcagagccagttacgccgccgccgccggcgagcccagctgctgggtggctacaggatcatccgcgttgaccctgccggcgtcgtcgtctgaggcgcacacccttgcatctgacatcgtggggatggacgggccccgggacgagattcttgagctgataggggaaacccagggccagctcaaggtgatctccattgttgggtttggtgggttagggaagacgcttcttgccaggcaaatctacgagagcgacgccgtcgccgcgcaattccatccacggatttgggttcgtgccgcggggaagaacgcagaggatgtcctcatggacattctccagcagctggggatgccggtacatcactgccatgccagcaatctcgttgtaaatctcagaaattgccttgaatccaagaggtaagaaaccaaccactgacatgttcaactgttgttactgtttgttaccaaatcaatctctgttgtgtgtccttcatcctacaccttttgcggcctctgaaagcaattgcttccaagaactacgagggattgaggagcactagagttgtttttcttgatttgttttatactcaacttaaacgaagtatcagaaggtacaacgtattttagtactaatctacatttcagtcatacagagtaaggtgagtacaaaaagttagccctcaagtgcagaaagaatcacatgtatgcggtatccctcaagttcagtttcgccttaatccgtgtgatagaaagccagaataggagtaaacaaaagatgtatgaattgctgtgtgcatgcattaacagttctgatttccctgtatatgcatcacgcatgtagatctggtcaccttattgatgtagtttttcagaaaactgtcctttgactctgcaccaagtgacccattctgaatgcttattttcaggttctttgttgtaattgacgacatgcagagggaatattggaacagctctttcagaaatgcctttccttctgatacgggactgagcagcattgtgatcgtaacgacggccatccagtccatagcaaatgcctgcagctctcgcaacagccatgtgtacgtgatgagaaccctgaatgaggaacactcaagacagctattcttgaaagaagcatcatggaaagattacccaccaggttcagaagcaatcctgaagaaatgtgatggtctgccgcttgctctcgtcacaacagcccaattcttgcaaagcagatgtcagcagcagcctctgggatgcgcaaagctgtgcgacaacctgggtaagcatcttgtgacagaagacaccttagcaagaatgaagcgtgtgcttgttcaccattacagcagcctccctggccatgtcatcaaggcctgcttgctctacctgggaattttccccagtggtcatcctgtcaggagaaaaactctgataaggagatggtcagctgaaggattcgtgggagcagaccatcaccggagctctctagatgtcgccatcgacagcttcgaggagctcgttaaccggagcatcatccagcctgttgatgtgagcagcaacactgaggtgaagacctgccaaactcacggtatgatgcttgagttcatcctgcacaaatccatatgtgacaacttcatcacatttctgtacggtcaggctcgcctgcctgacaagatccgttgcgtttccatacaacagaacagtggtagtaagaccagagtggattcagacattgatctgtcccttgtccggtctctgacgatcttcggaaaagcgcacaagtctttcctgaatttctccaggtataaacttctccgggttttggatctcgaagagtgtgatgaattggaggacgagcatctgaagaagatatgcaagcggttgcttctcaagtacctaagcctcggccgtggaattacagtgcttccaaaggagatcgcaaagctgaaatttcttgagacgctcgatttacggcgaacggtgattaagtttcttcccatacaagtgctcgagctgccatgtctgattcatctgtttggagtgttcaagatccaagatgctgaccagcaaatgaggaagctcaaatccttcctgacggagaaaagcaagttggagacactggccggatttgtcaccgataggtgccaaacatttcctcagctcatgaaacatatgaccaacttggcaaaggtgaaaatatggtgcgagaacaccgcagatgccagcagcagcagcaactctgatgttcacctgtcagaggccattcaggagttcatccagagaggcacagatgtgaacgatgtccgatcactctctctcgatgtcggcgaatgctcccaagaatttctcaacttctctttaggagattcatgctacctaagctccctgaagctgaaaggaaacaagatatgcaggttgccaccgttcgtcacctcgctggccgttctcactgatctgtgcctctcatcctctgatcgcctcagctctgatgttcttgcggccctgagcaacgtccgcgcgctgcgttacctgaagctgatcgcgcgtcacctggacaggttcgtgatcgaacgcggcgatctgcagagcctgcgacgcctgcacatcgtggtggtgtccatgacgacgatgagcaagcagcagccagagatccaggagggagccctgccgaatctggagtcgttccatctcctctgcaaggatctggatggcccctgcggccatggaggcatcaggatcgactccctcgggctcgggtgcctcagggagattgttcttgacgacggagttcgtgagacggcgaaggagcagtggaaggacgcggcgaggcggcacccgaagcggcccaaggtggtgttcgtcggagcgggagacgtcgtcgatcggcggcgggtgggtgctgctgctgctgccgcgcctgcagcaggagagagcaattctgcgatggcaccggcggcggtggcttcggtggtggccgccggcgacgtcaagaggccggctagggaggaatccgatatctccgccgcgctggcgagccttccggcgaagatggcgaggctgctcggcgctgcgagcatccaccagagtagtgggactcagggcgagctgtcctgcggcgggaacggagcatcccagcgccatttcagctagacagagatacagagagcatagcgtggtaacgggtaactatctctgttacctctgttccatattacatgtcgtttttagttatattctaagttgaacttgtatagttttgatcgagttacatataaaagtaaatactactccactataagagcaggtacaatagcaaattataagctagctatacacatattttaagaagataaaataggggagagaaaagcagtcggctacatatttgtagccagctatagtatggactctgagacacattgtgtgtgtatgatagatgagaccagatttaatagggtagtatgtaactgttgtatgaattagctattaaattaactatagatgatttaaagctattagttggctatactattaaacttgctctaaaacatgttaattaaaatccactataaaacatgttgttctgatagtgtatttatttagtattggagatgttaattattttttactgtataaatttgctcttaaaaataaatttgaccgagtataatactagaacacctcccgttgtggaactaaacctccaattaatgtaagcatctaggaagaagaatctttatttctttaattcagcttcacaagagaaagttacactcaacctgagtacctgacgttttatctgcgcttccgcaacgtcttatttgctcacggattacatatgactgcaagtacatacacatttccaattattaggcaacagtaattactcactaattggccttggttaggcttatttacgtgttctaattggtgataactagagacatatttaattattagtcattatttctagcttttgagagagatgatcccattctggatattccactgcatgctccagtggttgttgacgttcttgtaagtccaataggcccatccgaaggtagctcgtccataaacatctagctgggcttgtgcaaacctctgataatcctggttagatgctccctgcacattccactcagccacccactctcctgcatatataattaagcaacatatatgtatcgatcacgttcaagaacttgtaatcttcatgtataaacagtactcactccctctctaggttggttgaaagtaattgtcattttggatatggccaatattaaatttcaagaatttcgactacaaatatcttctaaaatatttttttcttctgaatatgaagaccatatatataaattaatcttaaaatacactttaataaaataatatatttgttaatatttacatatattgtagtaaaaaatactgattagaattatttctttgagaccgtgtcctccaaaacgacatttactttcaacatgaagcgagtgctccatgttgaaagtaattaaattcgctagagaaacttgcaaatgaacttacccacgaacgtcagcggcccattcggccttgtgacggtgctgagttcgtcggagcggttggtcctgacgtagtcgatgttctggtcgacggtgaggccgttgaagctgctggtgaagaggttgtagtagtggacgtcgaggacggcgccggggaagccggcggcgaagccgaggagctccgtgttgctggcggagaggcggttggacatgaccacgtacgccgtcgaggtgtacttgcggacggcgttgtagccgtccttgtagtatctcatgagagccgggagagtcaccccgggtgccagtggctcgttcaggagctccacggccaggaggctggggctactcgcgtatctgtgtagagtaatttaattatttgagagtaaagttcagcaaactataataattatttgaatgaaactatcatttcgctacaactttagttttgtgctgtatttcacaacgggtttatcatacaactatgagcaattttacggtccttgaggaggtaagtaccattttttctattgtaaatttggtatctcatggtacctcatggtacctaggtacgatgatgtaccatgaaaattttggtacctcatgatatctccttaagaaccgtagaattgctctaaaactataactgtatcccctagtggttgaaccatctttcggattgtcatatactccctccgtttctaaatatttgacatcgttgattttttagcacatatttgaccgttcgtcttattcagaaacatatgtgaaatatgtaaaactagatgtatacatataagtatatttagcaatgaatcaaatgatagaaaaaaaattaataattacttaaaatttttaaataagacgaacggtcaaacgtatttaaaaaagttaacggcgtcaaatatttagaaacggagggagtatactattattatagacttacaatcacttgcagttatttggaatgacaagcaaaaattgcagcaaactaatagttttgaaaaaaaaacttatagcttactaaaatttactgtttattttacaataagtaaattaaattaggacaaaccattcatgattaatggaaattcctcgtattttacttccgaagagataatggataaactagacaagacaaattaaacctattttgtgtagtgaattgaaatatctatgtggaataattaaaattgtgacctgtgtgtgaggaaatcgatgacttggacagtttgggcgatgttggcatccgtggtgccccagtcctgtgaaccatctctggaggcactgtgctcaaacgggttctgcgacccaggtgcagcgtgcaggtccacaatgactcccaaattatacttcctgcaatgtacatacggaggacacatgcatagaaaatctctgtcatttgtaaagtacaaccatctatcaagggactgctcattgtcctgattccaaaccaatttattcttcccccaaaatcaaaattgttggagacagagaatttaatcatacttgacttatgctggaaattaaaaaaaatgagcatatgcttttaattttgactaaatatggaacaattatacacttactctgcccatttgaatgcattatccaaggcttggagggatcctccaacgaaaggagcaggaggattggggtcgctagcaatccaccatccaactggaattctcactgcgtttagcccacttgttgatatgaacttgaagtcgctctcaactatgtatgtgcgccagtgttcctgcaaaacacaaaaaaataggatatatacttataatttgtacatgtgcaataattaaaaagaggtgg

SEQ ID NO: 26893 - DNA, 4751 bp, Oryza sativa
  unsure (1)..(4751): unsure at all n locations
attatttgtaatctttttcattatgtacaaagagggttaacttagttttttttaaaagacatgtctaactctaaattcaaaataaggtttttttttccattttaagttgataaaatattattattgataataaatattttttatttgtaccattaagctacttctccttctagttggttaatgatgtctattacatatgagtaaataaagacaatagatatataaatcctagagattgtttctttaaaatacctagtcaagatgagtcctaaaatttgaatttaaaatcaacaaatataacttttaaaccaactacacactgctaccttagtgtagcttatatatcacaaatactatgtgaagaaactcataactgctatactcctacctttattctccaacgtgagcccctttgtatttggccatggtttactttccctgcttgcttgcttctgcagttgttattagcttttcatttgtttcatcttatttctcctgttacctcaccttcacacatagtctcgcccttggacactccaggagatcttgcgatatgaatcaagagtaaacaccctatatacccctgaaaactcactcaatcccttttataaccctgaatactcactcataactataatagtcttatgcgacaaacttttacattttgaataatgtaattcatgaatttctatgttcatccaaagtgtaaaatgatcatctttatagaaattagacggtcactaacggtcaactgacggaaggggtatttatggaagggattaaaattaaattttgggttatacaaaaagtaagcaaattaaatttaggggcatagaaaagattaactaaaataaattttagaggtacagaagcgattttctcgtaaatcaaaagagcaactgctcacgggggagagaagataatatatatttaaggtcagcgaagctaaccaagctggtctccttccaaccaaagattaatcaatttgaaaaccacatacaacctaggtgctaatgctggtgtttgagtctcgtgaatatgagtagagatgagatttccacaacaatgcaaccagccatgtcagctatggtgacaaggaaatagatttactggtagagaaaaagaggaactctaggtgattttgtgaacaacgtacgtnntaggaaaaaaacatttttccgtgcggtcaaaataattttcccatgtggaggatttgcccgtctgcacccaagcgtatggaaaaatcaatattttcgcgtgtggacgtcacaaccacacgggataatcattttcccatgcggtcgggttaagtggaccgcacgggataatcgattatcccgtgcggtcaaattataccgcccatacggaacaaaaaaaaaaccaaaaatataaaaaaaaagcgaaaatcgccgcccgcccgccggcccgcacgcaaccagccgctgcggcgagtctttcctcgccaccggcaggtcggcggcaaggtcaccgccgccgtggtgcacgacgtcatcgacgtcctacagctggtcctgccccatgcgctccgcagccgcgcagtcccgctccagccgatagccgcagccgcaaccgctgccaccaccacctcctcctcctcctccctcacgtccggtgcgacatcaactccgggcatgagcaacatcgtggacaccgccgccgacttggcctacagtcgcgccggccgccaccaccgccagatccgggcgggggtcaactgccgccgccggatctaggagggggacagccactcctcgccgccgccacgcccggtcgccgcctcaccccgcctgcccagttgccgctttgccgctcgcctcgtcgccagccggccgcgcgcctcctgcggagaggagaggataggagaagagaaagtgagaaagagagagagagagatagagagagagaggagtgaaagtgagacagatagagaggaggaaagtgagagagaggggagtgaaaacaaaaaggaagggagaggaggtgtgaaaaaattgaaatgagttagagggagatgtgtgaaaattttgaagtgagtaagagggagaggtgtgaaaattttaaagtgagtgagagggagatgtattttcgcgtgcggtccacttaatatgcccgcacgcgaaaattgatttttccgtgcggtcctcttaagtcgaccgcacgggataatgaggattatccactacactggacaaggtcacctgtgacgggcccaaaccctcacctctgacggctttgggcttggtcagtgatcagtggtcactggtgagtacagtcacctttgatgggtggaagaccgtcactgatgacagtcacctctgacgggctagaactctacggtccgtcagagataagtgtctgcactaacccatgccattttgcaacccgtcacagatgactcacttgtgacggctcaaagagtaaaaaccgtcacaggtgtgtcacttgtgacggcatgtatgtgcaaagccgtcactggtatggtcacctgtgacaggcttttgcgatatgaaccgtcagtgatgagcttacatctagaaaaaaataatttctaaatgttggttagccctaggatttgctagacatgccctctggaattaaaaacagaacatacacatgcaatatatatgtctccagtttcagcccattgcattaaaagtttcaaactaacatcacatgcattccatgttgtcaccgaaaatccatagacattcacacacatgcattgcaagttctcgaattgagccaagccgatacttcaaagcaccacaaataaatccagaaaagaagagaacatacttcatgccgtgctcattaatatgcacacagggttatcaaaaatacaaagaatcatacttcaatgccaacatactgaaaaatgagaaatacagcctaagtgacacaaacttgaacatagcatttccttcttttggtttctgagcctgacgaatatggtataacatacaaacttacaattagatcatgagtacagcccccagtgcctgcaatgacatcattcagagaagtttacctcagattagtattcattagcctttcacccatccttgatagtcatccatatgcatgtcagtagttaaatattatgtgaaagaaacggaaatacatcaactagcagaggaagcttaccatttgtagaaagaactagcgtctaatttgttcagctagcatagaaattggggaatttgtagagtatccaagaacacacccaaaaaaacttctggtaagaggtctaataaggaaaataaaaacatatctagtgatgcatcaacttaaatagaacaagaaaacaaagcgaaacagcatgcccactatccaaacaaaatactagtacacaaagatcatctaattaatgatccagtagctcgtgatttttgcctggggttaaagctagatgcatccttggacaaggatttagccacaggagccacaggagatgctagaatcggttgactgcaagctcagatctggacgcaagagaaggaaagggtgacttctgcttagtactaaactaagtaaaatagatgaggaggcagtgactaccgacgatggggtggaaggggatagccgacgcctgctctcccctcggcaggttgacctcgacgacgcggagtggtgtggacggcggactgctttcctcgcggacggatctggagcacccaaactcgggatggctggatccgcgaccttcgagttcagggtgtccggatctagagcccccgggttcatggttgctggggctgtcaaggggaggccaggtggggatgcagaagctcgtcgtcgactggagataagcagcgatggatggcggggcttgtcgatggcgttgggcagtggcgttgtcttcatctttggctcgatggggccgccgctgcacaaagagagagaaggagagagagagagagagagaggagaagtcgagagaattggagaaagggacagagagaggccgaccttatctccggcgaaggaggcggcaaccccgagctcctggcctccaactggcgccgacgccggtgccgcctccacatccggccccagcacccgcccgggccacctccgccttcggccttcgcacctgccggtgccgcctccccctacggcccgcgcacccgccggcgccagtgccctccgccgatgaagagagaaagggttgggagggagagagagagagagggggggagtgattgaaagagaagaggataaggataaggatccctgtgtggctatctgtgtttgggagaggataaggatcgatcgatacagttgcacgggaagaggggagggttatgagagcgatttttttatcatctttgatgggcacacaaaatttgacccgtcacaggtgacattaccttacctttgacgggttctatttttagaccgtcataggtgactagttagctgtgacgggctaaatatttttggcccgtcacaggtgactttaactcacctttgacgggttccatttttggactgtcacaggtgactagttacctgtgatgggtcgccgccggatggctcaccgatgatgacatgttgtaggacccgtcaaaggtgaccctcatcactgaccagcacttatgtccgtcacagatatgccgccacaggtgtgagaatctggcgtagtgatcctattcggtcggattaagatgcccgcatggaaaaatgtattttctcgtgcgggggacaacccggcgtcggtccccctattt

SEQ ID NO: 26894 - DNA, 17466 bp, Oryza sativa
tcacaatattttttaacatatatatcaatcatttttataatacttaacatatattcatccatataatccatataatcaaagtacaggacatcatatttcatctataatttcatacaaagtctactaaatttatttctcttaaaatagtttgacaaatcagttttatttgttgttaataactaattttttttttacttttagcttgattttttaaaaaatagaagttactaatttctgcaacaaagcgtagggaatcacctagtagtttatagtattggacccatagaattaagtaaaaatcaagggatagattttattggcaccacatgacaacttgagagcattttttaggaagccacgtggcatcttgagagtgttttaaggaagcttactgaacttttagtatataatagatagatagattattgtcatccttataaaaaatctaaaataatatatgttttgtttaatttcagcaaatagctcatacttatgtgtcattttttgttcttaaaaagttatatttatttttttctttcaaagtataaatatcataccttctgtactttcttattatatttcttattttataagatgtttgttaagtaattttgtaattagtcaatgtatattgtttatgtcatgtttaacatacacaaaagttaagaaattttttcatggagttagttatatcccattgaatttctaccgatacttagaaggaccacttgatgggttattaatttctaaattaacatgtaataatatatttctttaactgaaaaaccacaaaattcccttggctagctctcatgagtctaacctcaggattggatcgattggcggcaccttacctattcctattggacctactagcattctttcgcaattcatattctcctttagaatacaacaattttgcataatataaaataattggtgaaggccagttagttttttatttaacctatgacatatcgatattttcttattaaccctaagaatcagaattcataatattttgatatgaaacatattctaaatttttcatatgaaagaactagtataattttctatagatttataagtggtgcatagaaggtagataatctaatttcttttcaaatatattcagtattggactcattttgtttcttgcattctctcaaacatggagaagtggataaaagttctcgctatgtgtatgtgatttattagatgtgatcattccaagttatcagtaaatttctagacatattctcaagcaattcaaaaggaaatagaagggctacttatttttttcgttttgatattcttttgttgactttagttaggaacttgatgggaatttattgttattgttaaagtgttgcaaatgaaatagtgcaaaagagaaaagagtatttggaatatgcaaaatggaatcttccagaagtgcatgctctcgaagatttttattccttttgttttcatatgactctaattttctagcaatttagaagtgcccatggtaacttagacttcggattcgacagagatatatataaggataagcaccgacgagtttggatcaacctatcaccactacaacttccgtgtcctctccccgaccacgctagtcgatcgctgagatcttcgcggaggtcgatgccggaatccaggacgagcgtggcgtgcgcgtgtgctgccccatcttacttgataacgatgagtttggcattttccatggttaattatgcgcttttataccatagcactaaagattacgttgcggattataagaacatttggactcccttgaatgggtattgtattgtccataactccatatggagaagagggggatgatttcgactgatcgatgaatttcagttcctcggtttgtattaatgattcaagagtatgcctagctttgaatggggctgggtgtagcatttctatgtaatttgcaagtaaatttgccattgtagcgttgtagtgtgtttgacgtgttttgttttttttttttgcggggagtgttttgtttgatcttaaaagaggctagtcaggtcttggttgggatgggagataattgattgattattcgagaaacgcccacgtatcttctggctagcttcataaggtgatgagctagatgatctgggttcgaggcctcactcttcttaattatttggcgtattttttattgattattctcctctaaaaagaaagtaaaatagattagaccgtacaaactttttgtcaagttgctgaacaacgacaagaatttctgaatacacaaataccaccttgaagaaaaaaaaatcctgtgtatagcaatatcaaaacatacatggccaacttggcacaaagccgaattctactttgttaggaaaaaataaaaaaaaatgatacgactccactggggatcgaacccagaatctctggttccgtagaccagcgccttatccattgggccatggagtcatgttttgttctaaaaatttccatattttatataaaatatttttatgtgaggcataatttactttcatttatttcttttttttttcgcgaagaagatgcaacttacttagacagcaacttatcctcccatataacacacagatagcaacttgctcgaccataaaaaaaagaaaaaaacagaaccatgcacaggtcaccgtagttacagttcacattgcttttacactatagttacagaccaattatataatagttacagataacttacaatgtagttaatactagttataggctgtccaacctcactccctcgtttttcgcgcacactttttacactactaaacggtatgtgttttttgtaaaaaaattctataggaaaattgcttaaaaaatcataatccatttttaaagttagttttagctaatacataattaattatgcgacaataagctattctgttttccgtgccagagggatagacccctaaccggcacaaacgaacgcagccataggatagttgcggagcacttatagtttgcggagcacttatagtgtagttacataccaattacataatagttacataccacttttctacgtagttacatactccctccattctaaaatataaggcacaaccacccttaacccaaaaccaagaaataattattatcatattgtagtttgaatcatcctaataaatataatacatgcatccaatagagttagagtatgtgagagtgaaggattttaaaaagtagtaatttaatggagaatatgtcatagttaatggcatgcatgcatgtatgccttatattatggaacatctaaaaaaagtggttgtgccttatattatggaatggagggagtatcatttaaagggtagttacagaccacttacagtgtagttgcacggttcacggtcggaattagaattgcagtagtcaaccccagattcatccgatgacgaaatctcatttggcgtatgaggcatttttgctttgcaaaatgctggcatctgacatataaaagacatatactaaagctatccgaaatttctgaatggttgcttgaacgagaaggcgggagctatatatcagtatatcaccataacatatatgcaatgcacatattgtgaagcggtttcgcaaaaaacgaaagatcagcaggagccacaaatctgtcgcaagacgaatagcaattccgttaatcctatgggactataaataaccaaaaaataggacatggcctctttgatagttccatacaaaaagaaaagaaatttacaaataggtcatacttcttgctatttttctatgaaagtgaagcatatgaatacatttatagtttccttctttttttcctatgaattaaagggtcttgtaagaaacatttcataggaatttgaatcctatgaaaccttttgccaatcctttgaatcaaaggggcccgtaaagttacggacttttgcaaagtgagcatgcgatgaaacctaccaaccagtattagtttgccttatcatatacatacatattgccagcttaacaaatactagtaatttgtgtacgtgcaatacacgtttcccacgttagctacagtaatcgtataaaaaggactcgatgtcttcaccaacaatacttcaaatatacccgtcatggccatcaattgaaaatagcatttacatcatcaccaatgaggtgtatacaactagctccttccatgtgtgcagtagaagttcatgtgctctgcaaaacacgaagtttaaatctatttcacttgcacgaaatggtcatcacatataattccaaaacaaaaatcatccatagttgccttagtggaagtaaaatgtagatagcaagcgtagatattcaagaaacactaacatttgttaaaacacctctatattttccttggccacaatattaatctaaagaggacatattgctaaactattgtcacgcccggagttttccctttccttaggttccaaatcacaaataaatggcctcgagaatttgctttggttaaccaggagaaaaccccagctaataatacatttaataattggaattgtcagggataatttttttttcgagttctctttgctccgaaaatcactaacatgacttaggtcaccggagattaaatatcagatcaccggaggcaatgttgctaaggtaaaagtgtcaagctaatagttttcttcctttgctttggtcatgaattgtgcccaattcactcccctctcagtccgcgattttgttttgcatgacgaaccgtatccatgtcagttcgcgggaccgtttccgttcttttcctgaaacggcattgcattgtttttctttttgggaaagtcctagtctcccatcagtggcctacctctatagacccgtggcatataacaccatttaatggtatctaataataaaagcacagcacttacattactaaatactactctacatctttgcaaatgacacagagcaatcatataaatgaacattaaaccaacaccattgcatatttccagtaagctagctacataattattacaagataaatatgaactaattaaagtcggcagctgaataataatatgagtgaagtataagaccaaaactatataaagaagaatatttcattaatgagtgtcttaaaatagaaggaaaagctactagagacatacccaaaatctcctgaagacttgaagaactaaagaaactattctatcctactccactagcactagaacaatgtaaataaactagagagcttcttggatttgatccttcttggtgcactttggaatggagagagtgaggtccttaaataggctgccaatgatggttgtggcgatcggaaattgtcggaaatagattattcttaaacaaatatgcatgcaagcattcctaattctcctttattctgggtatattgacagtcaaaatttgtctataacgaccgtcagcagtgcctcagattgatgggcgcacgacaaagtgggggtgcgggagaggcgtctcgcctcgcctgtggacgcactcatgctggagccatacgacgcaagggatcgaggcaacaacatgtcaattggctattggtgcaaagtaggaggatgcagataagttctgaggctaggagacggcgcgggacgcgtggctgttcctggttgggcagcacaacatggacgaaggatagcgcctaggatcttctgtgacggcgtgtcacgcccggaaattcactagtaatttccgaacttatttgtgcataaaatcctcgtccaggaatcagccgaggtacacaaactgacaatttaatatacaaatccatcataataataacgttacatacttacaaaagaaaagaaaacagcagcggaattaacggtctagcgatggcttcagctccactcccacaggcagctcaactggggtataagccaaacgtcttctccttctggatcctttttcttcaactgaggttgattgattattgcaagaataagcatatgacatactcaacaagccacacagcaaatatgcaagtgcacaaggataccaaaggatggcataatataggctcatttgcgaaagcagcatttagcaaagagttaagagtagtaaaacagtagagtaattaattaaaaattttaatcaacactgaacagcacacccatgctgcacaggcccaaccatcctgaacaaccatacccggctgtacagatctaactccaaaccaggagctaagcaaattattaccagttataacatccataattattgtgaaaggtgtgagactaatcacgaaaaacattgctcaacccgcccataaccgcgggcacggctattcgaatagttttactctggccagaggtgtaccactgtacccacaagacacaaccccacatcatgtcaccatgtgcctcaataccaccacggtacctcggaaaggagttgtgacaataccccttgcacaacataatccattacagcgcacctttcctggatcataatcacccccttataaacaaggcatggactccccagcgacccccgtggacttctcgccacttctcagtctggcgcactataatgaatcacgctatacaaaagataaagccgttgcccacgctggcttgtggttggcacgataaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatccttaaataatagtgagtcataagttatcccaatagtgtgctaatgtttctaagcatggctaagcaatcataactaatatctagctgaaccaatatataaagcccaactagtcaagttataataacccaaggtatcaaggaataaagtaatcaatgcaaattggccataacaaaggaataagttcacaccacccggtgacattcgaaaataaatgcacagttgaaataaatagagaatttaaatataggatcaacatgctcaaaggattgtgtttaggatctgtgtgacttgccttgcaataatcggtcttcaagtaatcttcttgatcacttccgacgcactcacgaaccttcgcaacgacggaaacgacaagctaacacgcaaaacgaagaaaaagactaataaaaaccaaataaacagtacatataaagtaaacaaacatgtagatcatgattttagatgaatttagcaacttgaaccactcaaaaccgagttacgatgatttagttatgaatttccgaagatttaatctattagaaaaacaggaaaaagaaaaacgatgatgacgtcatgatgacctcatcaatggccggaccaagatggcgacctcgccggagattggatggtcggctgcgactttggaggacatgaacacgtagaggacgacgagacgaacccaacggtactcaccctcgaaccaaacgacgaacgacgacggccggcgacgaggtctagcggcggcacggcttcggtcgacggcggcgacggggctccggtgaccggcgacagcggggagagagcggccgggcttctccacacctcggcgcaccttacggcggtgacggcgaccggcggcgacgacggaggcgacggcacgacgcggatggagctcggccggcgacgacggcggggtggagcacgtggcggcggcgctacgaggcacgggagaccacgggagagggggcaaacgaaagaggaggactagggggtcctatttatagccttggattgaagagatcggactcctcccgcaagaaatcgatccgggaaatcaaaaactcggttttggagataaactcgaaaacgagtttgattcggataagatactcaacgatttgctccgatttttggaggtaaagatagaggaggataagaggaatatttcccctcaactaattttagaaaaacacaaggggaaaggtcagatttggaggggaaaaccgcggctatacaggtactgtgcggctggctcgggctctgtctccagccggctggagattgaagatgacactgtagcagggaggcaaactagactttttgctgggcttctacttcttggcccgattgaaaaagggacacaaagcagactttggaggagggataaggccagccgaaaggaagggagaatgggccgaggatagaagctgaacttttcctatttcggcccgaaaaggagaaggggattttaaatacttttccaattaaattaatcactgaaatgatctttgaattgttaagaatacttcctatgctcaaataattccaagaaaaatcttgaaaatacttggacactcaaagtacttaacaaaattataattagaccatttaatgattaatttaatatgtgggtaattactgaaatgctctttgtaagattaaaaattaggaattgagctccgaaaaatccgagaatattccagagagttgacttaatcatggagaatttaataaaaaattaaatccatccatgctttatatttaggaaattttatttcccacatttaacttcacttgtaaattaatgaacatttaatataaattctattaataatttattaaataatttataaatcctgaaacgaaaatcaggatgtgacaaatctaccccccttacaaagaatctcgtcccgagattcggaacggctagaaagaaaagggcataggtaaactgcagtctatcttattccataactccgataattattctaaggttttaaagaaagctactgctgctttggaactgatggctgagctgtatcccttgagacgcaaccggcactgcatttgctcctgtgaggacaatgttgttgacttggccttgtggctgttgacgcttcggcttcggacactcttttacgaagtgacctggctcataacaattgaaacacacccgatgctcccttccattactgttatcttcttgagactgatcctgctgaaatgacactgattgagtagcttgctcatcattgtcttcattgcttgcattagtctctgagttgatctcaccactgatgcccaactgttgtgactgttgttgtgactgttcttgacctgcagaaaaagattcaccaatttggagtggcttgatacgctgcctctggctactatcctgtgcctcctggaatacaatcattttccttttacggttatccatcctgttattcttgtcttcaagtcgaattgctttgtcaaccagctgctgaaaatcaacatagtcatgggagatcaacataactgacagttcatccttcaggccttccaagaacttctcctgcctttcctcgtcagtacacacatcttctggagcataacgtgccagacgattgaactcatgaagatactctgccacggtacgatccttttgcttaagtgcccggaactcacgcttcttcaaagcaacaactcctacaggtacgtgtgtcttcttgaatccttcggtaaactcttcccaagtgattggttgtcgttctgctctgttcatccggaaatgatcccaccattctgatgcagattagaaaaggtagaaggagaggggttacactaaagacaagaccttaaccaggttaacactgatctgatgtgtgtagaccattatattgttcaagttgattaagcaagcaacctagtatagtcacacactcatcaatgaacttctccaatgatggaaatgcaaccatacctacacacaaagcaaacaacaagcgttctaccctactaactattcttcaaagacactttggcggcataggttctaagataggttccaaacttcactctatcttgaccacttggcacttcggttcttcctcgatccacttgactgacctccataaattgtccacatcaatatcttcaagtttccaccactagttttagaactactcaagttgaaagagagaggagagtagacaatgaaacgatttgcaaagaattctagataaggaagaaaggagaaattttcacaaatcatttttgtcggaaaaattcgtccttaaagtttgaccatttggcttataccccagttgagctgcctgtgggagtggagctgaagccatcgctagaccgttaattccgctgctgttttcttttcttttgtaagtatgtaacgttattattatgatggatttgtaagtatgtaagattatgttattttgtgtattcgtagagtgttagaactaacatgcaatttagtttctaatatatcaacctatcatactttatgctttttattgattttaaaaatctgtgggctataaaatagagatatgctcacgagtcttgcatcattaacatcgagttcgtcgatgacaatagttgaggataataagctaggcagcattacatccttttgtcactgtggatgctcgagttttctgatgacattgaagatgcacctcttcgaaacaatcaaaaaacaacattttatccatttatattatccactcagtatatgtagaatcactgcatatgattgtccttggtcttaaaattaattcactcttttaggtatatatgttaatattgatataactaatgtgtttgtggtggagattaccatgctaagtggcacatacctgaaggtgatctcagatacttgattctagttggaaatatcctataccttattcaatattgagaatctatgtcttcagttagatgctaatctacaacgcgagaagtgacatcttcaatacaagatattaaatgtaggtcttaaaagtgattgaagatcatgaccatatgcgtctttagattgcattgacaaaatattcaaggagaacttctagctagctagctacataaaaaaatatatattattttccacaaaagaataatttgttagtataatccttactatagtttgtgagttagtctagagggttaggtggtaagctagcagtattttttttctttaactataaaagattttcttcccttagttagcagatttttcttccgttagttagcagcttaataggttcccttggctactatgtttccttaaactatatacctttatgtatacacaaggaatgaaccactaagatgtgtttgtttatctgcactagtctagcatagcccgtatggatcatcctggcttaccgtgtcatggataagtgtgtacaattgatgttgtttggctggttagatcagttgatcttggatgcaatggtatagtggttggatgaatgcacatgagggaaaatcttgtttggttggttgcatatattagagtttggttacctcaggttaacttaccctttcaactaatgggtaaaaaatttataagtccagctaatttaaattacattaattagaaatattaaaactgaacaaaattgttacacccagcaacaagaagaagtgcattgttagtcctacataaattaatcacgttggctgtcaccaatccgtgtttttccttcgctaggccgaaccctagctccgtcgccatgtcaatctgcctccccatgcgtttcctcctctaattgattacaaaaatcgattctccactcatccctcatcatttttcccatgattttcccctacaattcggcttgggcggatttaatctccatttaactgtcgtcgatgatggccggccagtgtcgtcgatgatggccggccagtaagcttcctcaaccgttttgatcccgagttttgttcgctccaattttggaaaaaatggaaagagaagatcgagtagatcaaaagccctaaaccaattttaggagatcgaaaaacattcggccagatttgatggggagaatcagctcaaacatcatatgtgcatggcaccatctcgtggaggtagaagatggagacccacggctccacctgcaggttgggccaaagaatggattcaaaaacatcttacccgttgcaacgcacggacattttttctagtataagtaagtattcattatggtattcactcttcttatttaagtaagatatattctcatcgttgtgggttcattgcgctgcttcggtagagtacattaatcttaactttgtactgagattaaggtagtaattaatagcatagatgtggtgtctaggctagagattaccattgttttttgtgtgccccacgggttgtagaggtagatgactggtggtgatagccatgtccatccttcgtaatcctccacgttcgggtacatcataaggccagagtctccttggcagatcaggggtaagccggtgcccgaagcaattgatagaattttactttaacttaaactaagataagtaagccattggaattcctctcatatcttcacctaccatttatgttgtgtccttgggtaatttagttagaaaactagttcacacacgttccctgcggatatgacaccctggaatactcttgggtgaaagctacaacggtatctgtgcgcttgcagagagcttcacctttggaatgtggcattgatttctaccttggtgtgtgtttgagagtgaggagtggaggcctatttatggtgtggaagtgacttgagagagtggggatgctaagggaatattctccctccagctcctctcaaacctccacctatccacaaccgacattagatggtggtttcctaccttgggacttacgccacttacttcaggagatcagtaatcgtcgccacgtggaagctgaggccgaggggagccagccagggttcggccgatcctgttcgcgccgttttctgtcagggtcaccgcttggtgcgtcctcaagtttaggttgttctcctccttgtgtgggccctttaattcgtgtactctcctctgattggttggagttgtgctttcttactagtgttttctctcaattggaacaagtaatcacctgcatactattgatggtcgttatagaccaatttcgatcgtcaatacgtccaaaaataatagagaactagcaatgctttaatttagagataaggtgaaatgggttaaaatcatccattggctagagctctagctcttcgtagcttcacgtgatccatccttgaaagagaacacttgtgtgcgtttagtttagagatcaggtgaaatgggttaaaatcatccgtattttttaatgggatagttttactatttggcattaagaatggattggttccattttttcgagggagagagaggaggtgggttgaattggacccttagattttgaggtgtgaatctaacacgaatattagggaaatattcccctttggagatcaacccatctcacatatcctcaaattaaacactttagaaatgggttcgacctaacccatccgatgaaaaaaacgcagcttgtttctgaatgggataaaggtgagttacaaagaaccattgagctagactatttcctcatttatcaggaacacgcttatcaaactgctaaattgagtttttcgtgaaaaataatatatatatatagaaatttctttttagagtaaaacacacgaccggtccttaaagttgaagcgaggtttcacttagatacatgatctaggaaaatcgtcattcgggtccacgatcttgtttaagtgaatcatttaggtccaaagcacctctgaccgggttgactggcttacgtggccgtccacggaggcagcatatttgcattttagcccccccacatcttggcttccccatttccgatccaaccattctccccgaaatcctcctcctgtgtgatttctagggttagcgattgcagcgtcgattggggtggcggtggagacgtggcggcggccgcgaggacgacaacgatgaagaggagggaggcgcgtacgacggcaacggcacgggagaacaagcgctcgtcgtcctcatggtgtcgtcggcggccgcgtaggcctccacctccgcggcggtgtccggctcggtccccgtggggctggcggctaagaacccgaagctgatgcatgagggcgcgcaggacctcaacctggcgttccctcatcaccatggtcatgccctgcagtcaccggagttcacggcattcccgagcttgaagagcagcaccatgtgcaaccccggaggcaacctggcggcggcgaacggcgccggtggcaggggcagcgtgggcgcgtgttctcggcgatggagttgctgaggagcatcggctactacgttcctctgcctcagatggggccgctagggatgccggtggaatatgcagttgtggggttccatcttggcgagttccgcatgccgccaccgccacagtagcatcagcaacaagctcagactgcgctcggtttctcccaggacacgcatggcgggtgcaggcggcagctccagggtgtttggcgcgtgcagcgctgggttgcaagagagcgcggtggggcaggttgttgttcccgttcgaggacctgaagctggtggcgagcgccacggctagcgacgcaaacagcagcggcgatcatcagtacgaccacggcaagaaccaaggtggcggaggcggcgtcatcggtggccatgagaccccagggttctggaatagcagcatgctcggcaacggaagcagcaatggcggcggcgattcttggtaaggtgctgtgagctgcttgcccgccgccgccatgcatggctcatgcatgcacgcgtggtggtcagcagctagcagcatgtggaaatagagaaatgagatagagacaagggggagccaagattggggggggggggggctaaaatgcaaatatgctgccaccgtggatagccatgtaagccagtcaacccaatcagaggtgctttggacctaaataatttacttaaacaagatcatggacctgaataacgatttatctagatcatggacctaagtgacacctcgctccaactttaaggactggccgtgtactttactcttctttttaaaatcaaataaatttattttaaaatatataattattagtaatacttaattaatcatatgctacattcgttttacgtcaaacaaattagctcactgattcagccgcttcgacgaagcctaagtccatcccaatccgatgtcaatgcggtgatgcccacgttccccttttcaatctagcttgttttagcttgcgagccagtgttccttcatctcttccaccttgtcttcctcctctttggcaaacacggataggggcatggaatgagacggtaatggacacgacgagaggagtgtgctggccagcgagagcaacaagaggagtgcattgtatgatgacgccgggggatagcggcgcattgggtgacgattggggaagtgagcccaacaagcgtgacgacatgagtcgtggagcacgtgttgctttgactccatcgtcaccattgcttggttttacgtagccatgctctgcaatgcaccatcgctcccgatgagtggagtgcaaaggtgccagggccgccatgcaagctgcagaggagccgatgggggcacaatgacaatgccacgatgcgaactgattgtcgctggtctttttggagttagcttcagagtgtttcttttttttctttttttttttttgcctattgcagaattgggttgggtgcctgggccgtcaagtgggttgttggcctaatgagtgttgtgcttcttttgattgcgcttggctcattgagcttgcgagccagctcgagctgactcgttatggaatacgggccgaaatgatagttgtctcattaaaaaaaaaaacgcaatgagacaaagcatcttctaacgacgcgctgttgtggcatcgttctcgttgggccaccaccctgatctgtgacaccgagctcgtcttcaacacgctctacgtcgctggatggaggtctgataccacttgttggcaaaggcggcatatcgaacatcttaagatagtactgtatcaaatccagcaataacagagcaaatggataaaaaacagaggagaactgagcaactctcgaactgaaagtttttgggggcaaattttctctctattgaaatcaacttctatataagccgcacagatttccacggatcaatggatcatgccaatgccatccctggcagacatatgcagttgctcctgcttgtgattcaccttccgcccgttaatgtgaattcaaatgggcacaaccgcccaccgcagccggtggtggagctttttgcatatatgcagtcatagtcaatgttcttcagcttggattgcatgttaccatgaccttaggccttgtttaggccttgtttagttcccaaaaattcacatacataaagcattaaatatatatgaaaataaaaactaattacacagtttacatgtaaatcgcgagacgaatcttttgagcctaattaatctatgattagccataagtgctaagtagctcacatgtgctaatgacggattaattaggcttaataaatttgtctcgcggtttccagacgagttataaaattagtttttttattcgtgtccaaaaaccccttccgacatccggtcaaacgtccaaatgtgacacccaaatttttttttcgcgaactaaacacacccttaattaaaaacaaagtcaactaaaaaactatcagggatttgacaacataaagatatacacaatgtaatggagagggtttgtttgtccaagctctattggtgtccactatattttaactgagtggatggcccaggttgacctgtaaataattttttttgggggggagacttataagctaatggcatatgtttgtcttgcttttatgcaagtgctagatatacatatctaagctccatgatcagaggatatgtctatatattatactccctccttccctaaatatttgacaccgttgacttttttaaacatgtttaaccgttcgtcttatttaaaaacttttgtgaaatgtgtaaaactatatgtatacataaaagtatatttaacaatgaatcaaatgataggaaaagaattaataattacttaaattttttgaataagacgaatggtcaaacatttttaaaaaagtcaacggcgtcaaacattttaggatggagggagtatgtattaagaaaggtcaacaccgagttggaatcacatggctaatatatagtatacaaacgccatagtaaaaggaagatggctgaggataaacatgacatgtaaagtaccatgatcaaccagcatatatatactagattaattctggcctgcaaaatttgaattgaacaagtaatgaaacatatatcaacaaacaaaatatattatcaatgtttatcgaatcagcaaattagtaatgcaggtcgtttatcgaatcagttccttaagtacgaggattgcgttctatatggtatttcttttgcaatgccatttcaatatcaactttgcctgttaaataggtttctgttcacgttttatacaatgtaatacgtgataaagtttttaagaatatcagtcttattgaattcataataaatatgg

SEQ ID NO: 26895 - DNA, 26903 bp, Oryza sativa
tcccatcgctgcctccctcccacagcggtggcgtcatgatctgtgatgcacgatgataatgagggtaagcagctgagtccatgcaattttgaactttttactttgcatctttgttgttttaccgatttgctgctgcagttctgctaatttgctcctgtattctgattccttcacattctgcagtctgcactcgcgccggtcggcagcaggcgctggagaccctggccacgcaaagcaggcatggggatggcggtcaggatcgatggatggatggatgttcaattcgtatgtgttccaatgaaagtcaggatgttttatttgttttattttctctccatgatctatctactcaatcaatctctataggcaatagctgcttgtttttctttgaggaagcatagctgccatgtttgatcagttaattgcagcttatttgccggcgccagatatgtggtgattgcttgtgttcgttgatgcgctgtataacatacatgcatgttccatcgatccattgtagatcaatttgtagtgaatgctagatcattctgaatttatgattattcttttcattaagaacattcggtccatttttattcttgaaatcgtttttcatctgaaaagatggcaggttttgtgtagcttataacttgtatgttattaatcagagatatctggatattttagcctgaagcatcccaattacgtattctacatttttcagccaactgcattcttaattttcttttttgcacaatgtcatcgattatagattgggactaggcaagcccaggaattactgttaaggaaacataatgtgacctccatgcttgtctgaataaaaaatgatctgttggctaaaagtacgcatgaaggaacctaaactggtagctcaattttttatgaagcattttatttcttcttcagcgaatcatatctcatttagagtcatttatgagtgtaaattatgtaatcgtttttgtctatatccaggtggctgtgggatgcctctctagatgttcgtgggtgatggatatctgccgatgggagacctaaggatctatagtgttttgtcggctcaacatcgatatgtggcactagcgccgtcttgtttattggattcgtgcatgtaatagtaatttagttactaagagacattgagaaccatcagtgatagtaacttggttactaagagatttttttggcaatatcaatatgttatgttgagattggtgtaatagtaatttatttactaagagaaatcttatgatgatatcaatacgttatttttaagtaattatttaccgcgagaaggtatgataaccaattaactgtagtattatctcaagtaatatatatatatatatatatatatatatatatatatatagcgtagaaaaggtagagtcctagttctttgagagaaattgaatatatatcacctttatttttaaatgaataacattgttgatttttgacatacatgacatttcaacattcatcttattcaaaatttagtacaaatttgaataaagttgttataaaatcagccccgaaatcgtcatcagtagctaaacacggaagaaaccttataggagatccaaaatattgatgacgacatagtctacatctccggagcaatgattacgggtgctcctcccggatccagtgtattacaatatatcagagttacaacgaccatcggctgacactactggcagctacctctcacctatgttaagtcgtcatgtagttacaaccggtccgtccctctatttaagagagagcttaggatcgagtccagctcttactctattcctacacctagtacgataactcgaagtcgtaatctataaccgactttgtatacatattggatacaaactctaacaaaaaaactataagtcatatttaaagtaactttaaagatgaaacaacaagtcaacaaaatattgatacttccaagtgtttattaaatgatcaaacattatgtccaaatatccataactttatctatatattgaaaacaagtagtaaaatttggatgctgcttcccctgcacagtatgtgtatatactattcagtcttcatagtagtatagtgcatgttattaatttactgttctaaataatttagtgtgcgcgtggagtaactgattggagtgtaaatatacagaaaattgttaatacacatatgtcagtgtcaggttagttgcttacatgctttcactctttttttcttgtcacaaaatactccgttgctttcaactctagttttatatttcgttgtctgcagaaagccctctgcactttttcccttgagaaaaggaaaagtgcaagactcaaaacgagctatacaccaactctgctgagatgatagtctgacctgtcatgcattctataaattgtgtagtgggattttcaaaatataactaattgtgtttagtttaaagctagctgtttgaacgaaaagatagttcatattacaagttactccaaaataagagaaaccagattaattaggcttgcaacacgagaacaggaattttctgatatactagatgtaaatgaaactttccattcattagttaataacccaagtgtgttatctaacaacttgaaaaatacagttattctcctccctccgccccaaagaaaaaaagacgatcccttctctgaaaaaaaaaactgctcctaaatcctccccaaaacccaacctatatatcgtgaaaaaaccagcacaaaagaaactggaatatattgatatctccgaattcgggcatataactggtaatagaaaaacttctcctcatgtaggcttccctagttccatttatgtgattcttgcacgtgtattccttcatgcatgggtacctgttttgcttcccataaaagatgggcgagttcaaaggagctgctcagctgagcaacttggcagcacgctaaaccgtctatcccttcattcttggtaccttgttgctttccataaaagaagggcaaattcgaaggagctgctcggctgagcaacttggcagcacgctaaaccgtatatcccttcattcttgggtaccctttttgcttcccataaaagaagggcgagttcgaaggagctgatcggttgagcaacttggcagcacgctaaaccgtgtatcccttcattcatttgtaaagccagataagagatatgtgaattttatgaacaatgttattatcactttgtcggatgacgaaatgactaaaataaaagttatagatcttgatgagttatacaacttggttgttgataactttttcagctaaaatcatttagtatttgaaattgttgtttaaagttgtcatattttcatatttaaattcaaactatttaaaaaatgttatatagaaaaatgaccaaaataaaagttgtaaatcttgatagagtaaagtgctggcggtccttaaacttgtagagtccctaaactctcaaaatgcatatttagatcccagaacttgtcaaagtgtatcatctaggtcccaaattgacacatcccctctaggatcctgtgtggcactgatgtgacaatgccacatggacgtgactttgttgttcatgacttttccatttgaaatcatttagtatttgaaaatattttgaagttgtcatattttcaaattcaaattcaaactgttcaaaaaatgttacgtgaaaaaatgaccaaaataaaagttatagatcttgatgagttatacaactttgttgttgacaatttttctatttgaaatcattactacccgaaaaattatttaaatttcttatattttaaaatttaaattttatatagttcaatcaaacccgaatggagaaatgaccaaaataaaattggtagatctcaatgagttctacaactttgtctttgacaactttttcatatgagttcatttagtatcataaaattcaattcaaaatttttttttcctagaaatttgatttgcctcctcatcatgttaatacttacatatttgatccaattaacttggttttgctggtgaaatatgtgaatggatgtgaaatatgtgatcaaaatgaatgttacgtgtcatttcaaaaaaatggatgttatgtgaatgtggttatgttaaatatattaatggttgtgtatgtgaatgaatgtacaacttcttctttggaagctgatctccaaagaactctgaggttaagcgagattagggtggagaaccgaccaggaaattcttcccgggtggagcaatttcgggatggtgaccgaccgggttcacacaagtgaggacaaagtgcgcagaaaagaccggcccaagggcgtggcccccaaaggcctgaggctagccaaaaaatatttttttttggattatactcatccttgacatgctataatttagacccaattgagatgacagtcatccgtgatgggctatagtttaggcgcgttagaaatgagagtcattcatgacgggctataatgttggcccgttagagatgagagttatccgtgacgagctatagtgttggcccgttagatatgagagtcatccgtgatggggctatagtgttggcctgattgagatgtttgtcattcgtgatggccggatgcccaattaagatattttctcacatcagtaatctttgcttagtgacggaggctctgtctgaaagagatgaggctttaggtccgttagagataaccaatcccgttctaatgagttttactgactttataagtaaaattctgttgttttttaaaagtctctatataaagtagagatatgtaacttcaaatttaatatggaaggagcatttgctcaagaaacattaccgcacatatttttcattgcattttaattgaatgccaattttatggttctttttgtgactgataaggttctaaattaattagggtctgtttagatcacctagcaaaattttacaccctatcacatcaaatgtttggacacatccatggagtattaaatataaataaaaaaactaattacacagattgtgcgtaaattgcgagacgaatcttttaagcctaattgcaccatgatttgacaatgtggtgctacagtaaatatttgctaatgacggattaattaggcttaataaattcgtctcccggtttacaggcggattatgtaatattttgttattggactatgtttaatacttcaaatgtgtgtcggatatccaatgtgacacgccaaaactttacacccctagatctaaacacagccttaggctttctttagttcccaacaaattttcccaaaaacgtcacatcgaatctttggacacatgcatggaacattaaatatagataaaaaaactaattgcacaatttgcatggaaatcgcgagacgaatttttttagcctaattagtccataattaactataagtgctacagtaaaccacatgtgctaatgacagattaatcaggcttaataaattcgtctcgcggtttctaggcgagttatgaaattagttttttcattcatgtccgaaaaccccaaccgacatccggtcaaatgtctgatgtgacaccaaaaaattttgtttttatgaactaaatacacccttagtcatgcatgttgagataaaactggtcccaataaaatttgatatcaaattaaagggttctctgaccaggaacacaaacacaaaccaacagccattcctttccatccaatgtgtcaattcaaggtatgcagatgcatcaatcactgcatttctaattacacacatgccacaaacaacaacatgtatcacacaagagtagcagcagtatctatgtctttggcatattgcacatagcatttgttcatgagagcaacagccacaaactgaccacacacatgcacacaaatcaattcagcctgagtaatcttcagtctatctcctcctggacaatgccatctaccaaaaaacaaactcagcagaggccaggagacactgatgatagatcaaagctagtagctgcaaaggccaatacactcgggaacaaaaactaatacaacaacacagatgctgacgtcatgcatgaagccgtcaggaaattaatcaggagaggatggcgtcccagtcgatctcccacgacggataccggcgcagcgcgaagccgtcggcctcgtcccatggcgcctccgtgaagtccagctgctgaatcgtctccggcaacggcggcggcggccgcggcgccggcggcgtggcggtggcggcctgattcgatgaggtcggggatggggaagaccctgtggacgagacgtcggcggcgtcggccgtcgtcgtcgtggaggcttcggagacggagcagcagcccggctcggtcttgacgacgcgcggcgacggcggcggcgtggtgttcgtcgacgccggtgctgcggcggcggcggtgtccgccgtggtggtggtggtggcttggaggatcttggcgtcgacggacgcgctgagcgccggcgcgtggtgccgccctccgcgccggagctcggggaagttgaggcgggcggcgtcgccgcgcatccggaacgcggcaccgtcgtaagcgagcgcggcgtcctcggcggtgtcgtacgtgcccagccacagccgcgtccggttccgcggcagccggatctccgccacccatttcccccagtgccgttgccgcacgccgcggtacagcttcgcatgcaccggcgccggccccaccagagcaagccgccccgccgccgccgccgccatgccaccgcaccgcttcatcgagcacggcgccgcgcccaccgcccgtcgcagccggtggtgcagctgcgccgcctgcgacggcgtgacaaggttatagttataccacccggcgccaagaaccatggccgtcgccggcgacaggctctgctgctcggcgtccacgaagaacggcgccacgggcgccgccgcgccatggacgagctgcccgtactccacggcgccgcccagcgccatcggcagcggaggaagcttactattaccactagtagaagccgcagcagcgaggcaacgccattggcgatccatggctgcttcttcttcttcttcttctaccttgcgatcgatcagcaaacgcagcaagaagaatcgtgttaatttggaagttgaatgagtgaataagcaaagcttgctatctagctccatggtgtttttataggcagagagggagtagtgatctcacccaatgggaaagtgccaagtggcacctctcctgccacgtgtccactgtcctaaccaacatatgtggaagagttggcacgtgtgagctggggattggctgagaaatggagctccaatggcggaagaacctgacgacgaatgatgtgatttttttttcatggcaagttgtatttttgcatgctgattttttttctatttgcacaaatttcctccatgtacttgttgtcctatgatttcaatattgaattcgatatggacaagtacaatgtgttgttcattcagatgatattggcacatgctgtactgtacaaattcaagacaatttgtcaatgaagcttgggccggatgaaaagcatattttatcactttaattattatcactttttcttaaaaaaacatttttgtgcatataattaaaattatgacgatggatgaataaattttgaaggatgtttattgggtcagaattgaactactaatttttgtgaaagttctactccctccatcttaaaatacagttactaggtagctaagtatattttaataatagctactccctcaatctcaaaatataagcatttttagtatagtgacaagtcaaacatttttaactttgactattaataataataaaaaaaagattacatataaaattgatgttactagatttatcattaaacaaactatcataaaatgcaactctttttatttaaaacatcttaattttataaatattgttggtcaaagtaacatctcagagaccatgtcagtggcaaaaaatacttatattttgggacaaagggagtagtatattttagggcggaggtacgtgtacaaaactcttgctttccatggagttccaaaattgttggtttaagtccaaggtatatgatcgtggaagaatgaaatcaaataccaagaaagaaaaaaataagtgtgagcaaatagtgatgcgatggtgatgtagaagccgccggtacaatttgatttgatgcagggagaccttttctggtcgacggtttgcaatttgattggacatggcgtgatccatcaatgtgtcagcataaggaatgtaggccaacagttcatcgtttcatcctcagccaggcgtacagaaagccaaaaggcaatgcaaattaaaaatcccccctctttttgttcacttgttatattctctccgtgttattttaataatgcatctccatgatgatttttgatccttttagcaagtagaaagggaaaaatatgctatatgttgtaattctagggtcatcttcgaaccaaatgtcgcaattttgcaagagttgcaagttttggatttttttttcttttgagcataccaacccatagggtttttttttctataaaaaaatgtgtggagcaacatgataactcatcggttgaaacgtattcttgatataaaagatgtatggtataaatttacacgtgtgcggttcaattattagtcaaaagagatactaggtggctgtaactatgaaattttatagagtacaatggatacgcatagagcgaagaatctgcacaaggagccacacaataaaggaaaaaatgtatatccaggatatataaacgtttcagtttatgtagagcaggaaaaaagaataaagtggtaaatgaacttttcatgaaatagaaaggaacaggaacctccaatactttgaccaataaagatagccaaataactacttttttgttctgttacctatacctagtgtgaatagattaattagaatacctgttatcttatatcataagaaacgatcgattttgtaatctaatgataaacatgagtggaccaagattctcgataaccaaaagttccaaagcaatctaatttccactcctgaatcagatatatagtatcttaaaattcgttaagatatggacaagatctatcagactaataagtaaattgagtaataaatatatcttgaaatatcacttaattcttactgaatggacaacaaaactaatcataaaattgcatatataacattcccgctgattgcatacctaaaaacgtagaaattcatacactacttaaatgtaaaagataagtaacgctatgtgttaattaactacaagtttgcgcattaataataatacatataatctgtagagcatttatatttaacaaatctgtctatgccttcataaataatgcgcacaatgcagccataaccaaatccattcacattcttgtaataatgaactaatccacaagaaaatgacagaagccaaaaaaatgaaaaaaaataatgagaatgcgttgcacttgtcgctacaaaaaaccgtttaggttggtccatctccacacaacggctcatcaatctaaccaagcattgcaagcattatattgtggtgataaccttgttaatctcgatcaggtcaaaattaagccaaaaaaaaactaatttaaacaccggagaggcgataaactttttaaacgaatcctgtggccacccttcaacggagggcggagctggatttgttaacaatttgcacaaactagtggccacggctagttcgggaggccaaaaaaaataaattaaagattaagaggctaatgacggattaggggacggctaatcatgcagtgtacgaagtggttaattaggctcgcgtcatgtcgtgacagatttggtgatggccacgggtggctgcgctttttcagcgggtagattaattaataagcgtaaaagtgtgattaaataacaataaagagatgggaggataaggattaagaaacggaggaaagtttaggggagaggacagaaatgggagacaggcgtcagccaatccaagcatagattttcaccagagaaggtaaactgttaaggcctcctatgtaatacagccatacaggtagtcgggcactactctggtaaaagttatttgatttttatcgcaggattgactttaagttttaacatttataatcaataattttttaaatgcatatttttaaaaaaaaacttgtatacgtagatttgcctaaaaacactattatgacaacatgaacttattagactttataaacttattttatgattgggattttaaaattttttaatcaaagcttgtcctaattaagctaaaaaataactctaaatattggattaaattgcatcatacccttttttttctttcaaatgcatggaagaaaattagacttggaggagagtttgagggacccaaatatactatggcctagaaaagaaatagaagcatgactagtggtttgtggttttctccatgtaaggtagagctaactctacgttctctactactttaaaagcacgatactcttttcttcctttttccaccgtacgaagtccgcttgttcgtgtgtgcataattgttgattcagtaatttattctcaatccacccattcagccaatcccaaatcatattggtctggcccatcacaaaagtatgggtatattactagtcattaaaataagtgtgattagcagttatgttttctggacttataagcggtgcaatttttatatataaatttttataatactatttaaatccatttttaattttataatagttaatttattcctttatactcgtgaattactatcacaaaacaatcaacttttcaattgatagtttgtaagtttttcttcagttaatcagctctatttagataaagctgacttttcaaaggtctctagtttaaccatcctaaaatctgtttatacggtacagttttttttttgtttgttttttgtttatacggtatagttaattatgttgggctcaaaccaaaccaattaattaatttagactgcactttatgataactagttttgtctgtcaaaactcatgcgcaggaaattgctaagtaactaattgtgcaaatcgttcctgatcccttaggtgtcttgttttttttccaactcacgtggaagacatatatgtacacaacggcacaaacgcagattttcaggtgttgtcagcgttaataagttgtttaggggcggctgaattcggtattcatagttattactaactcactcctctgtgcacgcttttcaaactgctaaacggtgtcttttttaaaaaaaaattatatacgaaagttgcttaaaaatcatattaatctattttttaaaaaaaataggtcatacttaattaattatacgctaatagaatgctccttttctcaatttagtggtgaccactgaccaactgaggcgtgcagtgtcctttatttttctttcttgttatcttcttcattctttcctctcctattatttccagaaaaaaaagagtatatctcattcgtgttcttttaatgcgaattgagtttggattagctaaaatagttttgtttaccttcacatacagatagaagacaacatgtaacgagggcatccacaatatagtctagaactagtccataagcaataaaatatttcattcagctacctcaccacattgtggaactagtccatagtaagaaaatagcaaaagctacccatcagcatataggttgcccatatagaataaaatatgttatttgtctctatttcctctctcctcctaatactagttgctatctatatacattgtgaagataacaatagttatagtccatatatgtgggtcccatctatatggactacttttgctatatacattgttgttgccctaactgtagctcattgagatagagaagaaactgttattcacatgaccaactgcttcctgtagcctccaataatacaatgatttatgtacttgtaaaaggaagctatcctatcctaattaagctaacagacccttgttgattacatgtttaaaccagtatttcataaagtttaggcagcttggcaatctcaacaagaaaggaacatatatatatcaaaggcagtttgttattttgttgggtcatcatccatattacgaaacggcaaaacttaaccaatcaaccaaactttggcgctccagccctctgaagcaacatcaggtagcttaggtcaaaaccatttcagaatgcataaccacaattgcacacatactagataacagaagaattgcctgatagaaagcacaacatgtcgatttagtaactgatgagttttgcagttcagctgcagacgaacatacatataacatactcaagtgctaagctatatcacaacttatcaagcacgcaacatctgatgctgatagttttgctctcagtaaaaggtatatagaagtcttcttagagtatttcaacaacgtacgaatattgatacataactcacatccttcaaacgcggtcgtccacttcctcgtacatcttgaggatttgtgcgcacgcagcaagaggagcatccttctggaagcccagagcgttcgccaaccgaacattagatgtcacaccattgttgttggtgaggaagacaggagccctctcccgtccagcaacaatcttgccacactttgcgtccgggctgctcacaaggacagactcgcagagctcgtgctcatgctcatcgttgacagggatgttgtaggtgccagtgtggtcagtctggccctcgaagctgcatgtcttggcgccagtggatttcgatctgcactcaacctttaccttcgctcctgtggatggatggatagaaggaaagtcaacatacaaatatttagccatagaaggttactgataagattttagtcacctatgtgactataatatactaaaaaaattgcaagctgacttaaaccccatcaggcgttgcagaggttatcaaaaacatgcatttagtttctattatgtcatcaagagttagcttatgatttaataaaaaaattctgctcaaattaatatggttcccttattctacagcccagttgtggtttccttatttcctaatgtagcacatagcagcaaccacaaattgacaacatttttgcagataagatttgtaactgatgtcttgcaggttcacgtaaccatgtattttcacataaaagtgcaccagaccccacagtacctggtttatcttaaaagttgttactttagtcataatgcaaaaccttggtcatctagattgcaaatgttgagtaaaatagccatggatgtcacacttcggtttacaaatatgcagagtttctagcccttgatagttgatacaacaatgaatcatgcaatacattaggcagaacaggcttggagaatggaatatatgaaacacatgcaacattttggcaggtattacaagcatggctctaaacttttcatagtcaggaatgttgatccagcccagcattttgtgaaagtcggcatagttcagtacccaaaaatttccatctagtatggctagaagaaaccgagcactaacccatgagacaactgattgttgcttgatttcagaactatggttataaatgattcagtgaaggaaatctggagggaaaccatggttacaaactgattcatgacaggtctagtttgttcagtagcagatccatcagcacacagcctgtgatcacacatgtttagaccctgtttagatgggactaaaacttttaagtccctattacatcgaatgtttggacattaattataaatattaaacgtagactattaataaaacccatccataatcttggactaattcacgagacgaatctattgagcctaattaatccatgattagcctatgtgatgctacagtaaacattctctaattatagattaattaggcttaaaaaatttgtctcgtaaattagctttcatttatgtaattagttttgtaagtagtctatatttaatactctaaattagtgtctaaatacatggactaaagttaagtccctggatccaaacaccaccttaatcttctgagggaccatccaacctgaaggtaatgagccttaagatgtttatattattttacccttcagcaccaccttgaaactaagggcttgttttgttcattcccatgcacatttcaaaagatttggcaacaaaccaaatgagcaaccttgccatctcttctttttttggcaatgcacaaccttgccattcccagaattttggtatggtttgagcttggcaaagaaccaaacacaccctaaatcagtaccgtcttgcgcagatcccaccacccactacacaaaaaagactcaagtctggtgcgaatagtataggtactgttcatatacttccgaatttgtcttctattcctctatgtgcgagttaagtccaggctcaagaatctgtggagtggtacatgtatgttgtatgaatgctgacaatttttttgagaaatttccgtaaccatctggatggtatttgaacaaatgttcaaaacagtttctccaaccgaagattgcagactcgaattcggcagttccggtcttggaatctaaagatctagcacctctaccaaaccataggttctagcatttatactagacacgcacgtcacttagcttagatttgcagatctactcgaacaaactccacattccgcaagccgatctgaaaataactaaccaccagcagaaaaaaggccaatgctggcatcctgcaggcaagaacacacaacacacggtggcagagtgataacttcagcattaagcgagatcctactgcaggctacaactgctgagctcccggctcaccgacgggggaccgagtccgtacacagaccgggagggagtggagtaagtgtggtttagttaccggcgatgtaggtggaggcgggggtctcgaagccggcgaggcaggtgtcgcaccagacgcggccgcggacgacgaagcccgcgcggcgggggcggaggtcgcgggaggcggaggcggcggaggggaacgacgcgagggccatgcccaggaggacgaggaggagggagagcgcgcggggggacgccattgccgccggcgccaacgacgagctcgcgagtgaagcggcggagtggggcgagtgaggagtgaggagaggagactagactccagagaggaggaggaataatggtcgtgtggggtcgcgtgatggggtggatggatttatgcgcagcatgtgaccggttttgtgggggtgcgagcaccgcacggtgagtcggtgatggccaggacccaggagaatcaaaggcaaagctcgttgctaatcattttctgaaaatctaacaaattgggtttctcggtttctatcgtacaattatttttatttgactatatattttttaatttgaacgaaaatctaaattttttgagaaagctttttttttcgacgaatacaaggagctttattaattcataaaagattacagtctgagaaagattacagttttaagcaagatgacaaatagctgaggacttataacctaaggccagataggaaactacaggaccataaactctctcaaatagactctttatctgatctggtctctcgcattcttttttttatgattctacttaggggtttgagattttctccataatctatcgagttgctccaagacgaaatttgatgtttttcgattggaaccgctacagcagcaataatttgtgaggttatatgacattgtaacgttgaatgttgtagacatagtttttgaacttacgtgtattattacaaaatagttttcgaacttaggaaatgtggaataacgccatataccaaagttattacttactcgctcttaaagatatacttagtgtcggtttggttgtctactgttaaactttggctaagttttaacacaagcaatgtttaataagatattgtaaatataagtcatattaagattgttttagcacaacactggatctaagttttcttgaactctataaatttataatgtcgacgggattcccacggaccgtattctatgggtatcggggtatgttggtacgaggatctacacgatacgacatcgagcacataaaaagataggaattatactggttcaggcacctcacaaggtaatattcttaatccagtttatatgggattatagaagaatccacagagtacaacagagaacaacataactccaagattaccgacgagattcttgtcgagagagcctcgacgagatctatcgatgaattggcttcaagtcctccggattgcttatgtggtggcgggtgtcttgcactaagattcgatgccctatacctctcagggggtatctatttataccgcagatcaccttggtctccaagtagaacttggagacaacagaccccgcacgatatgacaacgtcattaattatcccctataagtaggactctgatatcccctgttcgtagatattattttcgtaaggactcatcaatttccttaattcaaatggatcctttccgtttacttgaagatataatgtatccgcatactttatgacttctaggatagaaggtatgtcttattcgtaaccctgacacacaattacgttgataatatttggataaaatattttcttccaattttaatgaaatctaaaattttaaactgtacaaagttcaaatctcctgtggatttgagaaccggggttgcgccaaacacgagtttggtaaaaagttggtggcaattcaaacatgaagcatataccaaagttaccaaatatttggtaggcaagttttggtttaaaatggtataagccatcaacttttatattattgtagctcacatgttaagttcaagatactgtacgtataagttgataaaaagaatgatattctcgtctattgtcttacatgttgtaatgccataagtcatgtattagtttgaatcaagtgatgctaaataatatatactactccctctattcttttttaatttaactataacttaaaaagttattatttctaaatacttgacattgtacacaagctaacctacgctactagtggagaaggtctagatacaagttcacgtatgacctttaggctgtgtttagtttcatgttaaaaatggaagtttgaagaaattggaacgatgtgatataaaagttggaagtttgtgtgtgtagtaaagttcgatgtaacggaaaagttgaaagtttgaagaaaaaatttaaaatctaaacaaggcattagaacatgagaatgtctcgtgctctcgccgaagatttccgtccaggacgaagcatatatctccctgaaatcaaattggatttgatgaagatagcgacacgcatccgttcaaattcaatgtgagcaaggatggagtagcaatgttctcaaaaaagcaaggatgacagtaggagcgatcgccatttcgtgcggctttggacgtttgccggtccatccatccagccccgttcacgggccgtcgactgctgcagtgcagctggggcggcagcgtcggtgcggaggatcacatgcgccgtttcccgtattccccgtatgcgcgcaccggcggttcgcttacctacacagctactccctccgtctcaaaagacttaggcagtgtttggcaaatatctaaggaaaatgatttccaacccatctttaaattctaaccattcattcttcgtcatccatttaatcctaaccctttatttatttcctaatcccaattccacctctcatttcctattatccaaacacacccttaattcttgagttttttgtccaatgtttgaccacctcttcttatatgaaattattttaattattattagatgataaaatatgaataatattttatgcatgatttatctttttaattttttttataatttttttaaataaaacgtacggtcaaacgttaaaattgagtttttggacggtgggattacacagccatacctcgctcgccgtgctactgctggaggaggaccccaacccgacgcggttttgcactttttccgtggccacctcaccttttcactggtggtgaatgatagaagagcttttcgctctaaaaaataaaaaatagtaatctatttatgaaatttaaaatagttaatataattatgcgttaatgcatcacctcgttttacgtatattctcaacttttttaaaaaaaaatgaaagggagatattaagattaagaagatatgtaaattatttcgaattttcttaaaaaaaattaatttgattttgtcaagcaactttttctaaaagcgcgcgcacaaaaacaagagagttttaatctttgtgctactgccagacgcagcctaacgctactttcatttgtataaatggagtgagctattttcctcgcctactaaatggtatatttttttaaaaaaaaactttctatatcgaagtggttttaaaaaattaaataaatatatttattaagtttatactggttaatatacttaattaattatatattaattatctgtaacatgaagggcccagccggacatggattttactttctaggtttcccgtagacccgtacaaattttgtggaaagaaatagtgctaagttccaagctggatgggctccaaggccatttataactagcacaatcgggttggtttatatatggtccacgtgtaaatttaagtttcgtaatttgtaggttatagtactcctgccgtggtgacccatgcataaatgtgaaagtggttaagtaatatcattttagtttgctccttttcttaacaaattggccgttttcaaaaccttattttgaagcttaaaaaaaaaaaagaccgcgggctcaacgccagaaccgttggcgctgaggttagccgtctccgcatcaaggtggttggcggtaacgccctgccagcatggcggccgagccgatctcctgccgacgtggcagggagcgctattttttttttctcaacccaaaactcagcgtcagccgtaatggcgctgagatttgcgactttgccaccaattcagttggctttctaatccagtaaattgaatgcatccagcatcatataactattccgctataattgatttttgacaaggaatgtatgctcatgatgtatatagcttattgcataccaatatgttactacacattttgatcgatcatgtcacaccgcacatggttgtgataaatagcggacggaccattcaggatagccataggaatggttaggttcgatctacttattccttacatcgatgcataaatttagtccaataaatttttaggaacgctacaaaacataaatggatcaaaccgaaccaaaccatcagaacctagctctgaatgcatgattcaacccaaaatgactccacatatataaatagccaaaaatttgtacaaagttgtctctctatataatagatcattcctataaaattgaattgaatttatcaagtttttatagtgtgaatttgagtttaaaaattttgggctagagtagaatttctttgtctattagtaatgcaatgtgtgccgacatgtataaatagctcataatttatttacgcatctaaatcccgtagatctcgtagtttatactacctccgtttttttaatagatgacgccgttgacttattctcacatgtttgatcattcatcttatttaaaaaatttacgtaattataatttatttttgttatgagttgttttatcactcatagtactttaagtgtgatttatatcttatatatttgtataaaatttttgaataagatgaatggtcaaacatataagaaaaagtcaacagcgtcatctattaaaaaacggagggagtacatccaaatgatgtcttcacgtctgcccgtttgagctttcttattacgtcttacaaactgaagatacgcgaccaaagcaacaaaaactttggagtacacgcgacatccatggtactgtacccccgttgttgcttgcactctctttccctattcacgtgggccaagcccaaatgttcattgtccatatattgccaaaggaataagttcaccagccgtgcctcaacttaacatcgagtttatttgacatcccttatcctcaataccagaaatcttcacctctaaactatataaaaccatccaatttagtcagcaaaaccaagtgtctatatgtggcaaatttgacccggtccactcgtgttggctagacgctgatgtggcaaaaacgaaagtgggccccacatgtcatcctcagtctccaccttatctcttcccctgctctctagtctatcccatgctcgtggtctctcctccctcgatgaggtgatggtggcggcggctgttgcagccggggtggtgaggaggtggcgtgggggtgtcggctggggcccacagcaacgacaagccgacgacggtcgacggcttgggctgacgaggaggcggcaccgactagaggcgggtgaggagacggtgtcagcagctgggtggcagggaggtggtggcggagcagggctagggtggaatggccggtggagcagagcgggggcgatggtgggcgagcacgggcgaccaacggttggcaggcggagcagtggagatccgaggaccgaggagcatgcacgagagacggcacaagagatcatgcatgaccgcaccgagcgcgcatgcgtgctaggcgaggaagaagccgacgagggcgtgccacaccccgagcaccaccgcgccggcatcgcacacttggcgttgcgatggacaccgccgcccaaaacaagctcgcagagtacggcgacacggcgacagagaagctcgaaagaggctacctgacgcagctctacccctcctgctccacattcctgcctagccgcgtcggctgcagagaaggcccacaaccgctccatgatgccaccttcaccaagcgatcgattggaaagggggagaggaagccggctggagtagggggacatgaggtcagtaggagagtggggtgaggatgccggtcatgccggcggagagggggaaagaggcggctactgccaccgctactctcgcacgctgctcgccgcccgtcgccaactgccacctccgctcggctgaagagaggagaggagaggagaagagaagagaaaagaagagaataaaagaaaagagaaaagagaagggaaaaaaagatgtggaccctacaatttttttcttgtcacttacatgtgggctgtcccttacatgtgggctccacgtacttgttttaattttttttttgcttactaggatgccacttcagcaaaaggaaaaagatgatgctaacacatggaccccacatttttcttctcacttacatgtgggccccacatttttatttttttattttttactaactaggatgccacatcagtgaaaccagatatttatactgtctcaggaccttttttagacggttttacatagttcagggtacatatttctaatattgttgttagggacctcaacagacttggcatacaattgagggaggatgttaggttaacttattccattgccaaatgctctagttcagatcacaacctgacgatggtccattttggctgaagtccattttgattccttcaactatttgccgaatctgattcatatctcttaaccgtaaaactaaatataaaggctctctctcaactattaaaaccggctcattttacctcctcaagtagtgtgagaaaccgaatctgattcattttggctctctctatccaatgtggcatctacatatgccattacagtgtgagaaaataatacggtacgattatggggcccacatgtcagtgacctctcttcctctaccctttcctctcttctcttccctgtttctctctatctctctcttttctcccagtggtttctagcttctaggggccacgactaacgaaagaggagctggatccagaggccgaggcaacaacgaccttgttagtgggagagctgtggcccgacccgggggatagtagccaggcggagcctagggatggttgtgttgaagaaaaggatggggtcacagaggatcttagtgtttgacaggtggtgctctctggagccatgcgggttgggaggggtccaacaaggacaaggaggctaattaggcggtcactagatgcggagatgaggagggagtgggagtagttgtgggcacggaagcaaccgtggtgcgggaaggcgggagagcaatacaactcaaaggtgccaaatctatcacgagtcccgacgaccgaacgatgacacccttgttggcttccgctggatacgcctccccatctcattctcttgtctctcgctaaccaacccatgctctaggtgatacacctccccgttgactcctgtgatctctccatcgccagctacctgcctccacagtccctaacaccagcgtgggagaaagagaggaggagcacgatgggtcaccgcaaggctctcggatcggtggcgctagattgagggttgttgccattacacgctctgctagtttcctttttggaccaacctcctcgccgagatctgcaggccattgcctttctccttccgtgccctcccgtctctgatggccttggcacctcaacccatcgagggaaagaagaggggaggagccgctaatgccttccctggctttggctctgccttactgccatcctcccaacctagctctctactactgctagaaggtgagacttgagagctgaggaagagggaagggaggagagaggagagaggagaaaggggagagtttacgaagaaattggttaagggtggatcaaggtgggagaggatgacacatgggtctcacttttccttattattttgtcaactttaatgtcatgtagtacatagctacatagctactccatgtagtacaaagactatgttaatgtgtcacgttggtgccacaccagtctaaaccaccatcactgcacatattatcctgctcctcttgtggaagcatcaagatcaaagaatataggaaaggtgatttattgatagagttgtgaatacgtaactccccctatcaagatttaaatcctagtatccacaaatatcacgcacaaacaaatactctttcaatgaatttcaatccaggtcttttctaagcactttgtcctcactcatgcgcactcgggaagaatttcccgatcggtcccgcttacatctagcagccaaactgtaacatcccgcctctcccaggccgggcccacttacatctagcagctctcataggtcatagactgccctcacagatcaacacaggtcttttctgcgcactttgtcctcactcttgcgcactccggaagaatttcccgatcggataaggtataccctctatccttggatgtacgatgggtaccgatacggtatacccacgcgtatacgaatagtttcagtatacgttaaggaaatctatcacgtgatagaagcagaatctacggacggaaggagtcctactcggacaagactgggtcattaccatatcgtgaggggtccgatatctccgagtcctacttggagatcaactgacccgcggtatataagggaccccctaggcatgacctaaggcatcgaatacgactgccaacacacccaccacagactacggagctggagcctacaggagccaagtcgccgggagatctagtcggaccaactcgactacagtctcgccggtatcatcgagttctgctattccctttgtaatctgtggtctctatcatataatcccataccaactggattagggctattacctaccaaggggcctgaaccagtataatccttgtcttctgtttgcttgatgtcgtactacgtagatcctcgtaccaacggaccccaataccctctatatccggtctacgggtattccccgtcgacaggaacatcttaccttttttttttaagaagggtattttttttacccagcctctatatccaaccgatatatgcagctttcttaaataaaaaacttagctatcaaataacccaatctaaaatccgctcgatcctatggagatttgaactcaggaccttagggaatatatgcagccttcttaaatcaaaaacttagccctcaaatgacccaatctaaaatccgctcgatcctatggagatttgaacttaggacattggggtgctacttaggtcactacaaccactagattgcatatcccttacactcttcaagaacatcttacctgtaataaaagaatgttataataaaaattagacaagttattttacgaggaaatcaaatgagttgtttcatacttgacgaatgaaaaatccatgattagacaaactttgaatttagcattgtatacgtatctttagtaatcacaccagatcacgttgtcatccgtgtgagagctaaagcacaggtaactaggcatttgaacggagatcagatctgcgagcttgtcgtcaaaagcgtgcgtccacacacagccagcgggtcaccggtgtgtctgtgggagaaaccggcggccggaggtgtggaatttcgtttaattcagcggcaatgcttcataatcatcgatcacaaactaagtactagtagttgagtatgcagagtgagatagatgcatctgccagtaatgtagctaactcggagagcaacatctcatatgtgtatatttgtgtactgatgtaccatgcattcacatatatatatatcctcatctcaatgatgttttttctgtacatgatcttacttacaagtcaagtcaagacatgcatgcatggagaaattagattatatagattaaacgcgacgcatgtgcctacctagtagaggattagtaaactgttaaaagtacatagcaagcaggccaatttggtctgacactcttatcttcaaaggacaaaattagaatgatcactcatatttgattaattaagccaagttgacgatggaaaattgtctagtggcgagctaaacctacaattaattggaatggcaactcagcgccctctagctaactgtgggtgtcagcttatctatataagtgcctctccttctcttctcctccaggcctactagctagctatagccaccatacctctctctttatctcgtctccagctgcgatcgatagtacaccgaccatggccacgccgagcagctcgtcaccgccggtgccgcccatccggtcggtgaacctcggcggctggctcgtgaccgagggctggatcctgccgtccctcttcgacgacattccaaacaacgacttcctcgtacttcctcccctctctttctctagtggagaaaaacgatttttcatggtgttggtctaatattttctctgacggtaaaatatgaaaaccgccagcaatgttttaacgaggggtgggaggcaacgaccgccaatgaaaaaatattttcattggcggccgagtaatacgggctgcctgcgaagatttttttattttcgctggcggtaccttctgagcgccgccagcgaaaataggtttatcttcactggcggtatgatgagctattttcgctggcagcgctctttggaacggaacattttagaacggaacgagtgtttgtcaatatttcttgagtccgtgcaatcaacatttgtaacctaattaactatgaacctgatatttgaaactcttatgtgtgttgcaggatggaacaaagctccagttcaagtcggtggtccacaacacgtacctctgcgccgaacatggcggcggcgacatcgtcgtcgccgaccggacggccgcatcgggatgggagaccttcaagctgtggagggtcgacgagaacacgttcaacctcaaggcgatcgacgacagcgccgtgcacttcgtgggcgtcgacggcaatggcgtggtcgtcgcgacggcggccactccggggccgtcagagacgttcgtgatcgtgcgcagcgaccgtgacaatagcaggatccgcatcagggcgtcaaatgggaaattcctgcaggtatataatggttatttggtaaaaaaaaaggaaatatttatgagatcatgaacgaaaaacctgctccctattatttttgagtttgtcttaactcaaacttcttaacaagtttataggataatattatataatatctacgaccttaagttagttccattcaatctattttatagtatatccgtatggaatggaggtttaaatgtttagattaagctttgcgagcaaaatatatagcatggatacgaataagctgttaggacggtagaccaaataatccatggtttgtgtgtacgagctagctcagtctaagttagaaatattatttcctatatgcgctactccctctacgtgacatgcatttgacttttctttatatccaagctacaactttgacataacttttatgaaaataagtttataaatgtaacaaattatgatatcatggaaataattttcaagacaaatctgcacatgttatttttatattttaacttaatatttaaaatgttttattatttaaattttcataaatttaaaaagtcaaacgccaagtatttttaacagaggccggcagtaacatttacaaagatgaagattattgtagtgtgtctaaatatggaaattctgatttatcagttattattcgatccattttaagctactacttcatccgtcccaaaatatggcaacttactattgaattagaaacagcttaatagcatgaatttggacaatctaaattcatactaatttaatactccctccatttcatattataagactttctagcattacatatattcttgaatatagatgttaataaatctatatgaatgtggagaatgctagaaagtcttataatatgaaacggatgaagtataagttagctatattttgaaacatatggagtat

SEQ ID NO: 26896 - DNA, 1381 bp, Oryza sativa
tggataatgcatttcgatgggcagagtaagaatatttacttttccatgtcaccacagtatagtagtttcttttttttttttagcaaaaccaccgtaatttcttcatcattaaataaattctcttagcttggattgaaaaaaggatgtcatatacgtaataagcgatctttgttgttgtgcacaggaagtacaatttaggtgtcattgtggacttgcatgctgcacctggatcgcagaatccatgggaacacagtggtagtagagatggttcacagacatggggcaccaccgatgaaaccatcatccaaactgttcaagtgattgatttccttgcatccaggtctgacaaagatatcaataaataatattttccttatcattatcttaaaaccggaaaagaaaaaccaaagggattcatctttcgtcttaattggtctacagatatgccaaaagcccaagtctcctggcagttgaactactaaacgaaccgttggcaccaaaagtatcagctggaatgctaaagaaatactaccaagatgcgtacaatgctgtgcgaaaatatacatcagatgcatatgtgatcatgtcgaatccaattaatgcagactactcgaatgagattctccagtttgccggtggcttctttggtgctgtgtttgatgtgcactactataacatgttcaatggatcgtttgacaacacaacagcggagtggaatatacagtttgtgagaaatgatcgttctgctgagctcaggagtgtcacaaagcagaacgggcctctcacatatgtaggtaagttgtcgctctaacatgtctgctggtgtgctttactcctccattggatcaacagcgacaattatattcaatcaattgatcaataatacaatagctaagtgattctccgttccaaaatgtggtgttttacttttgtcctaagtcaaagtaatctaactttgatcaagtttatagaaaaagtgcaaaataattacaacattaagctaagacatatttcatcgtgcatttgaatgaaactaaattgatgatgtcgttgtagatgttggtgcattttttctataaactttaccaaagttagagaagtttgatttagtacgaaacaccttaattacaatatggaacagagtgagtagtatttgtcaaaactatatagtttgttgacactcgacactatctaaatgttattactcagtggtatattgtctggtatgagctcttgattgctacaggggaatgggtggctgagtggaaagtgaataatgcatccgaggaagattacaagaggtttgcgcaagcacaattggatgtgtacagccaagctacctttggatgggcctattggagcttcaagcatgtccagaacc

SEQ ID NO: 26897 - DNA, 180 bp, Oryza sativa
tccatgctccagtggttcttgacgttcttgaatgtccaataggaccatccaaaagtagctttcccatacaggtctagctgcgcttgcgcaaaattttggtagtcttccttggatgcattatccacgtaccactcggccacccattctcctgttgcaaagaagagcgcataccaaacaatg

SEQ ID NO: 26898 - DNA, 1518 bp, Oryza sativa
ttcacgttgacgaaagattgtccattatcgtagtaatttaaggatgcagaattaacaagcatcgtcctaactgcatttattttactgtattcccacaagtgcaaaagaaatgactaactacgttgtgcagatactacgccccgctttgtttgggcttctagccagcttctcaaccacaaaagcagaagacaaaataaacaagctgattctaaaccatgattttggaaaagtcaggcccatcaaatactgtacctacaacccactgggggcaattaaattacccacaatgccatcagataaaaaaggcacatttctctcctgcctattaccccttcctcccaatgaccccatgggacaaactgcacccataaggctagggggcaaagaggatgaagtctaggagcacaccacctctatacaccgtctcctgctgtcccattcaattcaccaccacctcactcctaggtcaagccacctcctctgctcactccttgcaggttggctctctccatctcctaactcctatgccagcgctgccccatgcaggcctctccagtaaaactcatcatgtcgttgacttctgatccagtcatcattaattcattactaatggtcgagatgatccggctgcaatgaagatgtcaactgatcatcatatcgagcggtggccttcgtagatgtaggttttatgtttctttccccttaatttgcatgacctttgagtagtaattcaaacattgtatgtctcaagaaagaatttcattgcctttgtatatccggaaattgagatgaacagagctagttgctcatcagcatttggacgatgcaattttctggtttggaaatgttcatctctatagtcaagatgtcaatttgtgtttgtggatttggctgcatcattcactggtatgcagatcctatatgttcgttgaatttttacacttagcacttcacagaaaaactgcagtacaaaacagtttcattgctttcaaggatctcacaagctctaactgcttctcatgcataagccagaaaagcatcttctgaagaatccactgaacagaacaggtggcctaacaacaacattacttcctagcaagaactaaacaagttgcaaatatcatattttaggttgagatcatatatagttaatatgtctatgaattgcaagaccgctaaaaccacaaaagttcaaacattcacgtttcatgtcataacaaatgtgttcagtaataaggtctacatgatttaaaaccctagtgcattgcaatcaacagtgtattttcaaaaggattctgacaaataaaaaatgagggaaccagtcatacccccatctgccccctcacctacaacagaaaactagtaaaaaagtatcatgtgcatgcaccaccgctctcccaccttacacacaataccacttaaaaagaacaaaaatccaattttaaacaaattctccaaggttaaaccatgcacttatctctacaccaaacatcccatgtcctctacataattcttgaa

SEQ ID NO: 26899 - DNA, 5830 bp, Oryza sativa
cctgcaccccacattaactaactaattacagaaaaatagtggcccatgcagagtgcaatgcatttcacaattgaggagttgtctgagggtgcagggggcagatgttggaggaatggcaagtaaaagaatatataggttgatttgattttgatttacttgggtctaattaattatgatcattgttaagaaatattaggggcatattagacttttcacatctcctgtaccatttgccctttagggctagatcaactgtactgtggaaaatccccaattcactgaaattgacatggtatcagagtctctcctcaatccctaactctagttcagctccctggcgagcagccaggggcccgcatcgtcggtcatcatcatcacctaagtacgtcatccgtcgcagtcaccacccattcgtcatggttgttgcgtgcctgccgccagtcgcggccgccacatgtgtgctgcctctcatcgtcgtcatctgctccaacccgtccacagcctgcagcagtagcaagttcctagccactgccgacctcgtcagacccgtcgttcccctctgcggttcctcgtcaatcacggggccatcctcactgtccacctcggatatgttgcattgccgtggctcgtcgtcgtcagcaagcccggccagtcaaagccaccgctgtcgcggcgcccgtctctgcttcgtccatctatcgcgccatcggctggtgccgcgtcatctgtcgtcattcgcagaaggcagccatcagtcgcccttgctctctgctgcagggagtggtcaagctcttcacccaggacctgctggcagctgcacgtcctcaagcagcagcagatctgtttgacctcgagtatcctcttcatcattctcaccagatcaggtgatattcatggggtttaggctcagatcgagtctattctactcattgtcctcaagctccttttgtcttctagcagtagcaacaacaggcttagcatcagcaagttccaatcctcttgctatcatcatctctactacctactatattattcatcttcatcagttgcttaatctcatctgctagtgcattcagttcatccaaagtaatatcatgtgactgctagttagtgtctttgctgctgttataggatattcctctccaaatgtcttttgctagtatcctaagtcatctgctagtttagattgagccaccactatgtcttttgctagcatatcaatattctctacaaatcgatttctttcctatctagtctatccactcagtccagccacatatcttctagtatcattgtgtcatttactagttcccatttactccatcaaagtcagtgcctatccttcaattcgttgaggtcatgccaatctatctccaacttgcccggcttcccgtcggagttggtctacgtcatcagttcaccagctccatgtcagagttggttatcatcacttcatcagctctatgtcaaagctgatcatcatcatcatctaatagtaaaggcccaagaacagtttgtgaagggcctctatcatcatcatcatcgaagtctccgaatcagtgaagggctgaagaatggttcgtaaaggctgtaaggaaccgagggtcaaagaacaatttctgaaggctccgaggtcacttcattgaggaggggacagatcttttcttcttcaatatccaagaattggcacactttgacgacatcatcaagactttggagatatgccaatatttactttgtcctagtttttagttttacctttcaaatgcaatgttactgcatcattgcatttgaatgggggtgttaagaatattatggacattttagacttttcacatctcctgtatacattgcacttgccctttagggctagatcaactgtactgtgaagaatccccaattcactgaaattgacattatcacagatggaataaaatagtggtaaattacatacactagtaagtggtgtcaatgccaagccatatcacatagacactactctagaaactaatttgtcaatgtattatttctagattagggattaacataaaatttcctccaatcctcctcctctccctgtttccccttgttaccttcttggtttacacgtagaactgattcttacatgagatcactctctcctcaataaatctattgctaactctatcaaaaatcccatctagcaccctattcaatactacaggaactatcctacatgaagcactgggactgctctgatcctttctgtaatagtataaatcctagatacagactaacttgtaaataacaatcaaaagcaagataattgggcaaaacaaaaaacatgccacgggattgtactaacatagaaacgaaaatcctttcaagcacctctgccaggaaaaagagcaggcattgcagagcaaatatacatttctcatcatttctcaaaatgaaattaaggagacggtttcaaaaaaaaaaattatagagattcagtatatatataccaaaaaaaaaaggtttgcatagaacagtttggatcgcaagtagctatacaattagatgagggcaatccatcacaagtccatcagagaccgcaggagataagatcgggagccttagacgattcgatctaacacgggggggcggaggggggaaatcgtagacagatctggtaggaagtccgggagcgcgcacctgtaccgcgtgtagtcgccgtggcggaggccgtgctgcatctgcgcctccctcatgagctccagcactgcgaggaggagaggagaaccggcggcgcccggatcagcaactagggatcggtcgtggaaccatcggggagtggggagaggggaggaagagaagcccaccgttgatggagaacctgacgagcggcttctcctcggccgcggcgtcgacctccatgtccgacggcgggggctggtccgcgggcttcgacatggctggcggccggcggggtgcgcctccggtgcagccgcggcgtagcgtagcgagggaggattgtgttgggttttgctgggttgggggccgggggtacttggatccgagtctccgagactgtttcacggggttataccgtctatctatcgtctttcgtgtgttagtactaccaagagagaagcgtagtgagaatattaatccaaacaataaaactaaaatgttagggaagtttttttttgtcaaaacaattgattgttatgattactaataaattataaatactccatccgttttatatcataattcgtttgattttttttcttagtcaaactttgttaatttgattaaatttaagtggtattctttttctcctgaaaatgaagataaagatgaagattaagttttttatgcaaaacgaggtggtattaacgtatgattgattgagttttaattattacaaacttgaaaaatagattaataagatattttagagcaacttttatatagaaagttttcgcatgaaacgcaccgtttagcgtttgaaaagcgtgccacgaaaatctaaatcttcatccaaactcttgtcggagaaaagaacgcgaccatatagaaaagtttagcaacatctaaatattaaattagtttcattaaatccaacttattagtcaacacagaggaaacttctcactctgtcccataaaacttcattcctagattccaaggtgcagttaagaagagagatgaaagatcaaaatgctcctggttaataatataagatgggtaagtagataaagggtattgaaaggattaaaaatagtatttatggatcgatgatagaaagaagataataattggtttattttgggataaaattaaaactctataagttgatttattttggaatggtgggaaaaactttcatacacgaaaaaaaagcacaaaactagtcggaaccaagataaatcgttcctatgtaaaactaacaagctctacagatataaccacattttattgacctatgctatgtcatctaggtctctgtacataaaaatagtcaagacccagatcttgttaaagtgtatcatcccgatctaaaattgtcatgttcctgttgtgttcttttgtggtaggttgggaggaaagatccattgttccccgcgcacatgcttcctgaacttctaaatggtatgttttttgcaaaaaaaaaatctataggaaagttgctataaaaatcatatttatatatctttcaaatttaaaatatttaatatttcattaattatggacaaatgactcacttcattttgcgtatcttctcaatcttctattttccatgtgttttgggataaggtgggaatgggatatgttcgacgtatccatgtgttttgagatggaaggttcctatatatacgtttagtacgaggggcgagagtataaatgaaccccttatttgtatcgggtgctaacccatctgtgatgaacaaaagtctcattaaggattagtgctcactaatgacaaaacctcatccatgacgggtggtaacataccacctatcacacatcacagttgactcatatgtgacgggttataattacgaaccatcatggattagaatttacattttttgaattttcaatgaaaaaccataaaataattttaaattttaaatgcaacggaaaaacccctaaaatattttaaatattactatatcattcctcacacatcactagccagaagtttatgattttaccacggccatgcagaaacttgagagacttgttatgtgtgaatcacaaataatgttattagtgatgggtggaagttaggactactcatctgttatgggccatctcattacacccatcacagatgacctttatctttcatggggcatgattgtgacccgttataggtcatatgtgacatgttacaactgtgacccgtcacaaatgaccttgtatctatggtgggttatccctataaccatacctaaaatgtgatacttttcgacctgttagagatgagtcatctccaacgagtagcattagcttgtcacggatgtctggatctatagttgtgtcgtggtactacttcttaagggatggcccacatgtcagctagtgagaaatgtgatttggattggttggtcagtttttaagagacaaggtcaatttggatctttgtgcaatcccatctacctccaaactaaatacctaaaaaatagaatcaacccaacccgacccatcctatcccttgaactaaacatacgcttaggatcatatgtggcgcaaacatggttgtcaccttccctcttctctctcatctctccttgtttctttcccatagtgggaccatacaaaaaaatttcttttatttcatagagaattccacaatgagccacttatttcacttaatttagactagataagtttgcaaaaaggatccattttataccacttacgtacatatcttcctctctttatctccagcatgtagccaaacttgctggtgagctcctgagaaggcaaaaatgtgcatgataagctcttagctgtgataccacttaatatgctcacatctctgattagtttgatcttttggtgagttgatgataactacaatttggaacaaacattgacaacccgactacaactgtacaagacataattgtgttgtgccattgttggtatttgttacgatcacaaataaatccgcaagcgcacagataccgttgtagcatttcattcgtgagtatttagggtatcgttatttgtttttccgcaggggaggcggcggtttaaagaatgggctaatatattcatgatcatagtatgattaataaaccacggtctaagcaggggtaaatgataatatagatgtagtgggacatat

SEQ ID NO: 26900 - DNA, 5456 bp, Oryza sativa
cctaagctctataacccgtggggtatacccgcatccaacaacatttaatcaacccaagaaccatgtttgcgttgctaaataatgcatatagctcccccgaaaatcccaccctacagatggaaaagtaagaactagctcacccattaaaatcactaaaacgatgccatggcatagatcgactagcctaaacatatatagcatatgaaataagtataaaaacatcaaggaaacatataattgacaaagtagtatatgaaccacgaacaccgataaataaagaagtcttacaaagagaaaagagcactagagccatactcgaatctccaagaggactaggaaacaaaatagtaagctactcttagcctaaactctattaatctagagagtaatacaaatgagagagagattgcttcttgtgtgtattttgaaagggagagcttcttctccttttatagctgcccaatgatggttactaatgacagttatcacctacaactgccatagggaaccaatgaggggttgccatgtggaaggtggagatgagagggaccaagcctggttcggccgaaccagggtaacctctccaccgcctttctttgtgagcatgatgtctaggcccttgagttggtgcatggtggattagcctcaattatgttagttttgcttttgatttgtgggcccttaaatccttgtgcactctcctaattggtcggaactgtgtttcttcgcatgtcagctcattttcaccttcatttggttgataatccctgcattcacattattctccaatgacaagtggaactacattatttgaaatgaatatgcgtgtaagaaatatgagttctctttattttttttgagataattgacggtcgaatttggtacttaacaaccgtcaacagccatagcgattgttgacggtcgttatagaccagtttcgcccgtcaatattactaaaataaaggatgagagctccttaaatagcctcccaatgacggttaattgccaagtacaaggatgagagctccttgttctagaataaagaattgcacacactcaagaactagttatgcttgcagtgcacatttgttctagaataaactatttccacttgtacttggcaattaacctcttgcagagattacaacataaaatggaggagaatcaacagtaaaacaactaaagaaccaatcggaagctgtcgagaatcagacttatggatggatgggccgagaattcaaaattaacacgatccaataagcccaaaattcacaagtctgaaaagagaagaagaagaggccactagccaaaatgtgggctggttgggctggcccatggttcggccgaaccctccctccccccccagcgcccttcgatccagggctttggctggacggcgtggatcactccccaatgacggttggagggcatttctgaccatttcaaccaccacaaccgtcattgggaggctatttaaggagctctcatccttcactcttgcacacactcaagaagaagagctctctccctctctcaagtttagtagtatcctagtgttagtggagtaggaattagaatagtattcttagtcctcggatcttcaggagaattcaggtatggctctagtacctttcctctcttcttttgtaagactaattgaattaatagaatattcctctttatacatcttcggtattttattccatttatattatctgagtaccaacttcattttatacttgtatcaatatagttgtgtagctagcctaccagtgaggtgcaatggtgtgggtttagtgtctgattactcggtggctctatgtcatctcgggggatatagagtagtattcaataatgtagacctagtgtctagattaataagtatcactatctgggcatatatggtacaggtcagtcgaggtgggctgctgatggtgacagctcagtatgggtattcctccacgatagtatatattcctagacactttcctagggagggtactcctccatatttagccccggttggacggccatgataggttgtcgtaaggaactcggcaatccgaggtggtctctcaaaacaccaggagggcactgttagggggtattggttgcataattgtatactaacaagtgtaaactaaagatgtttgtatattagaagtataggaatgatttcttttcttattcttcctccacttagcatatattatatttttgtgagagtatcatatttctttcttctgtgttgcacataccctttgaattacttaacccctggatagaccttgatgtatataagtaatatataaactattagcatagtactcttttatcatatcttcccttgggattaaataaatacgatacattggaatactcccgggtgaaatgctataatggtatatccgtgcgcttgtggatcaaatctgtgaccataaatataccatgaatatttctacgtcattgctggaaaatatatttctagtaatatcgttaagaaatatcaacagcgatcgatacacctcttcgtgggttgttggtcttgtcaagaaagatcaaccatattcctgaaacaaatgtaaaaaactagtaagaacaagataaaagcaatgcaatattgcaaataggaattggaatgcatgagataagtttcggggttcagtaacgagaaaaacgtcatctaaccgatcacggctttacctagaaaagtaacaatggctttacctatgatgtgatgagaaattgttgtatccatcatagccattactctccgcttagtgtatgatcttgcccatagaagtgtacatatgaaaagaagcgcaacaaacttttatcatgtaatatcattagttctctagcaaatagaattaacctccaacgaaacgtatatacctggtaatgaggatgcacaacaaaatgatgtagatgctacattgaaatcattctcttgcatgccatctcactctagtcgctccgcttctttgcatgtcatcttgctctagtcgctctgcttctttaggaccaattgtttctttgaatcacaacaagacaaacttgagatagcataattagtcataataaacttcatgcgttaaatatactcctttatcattgtgggttccaaaaatatggaaactgtcgaagggttgtacccgacaacaatgtttgtagagcatgtggatcattggtactaggttgtacactagattgtactaaggagacgtgggacaaatatttttataaaagtttgagccccttgttacaaacggaactcgaatccaaccctgaaatgtttttttctaaagaattttgcacaatgactaggaaacaaaaaagatggactggtatggtggaaataacgattcggtctcaaagggagactgacgtgagaacatatgacagagtcctaaaaagaaaacatagtttgtctagtttagaccgaaatgtcacttcgagatatgattttcggtagaaaaagcgttgttgggtttgcagaacaggattctcttttattaggaaaatatcgcgacacacattccttgctctcaactcaagggaaattgaaaccatttttttaatattatgaattaaattaaacctttgcttctgtagaagctataaccacttattacaaagttcatggcttaaaactaagaataaaagtatataacaaagaataaattgatgacacattaaaaagccacctccaacatgagggagagatataatttattcaaatagcaattatattagtaaatttctatccaaaattgatgaaaatttgcatgatcgttgtctctaactaatagcatgcaacacaaaagaattccttatcctcttcacacttttgtagttggacccaaaaccgaaaccaatatgttagtttgaagactaactgcatataaaatttagatggagaattatcaaaaactacattatttctattaagtcataaaacccaacattaaatcagatgctcatatgttttctgttttttagtcaaaacacatggaccaactcataaattaaatatactagaaaaaaaatgcccgtgcgttgcaacagttgaaggctattttaatcttattactattgtacggtttagctaagatgaaattcactgtagaaattcatttggatatttttttttacaaaatcacgagatgcaattaggagtcctttctgtatttccaaaaatgaatgaatttaaaaaccgactcaaatacggatatgtatttctaaaggcaaacgaaattaaaaaccgactcatacacagatgacgtaccaaagtaagtacaggcaaaaacatcttcaatttttataacagtagagatatgttacaaaataactgttggagagaaatatatgctggaagcctaattgtaggcgaactaaaattgaaaagcaattatttggtaagattaggcaataagacgcggtatctaaggataaatattttttttataaataaacttaacaaataacttaaaacaaatggttaagtaatatagtagattttttttaacaaaatgtaatttgtgaagcatgtagtaagtaatttgtttcaataatccggtgaataatataaaaataattaataatccggtgaataataagaaaaaatgtcatatggaggaacgaagagagaggcacatgttgtagttaaacaatgcgtgtagcgtgctatagcacttctcatccctaattaccaactttgataactctgctctcgtagtctcgttgatgtatcccactagcaataggatagatttcacatgagcctactaccttaatttgaacatgaagttccggaaaagccaattgaacttgcatggtcggaatcgccctctcgcaaaggatgagggagggtgatttcgacccgccatttgccgtacatgctagatgtaggggggtgaaaggcccgagtggacgcaagcgtagtcggtactcgcgttagtcaataaagggttatgatataaggcggtgttgacaggcctccaatccgatatgatgcagcgcggcgggggtgaggagcagtggaagggcggtgggtggctaggggtgcatctcgattaggacaagggctatctagctctacggccatcagaggtgcaagggaagagcaaggtcggcagccatccaatgcggaatgcaaggtgaggcgccaccacgccattcgtgtggggagttggatggtggcgcctcgccttgcacgccgcattggacggccgccgacgcgccaccgcgccacctgtgtggggagttggatggtgcgatggcgcggcttccgcgcaacgaattggcagtggcattaccgcatctaactcgggtacataagaaacctctcaactattgtgcttggccttgttcttccataacttaaacttgcagaagctgggctgaggtgagcattttccattcttcaggttctctgctgtgcacagtttctcacc

SEQ ID NO: 26901 - DNA, 2821 bp, Oryza sativa
tccaccctgaactgaagcaaaagaggatgatgatctttccagcttttgtgttggtgagaaacataagttactccatgtgccattctgcatccatcagaaatgtcctttgtacatgttagctctaaattcatagcaagtgaagttgagttgttagttgttgctgtacatgactcacaatttttccccttttgctgataaatagttggggcctgtttggtacagctccaactcctatatataactccaggagttgagtctggagtggagttgtgaagttgcttaaacccagctccacaactctagtacattttgtgagagagctccacccaactccactcccagttttggtggagctgaaactgtttggctgagctccagctccaggaggggtggagctggagctggagctgtgccaaacaggcccttggtttctcagtgtgagggcaaatagcaaatgtttgatctagagcttggatcgattccattattgaaaagaaacttgacagctaagcatatgcaattaagattttagcaggattgtcaaggaaactttattcttttttttcctttgttttgttaaattttgatgaaacaaaatgggttagagatacttggaatgcgaggctacaggaatttcggttcaaaagtcactggagttccacggagtgctagcacaaggtgccttcactgaaccacatggagcatgagcagagtagcatcagacatcagtggtcagagagtgctcggtacaacgttcatttgtctggtttggtaccaaccgattacacaaattctaattttatgctaggcttttgttgttttaatttgaaactacaacttaactagaaattgagctgagaatcttgtttcggtgtatttcaattatacattcctaatcaatggctctacaaaacctgaatggcaagatacaagtcaattatgtcccctccagaaaattcagggacttttgtttcatattagtttcaagttcttgataaaaacagaccgagagtaaactaaagcaaaaatgcaagcgataaataataatatccgcaatgtttttttaatatgcatgagtatgcatataatttcattaaaaaggtataaaaatggggaaaagactaaaacaccattctccccaaaaacacttaaaagacgctacttacaaaacaaaaaaggctcacacaacccaaaattacccaactgggataatcgaccttctaaggaactcgccaagcttagtggctccggccggccaaacaccaaagattacactcatttgccatagtttgaattacagtcataacactaggactagcctcattaaacacacatgcattcctatgattccaaatctcccaagccaccatgataatgagagatttgagaccttttttctatccttatccaaacctctaatagccttgacccaccaactcgagaagcggatggtatcttggcttggtgagatgaagatcagccctatcctttgaagaattagagaccaaacctgctaggagtagacacaattaacaagaatgtgttgaatagattcctcagcttaatcacacaacggacagacggcggggtgagacacctcccgtttgtcaagacaatccgccatccaacatcgattgtcaattgccaaacacacgaagaacttgcacttcaaaggtgcccagctcttccaaattattctccaaggagcaaatcggaatgtcccgacaaaaaaggactcgtaagctgacttacaggtctatgattctgtcttgaagagcttccaccgaaactgatcgggggtgccatcatgtagaatcactccatccaccatctcccacacctgtagatactcgatgatcacttgcacagttagagctcccttgacatctgtcgcccaatgttgattgtccaagggcgcatgtgccactgtgcgacttgtttcacattgtatgtgtcacatcctgatttttgtttcaggatttataaattatttaataaattattattagaatttatattaaatgatctttaatttacaagtgaagttaaatgtgggaaataaaattttctaaatataaagcatggatggatttaatttttattaaattctccatgattaagtcaactctctgaaattttctcggatttttcagagctcaattcctaaatgatacaaagaacagttcagtaattagttaatccattaataatctaattataattgttaagagcttttcttatgtaaaaaaaatccttaatttataaatggttgtttaattggaattattagaaatgattttaaaagcctagaagagaagatctaattttaattaataaatttcaatataaaatggggccagataaaatttcattaaatactttacttgattctatagttcctagatttttctgggatttatttgagccaaggaagtatttttaataaatggaattgcatttcatgaataatttaaattgaaaaaggtttttaaaagtctcttttggctttgggccgaaagtcggcccaaaaccttctctctctccctcggcccaagtcggcccagtccgcagtcgcagccggcccgtagccgagccgccgctctcttctctctctctcagtcgctgacaggtgggtcccacttgtcaggcccgtcgtcaacctcgcgccgtcgcccggccgaaaccctagccgagccgtgcgccgccgctttcctttttgctcgctcctttcctgatccggtgaaatcaatagaggggaaatgatcttctcgatctcctcttccttttctcttatggaatcatcggctttttcgctttggaa

SEQ ID NO: 26902 - DNA, 4037 bp, Oryza sativa
atcgctgacgtcatcattgccgcccgttgtggtccggccgtggaccggttgatctcggccgtccgttttggataggatcgatctcagccgtccgttcccgtgaaccgttgccgtgcgcccggtccaccgcaaaccctagccgctgacgcaataatccccttttccttttcaaaaataattcattattgcgtcataattcaattaaaatccatataagtgttttaatccgatttaatctttaaaaattcataactaattcattgtaactcagtttaatgtggttcaagttgcaaaagttgtgtaaaataaagatctacatattaaaattatccataaattgaattaaatttatttaattctttttaaatgggctttaattagatttaatctagtaaaattcataataaattcatttgaagtcagaatgaggccgttcaagtctcataattcatctaaaattatgatctacatgtttgtttactttttatgtattgtttatttggtttttattagtctttttcttcattttgcgtgttagcttgtcgtttccgtcgttgcgaaggttcgtgagtgcgccggaagtattcaagaagattatttgaagaccgattgttgcgaggcaagtcacacagatcctaaacacaatcctttgagcatgttgatcctatatttaaattctctatttatttcaactttgcatttattttcgaatgtcactgggtggtgtgaatctattcctttgttatggcctgtttgcattgattactttattccttgataccttgggttattataacttgactagttgagctatatatattggttcagctagatattagatatgattgcttagccatgcttagaaacattagcacattattgggataacttatgactcattattatttaatgatggcttaatgatagttcacgatggttaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttaccttttgtataacatgattcattgcggagcaccagactgagaagtggcggagataagcccacgggggtcactggggagtccatgccttgttttataaagggggtgattatgatccaggaatggtgcgctgcggtggattgtgttatgcaaggggtattgttacagctcctttccgagataccgtggtggtattgaggcacatggtgacatgttgtggggctgtgtcttgtgggtacagtggtacacctctggccagagtaaaactattcgaatagccgtgcccgcggttatgggcgggttgagcaatgtttttcgtgattagtctcacatctctcacaataattatagatgttatacctggtaataattttgcttagctcctggtttggagttagatctgtacagccgggtatggttgttcaggatggttgggcctgtgcagcatgggtgtgctgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgctgagtatgtcatatgctcattcttgcaataatcaatcaacctcagttgaagaaaaaggattcagaaggagaagacgtttggcttataccccagttgagctgcctgtgggagtggagccggagcttcgctagattttattttccgctgcagttttcttcttagtgaggactaagtgcctctcaagtaagtatttatcgttttagttaatttgatgaatctgtatattaaattgtcagtttgtgtacctcggctgattcctggacgaggattttatgcacagataagttcgaaaattactagtgaatttccgggcgtgacagtatgattcacattgtacgattcactgctttatttacaggttacatgtagtcagtttctctctttggtgaatataatttaagcttgcatattcctagaatgatagatgtggcaataataataatctaaattgtcaaatcttagggccccttgattcatagaattggcaaaggattttcataggatttaaattcctaatgattttttcctacatgtctcattgattcataggaaaaggaaggaagctttccataggattgcattcatatgcttcacatttcataggaaaatcatcaagaggtgtgacctccttgtaaactttcctttgttttttccaaagcactatcaaagggcaccaattatcaattattgtattttggattcctgtaggattcgagaatcatactacttcaatacctacattttttttgttctcgtaattttcctatcctacgaatcaaagggagccttagtcaattatttcaaacattggagttgtacacaactctaagagcatctccaataacctctcctagcaaaattttggcgattctagtcaaaaatagtgctccaacaatcttttccaaccggcttgctaagacattcggcaggccaaactccctggtcattggccaaatttggttggccaatggtgcaccccatgcagcaaatctccttcccgctcccactctctcatgtattggtctctctccaacccacatctctcgtatgtgtctacgcctcccctaccgcacgcagtgccttcgcctccccatccacgtagccgcgataagcagtagctctgtagtgagccccgtcccggccgtgctctcacctagcgccgttgttgtctcgaggtcacctcacgtgatacggggaaaagcccgaccttctcgacgtaggatccggataaaccatgaacctcacgaacaggatgaacaacacgctgcccgtgcaacgcacctttcaccatgaattcgcaaaaccacacgctttgataggttgatccacttgaccacgcaaaagtggatctattgccccctcaattccctgcaaggaaaagcaagaacaatctatggcaaaactcccaatccctctctctagtttggcggcggcggcacaaaatctaggagaagaacaagagcaaatttgctgcaattttcattagaataaacgtggtccccctcatgggtcgtgcacaaaggtatatatagccattacatgggttagaaactaactaagaatcaaatacaacacaatatggaaacttctctgcagcaccgtcaatttgtttcgggtcttgcggtgaaaccagaaggaatttctgtcctgggccctatccaccacgtgggccatgaagttttctttccaacgagtgctcacacgtccaaaacggactacggacgagagagaaacaagcgttttagtccatgtttgtccaggctggcccaaaccgagtccgaactgaatcttttctttcttatcttgaaactcatggttttggaaggcttcaatccgtggagtaataatagatggactccttcccaacccaagatgggccataggatagtataactccatccaaccatgccgtgcaaagccgacgctcatcactattgttgttacttgcgcgacacccggtctgcccgcacaggatgtcttcaacttgcaattgccgttggtagaaagctcagaatgacatgccgtttgattcgatggaaagtagacttgataacctttcttaatatataagccattcatgttgaaagccttctcatcaatgcagaattcaccatgaacttcacgaatagaatagcatccgatcttccacatgtgcgccgctacacccgtcacctccggctggacccccatgttgtttatgccagccaatggtccaaatctctcatgtctgaaagtaatcaagtgcaaaatattatgtagcatcaaattctcatatatttcacgcgtagacttagagagaaacgagttcaccttatgttctgatctgcaagta

SEQ ID NO: 26903 - DNA, 17275 bp, Oryza sativa
ccggcatgcaagctttaatttgtgctaaattaggattggttactctggattccgttgcttaatttgtgggctgggaatgcaactccacgaccagctcaccgatcgccggacactggtggatccagtgtgactgattccgctaatcctcccattcgccagccggcactgctttggggaactctagctctcattaggcacctgttgtgatcaatcatgccaccgaactgaagccgaccatcccactgcctttgatcgattgcctgtgtatcaggtagtgctacagctactttgttttctgtacttgctacaaaataagttgatgtcaatttatggatttatgacctgctctcccctttttttcacatttcttgactgtgagagaaataataatagaaattctttgtaataataataataataataataataataataataataataataataataataataataataataataataatataatcaatatgcagattcactgttgagtttgaaaataaattctttgtaatgacgttactgctatatcttatatacccttctttgtaattaacagtaatggcatcaacgttagttcaatttgaactaaccaatatgccatacattaaaaacaaatggagcgtgaaaatagcatttttcgaggtcatatgactaattcccttgaacaaagaactttaaaatagaaagggagaaaagaactgattcaatttaattatatgactcgttgcaggctgttgatgttttgtaagtcacaattggggaaaaaatttgaacttgtgatggctgaaggaacacgataactttgggttgcatcccgatgtgaacaggtaatgtgttgagttgctttttttttctccaaatgacttattaatttgcagtggtacaccatggcacctgctccttttttctatgtaagcaaggaattttggttggttctattaatttttctttggttggatgtaaggtgtagttttcaggtcattggaggctctatatatgcttgtaatccatgtgatttcctcttatcacattgaaggcatctcctactgttgatatttgtcggtccccaaataatactcatctttgcaaaatttttctttccttgaattattcaatgtcttagagtacatgaccttgcaatgccacttccttcttgttgcagcacattattcagtttgcgttatgaatcaaaaagtggttatagtagatagaaatagtttggaagaacagggagcctaaagatcctttcagtggatgtccgtgtttgggcggcttgagaccatcttaatattgtaggtgcaggaaattaaactaaggtaaaagcgagatgctgatgttaggtgtagatgatatggatacctgaatcagtccaaacctgcttaggttggagctacttctcgataggaatccaaatatcagagggaaggttgtccttgtacaaattgtcaatctagcaagaagtacagtggaacacagaggaagcaataaaagaagtggattacaaagtgtcatccttatttaccatcatatattgttttaatgaaaatattttattttattatgcatctgattgttattgtaaatgttatgagggatagtatgaattttatactatatgagtgcattgttttccgacagaaaaataatgagttggacaatttcagaggatgtgacacaaactgccatcagccaagcccactaattatgtttgagtttttgagttgcttcccatcttttagtgattatttcatactctgtggataatgttttacaccgtgcaacagagttgcctgaatatgagataatgttacggaatgaaaagcactaccattatgttagatctcatcttacaatgcttcttaatagatctgtatagctttgctcaagatctagaaagggaatgcaaatatcactccatatatataactctctttatcatttctttcttaagtgaattataaattaagttacgccgtaacgttagtacgggcatattactagttagtaattaacttgttaaaattagtgttgattagatataattagtctattttatagttcattagaatatattttggctttattaactataattaatatatattattatcaattaatatttattgttccaaacaagaaattgaaatagccatgtttgttgatcagtctagtacgttcaagaagcgggtattgggaaccttttcccccggtcgtttgtttttcttgtgcctcccatgatgacacaccgtcgtcactcgcgacgaggagcaaacgaggaacttggcccagcttagctgtggtgcacacacgcggacacgccttatccacactcacctcaccctcacccccggccctctcccatagtagtatcgtcatcacgaaacaaattaaccatagcagcagcatatcctctcccatgcttccatggattccttctagcttcgccttagcttctcctcctctacagtctacacgcgcgcatgcatagcatctatagagagagaacaaattaattattaggatttagtcgcaatggcattagccatggcgcccaggctagtccaccacccttgctgcatgatgctctccaagaacccaagaacgccgccgccaccgccggcgatgcaccaccaccatgcccacaagccgctcatcaccgcgctcaccagcacgtcgtcgttcttgctccgctccgtcgacgtctccaaggacgacaagccgctggagacggcgactacgacaaccccgcctactccggcaccggcggcggcggctccggagaccgaacaagcggaggcggtggcgtcgccggagttggagttggagctggaggaggggccgaaggtggacccgcggcggctggaggagaagttcgcggtgctgaacacgggggtgtacgagtgccggtcgtgcgggtaccggtacgaccaggccgccggtgacccgtcgtacccggtgccgccggggctgccgttcgagcagctccccgacgactggcggtgcccgacgtgcggcgcggcgcagtccttcttcgagagcaagagcgtcgagatcgccgggttcgcgcagaaccagcagttcggcctcggcggcaactccctcaccggcgaccagaaagcgctgctcatctacggcagcctcctcgtcggcttcctcttcttcctctccggctacttcctccaatgaaccagtcaccccctcttcctaattctctacctctacctctacctctactgtgcctgtttctactaattaagtatatatcagtacgttttatttttattggctaattaattaattaatctgtgtgaatacatagtgctattccatctcgaattttgaatttagatatttaaccagtaacttcatccaaatgcaggcctataattttctgagtttttcagctgctgaatcaagctccttttgaaattgaaatgaacaagggggcagggatcaagtagctagcaaggcagttctgcggttgtgacgggcctaattacatcagtcgcctgatattctatcaaatctgagtaaattgttccaaacgttccttcataggtccacatctcttctctagatccgactctctaaatattccagttggttagtttaccaaaagagagactcagagacaaatttacctttcaatccaataacctctccattaaagtctccactctaacagtgtgttgatactttttcatggtcaacatagaatcacctaacgatttgcggtgcaaacaatagagtcgccaaaatcgttagatcaaaaccggctagcagaaccgatttctagattaattcactttcacgaaattaagcgactaatttacaagcaaattagcaaagaaggtaaatatcatatttacgtgacaacgaacgactagtttctaagcaacctagaaaaggataaccttctcgctttcgtacagaagcatgaccgttttctggtgaacaacggtaaaaattaaccaaattctagggctgatagaaaagaactaaaaagtagaactcagccatgaaaataaaatatgaaatagaaaagaactaaaaagtagaagataagtagtagattgataatttgttcggggtctttgcctaaactaatctaacgcctatatatacacaagacaacggcatacggccccgttatacatggcaactcctgccaggtaggaggacgctatatcagtacgcgacgcatacgctgaatatagtaaaacatagcatgataaacaattcacatgaaaaagctaaaagagtttctgaaatttctcatctcacaaaagaaaaaaatagttaaagggacgaaagtactctttagaattaccacttcttttttgctcggtaattttctgattatgtcaaaagaaaaacaagtgtttcaaaccgttaaaactaaatgtttcatacgtaatagtgatatgattcaatatgtgtcttcagtatgtttcacaaaattcttgaaactacctgctactattctctctcctctctctccacctcatccatacatacatgctttatttcagcaagcttcaaaataatttttctcttaaattacttatccaatctatgatctgatcgtaccgttgtattcgttgtaattaaatctttagaacaagatatcgcatgattatttttgataaaagaaagcatatgtttcagtcagttaatacatgttgtttcatatgtgactgcgacatgtttcaacgtgtatcttcaccatgtttcataaaatatttaaatgtttcagttgctattttttttttgtttcaccatatataacttaatgtttcacttgttggtcaattgtaacatttgaccgtctgtttttttagggacatcggacgtccgatgggtagattcctcctaaaagtaggacgacgctatatcagtacacaacacatacgctgaatgtagtaaaacctagcatgataaacaattcacgtgcaaaaagctaaaagtgtttctgaaatttcttatctcacaaaagaaaataaagagttaaagggaggaaagtactctccagaattaccactttttttttgctcggcaattttctgattggtctacaaacgtggcagtgtacgattgctggatacacctgtcaggtaggtggcagctttgtcgcatagaccaggctaatggaccgcgtcacccgatctcctctctttaaatatttttcctctcttaaattacttgtccgatctacgaactgatcataccgatgtattcgttgcaattaaatctttacaacaagatatcatatgattatattatgtcaaaacaaaaacatgtgtttcgaaccgttacagctaaatgtttcatatgtgatagtgagatgtttcaatatgcgccttctgtgtgtttcacaaaattcttgaaactacctactactactctctctcctctctctctctccaccttatctatgcatacatgctttatttcagcaagcttcaaaatgatttttgtcttaaattacttatccaatctatgatctgaacacatcgttgtattcgttgtaattaaatctttagaacaagatatcgcatgattttgataaaagaaaacataagtttcaatcagttaatacttgttgtttcatatgtgacagcgacatgtttcaacgtgtatcttcgccatgttttataaaatatttaaatgttttagttgctgatttttttttgttttaccatatataacttaatgtttcacttgttggtcaactgtaacatttgaccatccgattttttagggacatcggacgtcccatgggtagattcctcctaaaagtaggaggacgctatatcagcacatgacgcatacgctgaatgtagtaaaacctagcatgataaacaattcacgtgcaaaaagctaaagtgtttctgaaatttctcatcttacaaaagaaaaaaaaattatagggaggaaagtactctctagaattaccactttttttagctcagtaattttctgattgatctacaaacgtgttagcgtacgaacgctggatacacctgtcaggtaggtggcagctttgtcgcgtagaccaggctcatggaccgcgttacccgatctcctctctttaaatattttttttctcttaaattacttatccgatctacgaaccgatcacaccgatgtattcgttgcaattaaatctttacaacaagatatcatataattatattatatcaaaagaaaaacatgtgtttcacaccgttaaaactaaatgtttcatacgtgatagtgatatgtttcaatatgcgtcttatgtgtgtttcacaaaattcttgaaaccacctgctactactctctctcctctctctctctccaccttatccatgcatacatgtatgtatttcagcaagcttcaaaatgatttttctcttaaattacttatccaatctacgattcgatcacacgttgtattcgttgtaattaaatctttacaacaagatatcacatgattatattttgataaaagaaacgattcgatcacacgttgtattcgttgtaattaaatctttacaacaagatatcgcatgattatattttgataaaagaaaaatatatgtttcaatccgttaatacttgttgtttcatatgtgacaacgacatgtttcaacgtgtattttcaccatgtttcataaaatatttaaatgtttcagttgctgatttttcttgtttcaccatatataacttaatgtttcacttgttggtcaactgttgaccgtccgatttttttaaggacatcggacgtccgatgggtagattcctccgaagaggaggaatcaatctgcacaaatcaagggaaacaactccgaatcaagctcggccttcctacaagcagtcatggacatgaatcagtcatcaaagggaatagaaccattttggtttgctgcttgcgcttacacactgtggaaatctcacaacaacaatttgacaacctacaatgcatcacgcagcaaatttcagacaccctaaaactttagagcctgagaaccaatgaaacaaacagacaaaaaatagcctggtgtgcaaggctttcctagagaaaagcctcatgtatactcccttgtaaatccgccaccctagtctccttttcttttttgttttctttctttttctcctttttctctcctctctttgtatctcttctatctgctttctgcttccagttaactctaacctttaacttgtaacctataaacctcatttcttttaacgaaatgactataaggtagagctctacctccttacgtcaaaaaagtcaagggcaaaaagaatgtctttacttatctgcttttggctgacaccgattctaatttcacacgggacacggccgcatgtagcgcaacgaaccaggtccggcaacatccagatgcagaccgacgcactgcatcgttcatacatccacacgccaacgcgtcttcgcctcaattgtccgcctgccacagcctccagactccagtgcaccaacactgcgatccaatctgctccaacgtgacacgtctggcttccatagtgctgcatccatcttcatctgcagctggtaatgctggtacacttggagtaatataccagtacacaattatatagtttactcagctgcagctagtatacatgcatatttccatgctaaatcaaatactaatgcaactcaatagtttgcaaatacgatcacgagtcactgcacatatacatctaactagttctcaaacaaatcactccatgaatcataacaacttatctaaataatttgtcctgctcaaataatgaaactaactcttagccaaattatggtacaaacacagtggatcccatatttactctttctttacttcttcctccctcatctcccccttcccacctgacggttttaggtggcgtcaaagacgatgacgatgaaacccacatcgagaatggcggcatggccgatgatgatgaggcagccgaggggaggtaggaattggtgcgggacaaccgaggggatatgaggtgtcgtgcatccccgcctcctccctttgaacttatgggtggcagccaccactggcaaccggagagcagggaactgaggtttgacgtgggcaggtggcggcaacggaactactacccccaacgatggcctacggctgttgtagatcaagacggcgacgacggcatatgagacttgatgatgcagatctacttatcaaaagtacattgttctttacttgcggatcagaatataaggtgaactcgtttctctctaagtctatgcgtgaaatatatgagaatttgatgctacataatattttgcacttcattactttcagacatgagagatttggaccattggctggcataaacaacatgggggtccagccggaggtgacgagtgtagcagcgcacatgtggaagatcggatgctattatgttcatgaagttcatggcgaattccgcattgatgagaaggctttcaacatgaatggcttatatattaggaaaggttatcaagtctactttccatcgaatcaaacggcatgtcattccgagctttctaccaacggcaattgcaagttgaagacatcctgtgcgggcagaccgggtgtcgcgcaagtaacaacaatggtgatgagcgtcggctttgcacggcatggttggatggagttatactatcctatggcccatcttgggttgggaaggagtctatctattatttctccacggattgaagccttccaaaaccatcagtttcaagataagaaagaaaagattcagttcggactcggtttgggccagcttggacatacatggactaaaacgcttgtttctctctcgttcgtagtccgttttggacgtgtgagcactcgttggaaagctaacttcatggcccaggtggtggatagggctcaggacacaaatttgttctggttccaccgcaagagccgaaacaaattgacggtgctgcagagaagtttccatattgtgttgtatttgattcttagttagtttctaacccatgtaatggctatatatacctttgtgcacgacccatgagggggaccacgtttattctaatgaaaattgcatcaaatttgctcttgttcttctcctaggttttgtgccgccgccgccaaactagagagagggattgggagttttgccatagattgttcttgcttttccttgtagggaaatgagggggcaatagatccacttttgcgtggtcaagtggatcaacctatcaaagcgtgtggttttgcgaattcgtggtgaaaggtgcgttgcacgggcagcgtgttgttcatcctgttcgtgaggtttcacggtttatccggatcctacgtcgagaaggtcgggcttttccccatatcatcttggtatcagagcacggttgtctcggtaggatcttttaccctagctacatattttatttctgtcctatacacaaaaaccctaaaaaaaatagcccatagtttgcaatatggttctagtgtttttttttgttaggttttaatccattagacttgtttggttgctgatcttagtgttccttcgtgttacacttgagcctatatcaatttatcttgtttgctagattttgtttcttgtcgcgttctgaattttcagtgcatatttcgttcagtaaaatagtcatcaaagttgcatagagggtcggaaatcagtgtttaaatacttgttggaaagagcacgtggtgtcctacaaatcattatctctggtcgacatattcattcggccattatctgcgtgtttcggacacaacaaagttagtggttgttctgagttttgtttgagtctatttcagtttgtgtgctagtccatatatcaataatacaaaaaaaaaatagtgagcctattctatcctttgcaaatacttttgaacccattgagactagctgtaggaagttgctcttgggctttgcacggttgtatttttacagtcatacccatattgttcaatccggtgtgctgatcgtagtggcaaaaaaaaaggaagtataagagttcaaaaaaaagagaaagcaaaaaaaaaaaaaaacaagaaggattacaaaaaaaaagagagaagtgctgcggtcaccacatctattgtttatttcagaagttagtctttatttgttttgtgcaaatctggtagcccaattcagattttgagcaatcagctagcgtctctccttgtacttttgcaacacgagcttttgatttcatatccattttgtgttagctctcttcttggttgcataggtcccattatcgttgcgtgtgagtgctgtacacttcatttatatctttggtgacgggaaaaccgggacggtcgtaatagtaggtccgttatccgcaaatcgttagagacaatttaatttaaatgcaacaaataaataaaaatcagaaattgcgagtccattacttccaaaattcatacatttacatagaaattctgttaattacatctccgtagagaaaacccctgattagaaattccaacatgaaagaaaataaaattacatgactgctaaaaggctaaaaagaaaaatatatcctaaagctccagatgtcgcagccgtagaatcttctgtagatttccgtttatatgtttatttcattttgggcatattttagatgcccactaatttgttggtttttaatatcactgcgtatatggtagcaaatttatacatagcttccttttttttggcattgcgactttatttttttatacgtagcgcacatatagaaattgctgaattttcttgagcactcgcggggcatagccaggcaagtatttgctttagcgccaatattatcgacgcggcatgggattttggtacggtgaatttgtgtcacgcccggaatttctatccaaaattccaaacgcttacatgtgtgttaaaccctcgtccaggaatcaaccgaggcacacaatgacaatttgataatagagtacaaataaataactatttaatactcgcaaataaaaattattacagaggtagatagttcctctcaaagaataacattctacgcagcggaaatataaaacgataacaaactacggaacagctatggcgactccactccacaggcatcttaaccaagaacaagcctaatcctccagatcatcaccttcactgagatactcctcttctggtgaatgaatattgcaagaatgagcatatgacatactcaacaagtcacacagcaaatatgcaagtgcacgggataacaaaggatggcataatatagctcatttgcagaaacagcatttaataaatatttaagagaatagtaaaaacagttgaataattaatcaatattaaataaacaccatacaacatacccatgttgcataggcccaacctcatttgaacaaccaaccccagttgaacaaattaaacctccaaaccaggaattatccattccaaaccaggagtcaaattaattatcacattattaacattaatgagtagtgtgagactaatcacgaaaaacattgctcaactcacccataatcgcgggtacggctattcgaatagtttaaactctgatcagaggtgtaccactgtacccacaagacacaaccccacatcatgtcaccatgtgcctcaataccaccacggtacctcggaaaggagttgtgacaataccccttgcacaacataacccattatagcgcacctttcctggatcataatcacccccttataaacaaggcatggactccccagcgacccccgtggacttctcgccacttctcagtctggcgcactataatgaatcacgctatacaaaagataaagccgttgcccacgctggcttgtggttggcacgataaatgtttcacaacagtagctcgcgaaccggtccttaattgtcatgagcacaaccatcaaaaccgtatgctcacaacccaccttaaccaggttttaattatcaattaattaacatcacacgatcaaccatcgtgagctaccatttaatataaccatcaataataataataataacatagtttataattaaaccctttagttagctaatgtttctaagcatggctaagcaaacttacatagagcatttagctgaaccaatccaatacataaggttcatgctatcaaattataacccataggaaaataaagtcatcttcggccaataattaactgggaaaggttcaccacccgatgacattcgaaaacaatgcatatttgaaataaaataatagctttaaacgggttcaacatgctcaaagggttgtttgggatctgtgtgacttgccttgggcttccgcaaacgcttcggaaccttcctcaaaggaaacgctctcctccggaacgtcggaaactaaagcaaataaacaaaatcaacaaaacagtacaaaaacaagcataaacagtacatgtggatatttttaacatgtagatctcgattttagaagaatttagcaacttgaaccacctaaaacggatctacggttatttagttatgattttccgaagttttaatctattagaaaattggaaaaaagaaagaaaaaagaagatgatgacgtcatgctgacgtcagcaatggccggccggctagggttagccaactcgccggagattggatggtcggccgcggatttggagggcatgtacacgtagaggacgacgaggcgaacccaacggtactcaccacaacgacaaacgacgcacgacgacggccggcgacgagaaggcggtggcggcggttcggcttgcgcggcgacggcgagctacggcgaccggcggcaaagaaggacgggcggccgaggttcctctcaccacggcgcacctaacggcggcgacggcaagcggcggcgacggcggaggcggcggcgcggcgcggctgaagaccgccggcggcggcggcgacctaagtgcacgcggcgacgaggctacggtgcacgggagaggacgggagagggggcaaacgaaagagggcgacgaggtggtcctttatatagcattggattgaagagatcgaactccaaacgagaggaatcgactcgggaaaaatccaaactcggttttagggataaaatcaaaacgaactcgattcggataaaatactcaacgaattgctccgtttcttgaggggaaagatagaggagaacgagaggatcaaaacccctcaaaaacccggaggaatcggggtcggattggagcggatttgagaggagaaggaggcggctcggactcggttagggcggccggccggaggttgaagacgagtccgacatgtgggccccacatgtcggcggctggaggaggaggggcggcggctgagtgggttgggccggctcgcccgcgggagaggagggagtattgggccaaaatcggcccaataacctaaagaagaggtttttagaactttttcaataaaaataatttgtgaaatgatgtttcatttattaaaaatacttcccttgctcaaataattcccagaaaaatctagaaaatagaggagcaagtatagtatttaataaaattttatctagctcatttttatgttgaaaattttcctagaaaattagggtttagcttgtaggcttttaaaataatttctaaaaaatgatttaaaacatgcatttttaatttaatcgattttttttagagtgtgacaaacctacccccttaaacggaatgtcgtcctcgagattcagaagaactggcgaacagatgaggatgagctgatttcaattcatcttctcgctcccaagtggcttcttcttctgaatgattgctccactgaaccttgcagaaccgtataacgcgattcctggtattcctctcgcttacttccaaaatactgactggcttctcaacataagttaaatcttcctgaagctctatacgatcaggatctgcttcctccgtaggtacacgtaaacacttcttcaactgagatacgtggaacacgtcatgtattcctgccattgacggaggcaactctaactgataagctacttcacctcttcgactcagaatcttaaaaggtcccacaaaacgcggtgccaatttccctttggtttggaaacgatgaacacctcgtaacgacgtaacccgaaggtatacataatctccttcttcaaaagccaaatccctgcgacgattgtcggcatagctcttctgtcgtgactgagcaacgcgcaacctttcttggataatcttcactttttcttccgcctctcgcaatatgtctgtcccaaaaacttgacgttcaccggtttgatcccaaaggagcggcgtacggcactttcgaccatataatgcttcatacggagccatttgcaaactagcttgataactattgttatatgagaattccgcgtacggcaaattcttatcccaacttccaccaaaatctagaacacaggctctcaacatatcttctaaaatttggtttactctttccgtctgtccatctgtttgagggtgataagcggtactgaaattcaaacgggtacccatctctaactgtaacttctgccaaaacttcgaagtaaactggctacctctatctgacactatcttcttaggaacaccatgcaaacataccactctggccatgtataactctgcaagcttattccccgtataggttgttttgaccggtatgaagtgagcgacttttgtcaacctatcaaccactacccatatagaatcatgtcctgccgacggtctgggtagaccggttataaaatccattcctatttcttcccacttccactgtggaatcttcaacggttgtaacaaaccggctggcttctgatgttctgccttgactcgctgacatacatcacatagagccacatattctgctatctcacgtcgcatactggcccaccagaattgttgctttaagtcttgatacatcttagtgcttccagggtgaatggaatacaaagtttcatgtgcttctctcatgatagtatccttcgacttcttattctttgggacgcaatatatttctcctaaccacacagatccgagctcatcttctacataacggatggcttttcctcttctcatgttcttctttatttcttggatatcaggatcattcacttgagcttctctgacttgatcaaacagagtaggtttagcttctaaagcggccacaaaacctttgctgactattcccaagttcaacttttcaaattcctggcataactcccaaggtaaacgtcgaccttatgacatattacagtagcttttcctgctaagagcatcggctacaacatttgctttccccgggtgatagtggatttccatatcataatctttaatcaactctaaccatcttcgctgtcgcatgttcaaatcaggttgagtgaaaatgtacttcaaacttttatgatccgtatatatctctgtacggttaccgaaaagataatgacgccaaatcttcaatgcatgcaccacagctgccaactctaggtcatgcgttgggtagttattctcatgaggacgtaattgcctagatgcataagcaaccacctttccttcttgcatcagcacacaacccaaaccgagtcgggatgcatcacaatacacttggaaacctttcctcgaatcaggcaaaattaatacaggcgcagtcactagccttttcttcagttcttggaaacttcgttcacaatcctctgtccacttgtacttcacttccttctgaagcagacgagtcattggtctggcgatctttgaaaagttctcaataaacctgcggtaataccctgcaagtccaaggaaactacgaatttctgaaaccgtcttgggttgcttccaacttaacactgactccacattgcttggatctactgccactcctccagacgagatgacatgaccaagaaacttcacttcggacaaccaaaattcacatttactgaacttagcataaagctgatgctcacgtagtttctctaaagctagacgaagatgctcttcatgttcttccttcgtcttagagtatataagaatgtcatcaataaacacacgacaaacttatccagatattccataaacaccttgttcatcagattcatgaaaaaggctggggcattagtgagtccaaatgacataacggtacattcgaacaaaccataccgagttgtgaaggcggtatttggtatatcttcctcacgaattcgaagttgatgatatccagaacggagatctatcttagagaaaactgtagcaccttccaattgatcaaacaggtcatcaattctgggtagaggatacttattcttgatagtaacctcattcaacgctcgataatctacgcacattctctgagtatgatctttcttctccacaaagatgactggtgctccccatggcgaagtactgggtctgatgtatcctttctgaagcaaatcatccacctgtctcttcacctcagctaactcgttagctgccattctgtatggtctcttatggatagggttggttccaggtaccaagtctatccgaaactctatgtctctcttaggtggcatacctggcaaatcctcgggaaacacgtctgggtagtcttgtactatggggatctcttgtagagcaacttggtttaagaccgcaccatgagatttaggagaggacacaaagaaagaaacggtctccccattgctattggttaaagtcaccttacggttggcacaatctataactcctctgtgacgagatagccagtccatccctaagataacatctagatctttggattctagcaagataagcgaggatgggaaatgaacttcttctatttctatagtaacggaaggacaatactgagtcgaaaatacttgattgcctggggtattaactagtaaaggtctcccaagactaataacttccatcccatgattgctcgcaaaacttttagacaaaaaggaatgtgtagcaccggaatcaaaaagcacagttgcgggtatagagttaacaggaaacgtacccaaaaccacatctggtgcattctgagcttctgctgctgcaacatgattaacacgtgcctttggtgctggagcattggagttgttcggggctggagcgttcttcacgcgccgaggcttaggacacttatcagcataatgtcctggatcaccacaattgaaacacacccctggcttgcttccctgttccttcctgacgggctggttctgaactggagttgctgcaggacgagcaaccacgttgcggttgtcattaccacgattaccag

SEQ ID NO: 26904 - DNA, 1391 bp, Oryza sativa
ccttgtctcatacgcgctggctgagacgaaggacacaacgaagaggaaaaattcctttgactgtactcatgatggccaagcctaggagcatggcaagaacataattccttagttcgtactcattggccgaaccgaaggacacaacaaaagaatccattgacatgagtagaggaagatgaactgagagatttttcgacttgtacacaatggccgagcctaagaatgaaggaagagcatgaatcccaccttgaaacacctctgattcttccggcacagcagagcgaggaagcagaggctgacgagatggcgtaggagcagagcggcacggcagcgtatattgcctagcaacaagcagcgcttctgcaaagcatacgcacagcacctagcctctacgctaatctcccctggaacctctccccagcgaactcttctactccctgcttgccccactccctctatttatagaggaggatccctgccattttcaagcagccgcgcgcgcccttagcatttgaaaacatttgaatggagcatgcagatcaactgatcgtgagacaatgggttaactaactgattactacaggaagcttcctttatttggatgacatgtgggccctttcagttatttgctgagtgcatgcatggttagtggtcatcgtggggcaatgtattaactgtttgagtactgcaggaagcttcctttatttggatgacatgtgggcccttttcagtttattgggacgaacatgctgttatttgccgaatgcatgcatggttagtggtgatcgtggggcttgaccacgttttcctctgctttcactgacatgtgtctctttcttttggtttcaaactggtggtggattctcttctgcatcatgcctgggctatttttttaatccatggaaaacaatcatttttggattccttgatatctctgtttaattgggcatcacaatttatttatttatttactttaatacacgctttgggtatgagttctttttaaagagacacgcgtatatattttagtcactatttttatcgagcgggctgttactgccgtaaatttattttttgcgacacgcgtcgcgtcctgacgcgcatattatcacggtggcttcgcatattatcacggtggcttcctccagcccacgtctagctatcgagataaaaatgctggactaatggcgaacgcgaccctctttagtttggcatgcgcgtgtatatgtatccacgccattatagcggcgtggacgtggcatgcatttttattttaagtcgcgactatttggggcacgatttttcactagccagataaacatctattttggtttacattttaatttttgtatgctattttatatcgtgggcacgccttttctgaaaatatt

SEQ ID NO: 26905 - DNA, 715 bp, Oryza sativa
atggaaatcgcgagacgaatttttttagcctaattagtccataattaactataagtgcaacagtaaaccacatgtgctaatgacagattaatcaggcttaataaattcgtctcgcggtttctaggcgagttatgaaattagttttttcattcatgtccgaaaaccccaaccgacatccggtcaaatgtctgatgtgacaccaaaaaattttgtttttatgaactaaatacacccttagtcatgcatgttgagataaaactggtcccaataaaatttgatatcaaattaaagggttctctgaccaggaacacaaacacaaaccaacagccattcctttccatccaatgtgtcaattcaaggtatgcagatgcatcaatcactgcatttctaattacacacatgccacaaacaacaacatgtatcacacaagagtagcagcagtatctatgtctttggcatattgcacatagcatttgttcatgagagcaacagccacaaactgaccacacacatgcacacaaatcaattcagcctgagtaatcttcagtctatctcctcctggacaatgccatctaccaaaaaacaaactcagcagaggccaggagacactgatgatagatcaaagctagtagctgcaaaggccaatacactcgggaacaaaaacccatacaacaacacagatgctgacgtcatgcatgaagccggggctgcagga

SEQ ID NO: 26906 - DNA, 753 bp, Oryza sativa
tgcaccccgaaccaatttgggactgctatcttacttaagctgctaagagcaatagtagggaaacagaccagtgacctggtggtagaagttgttaacctcctgggtgtctaggataattgggttggagtcctatgacagtcttaagttcctatatccatcatttttccttagtgaaaaccagagcacacgcatagagacaccaccaccatggcagcaccacaaaagaagtgaaattgggtggttattgaggatgattaaaaccgtttggtgccctgtcataaacgcatagtgatgagctcagtgtaatcttgcttcatagttattgtttgctaaatgtttgcactccttgtttggtaattgcatatgatgcctctgattgttccttggcaggctattcccatcacccagcaaaagtatttattattatcgccatatatgtatgtcacatcattttttttaatgacttcatcaagaagtacaatggcattgagcattacagttgaatttgtgtagtttttagacatttattgcatcattacattctgaagtaatttcaacatatgagagcaggtttctacacatagtattttatatggctgagagagcatggagtcatgcgatggaaaagaaaactgctggtccaaatgcacaacagcgtatctacatgttaggtagatttagaaaagctgtcaaatgggcaacgcttttttcacatttatgttctctaaaaggagattccaggacgtctttgga

SEQ ID NO: 26907 - DNA, 601 bp, Oryza sativa
aaagaaattgcagaaatataaaatgcaagcagcttgtattttgttaagtggataagaaactagacttaaaacatattagtttttgcattccaaacttagaagataaactcgagtgttgcaccaaatatctccgtgctattttctgcacaaaaccttgaaaaacacctattgttatttagtcaaacaaggccaatgtacctatagttatttagttggagaagaatgcccaatcccagtaaaagctgcaatccaaggaagcccactccttgtgtaggggttagaatgcctgatgcaaaaggcctgcttttggtgcgctcaacctacaagaaaacaaatacttttctgtcaaagatcaagatgctgaaatcccatcagagagtaaactgctttatgttcctggttgaccattccactgaattgttcttggagcaactggtgatatggtgatgacatttaatatggttattggttttttaacttgaaaactgcaacagtctgaaaggcatttctcttaacaggagaaagtacaacgaaacggaaacgattaacacaaatcaccttgttatcaatgtctcgatcaagaagatcattgaccgtgcat

SEQ ID NO: 26908 - DNA, 16592 bp, Oryza sativa
aggatgaactgaaggatatgcccatatcttaaatatatcgggaatatgtagcaaagagatagataccctactctaatcatgtagacagaggtactgcatgagcagttattcaacagacattcatgacttcatgtacccagtcccatctcttagagtggaagacttctaccatgtaaaaaggcatgagcaaatgcaaagggttcagcctgtatagttatttgattccagtgcaatagataatcattgccaatgcatgtctctagtccagaactccagattgccatatcaataaattttgaagtcactatttagctggtaagttgtgttaagtgaaccaggctcaaagtcattgtactcggtggaacttaaccgtagcacaaataacaacatgaaaatactatgacttgtttctcttgtcatcttatccaatgtgttgtattcaatagtatccaccttggaactcacatttaaagaaaccattttggaacaggggtacatagaatgtcagcttgattgagatggatttgtatacagctaactaccttagtagatgcactttcaagagtatatgcatctgtaggaagagtttgctatcagggtttcccttaccatttaccgcctggtaaccgcgataaactgagaaaaaccggacaaaatttaccaaattttatttttttaaaaaaaaaatactttttaacgtggtagggataccgggcctttaccgttactgtgccctggtggtaagcctggttaccacagtaaccagtggtaagggaaaccctgattgtggttgttattgccttttgttattgtaaattttccgctacttaagggattggataaggtatctcagttgcacttaggagcactagatgttgtatgtagttttctgaccatctatatcatcatcaacaaaacttatatctgaagttctaaatgtacttcagtttgtataatagtgagaacatttctcattgaatgtgagcacaaatttctaccaagatcattttcttggttgtgttggggatagtcaggtcacagtcatctagccatggatttgaactttatgagaaagctggtgaataacacatgtgattgaataatttttttgcgaaaatggtgggccagtcccaatctatccagtgtagtgagcactaacttaaagcattaattctaagagtccccttttaaacactaaagttaatatagtgaaattccgagcatttgacagattcaagataagcagtaccttagaggacgttttgagatacgttttcacctcaaatccatctaaccctgaatgatgaactcttagttattcggtttaacttttatcaagaggttgtaactataataagtaataaggtgcattaaattggtcacataaaaatgaatcacaaagcatgtaaagtaaaggcatcatatgcacaaccacagaggagaattttaaataatagatcagcatgggagagactgagttttagatgaacatgtcaataagtcatgctgagaaaacaatgtcatgttaaggattacatgaattcatcatcaactgtcaaaggaataaacagctatattgtcaagtagaaatatgaacaaagaaggtcgatgatgctttatcattaaaaggcatggtctagaatgcttaccgatgtgatagtgtacattcttcaatttatccaaatgcattcctatctgatctgcacatcccagaaatagcaagctcaaagaaccacaatatcctgattaatctctagaagaacactactactgaattccttaattaaatttctctgcatcacatgattacatatctaacactaaattgagatgcttgtcccaaatattagttgtatttaccttcctgataaaaatatcccaagaatcatcatccaagaaatcccgtcaacttaaaactacaatttcaagaattttgctaacgatatctttatgtattgactattgagtcagaaaagctatcaaccaaaatttgcaaaagaagctttgcttggactgcatcctctggtcaccatctcaaaaactgcagccccttcatttggcttccccgttttgcataatccctttatcaatacatcataagtcgttgcatttggtccatatcctcattcaaccatcacattacacacccgcccagcctcctataactccacattttcacataatcctcaaataagtgaattctacgttaacagactcggtttgaaacccctctcgagttcatcaaccaggttcctttccttgcaaaccattccattcttgcccaaccaatagatcaatgtgcttgtgaccacattatctggtggcacgttcttctgtaccatccatctcctcatttcatatggctcatttacttttccaccttggcatagcacatcaacaactttagcacctcacttatttgcgtgcctcagcagattttgtgacctcattcggttgtaacctggccacatccataattttggctgcatgttggagcattccgcactggcagtaactgccaatgagcagagtgtgcatcgtagcatatggtctacagtcactcgcaactatatcatcataaagattttgtgcacactcaagatccccctttcccacagtggacagcaagaaccgtggtgtaggtgacggcatctggggcgatccccaggccaggcatttcatcgagtaccttgagggcagaatccaggtcaccgatgccaacaagccccttgagcaggaatgcaggatgttgcggtagccgatagacgagattgggtgtgatgtagaggttagtaggcacatcgcaagagagcgcggcagcaaagcggaggcggcgcgcggagatgagagaatgaaggaggcggcgcggctagggctggacggtcgaggtgacggtgtggtgggcgagtggcacggtggtggtctttgcggtggagaaagagagggcggtgcagcgtcggcgtcggcgggcgtacactaacagcggcggcatgggcggaaggaagggaagagacaaattcacaggggctgttcttaaaattccataaaacattctacaatagggccactctgtaaattcccatttttctctttgtgaaatcatgaaagccctcactgtaagtgaagaaaactacctcgtttgttcattataagatattttgggttttaaatagattaatgcacgggttcatatatgtgtcaaaataccatatttatccccactaagaccatgtttgtttcagcgatttagattattgagtcagattactgtaagctggattataataagctggcgtagaatgagctatgagttatttgtttctctggactattggaggcatggattactgggtttgaaaggccaaagtttataatgtcctcaactattttggatgccttgctcatcctttttgtcactatatacaacaaatacatattttgaaaatagctaaaaaaataatgtcatgtattaataaataaatcattcatgacaacttttttataatagagtaaacaccaaattattatctcctagcaaataaaacatcggaaatattatcacacaagatatttgtgtctccctcttcgtctccaaattgactagcattcgcttgagatgaaggcatcatcatatagttttcatcattatcacaccgatcaaactcttcccactcaatttactatctcgaataaaattatgaagcgccatgcatgcatgtataatgcatatatagcatcggataactcatatgtccaacaaaatttctccatttcatcttcaaaataccaaaagaacgctcaatcatattacaaatagatgaatataagtggttgaacacctccttgtcactagaatgcctagtgaaggagccggcgcgcagtgacggtccagattagagagaagcccgagcgtggggtgaggaagacggcggcgcggctaaggtaggagaggcccgatgctcgcgtgaccaggggacgaggcagtggcgcacgctgctgggggaggaggaggccgatgcccacgcggccggggtagatgcacacgcggagtggggaaggagtccgctctgtttggttggatgacagagatgggtaatttcttttaagtatcttggggtagtgggtctttagccgtgaaataatatggaaaaaaagcacttttggaggaattaccagattatactaatatggcttatatattatccattcatttcaaattactcataataatctagattatgataatcttaaactaaaacaaacagggtctaagggttacttaagtgctattttctcaagaagccatatcacaacaattgttgttagcctttggataattcatcaatggtgcaaattgcatcttttcttcccaaaagctgcaccatataactcagtcatttataacctttggataattagaagaagggagaagaggccaaaacaacttgacggagctcgtggctcctcaccgggagaccgcgcaggcccccctttgccggttcggccgggggcttagggtgagatctcaagctctcgctgtgtgtggaaagatcgtccgcccgcaagacacacgagacacggcgatgtatacaggttcgggccgctgcgaagcgtaataccctactcctgtgttttggtggatctgtgtatgaaagaactacaaagtgtgagccgacctctcccttgttctaggctctgaatctggaaagaatcatcccccttctctatgggcaaggtcctccttttatacttcaaggggataccacatgcacccttctctttccaaactggacttttcttctctttatggacggagattggtatggttgctgtccgaatgacactttgatgggacagcccacacctacctccactcccagcggagacgggcgcaacgtgggatcgtggctgcccgttgctgacgcgaccagtgtcagaccggtcattcttgtccaccacgcgtcagtttaatagcatgcatgtttgcccttcttcgtgtaacaccttgtctgtaatggttaggatgaagcctggtataaatctaaccagggctaacgtgccatctctaagagataacacgctagctccggcttgagacgagttgcctagaggctttcgtcttgacgggatggggcaaggcgtgcgtcagaccgccagtcgccacctaacccttgatctgaccggtctgtgactggtcacagaccggataaaagagcgtgctgtactgcgttgcatgcagcgtgacacgcttgaccaaactgcaataaatgctgttaggtgagcacagctgtgctcacttatcccatatatgtggcgcagactcctttaaggggtcggggtgcttcggccctcggggtcggggcaaaagcaacccgaccccccctcgggggaaatcaggaggagggcggacacctcaccctcgggcccgacgtccccgaaggtgccaggccacgtgggcgattgtgtctgcctcaagcctctggtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaatccatgcacattggtattgataactttggttgtccataatgggcggtctattcaagactgccacatcacttgagcagcgcgcgaatctgggtgagcagatttgtctcgctcggagatacggtaacgccgcttcagtcggcgagcgtaattaacgcgcgcacgatacaatccgtttcgattgccacaaccgcatatccacttcacgcgccgtaagcgggcgaatgggattagtggaagcgtgggcacgggaaactagggagcgagatagcgagatacgagggagcgaggtagtgggcgcgagaaacgaggagccaggcccagcgatggcaagggtataaaagcatcgagaaaaggatttgctcccttcctttcgccattgttcctcttgccttcgccgcctgagctctaactctttctctgctacgccctactttcgccacacgcgctcgttctcaatcatctcttcctcaaccgccatggcacggggctctgctctgctcgacggcagtgtactaccgccttcccgcatcgtgaacgagaggcacgccggactgccgcgccgcttcatgcctgagtccgccaccggtcgggagacagtgatgctgggcgaggggcgcccggcaccagactacccggggcggtccatcttcttcctccccttcgcaatggctgggctggtcccgccattttctcatttcttcatggatgtcctggagttctacgatctccagatggcgcacctcacccccaatgcggtgatgacattggccatcttcgcgcacctgtgcgagatgtttattggggtgcgcccctctcttcagctgttccggtggttcttcaccgtgcagtcggtgtcaccgccgtcggtggttggcggctgctacttccagccgcgggggccggtgttgaatcgctacatcccctgcgtcctccgcaagaagtgggacgactggaagagcgactggttctacacccccctcgccaacgaagcgcgcctccgacttccaagccagcccccggcgcaggtctccagctggcgggcgccggtagatctgggggaggagtacgacgccgtcctcgaccgcctggcgggcctgcgatcccaggggctcaccggggccatggtgtacggcgattacctccgtcgccggattgcgccgctccaacggcgcgcccggagcgcctgggagtacactggtcctgaagactacatgcggacccaccagggagccagatgggattgggctcccgaggacttcaagatcgtggtccaaagggtgctgaatcttggctccgcggaggcgtctcgcattcctcaggagatcctccccctctgcagcgatcccgaccgcgcctccattctaaccattatgatgggggtcggggcctcagaggagagagcccctaagggccacgacggcgcgggcgagcgccgccggggggaacaatctgccccaggagggggtcgtgcttctgggccccgcgtcgggggctcggggagcagccgccctgccgacgcccaggggaagaggaagctgggaggaacacctcccccatctcctccccgagggggcggggcggcgcgtgccagtagtcggcgcccggagggggccgcgccgacgtcacagcccgagggggagcgcaagaagaagcggctccgcaagatgggggagacggaaccagcccggggaaacctgatttcccctccaaagtggtcatttaaccgaccccctcgcaggttcgtctcactcttattgcgaccatctttctcccaaacggaagttttttcttactcattttgttcgtcttctggttttttcttctgcttcagcgatgtcccgtcgcattcctcccgccaccccaagtccggccagtccgaggccgaagatccagcggccgcagaggagcggaggcgagagtctgaccggcgtgaagccgcagcccgccttcgggaagctgaagaggccgcccgggaggccgcccgggttcgccaagcggaggaagctgctcgggaggaggccgcccgggctcgccaagccgaagaagctgcccgggaggaggccgcccgggctcgccaggctgaggcgacagctgctgctggcgcgtcacttgggcctactccctcgggcggccctcaggcgacatccttcgaggcggctcgcgacgaggccgcgggcgcgtcgcctgggcctacctcaccgggcgacgcccaggaccaaacgggcccgggggacatccccgagcccagcgcatcctccggggggccaagccgcgtcgcattttctccaaggcggctcttttcctcatcttctgtcgccccgctgagcgccgagccccttctgcaggccctggccgccgcgaacaccgcagtgctggatgggttcaacgcccgagtggaggccctgcgtgcggaacgagcggagctcgaggccgcatgggcgcgtgttgaggaggggcggcgctcggtggacgccatggtggaggtgggccgtaaggctcaccgccgccacatctcggagcttgaagcccgcaaggcggcgctggcggagatcgcccgagaggtggaggaggagcgagaggccgccctcatcgccaccaccgcgatggtcgaggcgcaagacaccctccgccttcaacacgcaagctgggaggcggagctgaagaacaagctcgacgccgcccaaggggttctcaactccgccgctgcccgagagcggcgggcaacggaagtcgaagcggcgtcccggcggcgcgaggagtcccttgaggcccgtgccatggcgctggaagaacacgccggcaccgtggagaagggcttcacggaccgcgaggccgccaccgctctccgggaggcgacgctggcggcgcacgaggccgcctgcgccgaggaggagtccgcgctccgccttcgcgaggaggcactcgctgagcgggagcgaactctcgaggaggccgaggccacgacgcaacggctggcggacagcctctccctccgcgaggcggcgcaagaggagcaggcgcgccgcaaccttgaatgcgtccgtgccgagagggccgcgctggagcagcgggctgccaacctcgaggcacgggagaaagagctggccgcgagggcgcgcatcggtggggcggctgcgggcgaaagcgacttagccgctcgcctcgcggctgccgaacacaccgtcgctgacatgcagcgcgcgctggattcttccatcggggaggccgaggccctccgcttggcgggcgagatggggcccgacatgctttgggactcggtctcccgcatggatcgcgccggtcggcaagcgggcctctggaaaggccagtcgaggacgcgccctagcaatctggaaggcctcgctccgcacctcaacaggatggcctgggttctcgaacgactccccgaggagctcgagaagaccattaagtcatcctcgagggacctcgcccggggggcggtcgaactcgtgctggcgagttaccaggcccgggaccccaacttctctccatggatggcgctggaggagttcccccccgggaccgaggacgacgcgcgcgcgcgggtcggggatgctgccgaccacatcgtcaacggcttcgaggggtcggcccctcggcttgcgttcgcccccagctccgacgaggagggcgacgccagcggtgaggacgacagtggcgaagaggccggcgacccgggcgcgttggaatgagcccccaggcccccgccaatttccaatcttttctttttctttcttctttttgtatagatcaacttaatctgcaatcaaaaatgatgaaaaatttctatgttaactttattttgctatacatatgagctgaggatgatttgtgccgtggtccttttgcgccttagcttgaaataagggctcgtgcccaagtcccagtcctcgagtggttcgggtcggggctagtgcctggggagatccacatgtcgagactggccaggccgggaacatggtgaccgaggggtatgggtgacccgattgtgggtttttgccgattcccccccggagttcaccacgccccggggcacggctcggttctgggccccgtttggcgattttagctgaccgaaccgaacccccaagggcaaggttgagtacgagtgaccttattttaagttaagattcttcaaaaggaaagaacagcacagacacaacctttaggaatttgaaactgcttttattgaaatgctgaaataagaaaagtaagactgtgcatgtgtggtagcccccggccaaccctgcacacccgaggggggtgcggggttggcccgagccaaaacctgacacccgaccccccccttcaggggtagaagcgacgaaggtgctcgatgttccacgggttcggcagctcagtgccgtcgcccgtggccagccgtacggagcccggccgggggacgccgattactcgatacggaccctcccacattggtgagagcttgctcaatccagcacgcgtttggacgcggcgtaggacgaggtcgtcgacgcagagtgatcgggcccggacgtggcgctgatggtagcgccgtaggctctgctggtagcgcgcgactcggagggccgcgcgccgccttcgctcttccaagtagtcgaggtcatctctacgaagctgatcttgatcagcctcgcagtacatggtggcccgaggagaccttagggtgagctcggatgggagaaccgcttctgcgccgtagacgaggaagaaaggcgtttccctggtcgctcggcttggtgtggttcggttcgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcacagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttggtgaacttgtcgatcgcaacatacagatactcaaacccgcccggggcccgtttgaacggtcccaggatatcaagcccacagacagcaaatggccatgacagtggtatgatctgcagggcttgggccggctgatggatttgcttggcgtggaactgacacgctctgcatcgccggaccagatcgactgcgtcattgagagctgtcggccagtaaaatccttgacgaaaggccttgccaaccagagtacgcgaggcggaatgggctccgcactcgccctcatggatatcagcaagaagctcaacgccttgttcctgagatatgcacttcaggaggattccgttagccgcgcgccgatagagggtcccttctaccaacacgtagcgtttggaaatgcgttgtacgcgttcactcccttcgcggtcctcaggtagagtcttatctgtaaggtatgtttggatctcagagatccaagcaatcaatctaagggagcttggagcgctcccttcgggtcccgaggcctggactccgacgggcctcgggggccggtcaggcgcatccgtctcccctaagggatcgggtcgcgccgacggctgggtcagcctttcttcaaaggcgcccggtggggtctgggctcgcgaagacgcgagccgtgagagttcgtcggcaatcatattatcccgtctgggcacatgccgaagttctatcccgtcaaaatggcgctccatacgccgtacttggcgcacgtaggcgtccatctgcgggtcagagcaccgatactccttacagacttggttaacaaccagctgagagtcgcctaacaccaggaggcggcggatccccagcccggccgccactctgagtccggcaaggagtccctcgtactctgccatattattagtcgctcgaaagtcgagacggaccaagtatctgaggacgtctccgttcggagaggtcaacgtgacccctgcaccggcgccctggagagacagagaaccgtcgaactgcatcacccagtgggcggtctgaggcagccgagaggggttcgtactggcctcgggtattgagacggtctctggagccggggtccactctgccacaaaatcggcgagggcctggctcttgatagcgtggcgtggttcaaagtgcagatcgaactcagaaagctcgattgcccactttaccactcgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgtgggtatcgggtcttggcgtcccggagggcctcactaacaaagtagacaggccgctgcacctttcggcggggccgatcctcttcgctaggggccgtacccccggggcgttcttcatccaagtggcctctcggggcgcactcgtcttctgtgccgatgacctcggggtcggaggatgaaaggggcggccttccctcagtggcctcggggccgtcctgagggtcgggggctcctggcatcgtcggacaagcgggtaaagggcctactccggtcgtcaggggcctctggcctccgtccggctcgggggcctcttctccctgctttctcccgggtcgagtcaacacagggttagcctcggggccaaagggcgataggtgcggccttcccgcagtggcctcggggccctcctgagggtcgggggcacctagcaccgtctggcaagcgggcagagggccgactccggtcgtcgggggccttaggccaccgttcgactcgggggcctctcctccctgcctgctcccgggccaagtcggcacagagtgggggtgcgcagaatgaggattgtcctcatcgcgctccacaaccaacgctgcactaactacttggggggtcgctgctaagtaaagtagcagggattcatttggatccggggcaactagaaccggaggagagctgagatacgccttcaactgggcgagggcattttcagcttcctccgtccaagtaaacggcccggagcgcttaaggagcttaaacaagggtagcgccttctctcccagccttgatatgaaacgacttagggcggccatgcaaccggtgacgcattgcacatccctaagtttgctgggagggcgcatccgctcgatagctcgaatcttctcggggttggcctcaatgcctcgggcagagaccaaaaacccgagaagcttgcccgcaggtacaccaaacacgcacttatcggggttcagttttatgcgggcagagcggaggttttcaaaagtttccgctagatctgagagtaaggtctcttggttgcgcgtttttacaaccaagtcatcgacatacgcctcaacattacgtcctatttggctacccaaagaaattcgagtagtacgctgaaaagtaggacccgcattctttaacccgaagggcattgatgtataacaataagttcctacgggggtaatgaacgcagttttttcctcatcctccctagccatgcgaatctgatggtaaccagagtatgcatctagaaagcacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggctgtcgcccaaggcaacctccttgaccggtacctcgtcgcatgtggcgatccggtgcctcggggcggtgggggcagaggtgccaagcctctcgtcaccaccctcgggcttgggcgcagcagcgaggcggtcggcgcgctgctccatgcaagcgagcgcgactttaagatcgccatggacagagatggggccaccggggcccggcatcttcatctggaggtaggcgtagtggaccgccgccatgaacttcaccaacgcgggcctccctaggaccgcgttgtagggcagactgaggtccgccacatcgaagctcacccgctccgtgcggaagttggcgggtccaccgaaggtgaccggtaggtcgatgtgacctgatggccacgtgtgccccggcgtcacaccgatgatcggttgagacggctggagcaccatccccggggccttgatagcatcaaaggccgcgggggaaaggatgttgagagccgctcctccatctatgaggacacgccccaacttcacgttgcagatggtgggggaaactaccatcgcaacctgccctccccgggcaatgcacggtgggtggtcggtctggtcgaaagtgagagcaacctccgaccaccgcgcccgacgcatcgcctcatgagtaggagccatggccagcagctctcgcttcatagccttgaagctccggcgagagatgtgagcacacgctcctccatcgacggtggcaatggtggccccaggttcttggaaacctaggtcatcatcaccatcatcgatgccaacagcgggggccttctgcttggcctcacttcgccgtttgccggaaggaaccgccggggacttgccctcacggcgttcctgcctcctgtcctcctcccacttcctcgttcgctcagccagatttttgactgcacgacagtccgcgagatcgtggagggaggtgttgtggacggagcaccacctgccggcggggcgctccctgctgggagtaccagcctctttctttttgtcgctcgcaggcctcccctttcgagtggcccgcgaagcgccctcgacggcgaggacatgaccctcgtcgccggaacggtccgacctcttcttcctcctcctgtcacgccgccctgtctgagcggcggatccgggggcggccgaagctgccactccggaaccggaggagttccatgtccacgcttcctccttacgagccactcggtccgcgagctgaaaaagctccgcggtggtctggggctctttggaagcgatcttttcgagcatgcggttgtgtcgcacgccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgtggatatgtgccttggaagttcatggtgaactgttggcacagatcctcccaggagtggaccgacgcgggtggcaagttcatcagccaaccccgcgcctgtccctttagggccatgggaaagaaattcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccgacaccaccagccgggggcacggagggctgatcctcacgtccatgtcgaggtgacactctggacgaggaggcgccctccgttgcacggggagtacgccggctattacgccggcgctcgatgttgaggcgggcatccggctccccatgctgatcctcccgagtcgagggtgtcgacgagggagtggcagccgaatgccgtgcagccgccgccgctcgctgcgccctccgccttgacgacacggagccggtggtagcggcgccggaggtcttggtggtggcggaccgtccaccagcacccaggcgctgctgtgccgtcatgaccaagttggccacgtcttccagccatcgctgggctggagactcagggtcatggacgacgggcgggtgacgtaggagcgcgccagcagcctgaagcgcaccctgaggcgtgctgccgtcgccgtagacgaggaggcgacgctccccatctcgctgttcccctgcatcacctgcgactggtgatgctgcggatttattcaccctctcgagcgcctccccctgcttaggactttggtgtggaggtgggggagtacgagctcgacgacgtgggtttggctctccgtcgtcgccgctcacactcggagagaggtcgtgcgcctttgcttgctcggccattaggctgaacaagggaagcttggcggacacggaagagtatgagagctcagaaaacacacgctgagccccctacctggcgcgccagatgacggagctcgtggctcctcaccgggagaccgcgcaggcccccctttgccggttcggccgggggcttagggtgagatctcaagctctcgctgtgtgtggaaagatcgtccgcccgcaagacacacgagacacggcgatgtatacaggttcgggccgctgcgaagcgtaataccctactcctgtgttttggtggatctgtgtatgaaagaactacaaagtgtgagccgacctctcccttgttctaggctctgaatctggaaagaatcatcccccttctctatgggcaaggtcctccttttatacttcaaggggataccacatgcacccttctctttccaaactggacttttcttctctttatggacggggctgcaggaatt

SEQ ID NO: 26909 - DNA, 4118 bp, Oryza sativa
ccccccctcgggggaaatcaggaggagggcggacacctcaccctcgggcccgacgtccccgaaggtgccaggccacgtgggcgattgtgtctgcctcaagcctctggtcatgatactcccggtcccatatcaccgacacaacttataatatgaaacggaggaagtagtagtcatttgttttttcaaaatgaatgcacaggcaaatatgaagtggaaaacataactcgcaattttttttagatggtgcacaaatattatattaaactagatgggtactccacgcgttacagcaggagaattgtgtgataatatagtagatatgagttctctttcttacctactatacgatttttttcatgtgtttatatattttgtaactttataattatcctaaggatataaatggtttggttgtatggtgtgccttttgggggaagagatgcaatttacactcttgatgaatcatccaaaggctaaaaacaattgaggtgatgtggcttcatgagagaagagagaattagcattaactacacttagtggggatgaactttatagatatataggacaagacaaaaaaattacaatacaagaaaaattttatctctttcttccatattccctttttatagaagaaaaagatattgagattcattccacttttacccccgaactatttaattggaatgtttaaccctctaaactatttttttctcattttatatcccaaactattaaaaacggttcacttcacttccctaacgctactatttttttctctatataagccgtattttgcactttggcaaaataagatatgttcacaacaaacaaaaaattaagtctgatttaaacataaaatttcaaacaaacaaccatgaaaatatttttaaaaataaaactttgataatatagccatatatggctctaacaaatttcatataaaaaacaactttaataaagagcaattaaaaaagagaaatgttcttatgaagtaaaatgaaccactttcaatagtttataggtaaaatgagaaaaaaaatactagtctgtccaaaaaaagctaaactctggcttgtgtccaggttcatagctaggattagacttttttttgggacggaggggatagttaggaagttgagtgattctttgaattagttcagagaagtaaaatggactttttttttctcaaattttctaatatcacactaactacatgcggggtggggttcttttatattttttgaggaacttttttgtaatgtgttttttttatcgtttccatggtatattttacccagtaatagcaaatgatttttaccgtttccatggtatatttacctagtagtagcaaacaagcctgccagatcttgcggccaggtaaatagtattaaaagtatattgaatcctaaacataggcataaaacttttgtccatcgcagtctaaccatttaagaaaatttgaacagccataataatcaaccggaatagctactgagtaattctccttgtgttcgctcacataggatatcagagcatcactcatatttttttgaactcttaggtctcctttggaatgtatgattgtgaaaatataggaacaggaaaaatattgataagagtgtcatacctattgaattcctatagcaaattaaaacaaagagaaaaacatgaggacaaacgcaaacatgaagaaagttctgaaactatcgtttggatgatatataggaaaaacgctggaactttgtgtcattgggagagaaaaacatgaagaacctcatgctagactcctccaaaattcatagttcaaatccataagaattttgaaggaatttgagagagcttttactttgttccaaaggaccatatatgattttttttctcaggaaccaaatcctccaaaattccttgttttcccttcattccaaaggagcccttaataatgaattcatacgattgtgtgatccgccaatttgtactccctccatttcacattatatgaagatttggtattttcatccctcgtctagattcactaatattcacataaatttgaactgaaacacatacatggatctatgtatgaatctattcaaaacccaaaatgacttataatgcaaaataagtagcagtttgttctattatggcatcgggtatgatgatgaatattagatgtggaatttcaaacccattctcaagcaatggcgatcaataggaggaattccttacctattctgaccatctttttcagatggattctaaccctcttcattgcacaaaagttagccttccatctggccaaaagaaatagagaagtttgcttgtcatataataaacagtggggaaattaaatcaccaaaccagcattctgcttgaagcggggtcatcattattccctatttcacagcatacgggataacatcacattgccttgggaaaatacctcatatactgatcatgttctcatagaacaagtctaacaactgaatcaacatctttctctctctaaaaaatcaacatcatatcaaacagagaatgtgcaagagaactctacaagactgcaagggacacatcgaacatggtaacaagatcgtggtaacaaaatgaactaatcggtataaccggtaaatacattatgatagttctgtccaactgctatccatgggaaaaaaatgtatggcacaatttacatcttagtcccgtaaaaatatgtttggtgttagactgaattaattagccttgtcatgaataaggagcatcagaattcagaagagtcttgtaaatgcacaacaatctgcatcaatattttatcatgttccctggtttatcttttgaacagaagatggggaacattgtcacaaagtgctcaggaaataacctgcataacagaaaacggttaatcccataatattatactccctctatttctaaatatttgacaccgttgactttttagcacatgtttgaccgttcgtcttattcaaaaacttttgttaaatatgtaaaactatacttatacatataagtatatttaacaatgaatcaaataataggaaaataattaataattacttaaatttttttaataagatgaacggtcaaacatatttaaaaaagtcaacggtgtcaaatatttagaaacggagggagtattagtataggagaaaagccaaagaaataaggaatatataacttacaaaagttcattctgcaacttgatgcataaagcagggcatagcagtcctcaacatggataagggctttcatccaataaaaatagaaatgagactgcactgcatgatatgaaattggaactagcgcgccacagaggaaacccaagccctaactcccattctttctttctttctttttgaatcaactttccattctttggaggtttgcgcatcctaagttttgtcaagagtctttctattctatcaaaattacgaattttccactgaaaacactaccatgaaccataataaactcgtggctcataattatcatgatacaagtcgtccacataaaactccaccaaatatcaaagcgccaaaccacttattggacacaaatctgcagagtaccaacagagctaagtgagttaataatctcatagatatacaaaagaatgaacacatttcggttcaatgtaaaaacacatacttcctgttgcaatccaggcggtcagataaatcaacagttgaaatctgccatgctaactgcgcagatgcagcagctagaaaaggatagtaaggccatgctgtccaacatgagtaaagtttgcagtcaatatcatgtatgccaataaatatttgttaaacaaggcattatgataacattcaccaaccaaggtcagcactgtagccactgagtgctaagctgccaatgcatgcaacaccgaagccactaatccagtgttttgttaaatctccaaaccttaatgctgtggacttgacccctactttgaggtcatcttctttgtcctagcatatatttggataagaaattacgttatctactaagatgttatcactaaggtaaaacatcaaaaaaaaaaaccattagtacctgatgtgcatatatggtatcatatacgagtgtccagcatataccagcggtat

SEQ ID NO: 26910 - DNA, 4903 bp, Oryza sativa
tcgggggaggcggaggaggaggtagagaggggagagtagatcgagaaggtcgcggggagcaggatccccctgccgacgtaggaggaagacgagacgcgcggaggcggaggcggaggcggccagcttcgacggcggcggcatagcggaggcggaggcggagcgaagtatggggcgacgggactggggccgtcggggcaggattccggggtggtcggtggaggcggcgagagagcggagagtaagagtgggagcggggcgcggcggtggcggcggaggaggtcggcggcggcggctgctcggagtagagccatgggcttgtttggaaaaggaaaaaaaaaaactagggaaaattttcggatctacaagggtttccccacttgccaagtgacaggagacagagagagagaaaagaactgaagaagaacaacaagctcaccagggagatctcaccggagtgggagatgaactagagtctagaggcggttgcggcatcgatggtgggcggctctgtggttgaggttttgatgggagatggccgtgccgtcgagggttggccaacgccgtcgcggcaccggcggagacagaggccaacgccggagacggaggcagtcgcagctataccgggccaaacgggcggcccggctcagcccggcccgttaggcacggcttctgtagcgggccggcacggacccatcaatggcccatggacctagtcagcccgttggcacggtcggcccgaagtgaggctgggctgctggggagcgcggcacaggcggaaaatggaggcgggagtggctcagcgcctcagcgggcgggcgcgcgggggaccgcgagacgcacggtctcatggaggacagcgattgcacaggatactacccccaccagggagtgtattgggcatgttcctagctcccaatatttaattttagtagcatttctatatgatcgctgctcgataattctttcgcatagactgaaggttgattcggaggataccgaagatacgggcaccgtcaacacatcccgtgctagttttgaaagcacaggatatgacatcttgtgatcgttccaccatcgagtagatgattcatggttgatagcgtcgctatccaaatagttggacacttcttcaacgggaccatgcgatctagcgtcaccatttggtgctgacgaactactacaccgccatggctagaagatgagccaccccaaattctgctccactgtaactttttcttacctgctgcaggggctggtgggggtctttgcaaatgaactccttgaaactttaattcatacttcccaaatacctcataaaattagttttaacatcagaataataggaataatcaatattaattatctccaataattgatagaatattgaggaatccccgtaattttcccctagaatcaagaataaatgcaaaagcgtaaaacatggggggatgtttttccaatatttaagatatttttgtttcatactagagactgcggacattaaaagttcaccattttcatactctttcaacagagtggcaatttcaagaatattatgcaaaattaaattagttgctggatgatatacttgagataaaagaagagtacagttatgaaatgtttcaagaaattgattgaacctttcaattcgacaatatgccaagtacggtcaattggtattgcctggctgtccctgtttgttggtctattacatgttgaagaaaaacagtaagtaattatcctttaacatataataagtggcattccgtcgatgttccgcatcggttataaacttacgtcggggcttattcgatgcacgacaatacctttttcgttgtgcaatccgtgggtttgaagcagttaaccacgtgattgcttgacgaacggtgtcgatgggtacattcactctcttaaaaccacatttaacaattagattaataatatggcatgcacaacgatgatgcagaagaaatgatttagcataaacacaaaataagggttgcagaatttgcatggccctagaagagatgcactattagttgttacagcaaagatgttatctacaaggctatactcattaataacctctcgaattctctctactatattttcatcagtatgtgcaacatcaattgaccttagcccaagaactattttttgcatttgtcagtcatcataaatgaaatgtacaactacactaaggtaatcctctttacccctactactccatatgtttgtggtgacattaacagaaaagttgcatgtactaaataattccttcagtgattcacaacctttgtcatagacattttttaaatcacgggttgtggtttgtctactaacagcttaaaacctaggattatgagaagttttgatgtaattttcaaatgcagcactctcaccaaagttcaaggataaatcgtgtctagcaattaaacggacaagagattctcgagctactataggatcgttctcccatgtacgtaaccgtaccatcaggatttagtagcagttgctgctgtcatagttggattcattgcttctttacacaagcctaagcatgttgcttcaagtgtattgttccaccaattgattttgcagatattttttgcatattctacatttcgcgaatgttacctgccttccaaacgccggaagttcttgatctctttgagctggtgttcgtcgatgcactcccgcgcatagtaccaaatccttctaaacccgccggtacctcctcggctcctccacagctggtggtgttggagccaacctggtcgcatcatactcaccaggtgggatgatcccgacaagtaattagggtcgaaaaatcaccaaacgtgaacgacggaaggttcggatcgtccattctgaaatgttaaaacaacgtgaacaaattttcagaatatttattcacataaaataaataaagggttaattagatctataccactgtaactttgacgattttgaaatatgccattactattcatctatttgaaggcatgccattataattctatagttatttgaaatatgccactacttaccctttcaatgtattttcttaaacttttagactaaattacccttgtcttcttcctccatctcttcttctccaacatatgcatcccctttcttcacccagtgataccgacctgccggtgcactgatgcatgctctctgcgcgagccccttcctgcggggcgttttcacacgttgggccgttggcgtgtagggtgacagactagagctgaaaatggtaaaagttgcaatggcatggatctaattaaccctaaaataaaatacaaacaatacagaagtatgaatattatggtgtacttctttattaccagttaccaccttggctttacagctctggtgtgcactattttttatttctgacaaaaattttgactaaacaaaaagacgaactagcacacaaaagagcacaagaaagcataaattgagaggtttggatgatctagaatgctaaaaagaaatttcatatttttatttttttttcatgctgcaacggctactcctcaaatatagccgttggctagttggcctagccgttgcaaacactggacaggacacgtggcgccatagtattggctggcgagtggcgacgcactgagctgtacgcgcgggcgcggcgctgtacggcactcctcgcctccctgcccggccctgccctccaccgcttgacgatgccatgcggcacacgctctcgctcccgccgtcccgctcccacgtggccacgtcctgctcccgtgtggccacgttgcgcgtgctcgcgtcctcctgccccaccgctgactggctggctgaccgtgccgcccgtgtccatgggtggtgccgtgttggcccatgggctgaggcgctggcccagacacgggatgggagaatgggccgtgccggcatggcccacatgctacatgtattgctaggacggggcctacaatagtaatgtcgtgattgggtcagcccggcttggcacgacccatttggcaagttatagtcgtagcgaagagtgccatatgagccggctgacggcgcttcgtgctactgtctactcctcgagagaataaagtttgaaagagtaaatttcgtaaaaccatacatacttatgaggacatagctataggttttttaatctaaaagttacataaaatttcacatttattaaaatattgattaatttcagtatatgtagaacattttttttacaaaaatagtgaagagttaaactaaaaacttaataattgaaattttttatacactgtagattgaattttaagtaaatttcatgctcaaactcataagggtgggggtggggattttaacaactttacaatcatatacctaagcgtaatgcctcataagttatatctagaacattttttacaaaaatagtgaagagttaaactaaaaacttaataattgaaattttatatacactgtagattgaattttaggtaaatttcatgctcaaactcataagggtgggggtggggtttttaacaactttagaatcatatacctaagcgtaatgcgtcataagttatacactactacaaaaatcgtttttctgtacgaggggatcggtaggttccatgcgggccgcttgtggcggcgcctgcaaaaaccgcccccccggggcgggttgattagccgcatgcgaagatccattatcgcatgcggctggttaagacagccgcatgcgatgatcggccatatatgctcctccaggcccgagcttgaccatttgaaaacgaagctttctctctcctaaagcaagcaccaattagggggggaggttttcaactcgaaatttttacttgaactctatacgaaaggtgaagaactctctatcttgcttcatttggctccatttttg

SEQ ID NO: 26911 - DNA, 4583 bp, Oryza sativa
gccgcatgcgaaaataggcccattatcgcatgcggctgtcctaagcagccgcatgcgataatggatcttcgcatgcggctggcttaagggaccgcatgcgatgatcggccatatatgctcctccaggcccgagcttgaccatttgaaaacgaagctttctctctcctaaagcaagcaccaattagggggggaggttttcaactcgaaatttttacttgaactctatacgaaaggtgaagaactctctatcttgcttcatttggctccatttttgttatatttcgttggtggaaagtggagtttttttaatattttgacaaggtttgttccaactattttttgcaaaatctagcttcaaaatatatgttttgatgggcaaattttgcatgtaatcaattgtacatactagttacatgtattgttgtattttttttgggagacaaatgcatttaaacttttgtatgaaatacctgcggtctatttttttatctgtaacttttttgcctttatataattagatggatcggtcgtcatggatgtatgagatgcggagaacgcagccgatatttattaaggaagcatctaaatttattgatcaggctaaggagcatgctttgagggagaatatgacaaagatcttttgtccgtgccgtcattgcaagaatcagaaattgttggtagatcctggtgaaatattgggtcacataatggagtacggattcaccgccaactacaaggtttggacctatcacggggaattcgccaatccggaagatgacgatgaagagttaagtttcgagatgaatgaggcagagaattttataatcgaagacatgtcgcgtgaaagaatgattgtcgatgtttccaccgatagtgatgatttcgatggtggttttgatttagaggatatgctacgccatgttgaaccagaggtgctagcgggcaggtcacgaggattggagaattggcaagcattagagaaggcatcgaaggatcttctttacgatgaaacgaagggatgtgataaggatttcacagtcttgcgttcagtgcttgaacttctgagattgaaggctaaacatggatggtcggacacaagttttaatgatctgatgagtttgttgcgtgtgttgcttcctaagcctaactttgtaccatcgaacacgtatcaagcgaagaaactcatatgtcctttatctcttggtgtagaaaagattcatgcttgtaagaatcactgcatattataccgtaaagaatatgcggaattggaatgttgcccaatgtgtggcacaagtcggtataaaacggggaatgggcccgtagattcagagtgtaccgatccagattctgataagggtaagcgcgggaagattccttcaatggtgatgtggtacctaccaattaaggaccgcctgaagcgtctgtactcaaacccgactgatgctgagttgatgagatggcatcaagagagccggaaaatagatggtatgattcgacatcccgccgacgctcgccagtggaagacatttgatgcaaaacacccagaatttgctaaggatcctaggaatgtaaggtttgcgttgagcactgatggaatgaacccgtttggtgacttaagcagctcgcacagcacatggccagtccttctcacaatgtataatcttccaacatggatatgtcagaaacgaaagtacattctactcactatcctcatacaaggtccaaaccaacctggaatcgacatagatgttttccttgagcctttgatggaggacatggaggagctttggaaagaggggttacgactatgggatgagtttaagcgggagcacttcaatctacgtgcaatcatattcgttaccatcaatgacctacctgcaaacttttcattatctgggcagattaaagggaagactggatgtctgatatgtctggagaaaacttcatacaaatacctgacgtcgtctttgaagacagtgtacatgcgacatcgacggttcctaccacaaagacataggtaccgtaagatggctagattgttcgataatacagtggagaatgacactgccccagtagcaagaggtggtacatacgtgtatgagataacaaagaagattaaggttgtatatggaaagggaaagaagaagacagtaaagaggaagaaagctgatggtgacaacggtactgcgtcgcctttcaagaagcactcaattttctttaaatacttagattactggaaggacctagagattcgacatgcaattgatgttatgcacctcgagaagaacgtgtttgatagcaccgttggcacattgctggacatcccgagtaaaacgaaggatggattgaagtcacgtaacgaccttgtagatttgtccatacggcatgaccttcacccagtactgctgccaaataggaagaccgagattcctcctgcttgttactcgttgacacttgatgagaaaaaagccttctgtaaatgtttacaaggggttagagtgcctactggtttcgcatcgaacatcaggaagctagtatcaataaaggatttgtccatttcgggatacaatgcgcatgactgtcataggttgctaacagtgttcctaccaattgctataagggcagtcaaaccagtccatacaaaggtggttataacaaagttgtgctactttttcaatcgaatttcgcaaaaagtatttgatcctttggaattaggtccgcttcagacatttgccgtcgagactgtatgccagcttgagatgtatttcccaccatcatttttagatatgatggagcatttgatcgttcacatcgtccctcagattattgaacttggtccattatacttacatcagatgtgggcctatgagcgttacatgtcgatcctcaaaggctatgtacgcaatcgcgctcacccggaaggatcaatgatagagggatacacaactgaagaggcagtcgagtgttgtatggactacataaaggatgctaatgctattggcattcctgttcatcgacatgaaggtagattgtctggaaggggtactgttggtaggaagcagttcttcgataatgattacaaaaaggtgtccgcggcacacaacagcgttcttcaacagctcgctatcgttgagccattcattgagcgacacctagaagaaatcaaagcctgcttcccagggcggtccaatgattggatatcaagagagcacaagcgtcgctttcctctgtggttgaaagatctaaacctgccagttggtgattctgtggaggaacttactttacaaagattggcatgtgggccttcaagtattgtcaattcatggcaaggttacgacatcaatggatttaccttgagtacgactacgaaggacatgaaaagcacctcacaaaacagtgggatccgtgtcgaagcgattgacacgagtggagaaaagaggtcgtattatgggaccattcaagaaatatgggaactggactatggcctaaacatccagatccctgtgctccgttgtgaatgggttaaagacacaataggggtttccgttgatgactacgggctaacgatagtcgatcacagtaaaacaggccacaaggatgatccatgggttttagcagagcgtgtggctcaggtgttttatgtgaaggacccttcagatgaaagaaaatctattgtcatatccggaaagcaacagatcgtcggcatcgacaacatcgaagaccccaatgattacaaccagttcgacgatgtaccattgtttactgatcttcctatgcgaattaagaaggttgagagaacaatcgatgaagcaaatatgtcgtacgttcgagcagatggtgttgccaaggttattaagtcatagttatttcgtaacctttagttctcattgtattccaaatgtacgtgcatgaatttaggtcccccttatgttgtaatcattagcaaatgtacgtgcatgaatttaggtcccccttatgttgtaatcattagcatgtaacatttgattacgagttttgagcaattttcatgagttttcttagtgccaaaaacatttggaatgtataattgtggcgaaatattgggaaaaaaatatatatggacagtttacttatagagaaaaaaaaatatgagtttttttggtaaaaagatctttctatgcggctggcttaacagcccgcatggaaagatctttttcgcatgcggccggcttaacagcccgcatggaaagatctttttcgcatgcggccggcgtaacagcccgcatggaaagatctttttcgcatgcggccggcttatgtcgaccgcatggaaagatatttttccatgcggtcccttaagccgcccgcatgcgatgatctgcgcctatatatagggagcgcggggagccaaaattttctaagtcccggctcccgcgaaaccctagccgccaggctgccaaaatttcccaagtcgccatcgccgtcgtccccgccaccgccggctcctccccaaagtcgccccgccccacgccgccgccgccgccgccgccaggacctctcccccctcgccgttgccgtcgctgccgccaggacctctcccccct

SEQ ID NO: 26912 - DNA, 13975 bp, Oryza sativa
tggattgtggattgtttaattgtgcatcgtggattgtgatatgtgcaattgtggattgtttaattttgagaatgtttaattgtggattgttaaatggagatttatgtttaaattgggacttatgtttaaattgggacttatgttaaattgggatttatgtataattgggactttgttaaattgagatttatgtataattgggacttttgttaaattggcagctatgttaaaatgtgacttatgtttaagttgagacttatgttatattgggatttatgtataattgtgatttttgttaaactgagatttatgtataattgtgacttatgttaaattggcacctatgtcaaatggagatttctgtttaattgtgacttatgctaaattgggacctatgttaatttgagatttatgtataattgggacttatgttaaattgagatttatgtataattcggacttatgttaaattgggacttatgtcaaattgagacttatgtgaaattgcgttaaattgggacttacgtaaaattgggacttatgtcaaatttttttacgtcaagttggaagatgtcgaacgaaaaggttccatcgaacgcaccaatagcgcctcaagaaggtaacgctcctcaaaattccggtagcaataagcatccaggcgcttctagtgaagaaacgtggcgcacaccaagtgacccgtttccaatggaaataacacaagtcgccccccgcgatgatgatccggactacatacctatcgaacaggccgtaagtgatgaaaatcgttagccatgtattattccctaactatgatgtgacatgaacttaatggtgtatagagttacctattctgtgcagatggtagtccgacgccgctcgaaacgtaaagccgggaggaacaggacagagcaagaagttgagatggacaccgctacgtctgcacctgaacgtacggagacatctacaagtgcaggcgggagtgggaaaaaaagacgtggtgagagaagcaagaataaattacccaaggaaacttacaacgtgattgctctcgatcaggatgggaagcccatcgagccaccgatagtgcggtccaagttcatcaacgcctgtggcactctagtcaggacgcgttgtcccattaatgtcaagttgtgggaaacagtggacgacaacatcaagacacttctctggaatgagttgcagaagtattttgtgttccctcctggatcagaggtcagggggagagattacgcacttaaaaagatgggagatcgatggcgacagtggaagtccgatctaaatcgggattatgttcagaagaatctcccaccgtttacggattatggacatatatcgcaggctgactgggacacgtttgttgcggatcgtacaacagctgaagcattggctttgaggaaaaaaatgtccgagctcgcgaagaagaacaaatatccccatagattggggtcgagcggatacgctggtcacgtcgatcaatggcgggagatcgagcaaagatttgccgcggccggtaagcccctgctggtagaccccatggttgaacgtagcaagaactaggtttgggcgcgcagcacaggtcaagtctcggatgagggagacatactattcgagactccagacatagaagaagtgactactaatttgcagcagatagtcgagaaagaaagatcaggacagttcgttccacggagggagagagatcagcttactgcggcgttggggacggctgaacactctggacgtgtaaggggtttgtcctcaaagacaagttggaaggtcgggtttccacaagacgcaccaagttataagaagagagacaaatacaaagaacaactatcggacaagatctatgcgcaagtgaaggaacacttctactcgttggcagctgaaaacccgacagcatttccaaggttattccctaatagccagcaacccacacaatccgcacagcaaacaactaatgtacctagcagtgtaggctcagtgcagacaagtaccttccctgtggatagtataactggaccaactccgtgcagtctcgtcgtaccaatcggccgcgctggaaagactaaggaggttgcaacgggtttagcgatacccggacgtcaattccacaacacggcaatccctgaggattacgcaagggtacaggtcgccaaggtccatagcgaccacgtttccttggaactagacatacctgcacctgaggggattgaacttctcggtgatgcagtgaatcagtttatcttgtggcaccgcagagacataatcctgagcgcggccgttcttgcagcaggatcttcaaccccatcctcatcgcaggcaatgactgctgccgctcctgcaccaccgtcgcctcctgaaccaccgtcacctcgacatccgccgtcaccaccaccgcttaggtcaccgcctcgccaacctacaccaccaccctccccttctcaacaaccgcctctcccgaccccgcaaccagttcaagcctctcccacctccccaactaaacagcatgctcccccggctccgccctcagttcaaacctctccacctacaccccaatctgctctggtagaagaagtgcacataccagatggtactacatccgaaccaaagtctaatactttggaacctcgtcgtataattccaaagttgctatcgacatacgacccaaaggagattgacaaggataaggagaagttcatgttttcagctttcaggaattctgagaagagaaaagaacttgctcacgtcttgtcagactcccagaagtcagtactagcggcccaagatgaagtgcaatcctggttatctgccgatgtgcctgaaacttatgagtatggcaagccattctagccaacttatcttatgaacaagctaccatgggaaatgagggtaatgcacgaatggtatatgaaggcatctaggaaaggtctcggtttcataagcgtcgccgtcccggaaggcgctttcatgagtggtcctaatgggatattttttatctctttccaagacctttacgccctctacaagctagataaaatggacgttaatctcgttgcggctttctgtctgtaagtctaaactctttattacatgttgcacgtttcattcgaaacaaataaaccaaatctcatttcttctttattcattgtacagtatgcaattccacgaagctgatagaactggagcaaaggttggatacgtcgatccaacaagaatatgcaaaacacaacacaccgtagagctgagacaggactgcgagcaattggttggcaagaccccggaagaaaaggaagaatatgtgaagacattgcacaagaggaagaagctagaagtagcaacatacttggcaatagcaatgttggcgcacgccgacaaagatgtcttaatggtcccctaccagttcacgtaagctctctcttctttttgtttaattaatttatcttcttcggaattttctgtctccaataagcctatcttatatgtagagaccactacatattattccttgtatatccgaaagaccaattgatcatatcattggaccccgcacactatgacaaggagacatttatggaattcctcactattttgaatttgtaagtgataaacatttcattactataaattgtttaggtcgatcaccagtcttctaactactaataaaacaattgtttccttcaaacagagcacacaagtactaccgcaaaagaggtggaccagtacatattccatcccagaagaagttatccgtcaggactggctggccggtactatcaaatttataccaatacaactaattatcgaatagtacatatatactaaatatatctactgagatcggtccccataattatatcgcagtgctacaaacaaccaccaggaaccaacttgtgtggttattacgtgtgcgagatgctcagagtaaatgggaggtacaaaacaaccagtaaccgagtaggtcatcgaactcttctctacaaagaaacccatctcgcacacacttctcactgagtaccgttttattttcctttctgtgtgcagatccccgaaatcccatatattgcacaacgattcaaccacactactatcttgaacgtggccgctgacctctgccgattcatccgtcgcgatgtctgcaacgcaagaggtctcttctacgacaaccagagtgaactcgcaatggacgacaaatttaaacctctcagagagtgggagaaagaacatatgcaataacatgtacactacttatacatatgatgaaaaaactgtgccacttgtattatatatttgtatgtaaattacgattgaattaatggttatgtattacatgtttgttactgcggcacttgtcttatcttatatgcttactactccgaaatacgataataaatccctcaataatttaatattaattacgaatcaccaaaatgctagaataaatattattttagctattcggaaattgaatttcgcatgcggtctacttaagacgcccgcatgcgaaaatagatcttcgcatgcggtcttcttaggtcaaccgcatgggaaaatatatcttcgcatgcggcttcttatatggaccgcatgcgaagatctattttcgcatgcggccgtcttaagtgaccgcatgcgaagatcaatcttcgcatgcggctgcgacggccgcatgcgcaaatggtgatctttgcagaccatttcgcgcatgcgggccggccaaccgcatgtgaagatcgattccgcccgtatgcaaaaacgctttctgtagtagtgataatacgtgtggttttctaaagagcaaattccataaaatccagaattttaggcatctataactcaaaacctcagtgttttcaatttgtttcatgaaactcaagttttggggcaaagtgttttataaagccccacctacaagcttatatcatccatccatctgagactaagatgtttatctataataattgtaaaagaatgaatgagatatttttttaagtacatattcacgttagcgggtttcaacaaccgttgatcatcgtggtgctatcatttatgtgtatatttaacaaattattatgtcattatcagttaggattatgttgagttttttcattgaaaaactgagaaaaaaaactagataagatgaatatgtactttgagtcaacgaatgtgaatttatgaaaaaaataatcatatataataatgaaatatgagtattttaaataaatatatgttttttaaacattttgcctcgaaatatgggttccttgaaacatatcacaataactagggtttaatgttatggatggcccaataccttggattttgtgaaatttattcttttttaaaattactcaatttaaagtgcattgttcagtggtttttattttgggaatatacgtgctgcaaaaatatttgcaactccatacgagtcgtccatgccgacacgtggggatgacgcggtgagagtgagaccttgcgaaccgggacgttgtgttgagccgttgagaccttgcaaaaatggacgagttcacatgccactcgcgcgaactcaccattggtggtaggacagagctgcaaccctggcgagttcgcgtctagggtcagcgaagtcgcatgcctagcgaattcatttccaagggacacgaaagtcgccagcatgcaaagacgagattgcttgcatgggcaacgaagtggccagcttgcttcgcatgcatgcatgagttaggctgtgatcggaactagaagaacttctagttcccaaccctccctctcgttttccgtacgcatacttttcaaactgctaaacggtacaaaagttgcttaaaaatcaaattaatctattttttaaaaaaattactaatacttaattaatcatgtgctaatggaccgctctgttttccgtgttgaggagatggatttccaaccgtgatgagcgaacacagcataaggctttagcttagctttagcttcctttgtttgtgagatactggagcagtggagatcaatggctgtgtttagttaccttcaaacttccgaaaatcccatcacatcaaatgtttggacatatacaaggagccttaaatgtggaaaaaaaaaccaattgcacagtttgcatgtaaattacgagacgaatcttttgagcctaattacgccatgatttgacaatgtggtgctacagtaaacattttctaatgacggattaatttggcttaataaattcatctcgcaatttataggcggaatctgtaatttattttgttactagtatacgtttaatatttcaaatgtgtgtctgtatagttcaaagaaattttgaaaaggaactaaacacggccaatgtaggtttttgtttgttcgtgatacattcatgcatacaaaactctcttcgcgctagggtcgtgaacttgtaattgccgccgcgcgccgctgccgatatagctgttcgaccaatgtcttcgtgtcactaaccacgattgtggctcactgccgcgttccctcgatgcgagaacgtgcatcatcattccatcacattcttatgccacgatgatagtatatctctgccaattcttttgaagtatgaatattcctgtgaaacccataaaaaaatataggagaccgctatataccatgggatcctgtctagacgggatgacatctacgatgtatcaagttctgatactggcatacttccggtatcatcagtaggaaagaaagccatagagatatgtgtgttgttgctcaagaggaggaagaaaaccaaagcttatatgcaccttgtcgctggcggcaaggacgaagacagagaaggggagagcaaaatatgtatctccgcccaagaggatgaccatcatatattggccatcttgaagaagcaatgtcaccaagcccagtggccttcgccttcttttcgttgtcatagtcgatgtgccaagtacatcgaccttcactatttgctcttgtcaccgtcggtggagcaccaagcccgttagcctccgccgcctccgccctcttgtcttctcatcggaatagaaggaagagaggagagagaatcccttctctgtgcataggagcctactgatgacgtctcctgaggaacctcagcagtgggggcaaagactcctctagactggccaagcggcggtagcacacacgcccccatccgtgcctctcttgtggatatgtgtgtgtgagagagagagagaggcgaatatataacgatcggtgatttggtattaccatggggcctgtaccctctatcacgcgtggaatgggatctcgtggcatcacttgatgctcatagatatcgagtttaatactacctagtagcacctcatactaataggtattaggtctggtactgtgcatgtatcatgtccaatgttctaaatctctggctatggctatagccggagtagccggagatagcggattgggaaggaaatagctaggataaaccaatttcgacgctatgatttatcggctgctaatagccggagatagccactaaaatagccaaatatagctgcacttagcgctggctaaacataagcaaaactgaaaatgggcttttatgtgcatggtccacaaaactcagcccaaaactaaccctaaatcccccactcgtgctctccacctctcccctccccaaattggcagcacaccgtgaccgggagcgatggggcgcttgtgaccggtgttgatattttgtatggtcacagataaaatccgtaagcgcatggaaataccgctgtaccactttacccaggagtattccaaggtatcgattttccattaggaacgtgtgtgttcaacttcttcaagttcatctaagggtgtaacgcgccgcttttcgtgagtcgttaaaaactaattcggcaaaatcctaattgcgaaaatttccgttctttgtgtgcgagtctaagttgttcccgtggatctcaattcaatcccgttgttccctctcatcgaaatcaaaatcctccacctcgaaaattcttcttccgattcaagtctccgaaatccaattccgtccttgaatcccttgccaatattcctctcggtttcgagaataccaaatccccattttgaatcccttcgtcgactcctccctctcatccgaagtccaagtcaaattccaaattcaaattccctccaattcaacttctctgtcaaagtccgttttgcctccctctatttttgtgggccgaattcctctccctcggcccaaccctcctctcagccgtgtccccctcctcttcgcacgtgcgttgcacgcgccccagccgagcagagagagagcggctctctctctctctctctcgctcgctcgctctctcctcttgctcgccctctctctctccgtttctctcccccgtcgaagctcccccaccggcgcagattctcgccgccgccttttcaaatttcgccgcgccctcgcgtcgcgcgcgcgctcgcccgcgcgtggctgaccgcctggtcgccgccgcatcagccctggccgcctgcaccgcgcagccgcccatgccgccctgccctgccactcgctccacctgtgcgcgcgtgcatccaagacgtggaggcagagcctcggctcccctctctcacgcgctctccctcctccctctgctcgtccaaatcggcaaggagctgagctcctttcccctcccctttttgctttttccctcttagcccggccgcccgtgaccacctcctaccgctccttgaccgcaagcgtcgcgccagccgagctcccttgaccacctaagtcggtttcctccccgaaaccgacttcccgtgcctataaaaccacagccgagcccctcctctcaacccctcccgctttactctccacgctgccgcgccattgtcgcccctgccctgcagtcgccctcgtcgtccatcgccaaagcaccagggagaccggtgcgtgcgaaggacgcgagaagaggactccgggcgccgtcatcttccccttccccggcccgaggccggagagctcgctcctgcgccgtcggccgctcgtcacagcgctcgtctcggctcggtagtgcctccctccgttctcccttcgcgcttgccctttccctcctttagctcgctcggtagctcggtagccgtcccgaacgcgcgtagacgaagccccaagccccgccgccgcccggcatggcctcgctgccattgccgcccattccagggagccgccgctcgtcgccggcctccctcggggcccctccgtcccatccaaccctgggaacgagttccccgagtcctagagatgctctagctccgacgaatcgaaccctcgtcgtctcatcgtcgtttccccctttgctcgccgccggttgccgccgccgcgattcgccgtcgccggccaccctccggcgaatccgagccgttggctcactctctcttgtcttcctcgtcgttccggtgtgctccccgtcgcctctcgccgtcgcatggtgtcccggtgaaactgccgccgtccgccgtctattctcggccggcctcctccttcctcccgccggcccgcatggcagccatgaaggcgccacgtcggcgccagctcggctgcgaccgggtcaaaagactggtcggccgcctccctccgtcacatctttcatgcgcctggtccacggagagccctagcggctgcacgtgggcccgctgtctcttggtccacccagtgctcaagccgtgagccgcatccacctccctctcccccgcgccccccctcagttgggccgcctccccgtggccgcgccggcccaatggctcggccgagccgctaaaatcctttgggccgcgcccaagcgcctgagaaagtctgaaattcgcccctccttctttctttttcaaaaagggtttaattaaatccttttcctttgattagaaaatcctttcaaccttagaaaatccatatctcccgatccgtaattccgattgaccccattccacttccaataattctgtaaaattgagatctatctaatggcactattaatttgtctaaatagggtctttcttttggtccttgtttaggttttgattgtttgcgtatagttgcggttaccggattttcttcaatcgtggatttctcgaagattcgtgaagctccgtgaaaaccttgagcaaggcaagtcaccctttgaccaattgctcctataattggaaaatcattattattttgtttgcaacttgcattattagaaccactcacgtttaacttgcttggcctcggtttgcatgccaaaccgatggacctacctagtagtcgcactaattcctgtaggctgtactaccttgactccttgtcgctccacccttgtggtacttcggtatccgtgctctctgagcgcgtataccaaatatcccatatacaccgttgattgtcgaaaacttgggaaatgggtttgagaagccttgaaaacccgacacgtggtgtcggcgtgtttgaaaataaaatagtttgtgaaaactcgcgatgcgggtgccgtgcctacgtggcgttgtcccgtattcacatataaggaccgattcctgtgggaaactcatcgagcataatcaaagtgcaaccacaaggtggaatgggacaccctggctaagtaactagtcggttcagggaaacctcgcatgccaatagttgggaacgccggggcggggtcggttggagccaaaccggcttcctggtaagcaaggaagagaagcttgcagaattaccgatcgaggtggttggagtttgatttgtgaaaactaaaatggcctatatttatgtgaggatttgatccttctatgtggcatgaggtaaccctgggttggctaggaaaaggtcttgtcgcgaatctccctttttccgccgtgcgtcatgaacacgggttcggcaatgggagcaagttcgtgtcttgtgggtaaagtgtacccctctgcagaggttaactaactgttcgaacagccgtgcccacggtcatgggcggatgtgaggtggttcccgttgcgtagatttgattgcttgtgctttgtgaaaagttgttgtggtgtgggaatcgttaccagaatcagcctatgtggcagatagatgacctgagtggtcagaagcgaatctgtgtgattcgggatgtctacgggcatcatagactaggcttcccgagtggaagcagattgttgtgctgctgggcagcaggactctgggagtccgagaaaatgaaaaaagctctgggagccgattaatcaagtgaaatggctccgggagccgagaagtaatgatctgacccgggaggtcggtacattaccatttgagttgttgaaaagcatctcttaagtcggatcgagacgcaagtctccttttcgacccaaacttaaaaaagaaataaatcacttagtgatttcaaaatgatttcaaataaaggatttgcaaaacaaccttgcctctcttccaagcttgcattaaacacctaaattcccgtgacttgcggagtacgaaagtacttatccttgatctatataaatatatatagttcctccgccctgaagttgaagatgaagtaaagtgaagattagggtttcgtcctagttcccagccgtcgcctgtggtgttgggtgttagttcgttggttccgctgctgctgctgctggtgtttccttgtccgtgtcgtctgttgcatttttgggctcttctgagctgcaacctaagttaaggtaaataagtcctctatttattttaaggattgcaatgattcatatttgtcaccgtgggtaccagcactatgtcctgggactggtactgagatcgcggtttcgtaggaagcggttcatgccgtttctcctacgacacgctctagtcaggtgccgttgtacgacggtgccggattggggtgtgacagagggcacagcaaaaatgggcaaaggatagagaggatttcctagtgaaaaacagtgtctacagaaagcttatttaatcctatcgcaatacttcaggcactggctaacccactgcttctagatatcgctctactccgtacccagacagggaggacttcagtgcttctgagggctgtcaccacctctacacccacctcaaatctactgtgggatacgcagcaaataatggtactcaataatatagacaccaaatctacagtatttaatactactctaatgccgatcaaacatcaaagtaaacactatatctaatacacaatattctagtaagcttaatagaaactaactaagagataatcctcacaaagtaaatcttaattactcgataaagatattatcaatttaagcagagtaattgacaaggtacaaaagtaagagaagaattaccgacaacttcaaaattcctctgattcttctaccttaatttctccctattctaatgtccgtaaagaatacaatagagcctcttgtaattcagctcatgcttggtgtgtgttggaatgaagggaaatgagagggtatttataggtggaggtgccttgggagtgtggagatcttccatagcatccaaagagcatcttccttctcccttttgccatgtgaaccttctgatgacggttgagcgccgaaaacagtcacaaccatcattgaggttggtatctaccgaactcaacttgggcctgtgctagcggcctctgttagggttcggccgaactcagggttcgaccaaaccttggccggctccgttggccccgtttttctcctgtacaccgatattggggccctcattctattggtatggtggattgacccatttggaggtgtttaattagttttttggatccaaaactctataagtttggatatgagtttgattctcctcattcttcatgtatattttttctcaacttagatagtttgtcatctgcgtacaaatatacaccaacacttgtggacatttttacaagtataccctactgctatgttagatgttttatactttcagttttatgcaggtattaacggcataaatttgatacttaacagtcgtcatcaaccggaagcggcggcagctcctgccccctagcagcggcggtggctcctccccaagcagcgccagcgacggctcctccttccaagcagcggcggctgctccttagtgctttttccggcagtggatattgcttctctcggcacctggtggcggttgctgcttcttcccagcgacgaatggccactattcaaaaaatgcatgccaagtcaaaaaaatcgggactaaagatacatacctagttacggttgtgcaaccagggcgcacaatccgggactaaagatgcatacaagtaaaaaaaaaaagtgattgaaatcccggttgaaacaaccgggactaaaaatgcatacctagtcaaaaacaaatgtgtgggatatggattcgaaatcaagatctcccacctcagccatcacgcacgttaccatcccacctactacatacatctaacttggatagagatacttcctttttaaactaaccctagaggcatctttagtccgagttagtatcaccaaccggaactaaagatcaatttttagtccaggttggtgttaccaaccgaaactagagatcctccatctttagtcccgattggtatcatcaatcaggactaaaaaataatctttagtcccagttagtaagacaaacccggactaaaaatgcttccagggttcgaggccaacccctgtgaataaatttcaccgtgttaattcaccaatggtatatgtgatcaatttatttcctcatcaggttcaggcccagccaatggtatttgtgattagcttggttccccgtcaggttcagagtaaatttcatcattaattcaccgatggtacatgtgatatctgtgatcagcatagttccccatcacacgaccaaatcttgcgctaaaagtttattactcctatttatcaatcccctatcacacagtataagacatgacctaacttggcacgatattcaaaa

SEQ ID NO: 26913 - DNA, 1407 bp, Oryza sativa
tcaatccatattatactggtcaaaatatactagaagttgaattttaaaaaacttgagctatgggatggatggagtactatatagagattgggcatttactggcttcctggcaactcggtcttgttgccgtcaaatctttttcaaggagaaatctatcatcccattaatctcgaccgggtcaaaaaaaatgcagcaaatgcaactatgcaaccgaagcacgttataggcttgacaatttaaatactgaactgcgatctaatcatctcttcatacagtatgtaaccgagttagtgtgacattcaaaactgatgtactttgaaaacgcaaatttttttgcctaacaaaaaaaaagtatgacattcttaaggggaaagggatgcccaacaaaaccattccaccaatcgagagtgccatgttccagttcatggcaaaagaaaagaccaattcaaaccaccaaactaatgtatcaaaatccaagaggaagataatcctgtcgaactacgccctcccttcttttcagccccagaatctgctgagaagacccttcttctccttcttcattctgttctcaatgtttgggaactcgatcgcattgtaggccatatcaagaacaataggattacacggaactgattggaatggaggtgggaatcgtgcaatgcgacatggtgttttggtatttgattcaccgagtgctgattcatagctttctagcatatcaagaaggaaagcctgctgcaaaataccagtatatcatcaaaatctgtttgaagatgttctataccagaactttctttcaattgcaatgatccatggggtaataaaatacacaacataaagtgctacaaaatattaacttaacttgcaaatctagcctacttaaacttaacgaacaataacatcctaagacattcttaacccttcacatgcatgcagaagacattcttattctaataattgtacagaacagcaccaacagaagcttgtcatgtcaagcatctaattgttagtccctcaatccacagatattgcttcagaacattagaaacttgaagtataaattattaattgtttttaaatatttaaattgatgcatgaaaaatatgtgtggattcttcttgacaagtataaattattaattgttttcttgtccatcaggattatgcataaattacaatggacacactggtttatgactttatgttgcattttatggatcatgtcggtgttcaaacatgtatttgtggctttagagagtaactgtcaagtacatctcatctttgcgatctagatatctgtttaaatatttaaattgatgcatgaaaaatatgtgtggattcttcttgacaagtatttgtccatcaggattatgcataaattacaatggacacactggtttatgacttt

SEQ ID NO: 26914 - DNA, 1867 bp, Oryza sativa
atggattaattatgctcaaaagattcgtctcacggttatgaaattagtttttttcatttgtgtccaaaaaccccttccgataccctgtcaaatatctgatgtggcaaaaaaaaattcttttcacgaattaaactagcccttagaaggtaatttttttttaaagaaatgaataacttgaggttggagccttggacacggtgtgaactcccaagtacgaaagtctagtttgcctgcgtcattgtagtgcatatacgcaatgaggcagccctcaattccgccgcatcttttgttggtcaaaggatgggtaattgtatgcggccgccttttttccgtggtagatgttctacttctcatgcctcagctgcatttctggagcaaaggacctgacagttcgatcgagcgagctagcggctctgattgtttgataaatcgtaggaaatacaaactaatcaaataaaaaagatttatacgataaaacttagcgatttaaattgagttctgaaaaacaaactacgatgaatttttttttaaaaatcaagatgcagatgaacaggagttcgagagtttgaacttcgagtagctagcaaagtcaatctgaacagagtgcacggtagattcgaccttttcttatacggtgaagctcaattttgggtagatattttattcgtctctttactagtgataaaataagatctaggcaacgcaggtgacaaaaacaactaaaaactaattacgaaatcaaactataagaaaaattaaaatcaacttgttgaactttatgggaaaagctggtcatgtgatagtgagttgtaggtaataagttcaaatccataaaatcaagatatacctctaggatctctcttttctaatatgtgttaggagacgaattcataaaagtgttgtattgcttgtatatttgtgtatgtgcatgtgtaacaataattaccactttggttatggatgaacggtaaaattcaaacaaattttataaaacaaatacatttcagtttgattttattacctgtttaccaagcaatttctagattcctaccggcttgtctgatcaccatgatgactgaggctgtgttctttgctcctagtcccaactcctctcccttgtttctatacaaaagttgcttaaaatatcataatgatccatttttttaaaaaaatagctaatacttatttaatcacgtatcaatagactactcctttttcgtgtggaggagttttgttcccatccacccaaaactaacacagcctgagcagttaagatgactagccccaacgtttggcatattgaagaaaaaagcaaaacgatatatttacaaatgaaaaataatttatgaataaaacttttatctacgtgttcttaatgatctaaaagcaaagaataaaaaataaactacactgagaaaaccccaaactctaaattttaaaatttaaattttggctaataagtataagcataactgtataagcaaaatgatgatgcttgacatttgccatccgtaccgtgatcctccttttactgctcaccaagaacgagttttaacacaaattaagattgatagaaaatgatgtgattgattaagcttataaagttaaaataaaatgtttataataaagtagtataagacggcctcgacctcttggtgacggccttgatggaggcattggaccttgtagtcaactcagtacatggcattttgcggcgagcaacgtcgacgacttgatggaggtttagacaagtcggagtcaaaagaaacggactcgataggcaaaaaggactgccatgattatgattggagtccctggcaaagtttggccgagttcaactaactcacacctaatttctgaacaaggc

SEQ ID NO: 26915 - DNA, 1155 bp, Oryza sativa
agtattggacttgtccttcaacagtctttctggtgagattccaccagacattggtaacctatcatcacttctccttttgatacttgctgggaaccaaatttcaggtgagatcccaagggagataggaaattgtaccagcttagtttggcttaaccttgctggaaaccagctaatggggcaaatcccaccagagatggcaaatatagggagcaatccaagcccaacattcatggagaatcgaaagaacccagaacttttggaatctatcaccagcaaatgtgtcgctgtagagtggcttccatcaagttatccagaattcaactttgttcagtccctgatgatgtctcagaagaactgccaaaccatatggaatcgactcgccatggggtatgacgtacttccaatatcttcaccactgcgaacagcattaggatatgttcagttgtcaggaaatctgctgtctggagagataccatctgctattggtacaatgaagaacttcagtttgctccttcttgatggaaaccgactctctggacacctaccagcagagattggtcatcttcaacttgttgctttgaatatctcaagcaattttatttctggtgaaattccctctgagattggtcatatggtaacacttgaaagccttgatctgtcaagtaataacttctctggtgcactcccatcaaaccttaaccaactcactaaactgagtaggttcaatttgtcatacaatccgcttctctcagggaatgttccaagcagtgggcagctctccacctttgatgagcaatcttttctgggagatccactgttgtctttgaatgtaacagcaggttccagttctgattctagtccaagggagttctcatcatctgacacagaggagcatcctacaaacgaagagatcatggtgacaacaattgcattccttgcattcttttcagtcacattgcttaccagagaatttcatatcttcatgtacttgtacttcacagcatcacggaaaattgccaactgtaggattatttgcacctgagtgctagataagttaaatcacttaatagaacaaatacctttgaaaagcgaatgtgtccctttatgttccatttctgatttcaaatataaatatttactagacaatatggcatg

SEQ ID NO: 26916 - DNA, 2329 bp, Oryza sativa
aaaaggtagggggtctcacacgtaagaaatctgccagcttgttttggggaggtgggggtggattctggttctgattgtttgcctgctgattctgtgcctgctgcactatcagattgatcagttgtgtttgttgggccagaatctgagctggcgtgggatctcctccattgttagtagctccacttccacttccacttccacttccagtgccagtgcgcgtgttcaccatctgacgataagcagagacaacaggaaagaacgacagagagacacccttagaacggagttatttatttaatttaaattctatattgctcttaactgtgtatgattacatttaagttgcattaacactatctcaccaactatcttacactctgacaagcaaaagaactagactcatgctgttacatcccaccaatgatgtaagcaacaactaaaacccacacactcacaagcaaacttaaacaagcaatctaacacagcgaactacggcaacgatctaactaagcgactaattccgccttgcgtcggaacgaagcgatggatcttcttcctctggagtagctggctctctttcttcaggatcttcctcttcttcctcatcacttatgatgtcgatgacaggttcagcacgatcgggcacaacttcaccccttacgcgaatcttcgaagctaactggagacgaggtggcggacaggttctctttcttgcggtgaggcgaagcttgggtgttggcggcggcgtttctcctttaagttcagctaattccttctgtagacggtacaccttgctctccaacttgcaaatcttgcctcgattccagttttccctgtcatgagctgctttgtctcgctccacacttactgcatccatagcactaagcatatgcaccgcatgcatcagagtggcactctcttcaccatcaggacaggtataggttccatagtcttgtccatgaggcttgtgaggatgatactggaaagctgatgaatccaactcttcttcaaagcgttgacgcaactctccaatggccaccaaagctgcttcttgacaagcatggctgtacgatcttcctccagcttcgaacttaatggacggaaggtcttcacgatcactagccaacgtcacacgaacacgacacttctcctcgtcggggtcatgggaaatttggcgatactcgggagcaacttcatatcctacctcaaaagccatcaacctcagctccctgacgaatcctaacaccttgaacaaatttctcggtgaatggggcggcatctaaagaaacatagaagagaagaattaatgcacatttttaagttagctgtaccaactagacttaactgatttaggccaaaaaggaagaaaataaaaagaaaagacacatacaaagctattttttttctttttgaatttaacttttaaacagagacaaatcagtttgaacaagtgaataaaataaaaccaaaatacctaagacctactataagcacagtacaatgtcaccattaaaagggatgagtagtactagtgccaacatgattaaatcgataccataatagatgtacagtgccgactaatcaataagatttggtaaagagaaaaagaaacattctgagaagaacaacttttgcttttataagaaaagaaattgaattaaataattttttttgcataaccttgcatgtgctgccaacttaattaatttataagagaatagagaagagcagttctatttttttcaaaatattttgaaggctacttaaggtttaccatttggcttatcctaaggtcaaggtggctctgataccaacttgtcacgcccggaatttctatccaaaattccaaacgcttacatgtgtgttaaaccctcgtccaggaatcaaccgaggcacacaatgacaatttgataatagagtacaaataaataactatttaatactcgcaaataaaaattattacagaggtagatagttcctctcaaagaataacattctacgcagcggaaatataaaacgataacaaactacggaacagctatggcgactccactccacaggcatcttaaccaagaacaagcctaatcctccagatcatcaccttcactgagatactcctcttctggtgaatgaatattgcaagaatgagcatatgacatactcaacaagtcacacagcaaatatgcaagtgcacgggataacaaaggatggcataatatagcatatttgcagaaacagcatttaataaatatttaagagaatagtaaaaacagttgaataattaatcaatattaaataaacaccatacaacatacccatgttgcatagg

SEQ ID NO: 26917 - DNA, 643 bp, Oryza sativa
cgacgagtcctcctccttccagccttgcctcggagctgcgatgggtcaggaatattgagtacttcatcgttagtctctgtgaactccccagctatgccgaacccataaatctcgccgctccatgtatgatatattacttgcttactgaagtactgtgacacatatactgcatctggtatgccacactccgctgcggcagcaatgacatgggtgcatggcctgtggagcagcttcggctttgcacaagagcaatgacatgtgccgtcggctttgagaacacactcctgcttcactctcttgcggtagatacccctgcctgccttatcttgacatagtatctcaaacctgtgctgttgggtaccttgcactacagctcgatgtttcatggcctttttacgcaactcctctagctttttctgcatgaaagctccaaacaaaatgctgttgttcggcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcataattccatatctagcaccacctgtgtcatacgccttggcccatttctctt

SEQ ID NO: 26918 - DNA, 2781 bp, Oryza sativa
  unsure (1)..(2781): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagggaagccaagtgtgaccgaagatgacctagttggcctaacctacttaaagctcgtcatcaaggaaaccctaagactgcaccccgccgcaccaatgcttgtcccaagggagtgtggggagtcgtgcaaggtgctagggtacgacgtgcccaggggcactaacgtgctcatcaacgcgtgggcgattggcagagaccccaattactgggatgacacggagacgttcaaaccagataggtgtgagaataacaagtataactttagaggcaccgatttcgagtacataccgtttggatctagacgaaagatctgccctggtccggcgttcacacatgccatcttggagctcgcgctcgccgctttgctgtaccactttgactgggagctcccctgcggagttgctccaggggaggtggatatggccgaggagacaggcgtcgtcgttcgcccgaagaacgacctctacctgcgtccggtcgtccgtgtgccgccgggagctgcctcgagcggcaatggtggcacctagccgtgcaccgcatctactacctagccttaattatgtgaaaatgtaacctggttggatcgaatggattaagtgctaaataaaatggtttatgtgttcatgtttgtttgtgttcgtcacatgtcacatgcataagagagagaatcagactatcagagaaggcgaggtccagaagcaggatcaatgttatgcaccttgcaatgtcgatagcaattggcattagtcctaaactgctcagtcatcgtgcaggatattggtgcaggtatcccatagagtcatactctggttctgtaatcaccaggcattcagaaatcaaaaccgtgaaaactaaagacaggcatattcatgctccacataattctccaagaagaaatttggataaaaatattgatataaatttttaaaagtacggaacaatggaaactttcatctgataagcattcttttatcggaataaatatatcagtggatacgtacgatacaatgaacagatcctctcatgctttgtataaattgtattacatgctactacaatacagtgaacaggtcctttcatactttgaattacatgctacaatacatctcaccatactttacatacaatcaatggtctgagagaagggtcaagcactcaagcttcctggtgcacacattaatctacacctcaattgatgcttcaccgttgcttgcctttctccattttgaggatcgttgcttgtttatgatttggacgtaagggtgaatagtctaagtgtctaaccacaccatgagcaataggtcaaccccttgcatcatatgatatcttggtatgattgagtataagactatgagagggaatattgccctcaagatctgttaaaagacatcaggagggaaacgcccaggcatagaattgttctgctgagcttgcttcagatgcactctaagtgcataattatttatctgcaatgttaaatatacttatgtaagaacaatcaaaatcaccgggagtagtgttcgggacaaaagaatcaccaggagtaaggagtagtacctcaagagtttttatctgttcctgatactgcaaaaccagttgtttcaggctatgaacctcctgagtcctctcgtcaaactctttttgacgttcatgttggatagcaaccgccctcttcagaacagcgttctctctcagatatattgccagttgctccttcagcatcacattttcctgcaggaaagcaaagcataactgcttaatttgcctaggagtacaagtactatggatgaaacgtgcatatgctgttggttgcaccttgtgcaaattatgcactgcttcagttcctgctcgctccattatggatttctccaatgcctccagggctcttgaggcacgagcccgcgcatcatctatgtctgatgcactcatcatctctctaacaaatagctcaacccactcagaaccatgatgatttgtctgaaagttttctgtagcatgtgggttttcagtgagcacatccaaatgtccattattaacaacacctgtccaagattgcaagctgacatttagcaggcattttttggagaaatttaattcatgaaagaggcatagttcatgaagacatggcaaacataagttggcaatcaagcttggacatatcctagaaggaaccaaatatagtacatgtgtcatgtcataggccaattgaaaatggaaccacccagcttgataacttgctataggagcatgaagtagaagcatgcacagtaacttcaaataaatactgaggctagagaaccgcatatcacaatggaagttcatccttgacactactcagtactcacaattgtggattgtccattaatgaacacaccacaatcaactaaaacatatcatatttaaacgggatataagaacatggcacttcagtttatcacccactctggtgttacacgctaatggcaggttgcccataaaaatgctacagtacattacaa

SEQ ID NO: 26919 - DNA, 18683 bp, Oryza sativa
ggggggggggttggttggtcggtcagctgcgcagatgagtttattgcgttttggagcggctgctaagcttgtgcgtactgacctttatacccttctctttggccaggtgttctactactcgcttttggatgttggaatgtcaggtcactacgctttacttccttgttccaaaaataaatttattttttatccatttcacgtatatttaatataacaagaaaaaaaaatattcttactttattgaatcacaatataattattcttttttatatgctttcaatacaaactgattacttaaaatgaacttatttttaagagaaatgagaggttaaaaataaacttattatgtaatggagggagtcacttttttctaatcttctgcattttggtttagccgccatttagaaaaattggctctcatgttgaggcctttaaaaaattgaaaattttgaatgaagtaagaaaatgatttacaataggaaaatattttatgtttgtataatttgtgatataaaagttaacactgtaagttagactacgataaaagaaactccaaaatcaactctaaattaagttttaaaattcaaatagctaataagccaataaaccgactatgggtgccggaatatttctccattgctgtatacgaaattctgataaaaaaaaacttttacaaattctcgtgtctcattcctgaagagttgttgcatttcagagtcccgtagattttagttaagaaaaacaaatatttttggactcttgtattaaaaaagatcaaccatagtatggtttggtggcaatgttttattttttttctactcatctccaataatctgttcggtacaattgtatttctacttccaactgtcaagtataatctatataaaatattatcccctaaaaaaagtatactattatttgcacagggggggagttagcttcagatatatactactctactatgaattttccgatcttcacgaacttattcttgatacggatacctgcctatttcagcgcgtcaaaacgggggaataaagtcgacttgtccagcttcaattgcgtggagcgtggctgcaaacgatcctctggatttttgtccgacgttatccattcccgttttagcaggcaacgggtggcttttcactcgattcccgacctcgacaccttatcacctgacgtgtgggccatgcacgcacgccggtgtgctctcctgctttgcaccggccggcgagctgccaactccggcgagttttctgctcgctcgagcccgtctgagcaagcgatcgccggccatggcggcggcggcggcggcctcaacagctgcaaaagatcaacatgaagatggcagagcatccaaacaaagtgattaaatcagtacagtacatgattgaagggaaatgtataaagatataagaccataatgaacattggattacattgaacacaacaaaatcgtattgagcacacactctcgagaggtctgtctccctccatccatgtaattaagttggccttcttgcattttagagctctctcgctctgaaccattctattctttatgtatggttttttttcccgtaatcatggatgtttaaaccatctttgtgtctggtttttgatgtatccacatggttcacttcaaaaaagaacttagcacaaacaaaaggagggagagttattcacagctcaggaatggaacacacacacaaactctgcatcctacaaaacaaaatcggcatttccatcaagtatggaaatagtggttcttggtttggttctttactttcccttttcgttttctttgtgtggtatgcaagctagaaggtgttattgtgtcagcacaccaatctgctgcagagctgacttcatgtcatctgtactgtaaccctcaatgccaatgatatttgagctgtccagggcgacgacatcttgtaacggatatctcctgacagtatggattctgttcgcggggatgttgaactcgcccttcaggatgacggtcctgtggagaccacctagcagttcttcataatccgaatcgccactttcaccaacaaggactgcaacatttggcagctctattccccagcgtatacacaagtacctaaatgaacattaggtttggtcagcacaacgggtaacaagataaaacttcatttctgagcaagtgcaaatggttaggtgcacagcacaatgacacacaagaattacagcaagcatccttctactgtgttgtaaacaatgataatttgttcacatcatcgttcattttagcgaatattaaagctggcatgagtttgaaaaggaatcatattgcacattttgttattatctctgtttgaagcaaaatagtatggaactacagacagttttttacttaaaacttcaaaattcactgtttattgaagttaggcaacacaaaatggaaaaatacttctatggtgagttggtataaatgaaggaaagaaaaatgcaaaagaagatgccaaaccttagtgcctgggaacgtgatgcgtgaatgggaactacagagagtctggtggcactgtggttatacaaggcattgcaacggagtgattggattctcatcaatttcctcaactcctttaaagggggtagctacaatgaaaaaaaccacattaaacattcaaaagggaacgtctaaaaaaacattaaacattaatagcacacatcacacacgataaatctgtgtgtcagtgtgtggttggaaggctcacatgatttggattgaccactctaaatgcaagacaataggttgaagagtgttcagggtcttcaaaaataatttgtctttcgattcttccctttctttctaccactgaagtagcccatttcactagatactttcttaggccttctcctccccatcgatactcaatatgtgcttggtgattttgatctattgcaggagtaacctgggaactgcttggcgtatctcccgaatacaaaggataatagatattacttccactattgcagatgaaagcatcaaaaacagtaggcaacatgcctgcagacactagcagcgagcgtatctctgatattgtaagtgaagttgacagcacaaaaccagttgaaccagacattttttctgtgcgtgtgacttcaatagtgtttctgattatccggactagatcttccttgttaacagagtctacagatataacaatgatatgcttccttcctgatatgggtgccttctgttcctgtttgccaccaatagcaggtgatctcggaccaagtgtcaatatccttgacaagtaattcttgcaatgttcaggccatgagaactggtgaatattttttagcccattctctctacatctcgaccaaagttgtttgtcagaaagaagcttatacagtgcatctgcaatggcattctgatcatgtggatcaacaaggagaccattgttcagcacctgcatgaaacatccacaagaaagtaaagtgatttaccccttcagtgcgttgttgtatttttgacatataacatggtagaacatatacacacctgattaatttctacaggagctccattttttgttgcaataataggcaaaccattcatagcagcctgcatatagatataataaactggttatgatttggagtttaggacactgaaaaagttgaacagctggaaaaggcaagttgagctctcaaagttctgacctctattagggtaacaccaaattgttcaaaataagccacattcacaaaagcaccctgcagaagatcaacagatgatcaacaccaaagtaagtgggaaaggaacataaggtactgatgccttctgcctattataccataagaaaaaaaaagatacttcagttttaaaaatcaagaaaacaatctttgtttcagcaaaaacattgcttaaaaaaattgcaacatggggttcttctgcaaagcgacgtaggagaaaaaaagaagaaacaagagcccaccccatttcacaatatctgtccattcaaagttgcgccacagaccaaggagggactaaatctatttaaaaaaagctaatgtaaaatgaccatatgtacccccttttaaatgctatctacagccaattatccacttttttactgaatcaaatagagctggagtgtggaaatcttgcaatctcaatttcttcaatgggcaaggcacacattgtggtaaaaggtggaatggagggagtacattgaatggtagatttcaaccaagaacacttacagaacataaaagcagcataaaaaaactaaaacatagaaaagtttctttgctttatttcaggaatagcatacctttgtcctggcagctaaacgataaatgtctggaacttcagagtgcttatgatgcttgggataagccacttgaccatacaagtcatattcatcaatcaatgtaagcactgaggtcaagacagcagcactcatgttgttcatcttagaaatggcctcacggttacccattatcagtgtctgcaatgcataataaaattagcacctaatagtctaggaaatatatatcattttgtacactatacaatatgattatgacattacagagaaccaaaccacagaacatcgagatggtttaagtccaatcttaccagatttgctagctcccttagagggcgacattcaccaaatgcctttacaagtgatgtaatattcttttcaggatatggacgagcaacagccagaatcataggcttcctaggatttgtaaagaagcgcattatctgtcatcagttgcacatgtacagattatcagtgatcaaactcaggtacaggtttaacaggcagaacaaactatcctcaataagacaagaaatactgaataaaggttatactagtaactgagatctctgtaggattctaaaggaagtgcagtgacctgagaccaaatgggtgggtcctcagaggctggacatggattttcttcttcaccatccatttcaaaatcgtgaatgatatgaccaaattcaacaccaggaggtattatctgaaaaatcaggaataggaaagcaataaacattaggggttattgacgatgcttgcaactacagctaggcagctggtgctaatgccaaaagccctaaggtgtaacatatactttcccaataatttagaaattgttgtgcaaggggaggaaaatgtgtatactcacaaccatacgaggcatataacggccatagcagttagcaccacgcttaactcttgcccgaagcttccttgcaagtataacctcaaaaccatcatacaagttccactgctcttctatctcctgtctagtgctagcaataacaatttcagatgcatcaagagataattcctctgcctcaattcggcacattattttgtatgtcatatttatttgttcccttgaatgtcgcccttgcttgagaagcccttccaatttgtccttaccaagaaaatggcctgtaaatgccataggaatattaagagacccagacaacagagcagcagctattcctgcactggcatagtgtccatgaatcacagcaggccatactggatgcccacagccaatttcttcaccaatggtttttgacatccgcacgatatggccaagtgcaccatcaacaaattcttgaatgaaaggccatagatgttctttagctaggtatttgtcttttggtccaaatggtatccgaatgatgtatgcaccactgttctcacccttttcctgtttagaatttttaaagcttgttgaaaccaacatttctgtaggttcaccataactacgatcgaaatttggtgccaagatttgtcttgtcagcaaatcaaccctgtaaactccaggagatgaactcaacgctttagcaagttcaaccacatatttgacctacaaaatggtatgtgaatatatatttaagaacttgttggaacttctgctatgagaaaaatctcagtagataaactagaaatggaaatagagaaaaggtctgtaaatctgtcatacactaacagataatgcaaaaggccttagttttctcaggaaaaagtgtaaaagtactagaaattaccaccaaaaaggaaaagaacatctacccctacccccaccctgaccccccacaaaaaaaaatgtccagtgggccataacaaccattggatattagaacctaactcaaaatttaagactgcatcctaaacataaaaggattcaaattaaaatacactcaagtaaattttgagttgaaaatattagaatgtcagtatacataatagtatttgtagtcccagtatgatatagtcataaataaatttgtgttgccagagattgggatcccatgtgcacaatcatgatatagtagcagcattacctggccaccagtatctgaatctcgtcctagctccatgttctcaccacggaccagaccatgtaggctgcagtacgaagcatgaactgattaatgaacattacaaattggcttcaaggatagagtaacagacaccgtttccacgtgagcatggattataaaatcaacatggaaaattttggtcggctgcccattatgaagctgttcaaaagatgtatgattgtttgttaaacatgtgatacatttatatcttgtcaattctaagttgtggctcttgttctttcaacagtagcaacagactgcccaaaagctaaggaaatagacacataaatatataatataatataaactctgcaacagaatcagatgcagaaacaaaatgcatgctaaaatagcagcgtcgatccactctttcctaaaaaggcatgcaaagtgcgcaaaatgataatgaggtcatcctactagagccagtattcattgtataccacttcaagcttgtgaatacctaaatagacagaggaatgcaaaatgcacgagcattacacttggactagaaggaatcaaggaaatctacagaatcagggcatcaaagctagataatgctttggacttcgtttcttttcatgtgcctagaagcccagaacaggagagagttcttcagtgtcatggacatggccaaataaatgtcatgataaacaagaatactgccatctcgttatttgaaattactgcttcatttgtcggattttctttgaattattcttatagtacagaatgatgaggaactcggctgcagtttactcaggaagtatggagaagttcctaataaaaaagaaagaaaaatcgacacagatagcagctactactattaccttaagaaatttgactaaagtagtttgattaaattgaatttttcgtcctgatgttatgctgaatgattcacaaatggtaaaaaaaaagggttacttaaaataatactttgtaccttatcagtactatgtatagcttgtcaattgaactcgtcttaggtgagctccctgtggtgctgtcaccatacgcaactgagggatcaccagcatcttctcccttttctccttcaaatagatcttcagacatatctgcattagtatcagttcgtaatttctcagcttctggttggcgtttcaacagacgacaggcttcttctttctcgaactgcatgtaagaacatctgaacatgtatatgacaagcgaaggacaaaatacaatggtacagaataggtacaactccaacatcagtctttcaggcaagaatatttgtacatgttggtatagccaattatattacaacacgaaaggtaggtagatgctgaaaagaataaaaatgaaacattcattgaactgggaaaccaagggttgactaagacttccatgcaaaagtacttccaaaacagatggactagccaaaacaggatacgttgcgtcatgaggacaaagtaatagccaggcagagctaagagcttaagaaatagacaaaatggatgatggaacaggatgcgttatattgtgccaggcatgtaccatcaggtcgagttgctattcatatattacatttgtttgcagcctttgctttcatatgtatgaattaccaagtgatacaattcaggcactcacattgtacttagcaatatgacaaaatttaaagcttctaagattgtagcacgaggcacgatgacataaacagtagcaagagatactctctatcgtaatacctcaaacaaaagatgcagcaaaacaaatgacttcattcacattctacctagaacgttaggggtcaaaatggaacaaacacataaaggcttatcaattgtagtgtaatgacatagcggtcacaagagtattctaaacaactgaagcaatagaagcaacaaagcaatccagcattctctgcgtgctgcccgcatttgttcagtaactcggctcaatgtcttctaaaagtcttatcatagatgacgaaacaactctctgtaataaagcaatgccaagcaggcaaagcatccttcctaaataaaccaagagctttgttaattatcccctctgaacagatccagcaccatctaagcaagtaactatcacatacgccacactttatcaattcatccattagaatcaaaattacaccgagtcactggctgagctctctgcaacctacgcacactatcatcatcatcatcatcatcatcatcatcgaagggaacggagcgaagagctcacctccttcttcttcctcgcgaggttccagatcctccacgtcatgttctccagccgcgtgttcctctcctgcgggctccgcatcgcgttcgcctgcgccgcacacgcacacgcacacagatcgatccaccgatcgatcgatcaatcaaacaaacccaacggggaggagagcgcggaagcggaattagaggtggggggagggagggagggagggaggggggagccacgcacgcggagccatgtcttgtagaggtcggtctcgtcgtacccggtgatgacctcctcgacgaagtagcgcgccggggagaagtggccgcgctcccggaggaggagcgaggggcggtcgccgccgattgccgccttgccggcgtcgaggatggcgtcgaggtaactgtttatccagttgtcgttgcccgccatgccgccgccgccgccgtggagatcccggcgagatcgtggagggggagaggagtgagcggaggagtggaggcgaagccaagggaagggaaggaagaggaggaaaaggagaggagaaggagcaagtgcggagaaatggcgaagcataataattaaaaaatgcgtccgatttggggttttttttattattaaggagaaagaaaaggtggcctcgtaatggaatgagtaataataaattagtgcctgtgtaaatccattgtcaaaattttttaccatatcacatcaaatattttgacacatgcatagagtattaaatataggtttaaaaaactaattacacagattgcgtgtaaaatgcgggacgaatcttttagacctaattgcttcgtgatatggcaatgtggtgctacattaaacatttgctaacgacggattaattaggcttaataaattcgtctcgtagtttataggcggaatctgtaatttgttttgttattagtctgtgtttaatactttaaatatgtgtccatatatttgatgtgacacgccagaactttttacccctagatctaaacacagccttagtggactgatgatgaaataaatagttgtttaattctatatataaaaaatattcaaacaaatcttgcttttttaaaaaaaaactttgtttttcagggtggatttgtccatcttttccaaagggcaatcaaattccattcagattttggacaggctaccatcaaagttaggtgagcccttcgaaaaaaaatactaaattagtaagcagtactgacgccatttctaaatttaagtgcaatttcgagggaatatcatggtttgtgaaataaaaaaagataataagagggagcacgtttggtccaattcttctttgagaccatcatgtgtagcttaacaatttggcccaactctaaaatagacatgccaagtttgaggtcgttttgggccttaacgttttcactcttttgcattcggtatttttaccacggtttggttattgaaggatgtagtaataaattacattgtccgaatagtcaagtcaaatcaacgtatgattgacagaacgagaaccgtgtcaatggaattcaatactacctccgtccaaaaataaatgcagccatagatatctgtgcccaacgtttgaccatccatcttatttaaaaaatttgtgaaaaaattgaaaatatttagtcacacataaagtattattcatgttttatcatctaatagcaataaaaatactaattataaaaaaaattcaaataagacgaacggtcaaacgttgaacgtgaatagtgtaaaactacacttattttgggacgggggaatagttttttttgggtgtgtgttttaagggcaagaatgacgatgtggtgtcaccatttggaaaaagatgtcacgtagagcttttatgacgacgaagaaagagaaagatgccacctagagtattaattaccccctccctccatcctgtaatataagagcgagtataatagtagactataaaccggctaaatactgaggtggaggagaaatagaggagaagcgggttgtcaacttacagccggcttggacacaaaaacaaagaaactctgtgagagagacaagtgggccatatattaattgtaaagagctattccctccgtccaaaaaaaagacaaaccctagtttccgtgcccaacgtttgaccgtccgtcttatttgaaaaaattatgaaaaaaattaaaaagacaagtcacgcataaaatattaatcatgttttatcatctaagaacaataaaaatacgaattataaaaaaatttcatataagacggacagtcaaagttggacacggaaacccagggtttgccttttttttggaccttagggcagtcccaaacctccaactaggatggtgtctatagcattaactatattgccatgtaggacttttaacttatgtggcactatattaattaagagagagagtgaagagaggaagaaactgggtctcatgcaagacacagcttcaacacgagaacctatgcgccaggctcttcaatagattgaaccgcaagaatacccacgatttttcggatcgggaaatgggtcgaaccgcgcgaaatggtcgcctcggaatacagggcgcaacgaaaccaaggttctttgttggcgtgttgcgaaagccatatgaaccgctatttagtccttgaataaagaaaggtagtaatttcatctagttgcattccatcgaactaaggtgggattgaagaaaggggtcttcaacttatcttgagccatcagtcagattaaaagcagcgccctgccgccagctcctgacctctgttcctatgggaaaaagcattttggagatttgctcagttgataccgaatttgaagataagcccttcccccgaacaggctttttatttggtgggtaacatcgatgaagctagcacgaaagcgacactattaagttttgcattgggagataatagtgtcttcataatagataaagaataaatattattggtagagaagagagatgttgtatttattaatggtccactttaagaaaccatgggttgtggagtatagtttctattgtgatgtcttattaacatagcaccatagacactacttatggacactatgggttgggactgcccttatagctaacaagctgagagaaggctacaaataaccttatagccaacaggtcggttgtattattagccttgttctaagggataatggatggatgtgatacattctagtacaatgaatttgaacagataagatacatttatccattatctcttatattatgggacagagggagtaacatatagcttaatatcatattatcacatatagtcaaaatcattatttcgtggcacctaaatttacgctttctgctagaggacaccataagaatgtgtttatactataggacactataaaaatatgttaattaactgttgaacacttacgatattattttattatatgcagaagaaattgagcgagaaacaacgacgaaaatacgaatctccacttgtggtcgggcaaccggcttgcctagccttcgtggtgctgtggcgaagcaggaggtgtgtctccgccatggcaccatctctcaagcccgtgtccatggcagcggctcgcggcatgctcgacaaaggagccctgctggccctaacccccgcgacgtcgcctccaacttcgagataaccaaacctcaccgtcgatctgttgatataaaaacacgagatatgagagatctgcttaactccagtgtatgtccaaaagcttgtctttagtgtaggtgtaaaaacttgtctttagctaaaacttcttaccatattgttattatgttatactctatgcatacataaaaagttgacgtggagttatttcgttggatcagccattcagtgtcaaattagatctcataaactttctttattgcgattggatcccataaactttgttttattaacagtaattttcataaaaccaagttatatacaaaaccacaacgattttatcgtgggacacataacttcagatattataatcccgtttgaatccgatgaatatgaagattaagtacagccacgcaaaataaatcattaacacataattaattgagtttaaattaattcaaacctaaaaagggctttatctcatattttaaaatttttaataaatctatatgattttatacaacttagcgtagataaaatttacacttctattaattgatcatcccctgaaaccaacaggtggcaatattctcacgtgtcccatggtatcattttttctgaacgaaactgttcctatcattatccttatttcacgtactgttctcaaatgcgcaactacaaaagtatcccacttaaaaggcaaacagatgcgtctaaaggacacgttttaagtcttacctggattatccatttattcttctacctaaaagttgatgatttcttcatgagatttaaggcaaatatatgaattatgtccacttcatttttttattggctcaattctgtcaattttcgataaacaatgaacaaacattttgtgcgaatatagccaacgtgtcagcccatcagtccttttcatgctgtgtaaagtgattcttacacacgcggctgtgtttagttccttccaaagttagaagtttgggttgaaattggtacgatgtgactgaaaagttatgtgtgtatgacaaattgatgtgatggaaaaagttaaaagtttgaatctaaagtttggatctaaacacagccgaaaaagtaaaagggaataaaggcaactagagatatatgcttagttaaatatatctttttggtgcctggattccttgtttggtacacgatgactcatcattatatttagcttaactaaataacaatcaaaacctaataggagaatcttgtttgtcgatcgtaatgtttatcttgaaacttgattaaaaacataacttaggtgtaatgttagagtctccagatcctttttgtccatgccatgagtctaaaacaaattgaagttttcaaagaaacatcacttggcccttttaactccctttaatttgccatcataacattaattagtttgttaattttttgtgcaattgtaagaggatgtttggttgccagccatagtttaccacgtctaaggttagacagatttgatcatattggtagttgtttggttgtagtcacaattgtggcaaaattcttttccaataaattgagtccacatgtcattaacttagggaagtgtgacatgattctcttagacttgctaaggtgtggttaacaatttgatcgcctaacttaagcaagtgtgatagtatttattgacaaatggtggtaaaatatggctaagaaccaaacacaccttaaatttcaatgagtttaaatatagttaaagacgttaagtacaattaatagggcaagttatagtcagaacaaactcaaaaacggtaatttaagaacatagaagcaaggactcctggttgctgaaaatgatccttgctttgttacgtgaatactccatcagtatatatatgacactatcaactttatttggttaaaatttttaaactttaatcatcattttattttgattaacaatttattgtttggaattgttcttctgcttaattaacctagatgacaggtaaatgaatggtgacgacaatagccttcaacatttcagggtgactatactttttagtcatagacaattatagtgcttatatatggaagatttatctctgttcttgaggagataccgtgagtaccgtgcagggggaacagttaaaaaaactagatgaatatgatttgtgattattattatattcgatgatacaaatgaatgagttaaccattacaaaggtgaaaaattgtttcaaaagggtattgtaaaaaaaaatagtatacaaagtagctcgtccgagaagcacttaagccttataaaccctaaagaacaaacttgaatactagcactaaactacaaatttacaaaaccaacactgttcctttacagctgggagctagctagaagcaatgcctggtctcaaccataggagaacctatgtgtgtcctgcaatggcctgaaagagataaggggaccaatagcacagtgcatgcatgcaaatgaaatataatgcaatgcaggcaatcaggaaggtaccatccatccatccatctgaaaacgatgagaaacctgactccaaattcacagaaccacacgtagaaagatctgcataattaagcaagcaggcatgcaagatgtttttctactatttgtgttttgaattattgtggcctgagtttccatggcatcatcccctcttatccatccaagatcacattgtatggcgcttggcgtttttcgccgatcgatctcttaattctctgcatcctgatcttttcccttctcagattggaggttggtagtttcagacaatggtagtatgattgattgggacaatcatctgttcaatggtcctagctgaacttcttgttcagatgaagctattagggcacccataatagttatctataggctctctacaagaaatccatgtcagcatatttttctacatggaagatattaaatgaagagagagagagcaaagctatctactaagttagagatagtctatagagaaaaacgaggcaatgcatgagagagctatagatacccatgtagatatactattgaggcggtttactattaatctagtctattgctgagatgtacatgttttatagatagcaccttactttaccattgcgggtgctcttaagctagaagatttgtgattttttgtgcagttcaatggcgttcaattcaagctatgtattattgtagccagcgaggaattttacgcatttcgaaaagttcatctcatcggaatctgtatatgtgcccttttccatgttggaatatgttcttggcaagacgagaatattgaaaaggtgaagctcactgggttgttaagaacctaagctagctaaggttaatcattgtggcagggagaagaagacaaagcgaccagttgagctgtggttgtcagctactattgttccttcagagaattcagagttcaggcatgctgttcttgatgattaatttcaggcatggaatgatggaaatctaatttactcatgtgaagtaacagtgcagttatgaccgaacttcagaaactaaattgtctggtctagatatataagtatacatggtggattttgtgatgataatgtgatgcaattgttgtttcatttaatttggtattcccaggttgtaatttactagttgattttatatttgtagcagtgacactacgaatctacagaatttacatgtcactttcaaattcttatacaagtctctgaatctctctcttttttttttgtataaaaaggatcactgtcaggaagactggaagagtatcttacctaccattgcattaggagcatcaagaaaactgaaaagacatcgtattgtacaaaaataacaatggaataattcataccaaacctgtgtgatcatatcgaaaagaaatcttattatacaaataataataatggaagaattcatactcaatttgtgtgatcatatcatatatactatgtacgtttaagcttagtagacttcagtgattaattgatgatctgtacgataaatttcgtctaaaatctacctaattggcagtactgttgaaatttagtgacgattacggcaaaaaaaaaatcatcaatacacgagaaatggatgaaattactgcataacaaactcgtctgtttttttttggaacaaccaaattagacaggtcatctcattggcgaaaagcttaagaacacaaacaaccggagtctcatcggttgcccatattccctaataagccagaataaaaattaatttacagggaaaacttttacatatttgtttatagcgacttaaaagccaacgctaaaaagaaattacgttgaaaatatcctaaaatcaagtttaaaatcaaatttaaaaaaaaataaattttagcttttgttttgacttattaggacaactgatgcggctcgtggtgattttttctggtgtggttggtgtggagaaatcacttcgcagagacaaccacctcgcttttgacatgatcaatcgatgatttgctgatgaaacagtgctggtttttttcccccgaaaggtgatggttaccgttgcaattgtagagtagagatggatacatagccacatggcgtggacaacgattcttcgcgtgatataaaccgcaaactgtcgatatcactccatggtcccttccatggtgaatgtgatgtcgctgccatagtcgatctatttttctctggaaaatctgagtattattgttacaaatgaaagtttttattttaaaaataaaagtgttttatatcttcggctttttaagtatgctttatagtctaattaatcgatttggaaaaatccaaaaaatatcattaacaagatccgatttttaaaaaattgtcatcgatgagtataaattttatgaaatccattgtactgtcctagaaatgccacggtgttatggttccattagcaacctctgttaagtgctataggataaacaatgcatttaatggtacgagatagatggaaccctaatggtgatggtattttgaaacaaaatcgcttgtacaatgatattttatgaaacttgcacccgtcgatggtatttcttgaatttgggtgtttgtcaatgacattttttggattttctcgattgattttgtgacaacatgttctttttagctaacagataacaaataaccacgaacatattttttaacgaatgtgatgatgttttttttaagaaaaactttctttatcaatatttcttcataaactctttgattcgatcttttgatttttctaatatttaactatttatttgcgccatcaagtaattttcataacatagtttcatccttcggcatttcagaacacaacttgagttgttctgatatcttgtttttatcaaaaaccttgctttaaatactttctccatcctgaatatagtaatttctggcatccaaaatttatataaaaaaagtataacaacttatataccaactctctcatcttaacccaccacatccatctctcattaatttatctacatgctttattgtctcagctgatcacaaccataactgatttagtttcacctttctctacaatctcaacgaaaactctaaaaatatcttctctgtcccaaaatagtatagacatgccccacaatcaggttcgtagtattattttgcgtctaatctaacactatatcaatattgttatattttaagacggaagaatacctatattttataatggagagatacattatattttacagcctaacaaaactaaaaaaaacaacttgatttgttgcaataaaaaattctactgtaatttttacaatatattgttaggataaaaaaaaccattttgcaataaatccacttttttgataaaaaccaaaggatgtcatgtcagttaaagctgaattagtaattttctgctgcttacaacagctcaagccaccaagaaaatccccaaaataccctccctctccctctccctctcacgcagctcgctgcctcactctgctgcgtactcctcttgctccgctcggcgcctctcctctcctcgcgtcccctctcctccattctcatccacctcctctctctctctctctctctctctctctctctctctctctctctctctctgcgatccgaggcgcgaattgtgaggagagggggggagcttagctgcggagatggcggcggcggcgatactgccggagctggcggcgcaggtggtgatcccggtggcagcggcggtggggatcgcgttcgcggtgctgcagtgggcgctcgtctccaaggtgaagctcacggcggagccgcggcgcggggaggcggggggcgccgccggggggaagagcgggccgagcgactacctcatcgaggaggaggaggggctcaacgaccacaacgtcgtctccaagtgcgccgagatccagaccgccatctccgaaggtgagcagagcaaccctctctctctctctctctctctctctctctctct

SEQ ID NO: 26920 - DNA, 12883 bp, Oryza sativa
attcctcaggctgcagattctgataagataacaagcagccggtcaagaatctatttatctcttgggatccacatttgcgtttccatagtaatttcaacgagctcaccagaatatttggcatgatgtgagtgtggttcatttagtgatccatgtagacactccacaaggttgttgcattatggaagatacctgctagtaaaatagtttggcttgtgtccccagttaaaaagaaaaaaaaacttagcttgtgggtgtcagcaactcagtaccataccaaaattatttgttagtgtcttagtgatatctgtttgttggaagatagtatgttagtattagctttcattaaatcactatgaaaataactacaaagacgtgtcagatgctgtctctggaaatatcttggcgcacaggctgtgctggctttgttgtgatgttctacatggaagtgactaggagtacttggttagatggagtttccctgcattagtggcaggcatatgattccccgcaaaaaaaaaaaggtggcaggcatatgattggttttacaggacttgccaaatagtttagcattttcatcgcgtcctttgcttggagctcctttcaataggctgagccagagttttgtctctgcagttgttagttttgacggttgtaagttcagtggattatatccggttggttgttgttgcagtgccagttggctgaattattgaatacctctctagatctactagattttagtggataggttttgattggttctcatttaaccaatcgattcatctttttagatgaccttctttgttaccattcgtctgtagttcagggttgtcattggtttgatgtagacacacgcctatgatgctattctgactttgcagcaccaaaagtgggaaatcgaaactgagtaatgcaaaaacttattctaaccttttggatgaactagtaccatttaccttgatataaaacagtatgtttgtatagaatttgttgaccatgctctttgcgatttgggcctacttgtttgtgggtgtcacaaaactttcattagcaaacataagtggtgatatactgatattattcttatgtgacatttgttcatttctcgcatttactttgcaatcatggatacaacctgaactaaactcaccttccatcttttttttcttttttttgttaataggagcgacatctttccttttcactgagtacaagtatgtcggattattcatgagcatcttcgcagttcttattttcctcttccttgggtctgttgagggcttcagcacgaagagccagccttgccactacagcaaggacaagacttgcaagcctgcccttgcaaatgctatctttagcactatagcttttgtgcttggtgcagttacctctctggtatctggttttcttggaatgaagattgcaacttatgcaaatgctcggacgactctggaggccaggaagggtgttggaaaggcttttatcactgctttccggtctggtgccgttatgggtttcctgcttgctgcaagcggtctcttggtcctttacattgcaattaatttgtttggaatttattatggtgatgactgggaaggcctttttgaagctattactggttatggacttggtggttcttctatggctcttttcggccgtgtaggtggtggtatttatacaaaagctgctgatgttggtgctgaccttgttgggaaggtggaaagaaatattcctgaggacgatcccagaaacccagctgtaagaatctttcacttgaattctaaagattcccataaatatactgttaggaaaatctcactttaccaaaactgcaaagtggctaatcttctctctggtcaaaccatcatggtataagaatgacttttgttctgcttgcaggtcattgcagacaatgttggtgacaatgttggagatattgctggaatgggatcagatctttttggttcttatgctgaatcatcgtgtgctgcacttgttgtggcatcaatctcttcttttggaatcaaccatgaatttactcccatggtgtaccctcttcttgtcagctctgtgggaattatagcgtgtctcataaccaccttgtttgcaactgatttctttgagataaaggctgtgagtgaaatagagccagctctcaagaaacagcttataatttccactgcttttatgactgttggcattgcccttgtcagttggttgggccttccttacaccttcaccatctttaactttggtgcccagaagacagtgcaaagctggtacggtgtttttacattcatcattgggctatataattaactttatgattcatcctcattctgctgttaatttatcacttatcaggcaattattcttgtgtgtggcggttggtctttgggctggtctaatcattggatttgttaccgagtattacaccagcaacgcatataggtatttacgatttgctcatttatgtggtgattatttttatgtttattcttcaccttttgacatctctgttgtttaccctttcagccctgtacaagatgttgctgattcttgcagaactggagctgccactaatgtcatttttgggcttgctttgggttacaaatcagtcatcatccctatttttgctattgctttcagcattttcctcagcttcagccttgctgccatgtatggtgttgctgtggctgctcttggaatgctgagcacaattgccacaggtcttgctatcgacgcctatggtcccatcagtgacaatgctggaggaattgctgaaatggccggcatgagccacagaattcgggagagaactgatgctctggatgctgccggaaacacaactgccgcaattggaaaggtacatatctgcctacccatcccattcttaatttccaggtcttgcaccgaacttagtcaattcttcctgatgatctccatgcataactgtagcataggttcacatttagttgaaatttataccaaggtttttatccctcaagatgtcgatcatgcctagaaagtggttgtttctaattatgatgatgatgttataccacttcagtatggtaagcttccttgattaaaagaaaagtttatatcgtaattttgtatttgcagggttttgccatcggctctgcagccttggtgtcacttgcactttttggtgcctttgtgagccgtgcggctatctctacggttgatgttctgacaccaaaagtgttcattgggcttattgttggtgctatgctcccatactggttctcagcaatgactatgaagagtgtaggcagcgcggcgctaaagatggtggaggaagtccgcaggcagttcaacaccatccctggactcatggagggcacaactaagcctgactatgcaacttgtgtcaagatctccactgatgcatccatcaaggagatgatccctcctggtgctcttgttatgctcaccccacttatcgtcggaattctgttcggcgtcgagaccctctctggagtccttgctggtgctctcgtctctggtgttcaggttggtaaccattctgaattctaggattacaattgcatccaatggtccgtgctccttatccgtttcaccttctctcagattgccatctccgcatcaaacactggcggtgcttgggacaatgcaaagaaatacattgaggtacaatatctaccagtatccatttccttttcttttgggttcaatcctgcatgttaccttaactttcttttcattgttctgcataggctggagcttcagagcatgccaggacccttggtcccaaaggttccgatccccacaaggcggccgtcatcggtgacaccatcggagaccctctcaaggacacttcaggaccctctctcaacatcctcatcaagctcatggcggtcgaatccctcgttttcgcccccttcttcgccacccacggtggtatcctcttcaagttgttctaaaccggcgacgttgggtgtaacaaaggccatagttttttggggatgagcaaaatatgtagactattttgtcatgatttgctccttgagttgatgactccattgtctacttgatttcccatttttgttctagttccaggttccaaccttgtgttttgatcccagaattttctctggtcctctttagcttttgtctccagctgcataagtcatcctgtggcacagtgaacaaggagcattggaaaatttgccattttctagcgataaaatgatgaggatgatgatgatgattgatgtcgatgatattgtcttttttttaaaaaaaaaatcttctaattttgcagcaatgggtattgattgacgtgaagcatccaaattgttgcgctgttacaaggttctccccactcattctctcaatgctttcctaaatgtaatttttctttttatatccacaaaatttttctccttttcttccctatttattcttgacaaataaatggcacatcttataaattaaatactattcttacaaatgaattgacttttgaacacaaaacccattcatagtggcaacccaattaatccattcgagcacgaggaacacaagaacgaggctgtcttacttgcattgctgcattattacgtacatccattcatgtctaatgtctggagggtacaacaacaatgtaaaaagggctaagcaaacacaaatcggtagcaaatcagaagagagacatgataaaaaagaatcttttaaatagtacatgcacaactaagtgttcttttttcctgttctcaaactaggctatggctgacgaccgagctaaaacccctacctgctaaccagtaaccagtgaaccactaagcacaggatgaacagagccacgttcttgcttgtaaggtagggctgttactcattgatcatttcctctttttggcaggtggttgcgggacgtcatcgtcgtcatcctcttcctcttcttcctcctcatcctcatcgtcatcctcgccctcgccctcaccctcatcatcgtccccgtcctcatcctcgtcatcgtcatcttctccaccatcgtcgtcatcactccctccttcaccattggcttcagggtccccgtcctcgtcctcatcattcccttcctcttccgaggcatcttcatcaccagcatcatcgtcgccttgattttcagcatcctcgtcatctccctcctcatcgttatcatcatcagactcaccatcatccttgttctcaggaaccgtttcagttttgcttttgctgagaatcctttaggagaagggtcaaaaacaaacctcagctttgagatgagatattaatatgtctacagtcatggatagaatacatgtattcaacactaatgaattcagaactgcagttgcaaaggggtataagacatacctattaatcaaatcccggtctccaccagatgtaatgaagatttcgttttgcaatgacaacatctggataccatagcaaaaaagaaaaggaaggggttaaagctgatgatggaggattggtgtatagcagagttgctcatcagaccaaagcagaggtttttcccaagggtaattattatattacacaagtagcaaacattaaaatgaaagatactacgtggataaacaattcctttttggaatgaaaatgacaaggctatatagagaatattttaacttcaatatggtgttcattccagtttagctccaagaatggagtatcttaatacaaggccattctggtgtgtcgtccaggcacaaatataaggagaaaaacacaaaacactagcttacaatgcatttagtgccaaactctgaaactcttgcaacaaacttacacatcaatagctctaacacaatacatttgtaattttgtatgtgaatagtcagacaaaactcggtctaatccacatcccctagccataaaattatcctacagcaatagctaatgttactccttatatgggtactaatttcatttacatttaccgaatagaacatatgactgacatagtagacagtggtaatatggaaaggccatagggcgcatgacaggccattgttgccatgcggggggctgctaaatgcaccaaacagtgaaatcattagaaacatggaaaccacttgaatatcccagttaaagaattatacaaggcaatctctccgttccacaaagactttaatccagcaattatagggcaaattagaagtgtggtgaaaaggccaaggtgcccctcattaataatcacggttgcaatttctatgctccaattaaatgtacattgggagtaggtataactcagaagttagaaataaaatctttgtgggacaaatggaagcctatttgggatggagggagtttatatagtgatggatgattggtcataaaacaaagaacatagcagccaatacagtacaatagagtaaacacactttacttgctggtctgaaacaccagttcacctggttttctcttcagttaaggagaaaaacaatcccagtaataccttgcagaagacactattggcacagaaaccatgtaaatacatgtatacatcatgcacttttaggccttattctggacaacactcgaaatataaaggttcctaacaagcacgaatttctggaccataggttttcagtgaatggtgctctgaacatagacatgataaatccagcaagggcacgcacaacatcaatgagacccccatgaaccaccaagtaatttactatcatataacaatagagcaccagatgcggaaacttctccaaattcctctgtgcacattacgttatcctattcgtaagaacagtacacaaaagtaactccttaatcctagatacttcctccgtttcacaatgtaagtcattctagcattttcccattcatattaatgttaatgaatacagatagatatatatgtgtagattcattccattcgatatcaatctgggacatgttagcgctccccttacattgtgaaacggagggagtacaacacaatgcaacataagcaaactgaaaagggcgaattaaatctctatgaacaaactgccaagaattccccctagtgcccctagtcgtgagttaattgactccttaatcctacaaatagcacaatgcaacacaataaaatctggaaagtatgaaccgaattccaaattccccaccaacaactaccaacaatttctctagcaagctaaatctacccatcaagttaaacacttcaactcaacagataacctcaaatttgtgtcaccacagtgcgtgaaagagatccaacacagagaatatggcttaatttctcgaaaaagaaaataaataaattggatcagcaactagacgacaaaccgaaaaaaagggagttccaaaagtcgggatggatctccaatctacggcggctcaggctgccaggtacagcgaaggaagagaagaataccttggggtcgagctgggacggggtccagcggaaggcggcgcccgcctcggcgacggagaggaaccgatgggaggcgaccgcggcagccatggcgttggggtggggaggaggaggagagagaggaagggtgagcaggatcgatgagatgagagccaatccagtgaggggtttttttttttttcgcccagagcagcagctgtcctgtgctgcgacagatcaggccgtttggaaggcccaagatggcccatttgcgtatatgggccggcatttcagcaacaggcttttaccatcggataaagtccacttggctccctttaggccgaatataattcgtacccctctaaaaaaacatcggataggacgactctcgaactattgaaaccagtgtgatttgactttcctagcagttttgaaggacggttttgctaatgtggcgttgacatggcggtgttgacctggtgttcatcccatgcgatacttatgtggcattagaatttaaaaaaatatatgtgagacacatctatcattcatacacaaaaatatatcgtaggccccacatgtcattctctatctcaaacccttcttcctcctccctctatgaactttctgactataaaatcacaaggaagtattttcattaactttttcaattataatgtattataacgattttaatattttaatttattgctcatcttcttaataactgttgtattattgagaaaacgtctttacctgttgtaatgctcatacttttttttctaagttaattgtgataagtgtataaataaatgattataaaacttcaacaatatagtagaattacaaccttatttatgagaggagtaacttaaatatgactgaacaaaagctacattcgtggtaactttccgaaccgagtaaagcaaaggaaatctgaaaaaaaaaacaaaaaaggcgttgccaagaaggaatcatcaatcgccatttcggcatctcgttcttccttgaacccgcttgttcgtttcccacgtctccctcttgcggtattggccgtcttcctccgcccaaacaacaaaacagaaaaaaaaaagaaaaacccagtcaaaacgcccccgagaagaggagaccgtcgctaagccaaagccaagccacgcgcgacccaatcccccgatccctcctccccctccctccctccctccctccatggcgtcggagatcgaggtgctcgaggacaccaccgccgccgccgccgccccggccgccaccatcggaggcggagaggtcgcgggcgcgggcgcgggggaggagggggaggcggcggcggatgcggaggcgctcaaggacgacgtgtacacgggcgcggcgtacggggacctcgagaagctgcaccgcctcgtggagcgggagggccggccggtgacggagcccgacgccctcggctaccacgcgctccagtgggccgccctcaacaaccgcgtcgccgccgcccagtacatcctcgaggtatgatccatcgccgtcgcccaatccaatccgccccccgagcttgggtaatgctagtgtgtcctcgagcttgcgcgtttaggaattcggttttcctgccctttccccgatcagcaacggagctccccggtgatgtgttgtttgaggtgcagacgaagtgtagctcctgctgggaatgcgctgtgggggatgggcacgagttgtttagttgttgttgcgaatctcgtttggttttttggttggatcgatgaggagagattttggttcatgtggcttgtaatgacaggaaggtatttcgcttttgctctgagggtagcggttttgagcttagttttggtatgtttgtgtttatgtgttggatggatgttaatgctatgttggttgaatggtggctgttggataggtctaggcagggccaatctgcagctcctttagtgttaggaaaccctgtggaacttgcctcttgccatatcttaccaagcgagcaagcatttccaagaatttcgctgaaccataaatgggatcataggaagtttgttcagttaaatgtcatgtccagctgtttagacaatgaagccaacccctttgaaaccttgcttggattgatttgagtatgcctatgctgactggtctatcccagtcaacatgttatgcattgtgtcttttaaggccattggtttcacggttttatgttgaacagtgtagttatatagtacttcttgagttgcatggttttctttgctgctctatagtatgtcctatccttttcagttgtttgctttggtgggatgacggttctcagcttgttgtctggacagcatggagcagatgtaaatgctatagaccatacagggcaaacagcactccactggagtgcggtacgtggtcatattcaagttgcagaactacttctgaaagaaggagctaaggtggatgccgctgatttatatggatatcaggtttgtctttgacttatctattgcatccatggttccttaacacatatatattctctttctgttgtctaatgtattttgattaattcacctggtgaccaactgtttcttactcaagttatgttgcaatgtctctataatgattatgtggtacataatagtttaccattgctttgctgtataatccctatatcagtcactaagatgcttcaaattgtaatttcatacacattgatgctaggttgtatggcttcctgcaagataatgaaatcttttctctcgtcagataccataaaactattacttcctctagtaccccaaaagcatgttgttctagtaagtggcaaagagattaggaatttgtaacattgccatttttggcctttataataaatttaattacttctatctctaccataataatggttaggttgttaggatgggattaaaatgcacaagtattttacttctgtaatcagatcctatattttatcttttaattcttttagcatacagtcattttgtttttgagtttgagtgatctgcagggtttattaccgccttaagctagtcgccagggttgtcaacaaggtactaagtgaagtaggctatagacaaaacagagtcattacaaggataggtttcgaaaaaaaaaatttggcatattcactttgattcggaattaggtctttaattgaaatgtcagtctgtatttttttcctacatatgcagattagttcaacaataaagtaagatatctgcagtagataaattcccggtttgatcttaaaagttgggcagaaaaagtcaagagtcagtcagttaccttgtatttgaagtatttctgacggaatccatctgttgttataccacagactacacatgttgcagcacagtatggtcaaacatcatatctttatcatattgttgcaaaatggaatgctgatcctgatgtccctgataatgatggaagaagtcctctccactggtttgtacctttcccctgtacattttttttcaaagttcaaacacaagccttgtggtattctttatttttgtcacttaatgtgttgtctaacatggcttcatggtgcccctattgatgattcaatattgttcacatttccagggctgcttataaaggatttgcagattctgtacgcctccttttgtttttgggtgcatatagggggcggcaagataaagaaggcacgtgtttagttagtttttctagctcttcctaaaccctatctttatactgatcatgacaatctaacctacaacaagcatttaagcacgcttcccctgcattagttttgttggatatcaaatattcatttccagctcaaatgcttttcattaggttgcactcctttgcattgggctgctatccgcgggaatttggagtcatgcactgtgctggttcaggctggtaaaaaggaggatcttatggtgcaagacaataccggcttaactccagcccaacttgctgctgataaaaatcatcggcaagttgcctttttccttgtgagtgctatgaatattcaccattttttgtttatcatacatgagaatccttctagcttcccaagagtatccttttagcttcccaagattccatcataccgtaaatgttgccatctgattgggaatttaatagttctgttaatatgctttttggctgcttttccatttgtgccacctatttttggcttgttcttcattgacaattattttttatacctaatacgtagtagtaagcattactctcatgatgaatggatgtgctccacggccctgctatttcccaatagactctgtatattgcctgccacagtgccacttaccgttaattcttttactatatgaattaaaatgttttcttaaaataatatgcattgttaataacatggaggtaacaaagtaaaagtttttggataatcactagcatttgtggattgtgaatgctcttgtacttgttctggatattcttttaactattccccagtatagattatcttgcttaaaggtataaaacatttatcgttagcctcagcatgtaatttattcctggcaaatgctaaggattgatttgatgatttgattgttctatgcaggggaatgctagaagagtacatgagagaggatgtggtgggaacagttattttgggaaactatcaaaattaggactcgcccctcttctttggtgtattattattggcttaatttatatatatgtatattcagttatctcaggtacattactgatataatgtcttttcagaaattttgatctttcatactgtggttgtggattactgaatttgtttccttctattcaggacaatatagcagtaatatgacattactatttgggttattttcatggttgggaattttccttgctactgccggattggttatgttctataagtgtagcaggtaaacattcgattatattgtaccaatattccaaaaactggaggaaacatatagacagatccatgtcaattgtgcctctttagacagctcttttcttaagggcctttttaacaaattaatctcactttgcagaaactaatattttcttcatttgcatctagtcgttccttagaagggttttttaacatattaatctcaccttgcagaaagtaatctttctttgtttgcatgtagcctggaagtacaaggtcactttctttatttttaaagaaaactgtgatttctttgctggaacagagcaatttggctatttatcaattaataccacgttttagtgtgctgtcctgaaacattgaggatcttgttattttgcctacactctttaatgcattatgttctggccttgcacatctatataaaattgtaacatgcccaccacatactacttttatttcacattaaagatatttgattcaatcatttaaaaatttgtttgaagaatggccatactattttgttatgcagaaaagatcctggctacattgacaagaatacaagagatgcccaaaatcaaagagat

SEQ ID NO: 26921 - DNA, 41814 bp, Oryza sativa
  unsure (1)..(41814): unsure at all n locations
aaagactatcgaaagaagagactatctagaacacaacacgagattaattaaaatccagaataaaaaataaaatcagtagtaatacaatttataaacaacaaaatatcaggacggaaaatatggaagtttgtttagaaatagtccatctagaacacaacgataacaaatggcgataaaaaggggagaaacaacaggcccgtaaaggagtagggtggtggctgtttatgggacatctaaaaactataaacaaaaccccaaatagaatcccaatgacgattaagaggagggacgacgggtaggccgttaagcagcatggccatgacggttagcgggacttctagaaagtaaaaaataaaccccaatgttaatcatgctcgttttttaaaatctcaatgataataaagaggggaggctgcaagcgggtcgtagagaagtataatggcggagccgctgacggtttggcgggacttctagaaagtaaaaaaaatgaaccccaacgacaattatgttttgttttttaaatcccaatgatgaagtgaggaggcagcgggcgggccgtagaggagtacaatagcggcgtttgacagggcttctaaaagttgtaaaatgaaagccaatgagacaatgaactctaaaactacaatgtccaatttttaaagattccaagaaggatgagtagaagtcatagtagatcaagcaaacaaataaatgggtgacaaaggagtaaggggtagcgattggcgtgacttaaaaactacaaaattagaaactcggagatgataaggcaatgagatagctatttaacaaaattttaagtaaaatcatatgtaaaaatagataattttgtatgagtgccattgagctagttgtgtttataatagaaaatgattgggcttctgtttgtcccattgagctatactgcaaatgtttttttctcagtccttgcaattatcattccctgcttatatttgggctctatttttaaattacattgtcaatcatttatttcttcttatcccttgcagatatccaggaatttaacaacaaatgagatggcaaatgccatgaggtatagttatctcagaggcccaggtggccgattcagaaatccatttgaccatggggtgcgtaaaaactgttctgacttcttgctgaaagggtacaatgaggatattgagagggtagaacagacattacaacctgatgaggaattgggaatgattcaaatgacaagaagtgcagtctcacagaatggcgagagcatgtcacttcatgctaatggcacagaccatggttgtgctgatccacaagggaactcaaaatcccatcgtcactcgcacggttcatcacaatgttgcagtcacagtaagagacctgacaagacccccttggggctaggattgggccttggtcgtaacaacccatctagccgctacacacgttcacttccttccattcattcggagagtagtgcttatttgcccttgtgattcttttggagaaggcgagctagatcgtatttcaacttgtaggtgtttattgcacaaccacagctttcttttggctatttcttcctgcagtatttgtcgcttggatctggtctcatcgacattgccagggtgtggtatatttggaggcccaatcaaccgactactgaaattgagaatatgaaggagatgcaagttttatgaaggcttcatgaacatccttagcctctcaggaacaccagcgaatgtctgtctaggcgtagcaatattttttgtgcaaaagtgcatctttgtacaatgtctcaacattttgtatgtacaagagggttagctgtccagatactatgatgttttcaagtacagctgtatattggaagaactgtaaatttatatagcgaaaccaaatgctggcaaatgtttgtttctctccattttaattttggcaacattagagtatagtcttggaggacttgcattgtcagcttgatcacaacttgtctttcaaacgtaacttagctatgaccgtatggataatttcgaagttttcgaatgctttaactttcagttccaaaaagaaaaaaaaagcatccgatatgatggatcatgattgtgatttgtagtcacattgtccaactgtgttatcgagttgattatatggggataaataaacttagcaaataaataactttaatcaagtggtgtaagtagaataaaggtttttattttgagcaaagatattttttaagcgtgaaacaaataatctatttcagaccggtgaataagctggaaaaaaacatggccttagttgcgtctctctgaaattgcggccaaaatttaaaatttaatagaacaatacatttttttgaaacaaaaaggacattttttacttgaatcgaactattgcttatggaactcatacaaaatttatgtggaatgtttgcttagtgcatgatctcagcgcccgtaactcgttcagaaaaacaaaggggaccaaaatacaagtcataataactcataagatcaaatggctccgatcgttcgagggcattgccttctcttcggctttgtgttcagtacattatcaaaatcgactgtatcaaattttagtactatcaaatgattcttttattgaaagtactgtcaaatgttaatcttagttttcgtaatgtttaggttttagtaatgtttagggtttattcactttgtagctatttttaacccttctaaaatttattagtgtcaaattttggtatattttaacattaccaaatcttggcagcgttgtatgcttttagtttaaagctttattaaaatttgataaacttttaagagtgaaaacttttagaattggcaaagtttaataaggtgacattggcaagtatatatgtttggtttgttgccttattaaattttggtaatattaaaagtctcatcggttgcctgttttctctaataagccaaaacaacttattaggaataaaaattaatttataggtaaaacttttatatatttgttcgtagcgacttaaaaccaacaccaagaagaaattacattgaaaatatcttaaaatcaatttctaaatcaagctcgaaaatttaaattttagcttttgttttgacttgaccacctgatggggctttaaatcttgataaggttgaaaaaccagtaataaagtgaactataaacccctccaggagtccaggagtcaggactccgtccactgcacctccccgcgattctaaaatagaaaaaaccgcgtgccgccggcgtcgcaaacttgagcgccacgaatcgccgcgggaaacaaatacccccaccccccgcctcgcctctcgatcccaaaacttgcgcgccacgaacccctcctcctcccctcgcctcacgcatttggtcgagcagctcacgcgcgcgcgatggacgaggtgtgcgaggggaaggacttctccttcccggcggaggaggagcgggtcctccgcctctgggaggagctcgacgccttccacgagcagctccgccgcacggcgggcggcgaggagttcgtcttctacgacgggccccccttcgccacgggcctcccgcactacggccacctcctcgcgggcagcatcaaggacgccgtcgcccgccaccacgccatgcgcggccgccacgtcgcccgccgcttcggctgggactgccacggcgtccccgtcgagcgcgccgtcgacgaggcccttcggatcgccacccgcgcccaggtgctcgagatgggggtcgccagctacaacgacgcgtgccgcggcgtcgtcaccaggtacgtcgccgagtgggaggccgtcgtcacgcgcatggggaggtgggtcgatttcgaggacgggtacaagaccatggacatcaagttcatggagagcgtgtggtgggttttcgcgcagctgtgggacaaggaccttgtctacaagagttttaaggtcagtacgtcaggtttttgaaaatcgctaattaatccctatgcctaattcccatttatgcacaatttagattctagaggtctttatgatcgatttagcccctcttctgatctcatcatggtttaggattattatatgggactattgtacgctaattaatcccccatgcctaattcccatttatgcacaatttagattctagaggtctttatgatcgattttagcccctcttctgatctcatcatggtttgggattattagatggctctaccgctaggactttggaaatctgtccgacagaaatgtatatgatcaagttggttactggctcactgctaaggctgcgttcgtaaaacggaacaactcattaacatgattaattaaatatgttagttaaaaagatttaaaaaatcaattaatatgatttttataattttctttaaaagaattagcaagcgtggttatataaaacaagtgagtagaagatgagaggaaggagtatcgagcacagaccgttcttccaattagagtttgggactatggggtttgggttttggtcaatttgacatgcttcggatgcattaatgctggaattatctttagttaataatattatgtgcaaccccccttcccctttttgtgtatttatttccctgtttaaatctctggagctgttctacaggtgatgccttacagcactggcatgaaaacaccattgtcgaactttgaggcaggacagcaccgccaggtcaattgttgttttctctcctctgcacgcccttgtttgacctgctctgttagttgacctgatgtttaattttgatgatgttgtagtttgttccggccgaaacagccatggtgtccttccctgttgttggtgatgtggacaatgcagctcttgttgcatggacaacaacaccctggacgctacctagcaacctagcactctgtcaatgcaaaatttgtttatgccaaggtttatagcgtatttaaatatttttattgctgtgtttgttaatagtacagtctgcatgtatggagtaatttgttggtgattttgggtacgtgaaaaatagtcctgaactacacctaaagcagacagaccatagaaaatggtggacatttgcaatttttttcctgtcatctggtgaacagctggggttatctggacttttaaactaattcacataactcaaaattaattcaagaccaaggctttactcttgccatgcattttgtaattgtttcatttgccacttctgggtacttttactaattgcctacctattctagagtcatgacagaaaacaattactagaattttcaaagatctgctgatctgcagctaatatgcctctgctttcactgcaacttcagattacccttatgtaaactcatactgcatttttttttatctcagatatatatagctgatacttcgattgctttgtaacttacacttgttttatttctgactgtgacttgctctgtttttttaatttatgtttactgtgaaatgatcgcaattttcatacaatcttaccgtgagaaaattatttggttagcttcgaatactaaaaattgtctcttgatcttgttataggtttaggctcatccaagtttatgatatctcatacaaagaaatagtcataaagcattatattttatatttctatagttatactgttcttagcttctatctgaagagctgcactacggtacaaacaggttaaggacaaatcaaatgggagcgtatatattgttgcagaaactaggctagaccaattgccggtcacggtcaaagttactggaaagaagccagggccttcaaaggggagcagtggagctgctaaaaatggactggatactgaatcgtatgaactactcgaaaagattcatggatcatccttggtaggccttaggtcagtgctactgctgttattaattggatcttatgattctttcttccaatatatccggtatcgcattcaaatttacttttaatatctgcaatcacctagtacgaactgatattacaatgctattcgtgtgactagagccaatgggatttcaaatccatccaatgtttcttatccggaaatcttcatcgttttttgagattctaatgcgtccatttccttttgagggttgacaatgttctagacttcataatcttggtttattctttcttttagttactgaatatattattgcagttgtgatcttcagtttattctaagcactcatgttttttgtttccttttgtgatacagatatactcctttgttcgactatttctcagagctgcaggacaccgcatttagagtcgtagcagataactgtgtagctgatgatactggaactggtgttgtacattttgcccctgcttttggtgaagatgattatcgtgtctgtcttgcttcggggatagttgaggtaagaattattcttcttaattcgaagtatagatacattttactcctacacactatcctaagcttaattgcagatgggaaaaatatttggacgtttctctctgtgaaggctaaaactgagatttacctcaatagttattttccttgaatttagcaaatgttgaattttgtcccgagctcatttttcttcttcttgaatattttgttctcaagagtcactttgctttgctatttttgttctacgatacttccattgattttcgccctatgatactttgcactactttatttaccttgatcgggtagaatgaatgtgataacgtttgctctaatcaacaagagtaacagagtacccattggaaattgaattttttttatttataaatttttttattaaaagttttacaaaaataattttccattttgaaaattgacggaagtagtcgcctaccgccctctgggagggcgatttttaaaaatcgccctcccagagggcggcgaaaatgacgtggcagccggccgttcgctctcgggcgacggccgtcaacgaaatttgcaggcggcccccttgccgccctccgctagggcgattttatactgtgcggggccgcgcctgcaaatgggggagggcgattttatactgtgctctatatttttttataaatatcaatagttatcaaatctttttatattgaaaactatacaagattaaaatctccaagactggtaaaatacaattttattattttttagggcatatttggattgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttccattttcgtgtgtggtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgaatcactttatgtcaacaggcagcgccgaaagttgatagtgataactcgagctgccgcttttcatgtgtgctgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggccttttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggccccagtaccgaagatcccggctgcaaatcctgctggacaaggaccatcagtttcgtacaagtatttaacagtggtaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggaaacgtgcagttaaaacatggtgacatattcgtgcaaaagctgaaacaaaaatgaactaatatctgggctgaactgtaccgtgcgaaaccggtgctgtaggtcgcactgctccgaagctaggggcactcgaaggcaaacgaggtcctgcgaggatggaacatcaagttacgacggggtgatgttttcgtagaaaaacagaaacaaaacttaagaaacctctgggctgagcagtaccgtgcgaaacaggtgctgtaggtcgaggtcctgctccgacggtaggcgcgcgaggccgtggttgtaccggaccagctggaggtacgacgtccacggcgctgcgacaggagaagacgtgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaagtaatacaaattggacgtaccgccacgaagtagtctcggtcacggtgcgtgggatacgcgtccgtgacagcggcaacgtgcggctctagggcgtctggagtgaaggtcacacgcgcacgagtgcgaggaaggtaccagcgaaggtagtcacgatagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaagaaaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaacccctgctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagggtcagggtgcagaaggtccgcctacaattaagaatgaaattttagtacaaaacactcatccggtcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaaaaacaccgtccacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaagacctgccgcacgcaacctgtatagagcaaacttcaaacataagtacgacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatactaaacaagagtacaaacaaacaaaagtgtttagtccgaacactcatcaccaggtggtcacctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctaaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagatatcacgcctgctcctatcaacacacattatttcataccgatgcacttgtgtgccttgagcaacaactcgatgtctccgtgcctttttgattttatcttccatgtactttgtcactacgttgccaaacactatgttgttatcagccatggacggaccaattttcttgtatcgatccctaaagtacgcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaactagtggtctgcgagattgctcatctgtttgcttcgttgtcaactcatccaacttgtcccacaactcattaaatttcttctcttggttcttgcaccctcaattacctcgttctccttatactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatagcctgctcctcccttggttgattttcctcattttgcatcgatggtccaacaacatcccctgcattgataggaccctctacatcttcggtttgcattgaaacatttatatctttctcttgtactgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactatctatgtctcaattcatactattatattctatgctctggatctacacatatgtgttgtgtgctacagatgtgctaaaatatatggaactaaaactaaaacgcaacatatatactcaaacataacatattagtacaaatgcaaaagatgtatgggagcatacctgtgatgaattgagcgaaccagcagggcttcgccgctccccttctgctgccctcccctctctctctttcgttttttttggatttttagtgaatataatgaaatttcacagaggagggactgggctttataggggggaggcaaaaatcgccctcccccagggcggcaagggggccgcctgcaaaattccatgccccccctcgccgcccatttgcaggcggccccccccacagtacaaaatcgccctagcggagggcggtaagggggccgcctgcaaatttcgttgacggccgtcgcccgagagcgaacggccgtctgccacgtcattttcgccgccctctgagagggcgatttttcccagagggcggtaggggactacttccgtcaattttcaaaatgaaaaattatttttgtaaaacttttaataaaaaaaattataaataaaaaaaattcatggaaatttcatatggtcgtgtagtttttgtttggacttcggcacagggcctagttggctaaaaggcccagggctgacggcccggtccatgtcatggggttttggcctagcccaagcatgacatggtccgactggtgtcaggcccgtgccttggcctttacctcgacacgatgggcaggccggctcggtatggcttggtccaacgatcaaggaggcaaaacagacgagggagccaaaataggcttattctagctctataaggcatggcccaaagagacgagtgattcaaaatagacttactccagccatttaggagacggcccaaatagatgagggaggaaaatagactttttccaaggaggagcatggtggctttcgtgccttcggtccggcccgagtcttattaggccgtgcctaagctattggtgcagtacattggcggcctgccccggtcggcgtgtatgtcgggctggcacggcccgactcttcttgggcctgggtcgggtcgtgtcgggtggcccagtttgccatatggcctagagggcttcaccgagaaagaagtgtttagttcacgttaaaattgaaagtttaattgaaattgaaacgatatgacggaaaagttgaaaatttgtgtgtagaaaaattttaatgtgatagaaaagttggaagtttgaagaaaaagttgggaactaaaccagcaagtctttttttaagggttacatgatgagagagaacactggtggtcgtctggtcgggtgaccggaggacaaagatacgatacatccagtcctcaccccgccgccgccatccaggcgccgacgacctcccatctcggagccggccggtgaccaccgtgccacccttcttccccccacctccaccacgccgccgctccacccccgcagatccagaacgcatcccccgccgccaccagccgccatcccggctttgacgaccaccatccggagcaggtgaccactgaccaccgcgccacgccgcatcccccgccatccaccacctgccctgctcgcgatgtgagctttcctctataaacttcaccttcacctgcccagtccagtggcggctcatcaaagattcacaggaacgatggcagccttcagatgtgttccgccatgcctcgggagcaatatccttgatccgggtaggggttttctttcggacaagtgcttcaactgccgcgaggttggtcatcgggtagcaacgtgtccggttgttcctccccgcccgcagcgtgctcgaccggttgccaccgggaatccaccacgctccttgtcaaagctgcgagggaagtgcttcaattgtctggcagctgatcaccgtgtcgcggcttgcactcatcctccccgttgcctttgttgttggggataaggccatttcgctcggtggtgcccttcttcaggccacttctcctcagcttcacagagggctgtccctgttgcctactcttcacagagtgcagggggataccagtcgatgttgatcacgttcaatgccgacgcgatttctacagctttgatttctcaagctattagcgagaagctttgtatcccacctgccgnnnnnnnnnnnnnnnnnnnnnnnaagatgacaaatgacaatgttggtgccgagtcccgggtggaggttcttccaaagatgacaaatgacaatgttggtgtccccaataaggtggttttggggtgccatttgccagatggtcaggaagtgccctcttctccacccgagggagatttggagaagcttacagcagcgccccttccttcagttgtatcgcccctttctccgagcgcacctaacacagccgtcgcattgactgtttcaacatcccatgggagtgttccttcatctctcaatgaaggacatggggtatctagcaagatagctgcaccaaaggaagagcatgttactccaactatggaccctccatctaggtgtgagcatcttcctcttgaggttgcaccaagcaacctggtgacagataaagcagagctacttgagatcacaaaagctccagcggtgaagaataggttggccaaaagagtgcggcaaaagattatcactgccacctctcgaagaagtgtccctctaccttcaaacatgaagaaaaggcgactcctcattgaccaaatgaaaacatatgtactcatgaagaagctaggcattatcacaaaggatgaggaggtggatgaagacactatggataggtgcattgcgttcctaaaagaggcatacccgggacactatgttcagcttgctgtaatcttatttgggctacacaacgtggctcgtgttccaggaccttaacctagattcatattagtttggtcagatgcgtgacttgtttaggtgttttaggtgttttgggtgctttggtgtgacttgtttaggtgttgggtgttttaggtgttttgggtgctttggtgtttgcaggtgtttagtgtagctttggggaatgtattatagatgttttggctgctttggtgtttgcaggtgtttagtgtagctttggagaatgtattatagatgttttggctgctttggtatttcaggtgtctagtgtagctttgggtaatgatcttgaggtgcttgtaggatggtgttttcagtgggaaccctttcttgggtcgatgtgtatctcttctttatcaatgaaatgaagcagtttctgcctttgtttttttttataaaaaaaagagcataaacttgaaaggcatagggatagccttcacattaaattatgaaatgcataagcattatctatttgctgtagtaaaaagtgataaatatgggccctacaatacttttttttttcaaatgactcttacaatgataggttcatgtgatcttgctgaccatgcacaaggttttagcagaaatattggcagagggtgaaaagtaacaatctaatcagcagttaaggttcgaattgaaaggtttttttactctatatatatatatatgtgtgtgtgtgtgtgtgtgtgtgtgtgtgctgctcatcttggaatatttgtttgttgatgttagtgaactttggcaaaagggggtgttggtgaattctgggggagggatgtgtgggtgggtggggaggtgtgtgcatgtgcgtgtgaaccatctacattactactatgggttgcaaggatatggtctgtgactgagtccaccttgagttgagtatctttaactttagtgcctttttgttttatgttgtgtattgacattgttgccctgctgcattctttttctttccttttctttttgggaaatatgcaaaaggttttgcatatcagcaggttagaaaggttcgcctacaaagatcagatgcttgaaggccgaagccaacaattggaaaaccaatcaaacatgaaagaaattaggtttacactcttgcaacacgaattagcatcctagagagcaaaatctctactgtgcgtattcttctttatatggtgcataatgaaataccttattgtatcatgttactaatttggttagcatgggttatttgatttcaaaatttgcacttgtactctttaacctgaagtatcaaaatggattttaactactctgtgaacaaaaggatggctcctaattcaggttttcattgttgtacccaacaataatcaccatggttttaaatcattagctactgtatgtgctagtaaaactcacttaactgattgtttctttcaaatgcagggtaccgatcttgttgttgctgttgatgatgatggtttcttcaaagacaagatctccgaatttaatggtctacttgtcacagacaaagaaaccaacaaatatgtaatcaatgctgtaaaggtaagtgttttcaaatgttcagttgccggtaacttatgctaactgtaagcagtaaatttgcattcagcttgttcagaaaaaaatcatgcgtttttttacttgatgttttgtatgctgaaattgtatgctacatgtaatattcagaaaaaaggaagacttgttagtcacggaagcgttatacataagtatccatactgttggagatctaatacacctctcatatatcgggcagttccaagctggtaggtattttctgctggtgtaaatttggaccatatactagcacattcttctgctggctttaaattgagctgtagtactctgatattcctgctccaataaaagtttttttttggcatgtttattcttaaaaaaacgccgaatgcttatctgaaggtttttaatttgattgaaaaattgaatatagggctttgaattgaaatatactgatagaaaatacatttccattttttttcacatttgggttacttctcttaccttttgtttataccttttgatgtaactcagaggaatgtagcctaaagatctttgttgtagtgtaggttcatcagagttgaaaggattagagatcagttgctggaatgtaataaggagacatactgggtgcctgattacgttaaggtatgctgaactttgtgttttaatattggctttcattatttgtattgttaacatctttgttatataaatgtgaccaaaggaaaaccctgtagtcaagtgttgtgctactcgagtgggctaccacctttgatgctagcctttctctcatgtaatctgtgtgactcctttcaaccttataaacattggcaggcagttattttccagcccagaaaaaagggtggaagacacgtagcaggaaatcttatattgtaaattctgaaagagctaaaatcaaatattgttcctagcttagcatgcttgttgaacgagttgtttgtccttaattcttaacttggctctttcttggatacagagacaattttcaaaaccacttgctccttcactgatatttccaatgacaatcaattagtagaaaatttcatccaaaacatttttaaaactcaaatttggccttttagccagaatttttatttttttgggtgctgggccctgattactcaaatttaaatgtaaaatgttccatctttttggcaagttagattggactgataaatatttttagaaccaacataaaaaagctaatgctgttttcccctgatgcaaaccatgaagttcagtacttcaatgctcattttcaaaggtgtgtttagttttgctctttgctgatacttggttgatttctattctgatgctttcatggtgtaattctgtagtactaaatttgtaggtacaggacattggttgtgctaacatattatgtatggatggacgctctactgctacttcattcatgcatatgtgcaaccaaatcatttctcatatcagagtttgcacgtgactttttgtcatgcgttttcagattgcacgtttaagactttccatgtggtttcttgccggtgtttatgctgaaatgtttcttgttacttccgagaagctcttgtgagagatttagtttgtagtaactaggaaaccacttaagatttttaataaattgttgcaaattgattttgtgtttcttttacctagatttgtggttcttgacaattcataatgcaggaaaagagattccataactggcttgaaggggctagagactgggctgttagccgaactagattctggggcactcctcttcctctatggatcagtcaagacggagaagaaataattgttatggactctgttgataaactcgaaaagttgtctggtgtcaaggttaattatctttgttatgagagttttttcccctttgctggtcaactaacgccggtccactataattttaatttgagagtagtactatttttttttcatatttcttgagttccaaaatttacatagcacttgacacaaacctgttctaatataaatcctctaaaaatctttaccagattagtgatcttcaccgacaccatatagatggcatcacagttccctctcagagaggggaagagtttggggcgttgaaacgcgttgatgaggtaagttgatcgcaactcataattttacatcaccttgtacctctcaatttccttgagtcttgattcatgtcccaaacagagaaaaaaattatttctctgttcttgtttaagatgtacttttttgatttggattattaggggacactctacctaaaaataattttctaacatagcatatgcaaagagtagagtagtgttcatattgtatgaaaataactgtaggtacatagttccacatcttattgcaaattcatgtttgtagaatgcttttacctaatcttgatcaacaattataaaatgcatctgtaaaatattatgtctaagtttagaaaagtttagattgattattctatttataacatcatagaagttcattgagatagtgtaatatcttaaattattagtaatatcttaaattactaggaaggcatatgaactgtagcgtggccaattcatgttcatcttttttccccttttgtttttcatgcacttttcagttttgagtattaatgtacataatttaaagagaaatcattcatccaagttatattgataattcagcatattgcaggacttacattatgagtctagatttgcttaatgcctgaacggataaatagctattgccgtgtgttttagtggcataaattttaatgctatcgggagtctatagtagaagttgtagcctgcaatatagggtattgaaataagctagcccaattggaagcatggtgcatactaaatttgatgaattcagcttgattactccttgaattatatgcaaatctaggtgttgtgaaatgatttatgtcaatttcatacaagttaaagcagtgatgttggatatcatgtgtataccctgtcttgtcttcactgatgactgttataaattgagaaagtatcttgtgctcaccattcaggtttttgattgctggtttgagagtggatccatgccatatgcctacattcattacccatttgagaatcgcgaactgtttgaaaagaattttcccggagatttcatagccgaagggttggaccaaactcgtggatggtctgttttatctcctgatcttttatttaacagctgttcttttttaatttcccttgatggctcaacattgtaccttttttcggagttcgttctttctgtagattcatgatcataaaacttgatagtattttgtgcatataaaattttaatcgttaatgcaatttaataagaaaaccttgtccagatgtgcttacctgtttacaaatgtgtcgaaggacctattcaacatataaaattttggatcttgcaggttctatactctcatggtcctgtccacagctttgtttgggaaacctgcatttaaaaatcttatatgcaacggtctggtcttggctgaggatggcaagaaaatgagcaaaagtaaaaataattacccttcacccatggaagtcattgataattatggagcggtatgttctagttgaagtcagtgatattggcttatgctgcttatcattttactgatttatgctgcgtctagattttttttatcttgattatacatatgattaattttataacttctgagctgcgattcatacgttcaacatccttttcttttccaggatgccctgaggctatatgtaataaattctcctgtcgtccgtgcggagtccctacgattcaacaaaaatggtgtccatggtgtggtaagtttctttgttccttgcatttatgtaattttatatgtttcattcatagctatattcatatggtcaggctactgatccacatattggttatacttctccagttatgaattatgatagtttttgagaaaaatacttaacattctttgactcaaccaggtgaaagatgtcttcctcccatggtataatgcttatagatttcttgttcaaaatgctaagaggcttgaagttgagggtcttgctgtattttcaccaatcaatcaagctattcttctgaggtcatctaatgtgctagatcactggatacagtccgctactgaaagtctagttagttttgttcgacaggagatggatgcatataggctttacacggttggtcatctttgattgatatttgttctcaacttctgtttcttttcatatttatgttgtgcttgatatataatgataattcattatcttacgttctcaacaggttgtcccttatttagtaaagtacattgacaaccttaccaacatatatgtgcgtttcaatcgcaagcgtctgaaaggtcgtactggagaagatgactgcaggatttctctttcaacactttaccatgtacgcagactttcagtgattttctgcttttgacaacttcagctgaacaggaaaaaatgcaagtcacaacaggatatatttttgggataagatggtggttaatgtttcaatgattatctccttaaatggttaactttgtgtttttgttttcttgattctcattccttcatgtcatggaattatcttgcaccgtttctaatccattttctcatgttcttctatatgactatatatttcattaagctactcctttttgttaatatagcacaataggagactcctttagtcctgttgtagtgctgtttacttgtaaaaaaaaggctactatttttgcttgaattcaacaagataagctgcctaggaatcagaagtttgttcccatggcatgtatttcacttatgtggttccttccagattatgcctagtatgtagaaataaaatttcttgtacttatctaagatattttgatgattaatttaggcgcttgtaacaacttgtgttgtgatggctccgtttactcccttcttcactgaagttctgtaccagaacttaagaaaggtgtccagcaaatcagaaaagagcattcatttctgcaatttcccttcctcaactgggcaggtactttttttaatcagtttaatactcctcttggttatatgctgttctaccagaagtcagaaaattgtatacagtgtgcaacttatttggctctatgatcagatagatgagcgtgttgagcacagtgtcaacaggatgatgaccatcgttgatcttgctcgaaatattcgggagcggcataacagacctttgaaaacaccattaaggcatgctcattatacaactatactatttacacaatttcttgttttatggtgaattgattttatacatatagaattgaccaacagacctagaaacaaaagataaatctgcatcatgaacagttccttcattttttttctttttatgtttgtcactcggtgacttgaatcaatcgacatatctaaaaatgattgcttattatttcttgtttcccaaggcctatctagctcatgtataagctctttaaatatatttaactgagtaactttcttgactttccagggagatggtagttgtgcatcctgacaatgattttcttgaagacataactggaaagctgaaagaggtttacagcgaaactaagattatctattaaaaaactcccagcatcccgttctaaatttatgcaaaattatatctgcgatcagctgatcacttcagaatattctgccttcttttctccatcacatagattttcaatattctgcatgttttcatttttcattctcatcatttggcgactatgatcatatttattgttcaatatttgagttattcctaattatggtaagcattatgtgtttatatattgattccattttctgctttgtagtatgtcaaggaggagatgaatgtcaagatggtcactgcttgtagcgatcccttagtgtattcatctttacgtgctgaacctaacttcaggtaattaatgcctatttgaatgtgcttgaagacttcctttcacatttgtagctgttttctaatattatttgtgtttctgtagtgtgttaggcaaaagattaggaaaagacatgggcaaaatatcaaatgaggtgaagaagatgactcaggatcagatcctaacatttgaggaaagtggcgaaatattttttggcagtcatctcttgacgttggaagatattaaggtaatagtattccttattatggtaaaaatgtacccaagtgtttattttgatcccactgacttgttctgttttcattcaaacaaatgtcagtgttaagggattatgcctgaacattgttgctagaggaaatctttctcccttaattaagtgatctttgacttcatggatatttgtgactgatattaatatagaataatatttatccgttccttcaatttcgttcttaggtttttcgagaattcaagcgccccgcaaatgtgtcagagaaggaaattgatgctgcaggagatggtaccttgcaaacatcttcacatagtttcagcatttatggaaccttttcttacctcacttgatattgttgtaggcgatgttttggttatcttggatctccaagttgatcaatcattgtttgaagctggagttgttcgtgaggtgattcaaaaattatgtcttatcatttggagtatatataatgttccatattgtagatgaatttctttttagttataatgtcaaatactatttggatgtttccttgttcataccaagccgagtagtgctttggaccaaggctggaaaagtccggctttgaaatgccaggcccaagtttggttcccagtcaaaagtatagtttttctatgtgaaatatcaatatttaattatttctgaagatttatgaataaatatcatgcctctagatgatcatgcccaaatttctaacttctcctagctattgccatgataatgtggtattacacatgatctgcaaatattacctgcaaatgtaatttttctacacatggtctgggttttgcgttatttaattacatttaaagttttcatcgctttgtctcttccattatatcttgttcaatttctgattactgtagtctaatgattatgaacatttttaccaggttgtgaacaaaattcagaagttgaaaaagactgctcagctgagactgaccgacccagttgatgtttactacagttcacaggatagcagtgatagctctctcgaaaagattttgcaatcgcaggttagctagttacttaagctaattatatgcgctttcatggtttgctccatgatatgcatatatggtggtgttggttgcaggatcaatatattagagatgcacttggttcccctcttacctcgaaggcacaggcacaacccaatgtggttagtttgaatcaacatactttttacatgacatttcctgcttgccttttgcatgcgtgtgggatatgttacatctgcagtttaaatttgaagttatgtatccaattttttatatacatgtaataaaatgtgagatttgcctgataaacagtacatatttaagaaggatttactattttatatgtttttagaagttatattagttggtataccgtggataaatattgtacggatctccggttgtctcaccatctcagcttttcaccttgctcgcagaattttaaacgtcttaaacatgcgaatattagttatccattgatcatacatattgttatggttttgcaggaagtaatctgtgaggaggcctacaacgtacgtggcatgtctttcgttatctacgtggcaaggtattgccatgtcctttttctgtttatctgaatcttattctgaatgtttgattatctgaagagtgtgtttcacactatcacaccttccgtttactacaggaaacagtgaagcttgttcatccttttatcaaggtatattctgaccgaagtctgtcgtccaagctagaaaactagtttttgcactcttgcattctatcccacataaatatatttcggctatgatatatgatttctcttgttgcttctgtagattgaagatttcccgtgagtagatcccttctttgaatttggaattttattcaaagaaatatgtggttaatgtaattgtagttgtgtggttaactaggaaatagcaccggctattttcgttagtgtccttcccctccctctctttgtaatatactccctccgtttcaaaatatttgacaccgttgatttttttaagtacgtgtttgaccattcgttttattcaaaaattttaagtaattatttattcttttcatatcatttgattcattgttaaatatactttcatgtacacatatagtttaacatatttcacaatattttttgaataagatgaacggtcaaacatgtgctaaaaagtcaatggtgtcaaatattttgaaacggagggagtaaaaggcaacttggcaagtctttgtaaatggggcaattacgtaattaaaataacttcacgagccttgctgtaacatatacaatcagctaagcaggcctgttcaaaatagaatgaaaaagttttcccacaaggattcggagctctgattttctggtcacagtttaaggttaagggagtaggttgtatagcagagtttaaggttaaggagaaactattttaatgccctaaataagtatagttttcttattatccctaaataagtatagctttagttagccagtgacatactaagaataatatgaccattaatatagagagaaatcgagaagaaaagaaagcaaggggggagtattattgattcaatgatttaaggaggaagcactgttgattctatgattaaaaatgagaaaaagatgtactattagggctcctttgatttggaggaaaacataggaattttagaggatttcaatcctataggaaattttttccctatgaagccctttgaaacaaaggattgaatcctatctaatcattcctatggaatggacaatcctatagagattttggaggaaatttagcaagagcttcaacctcttgctaaatttcctttgagtctatatctctcattcaattcctgtgtttttccagtagttcaatcaaacgatcattcctgtgtttttcctgcgttttgcaatcatctgttttacacttatattcctatcaaaatcctatatcgttcctattcctacgttttctcaatcctgcgattcaaaggggcccttaaagagttatagcgaacctctagaactacctatttagatactcctacatgcttgtttaggaatggagtggaggtagcagagaagatgactaacaatgataaatagtggccgggtgaattaaaaaaatatttactctaaaattatttatattgcaaattcttaaccttaaaaaaattccttatataaagaaggaaattgttatgcgtgacttaactttttagataagacgaatggtcaaatgttgagcacggaaacttatggctacacttataatgggacggagggaatactaaattactctcgctattaaagcatgtttaatagagttgttatttttatactcttcaaatgtccatttaaccaccttgaaaagaattcacagactcaaatatatctttcactcgaagaacaaactttattagtcacctggtcacgctcacggccatattcgtctgaaactctgaacaatggtccatgtgcaacaacacaaggatgacccaaactcaatcatatcaacaacaaaaacaatcaaagaaacaaaaaaaaaaaagagagcactcttcactcctcgatgattcctaatctagaagtcctaggatgaaagcacttgatcctattcctaccaccatcctgcctcgacttccgcgacgcccgcgccaggaacgcgcgcgccgccgccatttcttcgccctcctcctcctcctcctcctccgtcgccggcggcggcacgatcgccgccttcgccttcgccgtcgccgccggtgaccggtgcagcctgcaccggaacgagcccgggtgcgtcgtcggcgcgcacaggcagtacttggccaccgccgcgggcgcgccggcgttcttggccggagaagaagaagacgacgacgacgacgaggagttcacggcggcggccatgggtgggtgcagggtgacacttccagccaaccgcagtggcaagcgaggcgagtgattaattttgctactaatcgaagtgaatgtgaattaatgtgatcagttcgtgtgtccatataaaaggttgagaatgtgttcgctttgggacgcaaaatgtttgttggtgttgagcacaactgcctcctcgtttggaggcagaaaaaggctaactgaattggagagagatcctacaaaaaggggcgtactttacgtttatctggatgaaaggataagatgtcgattccagtgaggacaaatataatcgcggtgtaaagcaccgtttgctatcttgaagattgtatgatttgtctttgtgttccttgcactccggtatgttttcttgtgttttttttaaattacatatagaagagacacaccacacccacacagcttaaaaagaggcgaaacacattctccgtgatcctggtagtcgatcagtcgccaaaatggatcacaagacattcgacgtcggggtgatcccagtgacttggtttgtctggaagaaacacaaaagggtgtttgatgaaaaagcctccacgatataacaactttgggtggtcataggagacgaatggaaaaccaacatggaggacggcatgcattgaagagcaggtacaatagcatgctataaaccagctgcaaacatattttaagaagataaataaggagagagaagaacagcgggctacaaacatattttaagaagataaataagaagagagaaaagcagcgggctataaatttgtagacagctgtagcacggactacaaaacacagtgcgtatgataggtgggaccaggtattaatagtgtagtatataactattgtatgaatgagctattagattggctatagatgaattggagctagtagttggctatactattaaacttgctcttagcccgatagtggtggtcggagtgcagttaactagttctctaaagttttagagtgggtacaatagcatgctacaagttagctgtaagcacatgtggaaaagagaagagaagagagagagagcacggactccaatacgttgtatgtatgagaggtaggaccatatattaatggtatagtatatgtttataggtaactattatatgaatgagctattagattgactatagacgaattgaagctgctagttagctatactattaaacttggtcttagggtgtgttcggcatcctgttttcccaactctcccctttcgtttttcgtgcgcacgcttttcaaacggctaaacgatgtgctttttttataaaaagtttttatacgaaagttgtttaaaaaatcatattgatctatttttgaaaaacaaattagctaatacttaattaatcacgcgctaatagaccgtttcgttttccgtgcgtaccgttccttttgggaactggctgcaatgccccttttctcaacccatctctctcatttttcgcgcgcacgcttttcaaactgctaaacagtgtgttttttgcaaaaagtttctaaatgaaagtttcttaaaaaataaaattaatccttttttaaaagaagcaaatacttaattaatcacacgctaatggaccgctccgttttccgtgatcactctttaagatagaaacttgttctagcgaacacagcctaagtagccttgtaaaaatgtggttgtaacagcagtgcattgacgtattgcggaagagcatcgcagcgtccgcttttatatttccttcattttaaaatgcatgacttgttaatatttcatatatcgtttgatctttcatcttattttaaaaacatatatttcatttattttgttgtgacttattttatgatcaaacaaaatataatcttaacctatacttttacatatttatattaaattttgaatgaaacaaatgaacaagttatgtgaaaagtcaacggtgtcgtatattttaaagggaggtaagacattctttctaaactcttaatatactttggccggcgagcggcgagacatttcaaatattccagttagcagaaaagcaaaagtgttttgtgttctaaaaaagagagcaaaagtaagtttctatctgtacatcattctggggctcttcaagagcgctccttcctccaaatgagagtgatgcaccgtgtacggcgacgccgccgccctgagctccacggcgtcgcgccgccgccgcctctccctcgagtgcgccacccacagcaccaccgacgccagcgcggcgacggcgacggcgagcaagccccggtacacctccgcgctgtgcctgccgagccccgggcagtgctcgtcgccgaccacccggaacgcgcgccggacgaacgcgcagtccgccatgtcggcgagcaccggcccgtaccgcgacagcgcgtcgcacgcgctcgccgccgccaccatctgcgcgtacatcgccggcgtgaggcgcccgacggtggcgcacacctccggcgccgccgccgcggcgcgggtggtgcggcacacgcgttcgcgccacgcgcgcggcgcggcggcgaggtcgacctcgccggggtcgcagcgttcgccggggctgcacagcagcggcaccggcgggccggactggttgtagtagagcggcggcgggaggccggcggcggcggcgttggagacgttggcgatgacgccgttgaggacggtgacgaggtggtgcgtcacgtccttgctccgcgccagcgcgtccgcggccgccgccgtgtcgacgcaggggaggatgtcgtcgagcgccgtgcgcgcctgcgggcgctgcacccactcgcccatggcggcgcaggtgtcacccaccacgctgaaacgtcaaggaattcttttgctcagtgtcgagacagcaggtacgtgaggtcgccatggcagcaagcaacggtgaaaatgtagaagaaagtttttaaacaaaacatataccccatcacaaaatatgacttgtatatcatttaaaatttgtctaggaatattttgtctaaaaaaatttacagaaaatctcgacgggatacccttctatgagacaatacctgatacctgatacttgtagtggtactagctgtatggtacccgatacctgtgatacttgttacccggtacctatgatacctagaacctaatacctgtgatactcgtgcaagagaatagttaatatgtctattccgttgcaacaggaccctgttttgtagcagccctcaaaaaatttatcccacaatataacaacttctacacctacatttcattcttaatcaatcataatcttccctcattcaaattgactacccactttctcttcttaaccaattattatttttctccaatttaatatcacttatttttttcttaatatccatgtccagtggtaactttctcttgttcaattctacctgcatccttatattttggaacatatgtatcattttttgagacgtgaagcaaataaaaaatagttttttctagacatggagcaaataatttgtggagtgactaaaaagatcgtagccttacttgtgtagcagaaggaaggtgccacagagcaaaagcgttgctgcaaccagaatccacccaagaaacaccaacctgcatccaaaacaaccgtgtggctcaacaccagtaacagatgaatatttgggaatcttatgccaactagggcaattctttttaattttttgtaatttcagcatgtcaaatgaattagtgaaatcataaaactctaaaggagtgttttcatgcttacacatagacgagtgactccattccgcatattgagaacgctgagaaaaaaagatgcagaaccaaataagtcgcacaaacagattaattacaaaatgtttttgcaatttcaattcttcaaagaggaaaggaacttgttttctcaccgagcccaagaacagctaggatcaacatcgtggcagcaacaacaatcaaaatcttccttctgcaaacagaacaaccgaaataaaagaatttctatgaacatcatcaaggaaaatacttgttatgaacactcataacagcagtatctatactttctatataattggtacccactaactcctaaaactcaacatacaagtgtgtggtatgccacatcatcatccactagcaattactattatttagagtattttagatctcatacaaatatgatatatcatttgtaatttagttgtatttttaaaacttaacacgcaagcaatgtcaaatcaccatcttcacattatttaaacatataaatctatcatttttataatatataacatacattcatctatatatcccgcgctgcggggtgtagtttataaaatatagcaatctataatcgaatgaagcatatcttatcttagtaggacgaatctgaataagagaaatatctatattcgcaaactagaatacgttttttctgattttaagttgctatattttacgacggattaactgtttattttaccattcatcagtaagctttttacccacattgtctccaaggcgtctcggatcttggcggcgttgctcgccatgcgcgccgcgagctcgtcggcggcggagctcatcttgcgcacgacgccgtcgatgctccccttgacgctggccggcagcgacacgggccccacgccggccgccttggccgcctccatggagctcgcgaatcccctcaggctcgccaccgcgtcgccggacttccccgccacgtactccaccgtcgccgccgtgctcccgtcgaaccgcccctgcccgtcgtacagcacgccgcaccccacgctgcaaacaatggcggcggcggcggttagtttagtttactcaccggcggcgaggtgaggtgaccggagaaattatacgtacgcggcggcggcggtgaaggcgaggaggaggacaagggagacgaccagcgccgtgcaggagtacgagccgccgccgccgcggctgctgccggggcagcagcagaagcagcagccggcgaggaagagcgagacgccgaacacgacgaaccagatcgcggccgcggcgaacaccggcgccaccgtgaacccgaccgactgcatgcacgcgtcgtcacgaacgacgagctcagaataaaatcaagaaacggccatggaacaagaatggaggatggacatggatcaagaggaggaggaggaagaagaagaggagctcacggcccagtagtgctcgtcgctgatgttccacccgccggagtagagcctcagcccatcgagaggatccttccgccgcgtccgctccccggcgagcacgaacgtcgtcgtcgacggcgagctcctgccgcctccggccactgccgccgccgccgccaccaatcacatcaaaatttcacacttcttgccgcgataaatcagacaatgcacacgaaatctttacctgcggatgcatcggcggcggcggcggcgagcaatgctgctaagacgacgagagagagcacgatcagcaggaggagaagaggaggagcacgagacgccatgatcacgaacggcattgggcggcgtcaactactacatgttctacctgaatttcaaacgacggcaatggaggagatggcggaagtatcggcaatgaatttgtgagtatttttcggttggttgtttgttggcttcgaaatttgggcacgaacaggtcttcttccttccttccttcctcttgactcttgcaaatttaattccattccagcttgcatagttgcatgcaccgagcgccatggctaatttattttcagtaatgaaatgagttgtatcttatactacaatggtccattaaaaatctgctaatacctctacttttacagaactgtttcattttgaaaaaaaagggattaaattatgctttgacccttaattccatatgatatgttttactacgtcaaaatacagtactacctccgttctaaaatatagctatatagtataggatgtgacattatctgtccagattcatagtactagataatgtcacatcctatattagatatcaacattttgggacagatgaagtatcagatttgacacatccctaatattactatacatttaaacatatgtataatatataccaatattttaattctataaaaatatgttctagtagctgtaaataccaatattttgtgatgaatctgccattaaattttagtacactagatgtatgtataatttggactaatcattgatcaaaatctaacgagacctggtgatgaatttaagaaaatgaacatttcgccatgttcaaaacatagtttcgctagaatgtcatcccaaaacgtgattgataaaatgccaacatgaagcgtatgtctactgccactttgccattttcgccattttatttattttcaaaaagattttctctcctctactagatggtgagataaaattgccccttataaactcagagaacacggtgagagaggagacagagagaaggggcggcaacgctgcttgctgccggccggcgcgccgcctctccccattgtgcgcgtccgccgcggcggccttcgcatgctccgcccggcgatggagcgggtgaccaatgaggagatgatggcgaggaccacatcagcaacctcccggacgaccagctacgtcttgtcctgcgctggctcgacacccgcacggcggtcgccacgggggcgcttctcttttcttctcctcttcctctcggtttctcctctcgttccctttttctctcttccttcttcgcttctttgctcgacgcggcgagggggcgtggctggtgcagcggcaaggctaggtgcgagctggcgaccgggccaaggcgacgacggtcggcccagcacggtggcggcctgagggcggccaggcggcgtcgggtggatggggagagaaggttggcgtggcggcgtcccagcgccgatgaagacggccacgggggcgctcgcgttgctcggccgccaagctcggtctcgccccgtcccacactgccatcgacgccctcgtcagcaacagcgaccacctcgccgcgctcgatcttgatcccctttcagccgatgaggaggggcaatttggtctcatcaagccaaattccagcgaaaatggatttgaaaatgacgaaaatggagaaaatgacaaagtggctgtgatcgcgcgtttcatattggtattttagcgaaacgcgttttcatgatggtattccagcgaaaccgccttttaaaagtagccaaatgttcattttctcgatgaatttagcctgcaacggctgcaatatttgagaccagtggaaagtgaagctgaacttcggttgcatgcacttgcacatttgcgtggctagctgtattgtacgtaacttatgtagccagtcaacaacctagccataaattatactagctgcacaatgtatataccatcaactatacaatgtatatatagctgaaaaaataggcatgttctgatgtactggtacatatacaagcaaatataccgtcaactgtatatataaatgcaaaatagccatgttccatgtgcatgctaccacgttacaggctttgacaatagggcatatcatgcgcttattttggtgggtttcttttattatcgttttaaaagagaccatctatacatttatcaataaatcttctcctaaaaatttatgtgatgtaaatatagtactccctccatctacttttgataatcatattttatcttggcacacagaccaatgataagtaattctacttatcatctatttaaacatgctactagtattcctcgtaaacaagcgattcattaatatttacatttctcaatgaccatatagccaatcatatgtggaagaatggagagtcatgcattaaatccgagaaagtcattaagatgataggttgttggattaaaatatgcctatcaaaaataaatttttcagatttagaaatatgactatcaaaaaatatatggagggagtacaatgtaatttacattgtaacttaagtgtaactacaatgtaactggtatgtaacttttatttaattttgaaacaattagatttactttaagatttgtgcaagcgaaaaaaaaacacaacgcacacataagtgaggggatttggtcccgtgaccccatcctcgtgaaaatagcatgttatcgcaagatcttttaaaattatatacaagttgtatttatattgtagttacatgtaagttatgatgtaattacacaatgatcacattatatttacactatcaaatttttatgagacaatttatagataaatgtatagcaaaaactgctttagaatatagttataagtatttagacatttaaattttacatctactagtgtcatgtgtgtatgtcgcaacggtgttggaagaaatacgaacggatggttttaggggttttttttgcctgagctaatctttattttcatggcatcaattgctagccgactgtaaattatcatcgttgttagtcgcgcgtaattgccagccgactttaggattttcatcatagttcattttttttcccatggcttatcggcttggatctatctgaagacttaaatgaatagccattgctgttcagaatccgataggacacaatcgagcggcgtttgcttttgtttgtttttgtgcagctgagtttaaattcgaccttatcctcggtgaaaatcacaagccgtgccactataactgtatagaagctaatcggccaattaaatctagagagttactatacaactgaatcatgttaggacgtacaactgaatcctattgggataggatgataccggttaggtatcaggacatatatctctaaggtatactttttccgtaaaaaaaaaccaatcctatgtttgaatctagacacatgtattaggtttttttatttttggaacggatggagtatgtcctgatactccagacaccaaagcatcgtcgccagtggtcccattgtccacgtcccacgtcagagctcgtcgccgacggccgcatcctccattgtccacgccacaatggagctcgttgctaacgggccagcaacttggtccatttatatatggcccattcaattattgatctcattggtccagtcgcgttgcccatttcttttctaaatgggctttcacggcccattaattggcctagatgggcctcaactttggctaattggcacgggcaagcagggacacagcccgaaacgcagaacagagtctcctcccatcacatctgcaccgacaaacaaaatgaaaaaatgtcgaatttttttcatttttaaatttttttcttttaatatttacagaaataatctatcggcgcaactagggcggcaagctaacgtggcagacagcagctcgacggcgccgtctgccaaaaagcaatttttgcagccctgaagagcatttggctcgtactttttgcatctgggccccttgccaccctaccagaggacggcaagggacccagatgcaaaaggtaccagccaaaaagtactagtcccgggctagctttttttgcaaagggggggggcggcaagggttttcgtgcaaaaaaaaaaccctccctctcccgtctgccgtcaccgcccgtccctcccccatttgccacgtcagcttgccgctctagtggagggcggcagggtctggattattttttgtaaatattaaaagaaaaaaaatttaaaaatgaaaaaaattcaaaactgtctcgccatgaactccgaattttgcagatggtagtacctaataaatacagaagtagctaccaaattggacgacgaaatcctttgaattttggggctgaccggaaacgatagctgctgcagaagcaagtactaccaacataccttttgcaaatggtactcccttcatcaataagagttacttattttatattttagttttttccaaataagttatttctatttgcagtctctatacatccaacacttaaatgaagagataaattaaatgttttaaattaaatgtttgatcaaaatctgagcagctatcttaatactcattggttgcatgcagatatacactcattgatctttattatatgcaagatgagttaattttttttggttttgatgataataatgtaacttttatggaagaaaggagaacaagataccacattggaggatgaaatcctttaaattgtgcagatggtagtagtacatcaattcagaattgagtgtgatacaaatcgaaaatccaacaagctctcgagttcttcttttcgatgtgtttacacgtccttctcgggatacaacaagaaatagtctactactactcactccttttacaaaatttacacattcttttatcacaagaccaagaaaaaaaaactcatcttgcatttaataaagatcaagaagtatatatatgcatgtgaccgataagtattaagatgatttctcaggttttgatcaaacatttaatttagctttccatttaagttttggatacattaaaagttacaaatagaaataactcacataaaaaataaatatgaaatatatcaacttggagagagtacaaacgaatgagctaattaatcgtcgcattctctagtcccctcaattacgcttaaaatacatgcataaaaccatgctcgagattcgtgttctatagctccggatttcaatacaagactgaccagatctcaaggccttgtaaaaaaaaaaaaaaaactaaaccaaacatagtgcaattaacccctcgccgagccgatcagcaacagcaacagggaggcctacggcgatgaggcggccacacgagatcccatccaacgcgtggcccgacgcgcggcacgtgaccgcgcctccccgcattaacccccccttgtgtcagacccccctcacgtgaccggcaccaccctcatggcccaccgccccgccacgtgtgcgtgccttggattttctacgcaaaggtcgtacgcccacacgtgcgggggcgctgcacatgcgcagcggttgtagcgaaagctaaaaaaggagaaaagtactattataaaaattaaagatgtttttaccgatactttggtacgtcatccgtgtatgagtatatttgtaatttcgttcgcttttagaaatacgtaaggagtcatgtaagaaatctctttaaaaaaaacttgcatattaacgtgagacgattaaactcctaaccacagctcatgattttctcatgtgattcaaatcctaagacttcacccgttaccatgtacgggtattttttctataaaattaaaattaaaaaaaataaaagagaggagttggaagttgggatctcgtggaccatcgaatttttctactgtcaccagttaatcctggccgtacatcaccgaccacggacactggcatctggggccccgagacgtgggcccacttgtcattgggtggcggtaggttgagggtggagggatggaggggttttgggtggcctttgcagtccggtggagagatttgaccgtaagaccgacaaagtgatgtgttagaaccatgaaagattactgcgatttactaaaataatggcatgattataatattataatgagatgtctacttgggtgtagtgtgtgacccaacaagctatagctagtagtaaaaccagatgcatgatcaaataatagggtgacctacaaggaggctacagctagaaacaagaaacaacaacatccattgcttacccattactcatgggggctaattagcagctggtccttaatttgcttagacagattaacaacgtgatttttaggtcaaatcctagtagctggatgctaggggaaattaaaaggttgtaggctttggagctttgctatcacaagaaccgggttgttgttattccatggattattgataggtacatgcatgtatcccattccccaattcatgctttagccttgtcataaaaatataataatgtaaaataaataaaaagctttagcaaattccaatctctctctgaataaagcttcaggtttctttgcattttagaaaggagaatctcgatgtagctttcctatttatgcatgcaccactgatgatatatacagagcattggcaacgtattatgtacctcattcacatgtcatgttctgatgctttctttatctgacactttctcctctaatccccatttcatctgcattcaacaccatcattgtgcagagaaagggagtgatgaaacagctgttcctgaaacaaccaaaattaaatcagatacattcaaaattaaattttaaaacttaattttagagtgattttgatgttatttttccagcattggtttttaagtcgctaagagcacacacataaaagttttaagttttgtcgctgataagcgttacggtttataatcggctttaggcaaaacaataagactctaaagaaactgagaaagaactgtctttctttgtatctggagaccaggtgaacatggaaagattaagagaaaatgcatgaatggtacacaatatcaaaaggtatcagagatgaaaagtttttgcttttgttagagccatgatatatatcacttaatattccgtttgacttccacagttgaaagaccagtcagacattttaaggtgagctgtccatcaactcaccctttcagggacaatgggccaatctctgcaatgcagttcagaatattaggatgcatcgtcagataaatcacatcaggaactctgatccatcggtacagtccagaaaaatgaactctatgcatgatgcaaagttattcttttgcgaaccttgacagaagcacacctgggacagaccattgcagtcctcatcaaatccacacctggaaggctagaagtcaagccaaatcacagctgttagatttaagcagtagtagttatcttttgaaatcaggaaatcttgcatgtataaacaccaaaacagagacaatttatctatttagtgcaaaggagtagtaacttaggccaaaaaggttggatataccatgttagaaaggtctcacagcacaagtacacagtatataccccataaagaaaaagttcaaatctacattgtatttgtacctgtattatctccattgcatagcattcaaatttgtattcaaaacaagaactgttgaagagtaaaacagattgtaggttccaaaaaagtttaatcacagaatgcataacaggtttgagtttttgtagtttaccatttgagatataaaactcaagtaaaacaacagctagcctgtagcaaacacgatggggcaaagcccaaggcagtaatttgttagtggagactggtgatttatattgtatgcatgtgttgcccaagaaaggccatcctctcccccacacataagcctccaaacaaggaatcaaagggcttcttgggcactgcatttgtttaagagtggtgagctctatagccaagactagagattggagctttggtcataagttaaaaagtttggacaaggattgggaaacactagaaacagcatccacgttctcctcacctccccacctccctttctaccctttatataattgtttttgtatgctttgttggctcactatgtacaagtcatgcacattggtccaatccccaagagatgcagcagattttaatgttaaaacaccagacctttccatgttgcaatgccaccagaaatgagcatttgtgaacatttcttgtttattgttggaaaaaagagagacaatatatgttgctgaggagtaatatcccaagtgactaaaattctacataaagcctttacccacataaaccatgttaacagttgattgcacattttatctgtttgaatggtagtctgtcataatttctaaaggagaagatagaatggtaaattaattaataacgcaaacaataatttaccatgtcacctaaattgcatatgaaattgtatgattgcggtcaagcaaatctaaatggggcgaacttgatttatgcttcactagccaatcctgaacagtcttgtaaaatgtaaattctttgaatttcagtactgttttgagttgaacctgacaaaatcatgatagattagttgacttttctctaagaggaaaaaaaaccttttgtggcaatttttctataatctcagagaattttattggaatttttgaatcaactctaacctcttaagataaatggtccaataaaaaactaaattttgtaaaatgtagtatttgattatcataatatcacatccagcacctacaacggcaattccggaacatgttcttaataagatgcacaaagttaactacacatggctatcactaccctttcataaagcaaggtgcattccatgatagtgccagagattaaggagtcaaatgtcaaaagccctagtggtgcaaatatatagccccccgtctatggttgaatctttaatccttcttatcccactaaacaccccctcctctcatccttcataagttgtacgtatcctccttcctcacagcacctcaccctcaccctcacccagccaaaaccacacacaacaccaaaggatttcacatcaacaacacacatgatcatggtgaggattccaaacttcttcatactatcatgaaaattctctctatcaattgaaaatttacttggaatttcgcaacctcagcaggctatgtggaagccagcatggttagaggccctgggctgcaggaat

SEQ ID NO: 26922 - DNA, 879 bp, Oryza sativa
ggaagatttcttaatctttatcccttttcctttgcaggagtagtaggagacccagattctcctgcatcatttggtggatggcttaattattcagccactaaccatccttgggtggtgtcttttgttgtgatggatctctttcttttctttggcgttataactctaactgtagttcaagcatcacaggtatgaaccaagttggtatttgcctcccttttacctgtcattatactatttgaggtctgacacccagattgaatcagtatgtacacaacccatatatgtaactttgtaacttaataacccatatatatacttgcctttagcttgctgttgcattgctcttttggcagtgcatggatgaattattcaatgaaaaccattactcatcaaaagcagtatttggtcatttccattcacactgatgtataattcccttatcatttacatttgcaatctctgatcaaaatccacctaatgacaccatgcttccattttttgttttactcatttctatgtcaatatatttgggtgtgaactgccagccaacctgcatttcttttgtctagtatatgacttcaacacaaatccaatgtgttaacggccctgttaatatgtacacacacttttagagatcgctcttgctacttgtggcatgattcttcatgcaatcattggtcctatctattatattcttaaaacagacttgaaaggagctaccacgttcattgtggatgctagaaattcccacattaatcggagaaaaagaaaagaagagttcgagtagaaatacatttagaaataagtgaaataaaaaattattgaaagaagagtccatgtagaacacaactagagttcgaaatttttaaaaaataaaaa

SEQ ID NO: 26923 - DNA, 1950 bp, Oryza sativa
aatagcctgatgtaaaaggggaaaaacggaagagtagtaatacaccaaggaaatggaagtcttaagaagaagaaatatcaatatgttcataatttgttggcatcattcactaaatcatagaaaaggcataaaatatttgtggggtggggtgcagtgaggggaataaaatccaggaaatttgagaaatttggatgcagaaaactgctgtgtttaaggttcaaatcttaggatgaagcatgaaactcaatgtttcaaaaataccacagtagtacctacaactattaatttaaaagagattatagttctaacaaggtgcggaatataagaacacctatttcactttttggtgaatcatcctagaaaatgatgtatcaagtgagaactagattctaaagcagcacagtttggacattcgatctcgtctgacttagtggaacttcggtactcagcattgagaagtctgagagagaatatgttgagtacagaagattcaaaaatgtaaggtgcaaagttgttcctttttttttagcagagaaatttctctattctacatatctaactgagatatctgacatctaataagatctcagattgtgagtccataagctcttattttagatgaattctgacgtgataaaccataaattgttcaatgcatagagatattcatattaacccacacattttcctttttaatgaaaacctcataagctgtaatttttggacattcaagtcttagagctagtttatggtctatgctcttcaatttcctctatatagttccagtaaaacagtgcattatcccttttccttacatccctgaaatgaaaaattaagtacccaaaatcaattaagaatttatgcaagcagaaaacagtagtattgtaatgtaactcctatcaagtccatgagcaacactccatcattgacagaagtgtctatgcatagagcatctgaacccaataagtactcagtgtgccctttctcagacagcacagatatatgggtgacacttcacaataggtgaagtcaaccacatgaactactgaaggacagccatgctaatcacctcaaacagtcaaccaaattaagaaatatcatcattttatgtttttggggatgctcggtcaatacagtacaaattaccaaatagtaaaggatgagttgaaacctgatttgtgaagatctccagatatgttgactgcagacatggtaggtggtaggtacacaatagagccgacatattctgaatagtataaccaggttggtaaattattttcctctactgattagccatgaatcacaccagatctggcattaaattaatataatctctcgtctgatttgctattttcaggtaatgatgaagattaatattcattactaattagttttgccatttccaggttgtacgaagcagggcctggcaaaatgaaagtagcaataggtcaggaagctggcaaccacatttacaagataggactggtcccagaaagctgactgactcagatgttaggggtgtgtttagatagggttctctttgaaagttatggtagttttaagtcctactccacctttaactggagcaatgatccctgcatttttcattgaaaggaaacaatgtcctagaatgatctatagattgcctagaagacaaagaaataatgatgaaaagggtaacttgctaccagaggtagagctaaataaagctaataagtgttattagaaacaatggttagttatgcattagctacaattatgaacaacagacatgtttacaaaatgatgaataatgtgagaaaccatttgtatcacgtgctaatttatgaaaaataaatgacatatcagagtattttattgatatggatcacgatatcacatactatcaggctgctactcgtagagtactgtacaatattgcataaatattttgaagtatatttaggaacc

SEQ ID NO: 26924 - DNA, 7415 bp, Oryza sativa
ttttactgtgaaagtataaagctgaatagttctgaggctacagcttcagtatatggatacaagagaatgaccaatagcatttacatttttctcagtccaagatgagaacatatcttcttagtctgtaataaaggtctagatgatcatacctggttgattaatctgcaagatgagttatgctaaactagaatagcagacactagactaacacggaaaaatagcatgaagatacctgtctcagcttctcagggaccacaatgctttgaatggaaaagtatttactcatcaactatttgctgcactttgaatactgaactcagaactacgaattactaacctggaacatgcatgaagtcaatggttcaatcagccttttaaccaaagtccgcacatgccaaatgagacacaaatttcaacctagagggctaggcccaatgggacagcccataattgcatatagatgatccatagtgtgatggtacgcggcagacacgaacacatgatatttgattaaagccctaccagctgagagtgagatagctttcctgtaaagttacacaacaaaaatgtgaatactcaaacattaattaaatcatattcaagctaaatccgcacctaagataagaaaaataaaatccacgcggaagatgaaaataggacatttgcagtgtgaattcgcctaagccaaagtaactcagtactaagttggtacgttccccaaactgtaagccatcaccccaaaatactacaaagatttcatatatcggtacaatgcatcaaaatttcagcactgaagttgcacctcgcgggaacacaccgccgtagcaaaccccgcatccggcacccgcgagaacgacgatctgtacagtttgcactgcatcccggcgcgacattacgtcgaacacccggcgggcgagcaaccaattctcgaacgctctcaccactggcctctcccctatctccccaccgcgatctcctcgcatcaacctcagagaaagagctgcgccgaaccgtcacgaggcggcggctggggttgccggcggcgggcgccaccggaggagccactacgccgccggtgatcgatcgctcgctcgcttcctcttccgttgcgagttgcgatcgaccatccacggctcggctctgtcactgacaggtgggtcccacaccgtcagcagtaggacataaaagtgaaattttcagaaatcccatgaaacctcaagtatataactggtggcataaatgtatcacaaaaccttatctccatttcggcaaacattactaagatttttaaaatatagattgtatttgaaacttttagttgttgacatcttacttaaggttgttggatcaactcttcccttcttcaacaagcattgtttcagatatgccaaaattaatttaaatttgaaaagggtgaagttttgtactccaaaacatttaaatcataaaacacgtgattatacgccaaaatcatactgacgtgggttttatgtatttgaccataaaacgagatttgatgaaatttactcgacacaaaacaactctagactcttctcgaggaagcaacgcctcccttgggaaaggaagagagagattttctcttcctctcgccgccgccgccgccgccgccgcggcgccggccatggcgacctccggcggcgaggacccatccggctctgcctcgtcgtccgccagcgcgctcgactccctgcccttctcctccgggaacccacgcatcgaggagacccgcggcgtcgtcctcctccaccccgaaccacccgccgcctcgtcctcgtcccttctcccggtaagccaccccctcctccccttcgatggccctcgtaatcgccttctcaatgttctcgttcgcgcgcttgtcttgccaggtggggaggaagccgcgggtgtgcgtgcctggcgtgcccaaccacctgacctacgccgacttcggccgcttctgcgcatcctgggcctcccacatcctcgagacgcgcatcatcaggtatcgtcgggtctcgattctcagttgggtgaaagcttcgctgatgataattctccgtagtagtagtagtagtagtagtagtagtagtagtagtagtagacatgggctcattgcgcgtttcgtcagacctcaaacattggccaattttggtgtgcatgagtggttctgatgtatgtgtgaattggagtgttaattggtgggtatgtttgtaggattgatggggtggaggatcagtacggcgttcttataaaattcgacactcagagcttcacggatagcttctacatgagctttaacgggaatcggttctcatcactggaggtgctggattgctttggttctgccgagcacttcgatcttctgccgctctgagtaaatgtgtgctgtgctgattgatttggggctgatgtgctgcagggtaatgtttgccgtgttcgttttgtggaagacgttcactacactcaattgattgagcacgcacatagctcagttacaagctcagctgaacaacctacatgcccagtatgtcttggtatgtggaagtcttttgagttactctagaaatttaccaaattttcatgatgtagtgttctttcagtctgttcagggaaatttggaatacctcagcagctttcagtattgtattttttaagttaaaagttagagatgttcacccacctgctttttaaaaatatcattactccctctagccacaagtacatatgccactttggacttacatgtagtcaaccttcgaaattttgagtaatggtatgccattattttttattttgatacatgaaaaccatgtgtgtatctgtctcaaagattactttcataatgttataattttatcaggtttataaatggattacaatagatattactggtcgaagtgtatattgagagttatgctgatacccaaagcatgtctatgcaaccaggagtagttttctatatttactatcttatttaagcccaaagtatagctttcgaactcacattgatcacaccatttatttgtttttattgtcaatagaacgacttgaccaagatcctggaggcattcttacaacaatatgcaaccattctttccactattcgtgcatgtcaaagtgggcagactcttcgtgcccagtaagatcttaagacaactcacttactacaggtgttttttatatatatatattagtttactaagggcatcatcatactgttctatcaacataacttttgctgtcaccaagtttctggtatctcaaatttatggcaatcaactacattattttttaaaataatacttactaggagattggttggcattctataatttgaattcattgcttctttgttttatcctggctttagaaacaaatctatgtgtgtttacagaaagtgttgtgcaggtttgcaggtattgtcaacaagaaccagagaaatccagctgttcagtttgtggaacatcagaaaatctttggatttgtgtaatctgtggccatgttggatgtggaaggtatttcatgttaattctggaagatgtgaattttactaagtaaacaacttatttgattgattggggattaacgttctcaaaggtacaaaggtggtcatgctattgaacactggaaagaaacgcaacattgttattcacttgaattagaaacacagaaggtttgggattatgctggggacaactatgtgcatcgtttgattcaatcgaaaacagatgggaatctggttgagtacaatttctatggtgatcattcagttgatggtatgtgttcaacatgcaatggtgatgcggggatcagtgaagctctgctcgacagtaaaatggaagctgtaatgtattgagtacataaagtttgtagatcactagccataccatcgtagtacattttgttttccatctcttacaactgcgcgctttccctgcttttagattgttgaggagtacaatgatctcgtcacgtctcagcttgaaaaacaaagaaatgtaagtttaaatgcattgtgctttatttcgtttgtctagttgatgtttctttatcacctaggtaacgcttttatcacttgctgctggtatctactcccactgtcccacaaaaaagtccaatcccggggatgaatctggactcgtccctaggattggactttttgggggacaaagggagtatgttccaaggaattattggtgtcagatcattaacatggaatatttggccatgtaagttttggttttagtactaatgtacattctgattttggtgctaatgtagtattacgaatcactcctgctagaagtcaaagaggataatgagaaagaaattgctgctgctaccgagaaagcagtgggcataaaagtacaaaagttacaagcaaagcttgataagtgcatggaagagaccgggtttcttaatgatgtaagctcttgcctatttgttaagatcaaatctgaaactgtagctctagaattactgccttcagggaactttatgacttacgtactcataattattttgatatattttagattcatgaaaatcttgtaaaaaacatggagatgtggagggagagaattcaaaaagtaaaagaaaggtattttctctgatatctttcaaattatcacaggaacgacttatgaatcaattcttgtttacaatcatgtcctattccagctaggtaacttagtagaatatgcatatgttttcattgcctctcatatgctgtaacgagtgaccaaagtggatatttggtcattttataattcccttgcagttgttgaaattggacagaaattgcgttaatttagaatttgagttgatctcaatttatagtttctgttttactgatgatcaaaaatcggtttgattttattatagggaacaagctgccattagattgaaagatgaaaaaattgagaagctggaggaggaggtcagtatgtttcgtaactgttgttttttagcaagttttatgcttctcttctcatgatattgcgtgccttttatctcggataagtcggatatgtaactgatgttaccacatgttagcaactcagaacctccagcgtgcagagttgttccttagtgctgtcttgtttagacttgttagtggatatcacacttgcttgataagaccgtactataatcaaatagtttagtcccttgtttgcataaagtttaagttatgttatgcacataacataagtgaatcccctgtagcattgtatctcatgatcacgaggtaccttttgtgttgcaaatagatgctgtctgacatctccaaagaacaaaaaagagaaagctatgcattggtctttggtcacgttgtttatgattgcaatcttctgcataatgtttacagtatgcatagttttaccattgtcttattagaaggcttattactgacccatcatcctcttgtgacagctaagggatttgatagcccattttgagcgccaaaataccgtggcagaagcttcagagtcaatgtcaagcgatataaacggtagcacaattctctcggtaccatctgaatcatctgcaagcagcaacagcagcatcagaaattaggattgagatttgttaccgtaagctgtatttcagcatcagaaattagtctgttactggccttaccgtacattctttgctcccttattatctaataatgacagttatgtgttaccatggttatatacttgttggcttctcaaatgcatagtacaaatcaagcctttgtacagtgtgtttttctggacaattttccttgcctgtccatgtcaaaatttgacatttttccaaagaaaattctctcagaagatgctggattccctatctgcccctacccccaaccaccccaaccacacattgctgctctaacatgcatgcccatttccgtctttttccaagatcatatctactacttaatcaccattaaacctgcctggttactgctaatcacaggcggtttgaccgtattaccactcattttgcttactacttgatctgagccgcttagctcggtaagaagtaggtgagtagccttcatggagacggaggcctcgccgccgtcgccgatgagctcgctgcgtgacaggctgagggccacggtgtgctgctgcttcggctacggcggcggcggcggcggaggtggcctcggcgacacggtggcgcagtggcgccgccgcgtcggctcgccgggggagttccggtatgatcccctcagctacgcgctcaacttcgacgagggcgccgccgacgacgaagacgacgactacgaggccggcgacaaccaccgtgccgacggccttctctaccggagcttctcaccgccggcggcggccatcgccgccgtgtaagcctccggcgaccggaagcttcgatcggttgcagaggatatgcgagtatatatatatttagccatgcacatattaagaagcaatagttcagagtgtgtagcacgtatggttgcatgtaaaaacttgattatatgtacgaatgatcagtgtttgatttggacttttggaggtttcgcgagttcgaattacaacgcaaaattttttctattcttgtaggcatcgaacgttttcattcatcacattcatgcgttaccagtgatgactacgattgatcaacatcgaaattcttggagatgaacgtacgataaatgattctcaagttcttgatatttctgcaacgattacagctggacgcacaactaaattgtcctaggtaatttggcgtcgtttggcgattaattattgaacctgctatcctaggccaacccaagctttgattagctgcattgacgttgacagcgagccgtagaaaaatatcaagcaaagacaaatatttcgctcttggtgtttggttcaagccttcaaggctacatggacacatggcttggactttgcgtgccggctacttgcgatttagaccaattctaggaataattaaggctcgtttgtcttaggaattagtaggaaattaggaatgtgcaggctgcagctgcttcactggcctgtctagccgtagccatcaccacaccagaagccagtttgcatcgccagcagaatgtgccagatacagctgcttaattacaagtttctctccccttaatattatcataatccagggacttaagcttgagttacacgtaatagatttgttacggatgaactatgtagactcaaagttagaaatgctaaaagggataaagataaacatcatactatcgaaggcacagtgcctgcatgcttgccttgctagtatagaaaagcttacgcacatatactccgatattttatacacagtgaattaccaaaacatgttacacctcaacactgcatcgtgcatcaaaacagagaacatatccaatccgaatcttaaagctcctaatatcatatatatat

SEQ ID NO: 26925 - DNA, 894 bp, Oryza sativa
  unsure (1)..(894): unsure at all n locations
gctacaatttcagatgacttctttgcccagtgattacgcctatgatcgcaattcccttgtgaatgggccggtctccagattttgtcacaccagagcacgagagaatgtactacactcttcacaataaaaggtactgtttacatctagtttcatgttgaaccaatctaccacgattgctcagcaccaccatcacctgtaacgtttcttttttacatgcatgaacagggtagaattgataaacacaatgttgcgagcttgttacggaacaatgaacaatgaggcataattttcctataagttaccttttcttcttggtcttttcaccagaggatgctgggttgctatgccagtttcgtttgcgttggttaatgaaccaattgttgatttgcttcagttgtaaccccgtttcctgcaccaggcgggccttgtcgtcttcctgaatatgtgtagaaagaattgctcgtcatgacccacaattgataccataataataaagttacggaaatggaatgttggtgccacgtacagttgggtatggccacttagaatgagcttgccaccaagcttttagtatagatgcagtatcaccaggaagtttaccagctctccgcttgcgaaggatctcttccctaatatccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 26926 - DNA, 606 bp, Oryza sativa
tactgcgggttggcgaggaagctcaactgacctgggccagcctcctgcaaggtggccagcccggtaatctgcagcgcctcggggcccttgagagtggcgccgagggcctcggccaactggcctagcgtcatggtcacggtcatatcaacgggcttggttcatgcgctcgatgacctggcgggtgatgtcgtactgaggcttgacatcgatgaccgcgccacgctcgaggaccaggtcgtaaccacctttcttgatcacttcctcgacagcgccatccaacttcggcttcagctgcttgagcatgtcgcggtcagcaacggccttggcttcgttcagttccttggactggaactggaagtcacgggccttctgcttgaactcgagttccaggcgctcgcgctcctgctgctgcatcttgtcgccgcccttgatcagacggtcctggatgcccttggcgctgctttccaggcttttcagcttggtcagttgcgggccgaacttcttctcggcatccaccgcgtatttcttggcggcgtccgactccagcagggccatctgatagttcaggacggcaaccttcatttcggcgaaagccggggtggcgac

SEQ ID NO: 26927 - DNA, 1227 bp, Oryza sativa
attcctgcagcccaaaaaaagaaaaagaaaaaaaaaccagcaaatttcccttcccatgcgacgcgacctcctcctcggcgactagccggcgaactcgcgcacgccacctcggcccacccaggcccaggcccacctcgccgtggatcgccggagtagggggttgccggccggagcggcggctaccaccagatggtcggcggcgggggcgagtagcgcgacggcggcggcgaggacgacgagcggcggacggatctgcggcgcggcggggcggcgggggcgggggccaccatgtctgccgtagtgtgtgggaagaggtcctcctccatcttcggcgacgagctcatcccttcctcccctccctccccatcccctccccaccaccaccaccaccccgccaagcgctcccgctgctccccggcccgcgccttcgacgaggcgactcaccgccgggaggcgctcctgcaccatctcctctccctcttcccccacatggatccccaggttcgcctccgagctctacttatatcgctattatttcgatttttttttgtgggagtttgcaattggatgcgaagaggtgaatctccgtccagtaaattatgtggcttgttgggttaaattctctggtgcctggagctaaggatgcaatagctaatagctactaccaactatgatgctgcagaaatgttgaacaatagttagatagcaatggcctatccatttttgcaaccaacctttaggaatcgaagtgctactaatatatcatgtccgtccgatctccgatgatctgatggctggccatgttttcactaattttacagtattcaggaatgtaagtgtgaatgtgtaatcaacaaatacggcaaatgtgtttttttttgtcagcaccttttgctatcttcaattgagcatgcatatactgtaagaaactggattggatcgcattcgtcatgtacattttttgcaactaaagggtgtttccatcacagctatgtggtgtttatatttttagctgtttgatgatgagtttccgcatgattacagttacttgaaagagctcttgaggcatctggagatgatatagattctgctataaagagtttgaacgagctgtgcctggaatcggctgcggtaggtgattccaatagcgtcctgccagccgctcttaagttatcggctgaaggtacgtctgttgaatttagacagttgcatgctaaacatccagac

SEQ ID NO: 26928 - DNA, 920 bp, Oryza sativa
acgaattgctccgtttcttgaggggaaagatagaggagaacgagaggatcaaaacccctcaaaaacccggaggaatcggggtcggattggagcggatttgagaggagaaggaggcggctcggactcggttagggcggccggccggaggttgaagacgagtccgacatgtgggccccacatgtcggcggctggaggaggaggggcggcggctgagtgggttgggccggctcgcccgcgggagaggagggagtattgggccaaaatcggcccaataacctaaagaagaggtttttagaactttttcaataaaaataatttgtgaaatgatgtttcatttattaaaaatacttcccttgctcaaataattcccagaaaaatctagaaaatagaggagcaagtatagtatttaataaaattttatctagctcatttttatgttgaaaattttcctagaaaattagggtttagcttgtaggcttttaacataatttctaaaaaatgatttaaaacatgcatttttaatttaatcgatttttttagggcgtgacaatttgcattgcctattttaatttccaccccacctgtattactactagcgtggcactgtaccatcaagtgtaatcgaagtgggcaatgttgtcgcttgctatgcatatatggattaatttgctattgggaagaaactatacgtgatagcaaatgcacggccagagtatatggatgcatgcatatgcgtatatcagatttttttttatactgcactttatatatggtgcagcgagtatacactgttttaagcaaatatatgtatgcggatgattttgagattataattttcactccacttgtattactactagcatggctcaaagccgtgagcgtaacgaagtgagtgttggttaattttatggccgaccatc

SEQ ID NO: 26929 - DNA, 19459 bp, Oryza sativa
attcctgcagccctacatttcatacttcaaatatgtgttcgtatacttaaaaaaatttggcacacgaaaacacagacagaatatggaattatggacggctggatcgatggtggtgcaggctctttggatgtgtgcaaatgatccaggaattctgtctcctcaaattgtggcagaagtgtggtgtcatcccacgagacttttgcttggggcaacaggtgtcttttgaatcgtaggaatgaaaaaaaaaaggaaaaataagattatactatgaatgatagtgtaaaacagaggaaaaacacatgaataatcgtttgtttggaccatagaaaaaaaaacacaagaatcggataagagagatagactcaaaggaaattttccaagagctttaagctctcgctaagtttcctctaaaatttctataggattgctcattccataggaattttaaaagattggataggatttaatcatttgattcaaaggcatttataggaattttttcaataggattgaaggagtcctcaaggatcaagcagaagcactacatgggcttgaggacaagcctttttccaagaagagaagaatgtcatagatgtgtagtgggccagctttagacccaaccgagtagcaaagagtataaaaacaagatacactgcagctgaggggatcatcgatgaacaggcatgcatacggaaatgctaatgggtgggtgatcgctcccccatccgtccagtgatcacccccctgcctctcacctatactcagatacactcctccctcctctcccccttcctcctccccttcttctcttctactacagtacactacaatttttttaaaaaaacacaaaaagttagaaaaatttatgtatagaaatactatttatataaaaaatttgaatcggttatgtaaaattttggcttataaactttggatctataaactttaggtgtataaactttagatgtatagaaatattatatataaaaaaaatatttgaattcaaattaaatttgaatcggatataaacttttaacttataaactttgggtctctaaattttagatgtgtaaactttaggtgcataaatttattaaaatagaaaagtaatgcggtgccaagaaaggaaactaggtggagggagggagggggattgattgctacccccatctccagacgatcgatcgcccattaggatcccccgcatgcatatgccttgtgtccttccttcccctacttcttgtcccctacttttcccaatctattgcagtattgcttatcccatcctatacttccatctctaaatttatgtcaccgaacactttatcttgtgatggaattggagtttcctgccatgtttattgttgatctgtgatatttgagttggatcgtaacagtcgattttgatttgcatgtccttcaaagaaaaaacacaaaacattatagcgcaagcgaacgagaaaccgtgtgtgagagaaaagataatgcatgaatacctaacaagcgcgctgcgcgcggtctaaagatagccatccccattaagacatgagcgttgcttagcaagcttggacacattgtccacagcgagcgctcagccgctcgccatgaacgcgaccacgtacgtacggcgcctttgctcccctagtccccttccatcccaacctttctctctctagctagctagctcgagctaggccctctctctcccatggcgtacgacgggggctcggggccgtccaagcctccgccgccgccgcggtacgtgatgctcacggaggagtacggctccagctcgctggccacggtcccgcctggcgccagccgcaacatgccccggcaccgcatcacggacggtggcagcctgcgcggctgcctctgctggtgctgctgcttcctcctcctcctcgtcgtggcggtggcggcgacgtcggcgtacctcctgtacgcgtgcaggcccaaggccccgtcctactccgtgtccgacatgtccgtggcgcggttcgacgtgagctcctccgacctcaccgtgtacgccaagctggtggcgtccgtccgcgcggagaaccccaacgacatggtcgggatcggctacggcgccgggtcgcgggcggcggtgtcgtaccgcggcacgacgctgtgctcggggcggctgccggcgttctaccagggccaccggaacacgacggtggtgagggtggccatggaggggcggcacggcttcgggccggggctgcagggcgcgctggaggagagcgaggaggccggcaacgtgccgctcgacgtgtacgtcagcgcgccggtgacgctccggctgggcgacgtcgacctccgggaggtgacggtcaacgtgcactgcgcgctcgtcgtcgacggcctctcgcccaagaagaagcccgctatcaagtccgccgaatacagggtcaacgtagagttttaattcatcaggaattcaggatgtattgaaatgaccatgattacttgtctaatcgaatttcttaatgtagctatagcttgtaattaattaagtctgtaactaatactaaatgttaattagctagtactccgtacgttataaaatataatataatagattttgagtagatgtgatatatcatatacactgaatctggatataactatttgttgacctattttgagtggatttgacatatcatggtgcaatgaaactagacataaccatttgttgataaaataggtcaaatccacctaaaatactttatattttatatttttgggatagagagaagttgattcgtctcgtaggccattttttcagaaccatttgttgtactaaaattgtgcatcctgtttgtcgatcaatttcatcactgctcgaaagtcgaatcttgcaattcatatgcttggtgttgaggaacataaaaaggaataagaaatgagaataaatgaaaaatatagtaactgaaaactcaatataatagaaaaacagagagaaaattggtgtttggatagacagagtgtaagaaattagaagaaatgcaaaatataggaatcgggaacacaaatttgtaggttctaagtactccgatgagcaaccatgtttattttttctcgaattcctgaatccattttttatatattatttaaatttggccatgtcgacgccagccacattgctctaaagtttacggtccaatgacgtccaattttgtagttttaagatatattttcagacttttaagaaagtttagcattgtaaaatgaatcattaacaaatcctccaactcgtacattgcatctctaatattcactccctccattaacaaacgtaagtaaggactctctggtgagatagaaagaaatttgaaaaaatagatgattcataggacagtacattggaatacttacatttgtgtacactttgaatgcttatatttatggaccgatgaagtagaagattaaacgtcaagatgcatagaagtatagaacactaatacgcatgagtatacgattaaaccctgtagaaaagaggacaaaaataatgcattcaaatttacctagatacatccagagaagatcaatccagacaatatagaagtcgatatatttgcgtaaataaggagctgatgttccaagttttgagaattctagaggagcaaaatacaagagcctttttttttaactggattgtatttgagagcaataaccgtgatataattgagagaaccgaaggagaaaaaaacagcggaaagcctgcttacagcccctgaacagttgataactaactacaaaagcattgcaccaaaagtaagtatcagtaattacatgggtcattaattagcaagggaacccccctagtgtatcacccaaaaaaagagaattagcaagggaaatcaccatctaatcagcatgcaatgtactagttcaataacaacttagtaccagtagttgcataaactgtggatagactaccattctcagcagcacaaaagcaccagcaacagtcatcagagaaatcagcagattcaacaggcttttcgattaacagatatcctttgccctgatgatatgaactttcattgtgcatttatgattcttcaacagctcgaacaggcagatatcacccactccaacatcattgtcttccgcaaactttcggcatccaccaaccatccttctgttaccactcgaatcagaaagcctgatgttccacttgtccccaagacgcgaaagacggatagttttctcgtcttgaaggtaattatcaacatatcggttggcgatactctagttgcatacatgaaagaaaaatgagatgatggaatcatcgcaaataaattataactaaaacaattaggcactgcatcatatatattaagcaaccgcagcaagcatatcacatgtaaattcagtgcttacagcttagtactccatccgtttcacaatgtaagtcattctagcatttcccaaattcatattgatgctaattaatctagacatatatatctatctagattcattagcatcaatatgaatgtgggaaatgctagaatgacggaggaagtaggttataattaacaacatgaagaatactttttcatcggtaatcaaacaccagtataaatagtgcataattaagaagtatgcacattcgacaaagaaatatggcactcactagagaggatattcttccagaggcgttgttctttccaatgacagatacaaagattggaatttgagaaccaatattttggatcttgcgcttcaccacattcacctgaactcgacttagtatggtcttttgcccgatgatgggatcaggtataacacctactctgcaatcctgatctttagaggacaaagaatatcctgtgtgcaaagaaaagaaaacatcagatgtgctttatcaggaaatgcatataataattgagttgtaaccagatgacatggaggaggaactcatcgtggtcatgttgcctttacttgagttacctctttgcacctgtgtcaatctatccgttggttgtgactgcatttgcaagggcctagcatgagcatgagaaagggcaacgttttcaagtggcatttccatgggaccagtaggagcatgacaatggttcacagtttcggtagggaattgcatcggcatgggttgaggatgagcatgagaaaggggcatgcaatcaacagcagtatgcatgggacaaggacgagcatgtgaatggttcacagtttcagtagttgactgcattggcatgggctgagaatgagcgcgcgaactgttcaatgtttcagtagcatctacacgcctttcttgcacattaggattctgagaatcatccacaacagcagaacatgctttctcgcggccaatttgatcaactataatgacatcaaactgagaatttccattgaatctgaacatcatggagtcacccatctgcagatcaaaggttttgacgaattgtgcccatccctctgtaaagataaccttttcttgggtcttgtcaactctaacagtgtgactgtttctgttacgtgtttccagttggatttctccagggatgtcaccctttaaacgctgcacaaattcttttggaatgatctgcagaaacatatttttgagggtgttagtttgaatatagttttatgatatactagctgctctactatgttttcctctcctcctcactatgaaggcaatagatagcccaaaccagaatgctacaatataacgcatgcttcaccttgatgctaccagcgtggagctgtgtagttctgatgagatctgggtgatgtatgaacatcaaagttgaaatgcatgggataacaagtaattatgattttttgcggcatgttattgatgagtcactagcgctaattccgctgtgatttttttcccaaatgacaagtagttaaatatatgtcagttcagtgttatgaactcgtttgttgtttgcaggctatttctttcattgctacagtttgttcacataattttggtgttagtttaaatgtatatcagtcgttcagtacatgcacataattcgatctttgcaattgatatatttatattaatgttttcatgtttatgttcaatgtggggcctctctttttagttccactctgggccacaaaaatctcagggtaggccctgatttctgtatgtgactacagaacaaactgacgaaattgaaaagcctaatttcttgctttttaaaatattacatctggtgctaaccaacaaacctaatgtggtatcatattattggcttaaatccgggcatcaatacttgtttcttttaagagggtacaatctagtcaccgaattattgaaatttgcaaggaagatcatgcttgtaccaaacagaacttgtaagaagcaaagaaacaaaaaaaaaatacaaacggcaagggaaaagaaaagaagcagcattgcatttcataaaaaaaaatatttggcttaccatctcatgttgaaaatcacccatcatagttagcaagaagtgtttttgggaatcatccaaattcctgtagtcctgctcatcgcgccgtctgcatctttcgcacgatgtgcccatcgtttttcaacaaacctgcagtgtcaaaatattacttttcagtggaaatttttgttcatctttcacttcagaaaaatggcatgaacaacaacgacaaccaccacaagaaaaaggcccgtgaatcaccatatttccagcttgaaaactaaatctaatcggcaaaaattcctcatccgagttgatgcgatcctacaaactagtttacttgatcagggagggggaacagaaatggagtagtaacaaaacaaaccgacggcttcgtggtcgccgccgccggccgtcccccctgcctcggctgctctcggccgccgcgcgggaggtctctctctctcggccgcatccgcccacggcccaaaaccccatcgccgcggcaaaagaaggcgtgaatcttttcttctttcccccaaaccctccatgcgctctcctcgtacaaacccttccatacccacacagctttggaagaagacacaacttttcacagttttatcatgaaaccgaccagataaagatggtgaaaaatcgttctagcccggtccccccaatgaaaagaaaatcttcaaataatgaacaacccagttataatactactagtagaagaatagcaagcactagacaacctagaccaaaaggtgaaagacaacaagaatattggatactagctataatatgattggattgtttctttccttccttcggggagaagagaaagcgatagggagtgacgttcttgatttcactactagtactagatcctccatacctttcttcttctattttcttttttccacggaacaatcttcttctattctgagtttctgacccgcaaccatgaaccctcctttgcttcccctggtggtcttcttgggatgtgtcgccttatttatgccgttgcttgcctgagggtagatcccaaccgaaatttctcatcgcatcgaacgtttaaacatattaaatatatgcttaaaaaaataactaattgtacatattacgactaatttatgagacggatcttttaaacctaattacttcatgatttgacaaagtggtgctaacgtggtactacagtaaacatttattaatgatggattaattatgcttaataaattcatctcacggtttagtgacggattctgcaattaatttgttttactagtgcctgaatattatatactaaatctatctatctattatatactaaaagttcattaaacttcctacaaaacgctctcaaatcaccacgtgggacttctacaaacgctcctagaccaccacgtggctctattaaatctaaccttcgattttgacttaaattggtgaacccgatattttaaatctattatttactaaaagtccattaaactttctaaaaatgctctcaaaccatcacgtgggacttctacaaacgctcctagaccaccacgtggctctatcaaatctaatacttctacaaatgctcctagaccaccacgtggctatatcaaatctaaccttcgattttcagttaaattggtgaacccgatattttaaattattagattaaatttttatagcgaggcacatcgagccagcgcccgccgcccacaggccccacccctcacgcgcgtgtacggtgtatctaatcaattggaattcagaaaccgaagcgtcgcgccatcgcaggactctctgtctctcccctcctcgccctcgcgagtcgcgacgccaacgcgagcagcgatctgatcagatcgtgagagcgagcgccgccgggccacgcgtgcgcgccttggccggcttggtcgccgcagcagcccactgccgcactggcgccgtagcctgcagcagtccgccgccttggccggctgccgccgcagccgcagtgccgcactagcgcactgctgcagacctgccgcgtgtgccgccaacgcccgcccgcagtgaccgcagtcctgcaccaggccaaaaaaaaaggttttttactttttactttttttcaattttcagtttcgaaattttgaactctttactcatgtgcattgtgatatttattaaattattatagtagaactgatgcatttattaatgatggttgagaaataagatgggtgatgagcttttggatgattgtatagtcacattcattaagcgggatgttttcttaaaagtggaggaagaagatataacgaacactttcatggccattagaaggtgttgagattataggcatataatgatttaatatattccataaataaatcatggcattgcagatgtatactagcattaacgtatcattagatctacacatgtaaactaagcagtaaaatatgaacagatcaaatatgcgcaacatattgaacacgtaccgaggtggtagaaagaccggctactcggcaggaacttttcgcgattgcaggcgtctacgaaggcacgcagcacgcgagcgaagaggaagacgagccgtcgcggacaaatagggagcagtcgcgctaagcgcttcccaaaaactttattgccgccttctcccggtgcaggacgtcgaaggcagaggttccggagacctgctctcccgatcgccggtgcacgccggcgagcgggatggagtaatctacaagcgacggcgcagcacagagtaggaggcaaaccctatattgattttttcgtgtgttgcgtgaagacggcgggtcggtttatatagagaagggtcgcttgattagggcgcccgcacgatctccactgcgcgtaaccaaaccggataagtcgcgcataacttatccggactccacgccgttttcacgcaccagatttttcggaacgtttccaaaacaaaaacgaatccgaatttgcagcaaaacaaaactgcaaaaggaggctgcatctgcgcaaggtgaggaaccaattttttgcggaccattcgatgcgtatgtcgtgcacgcgcgccgcctgccctgcgaggcgaggcgagcgagcacgcgcgtgtgttccccctcttctctccaccacacatgattcaagtggctaggagggcatcctcccttttaaggaggtccccctctcctagaataagcaaggtggtactaaactccacatgcatgccatcccatgaggtgggcttttgtgattttccaaagaattaatcttcgagtgggttaaggcctatccattaattccaacaatcccccaccaaatctcaaaatcccactgagatttgccttttccaatgtactgtttatataccagcggttcgatggagaccgattaaggttgaacatccatctagaactccaagctacacttactcacaacttgaacaatggactacgccttgaattacaagtcttgtgcaagcaagtttcactcaaaatcttatctggtactagaccgtctgtagactacccctcgagtggagcgtataagtcatactcctaggtctttagtaagcttcctagaagattcacccaaaatcttcatagactgcgaccaacagtcaagctcacaaaggtgagttctttcaagaatgctctgtaggacagcatcttcgctaattaaagccaacagaactcattaaggtatagtcaacctgccttgcagctcacaagagtacatgcatctttacttagagagggtatatatcggtactctcctctagtttactaatggtttgttcttcccaggatctaattcacgggatctccgatcacatagactgggttactaccatagtataactcacatgggtctcaaacccatttccttcgatgcattgtctatcacatttcgtgatagtcccttcgtgaaaggatctgccaggtttctagttgtttggatgtaatccaacgttataactccggagtttctcaacttcctgacagacttcaatcgtcttttcacatgtctagacgatttcatattatccttagaactattcactttgacaattaccgtttgattgtcacagttcataaggatagccggcaccggtttttcaacaataggcagatccattaatagatcacgcagccattctgcctcaacagtagcagtatccagtgccgttaactctgcttccatggttgaccttgtcaaaatggtctgtttgcaagacctccacgaaacagcactaccacctagtgtgaagacatacccactagtggctttgatctcgtccacatcagagatccagttagaatcactatatccttccagtaccgcagggtacccagaatagtgaagccccaattccatagtacctttcagatagcgcattactcgctcaagcgcacgccagtgatcatctcctggattagaggtaaaccggctcaacttgctcacagcaaaggagatatcaggcctagttgcactagccaggtacatcagcgagccaatgatttgggagtattccagttgattcctagcaattctcttgttcttgcgaagcaataagttaggatcataaggcgttggagaaggcttactatcaatgtagccaaagtgattcaagatcttctccacataatgggactgcaagagtgtaatcccattcttacctctaattagcttgatgtttaggataacatcagctactcccaaatccttcatatcaaatttttgagacaagaatgatttaacctcatttatcacctcaagatttgtcctaaatatcagtatgtcatcaacatacaagcacaaaataactccctcacccccaccatggcgatagtatacacatttatctgtctcattgactgcgaagcatgcagatgtcaatgttctatcaaatttctcatgccattgcttaggagcttgtttcagactatacaaagacttcaacaatttgcacaccttggcttcttgaccttcaactacaaacccatcaggttgatccatatagatctcctcatccagctctccattaagaaaagctgtcttaacgtccatttgatgaacgagaataccatgtgaggctgctagggaaagtagcacacaaattgtggtcaatctggcaacaggtgagtaagtgtcaaagaaatcttcaccttctttttgagtatagcccttagcaacaagccgagccttgtacttttcaatggtactgtcaggcctcagcttctttttgaacacccacttgcaccccacaggtttacacccatagggtcgctctgtcacctcccaagttccgttagcgataatggaatccatttcactacggacagcctccttccagtagtctgcatcaggagatgcatatgcttctgaaattgacttaggagtgtcgtccacgaggtacacagtgaaatcatcaccaaaagacttagtcgtcctttgtcttttactccttcgaggagcttcactatcatcctcctcagtgacatgttcatgtgtatattcaatttgttctggtggtgtgaatgaactgggaattatttcagaaggttgactagaattactatgtgtatccttcattgggaaaaagctctcaaagaaggtaacatcacgagactccataattgtaccaacatgcatgtcaggtacctcggatttaactattaaaaatttataggcaatgctgtggtgagcatatcccagaaagacacagtccacagtcttaggtccaagtttgcgcttcttcgttattggtacattgactttcgccaagcacccccatgtgcgcaagtaagaaagtgatgttttctcccaatccatatctcatatggtgttttgtccttatttctgttaggaattctgtttaacacatgatttgaggtcaacaatacctccccccaccatgccttaggtagtcccgcggtgtccaacatggcattcaccaagtcagtcagtgtgcggttcttcctttcggcaatcccattagactcgggagaatagggaggcgtcctctcatgtataatgccatattcctcacagaataagtcaaactcgtataagaaaaactctccaccacgatcagacctaagtctttttatgtttctgtcaagttgattttcaacttctgccttataaattttaaaatagtctagagcctcgtctttcgttttcaacaagtacacatagcaaaatctagtagcatcatcaatcaacgtcatgaaatatcgttttccacccttcgtcaacaccccattcatttcacaaagatctgaatgtaggagttctagatgtgccaagtttctctcctcagcagccttgtgaggcttgcgaggttgctttgattgcacacaactatggcacttagaacctttgacaatggaaaacttaggaattaaacacatgctggaaagccgagacatcaagccaaaattaatatgacataaacgtgagtgccagacattagcctcatcatccacactgccacaaatatggttcacagacttattgcagaaatcagaaagggaaaagcggaacaggcctccgcactcataacctttaccaataaaatatccatgtttagacacgactactttattagactcaaaaactaacttaaatccgtctctagtcagacgggagccactaacaagattcctgtcgatagaagggacatgctacacgttcttcagctgcacgatctttcgcgaagtaaacttcagatctaccgtgccaacaccatgaacagaagcatgtgacccattcctcattaggacggtggaaccccgtgcgacctgataagaagaaaacaatgagatgtcagcacaaacatgtacattggccccagtatcaacccaccaattattagactgattaactgaaaaaacagtaggtaaattactatacccgtttccatctccagtgttgccaatggtcacattagcagacttagaagtctgccctgcaggtgccttcatccccttacgctgtggacacttcctagccagatgaccaggttggccacacacaaagcaagtcctctcatcctgattaggattgttgttgttgttcttctgcttcttgaagttggtggtctgctgagctttgtatttccccttgctcttgttctgggccttgtgcacaacattggcactggactgcccatcatcgcccttagacgcagcatctttttcccgagctttctcctcaacatcaagagacgctatcaactcttcaacagagtattcctgtctcttgtgtttgagtgcagtattgaaacttctccaagatggaggaagtttcgcaataatgcacccggccacaaatttgtcgggtaagacacacttaaggagttcgagttccttagctatggtttgtatctcatgagcctgttcgactacagaacggttgtcagccatcttgtagtcatgaaattgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctggtcagcagtaagaactccttcaggtttgccagtactcacctagaagcatttcatagctgtcagccacagagtgaccctgatctgccatctcttaaagtgcacaccggtgaatttatccggcctcaatgtatcggcaaaaccatgcatagttaaatcacagtgcctataataaggtttttggattgttgagattaaaggcatataatgatgacatatcatccataattaaatcatggcattgcagatgtatacagcattaacgcatgattagaactacacatgtatactaagcagtaaaacatgaacagatcaaatatgcgcaacatattgaacacgcaccgaggtggtagaaagaccggctgctcggcaggaacttttcgcgattgcaggcgtctatgaaggcgcgcagcacgcgagcgaagagtaagacgagccgtcgcggacgaacagggagcagtcgcgctcagcgcttcccaaaaaccttattgccgccttctcccggtgcaggacgtcgaaggcagaggttccggagacctgctctcccgatcgccggtgcacgccggcgagcgggatggagtaatctatgagcgatggcgcagcacagagttggaggcaaaccctagattgatttttttgtgtgttgcgtgaagacggctggtcggtttatatagagaagggtcgcttgatcagggcgcccgcacgatctctactgtgcgtaaccaaaccggataagtcacgtgtaacttatccggactccacgccgttttcacgcaccggatttttcggaacgtttcgaaaacaaaaacgaatccgaatttgcagcaaaacaaaactgcaaaaggaggctgcatctgcgcaaggtgaggaaccaatttttggcggaccattcgacgcgtacgtcgtgcacacgcgccgcctgccctgcgaggcgaggcgagcgagcgcgcgcgtgtgttccccctcttctctccaccacacatgcttcaagtggctaggagggcatcctcccttttaaggaggtccccctctcttagaataagcaaggtggtactaaactccacatgcatgccatcccatgaggtgggcttttgtgattttccaaagaattaatcttcgagtgggctaaggcccatccattaattccaacagaaggcgtagacctaataagaagaaaaattagtatggcaattcttttaaaacttttatagccatgtaagcttctttaagtcaaaattttaggtaattactaattttatatgttttaagatgctttattaatatagcatgatacacttttggtctattctattatctatacttgcatggtatatattaccatcgttagatttagtatgtttagaaaaaaaaaattaggtcggaccacccatattctaaatcctagatccgccactgtcggtggacccaatattttaggctattatttcggccgaaatttttcatttttttaatttttcatgaattttggtaatatttgtttaaattcaactaaattttgttcaaatttttggaaatttcagactgaaattttggtatttcggtgatgccgatcaaatcgtctaaaccgaaaagtttaaccctgtgtacaatacatccccggctaccttcctagatctatataatacctgaggtgatacaccaaaactttatgccgcttgtaacacaccctcggctctctagcttgtgccctgaaagcggcgattgctgtacacatgtgctgcatgctagagcccaagaaagtcttagctaaaaaaaattatgaaaatttgtaaaataatctttctataatttttttaaaaggcacaccttttatcagttagaaaaacatgcttctgcaaaatgagatagtagaagatggaatgaggtagatccaaacaccatcttaggttgagttctaaactacaactccaaatcacaatttcctcgtttttcgttagaacgtttcccaaattgttagtgttagggttacggataaggtataccctctaccattggatgtacgctatacggcaatatggtacatctgcgcgtgtacggacgttctctgtatacgctaaggaaattcatcacgaagtccaccaatggaaaggttcctacccgtataggactaggtcgtcactgtatcgtgcagggtctgatgtctccgagtcctacttagagagacctgcgatataaaagggaccccccgggaggacctaaggcatcgaatctgatagccaagacaaccaccatagcctaagaagtcggagcctgcaggagccaagtcgccgggtgatctagtcgaactaactcgaccacgatctcgtcggtatcatcgagttctgttattccctttgtaatttgtggtttccactatataatcccataccaactggattagggctattacctatcaaggggcctgaaccagtataatatttgtctcctgttttcttgatgtcgtactacgtagatcctcataccagcgtatcccaataccctctatatccggtctacgggtaacccccgtcgacagtggcgcgccaggtagggggccttggtgctcaaggttctactactatgacatcaagcttcatcgacaacagcgtcaacaccggccccatccaaggagtccctacttcaacaatgctagtgtggactcaagtcgacgaaatcgtcttcccggtttacaccacggtacctatctcggctggtccatcaatgaccggaaatgagaacgccgtggctataaccccgggcaactccatgtcgaaggatcctcccgccgtagcggagaacgaaacgtcgacgtcatacgagcctgagaaggttcctagtgcggccaaaccttgtccttccgacaagaaccacgagccgacaaggacaacttccgagataacaaagccctagtgtcctatccacaagtccaggaaacacaacttgcaagcttgctgggtttttctcaacgtacaagctgaaattcatgcctgcaaagagcatggaatccagcgtacttctctaactcgtgatgtctattgtcctattcacaagatgaagaatcacgacttctcaagctacaaggtccttctctgcgccattaagacgccgcttcctaaggtccagcaatcaaaaatctctcttaaggatgcagacaaggaacaaggagcgacgttgatctcggatcgattcattggagtaatcgacatcgatccccacgagtcgtcagtcctacacttgctcgaagactatggctcatcatcctccagtacaccacgcgacgtatttgccatcggtgggaccagcacgtctgcacacgctaacgcagaggcggagaatcaagcggtcacaccggcccaacacctcggcaccatcaacgcaatactgacagaaaccccctatgatcctgtacttaacgatgatctcgcatgatggacataacgactacaggaatcggtagccaatctcagtaacgcgttcgaggaggccgctaccagagcacaaccagaacatccgatagctggcggtgccgacggcgaaccaccggagcaacggacgtcgcctagacgagctacccctccacctcgcggcaccggcgatctccgcgaccatctgaatggccgccgagaagcaggacgcgcgcgagacaacgagaatcgctcccgacatcgtgtctcttcacgacgtcgcgagaacgaagaacgaggaggccgctcgaacgaagaccgacaccatgataatcgtcacaacccccacgaccgcgatgatcgcgaacagcggacgccggacgatactggtcgaggacgccgacatgacgacgatgataatggggatcagcgccaggacaacaatggtggacgacgacagaactcttgagaacccgaacgtcgtcctcggaatcggacaccggagccgagtgacccatcgtcatcatcatcatccttttcattcttgtcatccgatagatatccacggaggacatacgatcgccgacaacccaccgcccccagcgtcgggtgtggagctttcaaccgttccctacgtgatgtccgatggcctgagagattctgacccagggcaatagagaagtacgatgggagtaccgacccagaagaattcctttaggtctactccacggtactatacgctgccggagcagatgacaacgcgttagcaaactatttgccgatggtgttgaaaggttctgcgcgttcatggctgatgcacctcccgccctactcgatttcttcatgggcagatctgtggcagcaattcgtcgctaacttccaaggaacttacaagcgccacgcgatcgaagacgacctacacgcgttaacacaaaatccgggcgaatctttgagggactatgttcggtgctttaatgagtgcagaaatacaatccccgaaatcaccgacgcctctgtgattcgctttttcaaaaccggggtcagagatcgctatactactcaggagttggcaacaaggcgaatcacaactactcaaagattgttcgaggtcaccgatcgatgcgctcatgcggacgacgcattgagacgcaagaacgacaagccaaagacggggggagagaagaagccagccaaggatgtgtcacgtcccaaaacgactctaaaatacatcctctaaattatgtctagaataattaaaatccgtgtgaaagcctccaaaaattaaaatgtgcaaagtaaaagtcatacaaggcttagaggatttttgtgtattttctaaaagcctaaaatgtgtaaataaattttagtggaattttcagagcacaaataataattgttaagaaataaacaaagttgaaaaagttttataaaaagaaaaactctaaaagtccccctcccctcccttgggccggcccggcccatctctctcccccctctctctctctcctctcccccgcggcccagtcggcctccctccccatgcgcgcgccgctgacgggcgggcccgcccgccaccctcgctgacgggtggggcccacccgtcatccccgacctcccgccgctcccgccgctccgcccgcgccaagcgccgccgccgccgccaaatccgccacatcccgccgtccccgcgtgcaataaagtggggggaaatactccccgtgattccctctccctttccccccaattttccctccctctctcccttggattcgtttggaacccctcccctaatcccgccggcgccattgatggagcccgaaaacgccgcgccggtttccttcctccccggccaccctctcccccttccaaccttatttaaaccctccccgcacctcctccgtccgtttccgcctctcgcccgccttcctcctcgccggattcgagcacgcgacgtcgctctctctctccgcagtcgccgccgagctccggtccgccgccgtcgtccccccggaccgtttcccgccccggc

SEQ ID NO: 26930 - DNA, 14397 bp, Oryza sativa
  unsure (1)..(14397): unsure at all n locations
cccccgggcgcgccgagtggctgccgcgtggggcccggcagtcagccgcccgcgccatcgggtgcggctgacgtgtggggtccacggcgctggccggtgcgagcccgggtgcgcccggtccaccgtggaccgtgaggctgccgtgtgggccccactcccgtggacccggtccgcgcgccccctcccctcggctgacgcaataaaccttttttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgctttttatatggagtttattagagtaaaagcctttttcttttccgttggtcgtgtagacgctgcagcttcggaagatccactcttcgtggaggttgaagctgacgtttgggaaagcgagcaaggcaagtcacatcatccttgaacatattgaatcccagtttataaaattattttgatttaaattaatgcattatcgctttatttaaattcccgcgttatcactgttttatctagccatgcctatttacctttgttttgaccttattattgttattgttattattaccttgttcaccctagactaaacaaaacccccaactagtgggtaccctatgcatggtaccactagtatgaatttaggtagatgtttcgctggttaattaggcaacattaggtggttttacaactctagattttgggaatgttcatatcacctggacactatggaatggttggattattgtggaattggattcacacctccccctctattcaaaatcctcaaaatggttttaggctgggctcagggtgcatggttttgatagtagcacctcggccatataaggaccggtcttcgggcctctgttgcaaagcactaccgtacttccacatgtctagtgggtaaggcttagtttgtggcccagtctggtgtcacgcccaaaaattcactagtaatttccgaacttatttgtgcataaaatcctcgtccaggaatcagccgaggtacacaaactgacaatttaatatacagattcatcaaattaactaaaacgataagtacttacttaagaggcacttagtcctcaccgtgaagaaaactgcagcggaaaataaaatctagcgaagctccgactccactcccacaggcagctcaactagggtataagccaaacgtcttctcctcctagatcctttttcttcaactgaggttgattgattattgcaagaatgagcatatgacatactcaacaagccacacagcaaatatgcaagtgcacaaggatacgaaaggatggcataatataggctcatttgcaaaagcagcatttagcaaaacatttaagagaaatgaaacagtggagtaattaatcagaaattttaatcaacactgagcaacacacccatgctgcacaggcccaaccatcctgaacaaccatacccggctgtacagatctaactccaaaccaggagctaagcaaattattaccaggtataacatccataattgttatgagaggtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcacaacacaactcaccacagtgcaccattcctggatcataatcacccccttataaacaaggcatggactccccagcgacccccgtgggcttatctccgccacttctcagtctggtgctccgcaatgaaccatgttatacaaaaggtaaagccgttgcccacgctggcttgtggttggcacggttaatgtttcacaacagtagctcgcgaaccggtccttaattgtcatgagcatgactctcaaaaccatgtgctcacaacccaccattatcaagttttagttggcaagtaattaattaaccaatcacgattaaccatcgtgaactatcattaaaccatcattaaataataatgagtcataagttatcccaatagtgtgctaatgtttctaagcatggctaagcaatcatatctaatatctagctgaaccaatatataaagctcaactagtcaagttataataacccaaggtatcaaggaataaagtaatcaatgcaaaaaggccataacaaaggaatagattcacaccacccaatgacattcgaaaataaatgcacagttgaaataaatagagaatttaaatataggatcaacatgctcaaaggattgtgtttaggatctgtgtgacttgccttgcaataatcggtcttcaaataatcttcttgaacacttccgacgcactcgcgaaccttcgcaacgacggaaacgacaagctaacacgcaaaatgaagaaaaagactaataaaaaccaaataaacagtacatataaagtaaacaaacatgtagatcataattttagatgaattatgagacttgaacggcctcattctgacttcagatgaatttattatgaattttactagattaaatctaattaaagcccatttaaaaagaattaaataaatttaattcaatttatggataattttaatatgtagatctttattttatacaacttttgcaacttgaaccacattaaactgagttacaaagaattagatatgaatttttaaagattaaatcggattaaaacctttatatagattttaattgaattatgacgcaataatgaattatttttgaaaaggaaaagggaattattgcgtcagcggctagggtttgcggtgaaccgggtgcacggcggccgctcacggaaacgaacggccgagatcgattctatccaaaaccggtggccgagatcaacttgatctaccgcggttcacgggacaaggcgacgatgacgtcagcggtgacgtcagcgatgacttcatcaccggcgacggctcggcctcgcgcgctcgtcggcgaacgacggcacaacgacgcaaacggaggacaccaacgggtagaggacaacacggcgaactcaccggtgaccaaaaccacggcggaagagcaacggacggcgccggcgacgaggaagaagcggcggcggtcttcgggtcgacggtgacggcggtgctccggcggtcttcggcggcggcgaagcggtggacggggacggcgacgacctcacgatcccgatggtggcgacggcgaccgacgacggcggctgcaacggcagcgcggcgcggctgaaccgacggcaacgacggcgacggctagggctacgcggaggcggcgctagacgcgacggcgggctaaggcaaaggtggcggtggatagaggagagctcgggggtgcttttaaaggggctagcgagcggcgacggaggcccacggcgaccggcgacgcgaaggaaaggttagggttagaggagagagatgaatccgaatccaactcaaatccaccggtttccaaagaaaattagccgatgtttccaaaagagaaaaggaagaggagatctcaaggatcatttgccctcaatcaatttgaccggaaatagagaggggcgatggaatttggaagggcaacggcagcgcagctcggctagggttcggccgggcgacggctggaggaggaagacgggtccgacaggtgggacccacctgtcagcggctgagagaggggaggaaggggcgcggcggactgggccgactgggccggggagggagagagaaagagagaggttttgggccggctttcggcccaaagccaaaagagacttttaaaaacctttttcagtttaaattattcatgaaatgcaattccatttattaaaaatacttccttagctcaaataaatcccagaaaaatctaggaattatagaattaagcaaagtatttaacaaaattttatctagcccaattttatattgagatttagcaaattaaaattagatcttctcttttaagcttttaagatcaattctaattaaacaacaatttatatatttaggattttaattagatcattaatgatcaaataattactgaactgctctttgtatcatttaggaattgagctctgaaaaatccgagaatattccagagagttgacttaatcatggagaatttaataaaaattaaatctgtaaggaagtcccaaagcctaggtggtgcaacgctccaaggcatgtcagcgcgaaatatctggatggatggggtctcaaataaagcccaaataaatacagtaaccatccaacctcatcgcagaccccgacatgtcttgaagggtgcactacataggctctaagccatcggatatgaaatagaagacacaaccgttggaataaccacaccagtcatctacgtcatacgcccgtcaaccactcgatggtggcgaccaaaagcgtaccccagagactcgatctcaacaaaggcatattccccggttatctcaaccatttcaaacccatcctcatgtgggactagttgcccaggaatgcaacatagcctcacataaatcatctcaagcatgatatccaaataataagtggttctaagcaataagcataaataatcttaataaggttctaagtagtacttggcaacaagccataaatattggttcatgcggtaagcgtgctacccaaaagcccataggcaaaccgactagggtaaatccctagttagaaccatcctggaaatatgcaacatcacaagctgcatcaaactcctcatccaaacagtcattacctgcagcggggtctgagcataaacaagtaaaagaaagcaagaaatcagtacattaatcaaattaatgtactggcaagtcggaagcaatcctagcattctacatgttggccatattcaaggataagttgtgtataggttaatttgcataaatgccaattttagttcacaacatgtttcgcaacggaattttataacaatagtatagagtaagtaaaacttgtaatgtaaatggataaataacacacatctacccctcaaggtagatcatcaccactttccatcatctcatcaccattcaccgaactttacccaagttcacaaacaaaacattccaaccattttccaagttcacaagagtttatcaaaatcacaaattatactcatgacacttcaccatgccgctcatgaccgtgagcacggctaatagattagttttagactctgcagagtttgtacaacttttaagcccacatgatatggatcgctctagtttttccgatacccgtcggtatcaccacactctacacattgagtgtgatctagaggtcataacggaaccgttacattgtttattgtctagccttgcaccagcacgatgtgtgttttacccacgctactagcaaggtagcgccactaggtagcgggcccacgctttaacctagcgcagtaaggaacccaggcccggaatccctcacgaggcacgacaccgttgtattggatagactacccactaaaatcatcacataccacatatcattaatcaatttcatcatatcacaaaccataggaagttccgataagttaccaagtcccggtaacccatacccttcggcctaccaagatgcaaggctaaactctaaacaacttaataggttgaggccagcccatacttagcacatgtggtttgtactgttttcattagttggtgacatagagtggggtccttaatcgacccgggcgaacgctccccctatcggtgtacaactaccaccatatgtacaccactcgccgcccaagtctaaaaacaagttatctccattttcagttcacaatactcacacatttaaatttctgtccagcaacatcaaaataaccattttcacatataacatttatcaaaacgagtaatttgcaaggcggtaaccgaatataagcatatagcggcaatataagcatagtataatcccaaagaacacaataattgtattcaaaagcactctatggttacaaccagcaaggattcaatatttcaaggtggattatgcagcaattaggtcatatctaccattcccacatttatatatttttttaccaaaagtaatactaggtaacgtatgcatgttggttcggtggtgaggaacggcggccggagcggcgtcggcggttcgggtggccggcggcgaggatggtgacacccaccacgtgctcgacagattggtcctagggcaaaaggggtatgggtgagctcggcgtgatgcgtaggtcacgttccataggagggaagagagagggactcaccggggatgcacggcgactacggctaatttgccggagccgggtaagacggccgagctctgggcattctgtgtgtggggtgtgttttcttggacttggaacgcgatgtggggagtgtgccgttgcttctggtgctttggcttgggatataaggaagagtggagtgggggagtgagagagagaggtggctggtgctttcattgtgttccttgagcatccattgggcatggggggacggtggatgcagtgaggggagagtgggaggctgtcatgtggatcccagagggtgtggggcccactgtcagtgaaagaaattcgaaaatagccttggaggctaagtcaaagagggttgcctgccaaggatctttggaggggattcaaggtggattttgtgcagcaagaaatctgggctagatatcctcttggtcaggggtgatgtggagagtaaatgtgctgaagtggattgggttagaagtctctggtttaggtttgatggagtgatgaacatgtattgacagtgttggttagcagcagttgacagtgcagttagcagctgattggatttttggagggagagaagaaagggttagagagtgatccagggtgtgccactcctcaggatgctagaagaaagttagtagaagactttggctgaaaccaaacttcaaaaagaggttttgaaataaattttacagagagagcaagtttgaatctgctaagcagttcttttcatgatttttggagagattaaaggagatcaacaagttagcaatccttactgaaaaactctgaaaatttgtgggttgatttctgacatatcaatgtatttttgagaatttttgtggaagttttggatgcatataattaccagattaattatttttgtgactctaggcctatcaagatgcatgtgatgagatgattaagatccaaaaacaattaaaatcactccacaaccacatgatgcatttaaattaaatttagttctcaggtttacaggcttgggtatgttacaaacctaccccccttaaacaaaatctcgaccccgagatttgataggatctaggagaagaaactaggaaaatcggctctaaggcggtcttccctttcccatgttgcttcttcgggagtgtggttgctccactggattttgagcatcttgatggagcggcttcgcatgtgtcgctcggcttcctctagaatgcggattggatactcttggtaggagaggtcgggttggatattgatgtcttctagcggagtgagctccgtaggaactcgaaggcacttcttgagttgcgaaacatggaacacatcgtgcacatctgagagttgagatggcagctgcaacttgtaagcaacttgacccctcttggcaagaactcgatatggaccaatgtatcgaggcgccaattttccatgcacttgaaatcggcgagtgccccgcaacggcgagacctttagatagacatagtcaccaacctcaaagcttaattcgcgacggcgacggtcggaatagctcttttggcgtgactgtgcctcctttagccggtttctgatgagagcgacgttttgctcggcttccttgataacggcaggaccaaagagttgtctttctcccacctctgaccagaagagtggggttctacactttcttccatacaaagcctcaaagggtgacatttggaggctagcttggtaactgttgttgtatgagaattcggcaaaggacagacatttctcccaattggtgttgtaactgaggacacaagatctgagcatatcttccaagatctgattggtgcgctcagtctgacctccagtctgtgggtgaaaagctgtgctaaagaacaattgagtaccaaggagctcatgaagattctcccaaaaccgggaagtgaactggggaccacggtctgatacaatggccttcggtaccccatgcaagcgaacgatgtgagtcaaatagagctttgccagctttgcaccattgtaggagacattcaccggaatgaaatgggcaaccttggtcaagcggtcaacgatgacccatatggaatcatgtccattagaagtcttgggaagacctgttatgaaatccattccaacttcattgaacttccactcaggaatttgcaagggttgaagcaaacctgcaggacgctggtgctcagccttgacacgctgacacacatcacaaatagcaacatatgcagcaatatcacgtctcatggtaggccaccaataaagagagcggatatcttggtacatcttagtgcaacctggatggatggacatgggagactcgtgtgcctctgtaagaataagctcccgaagatgttgagtgtcggggacaaacaattgcttcccatgaacaacaacaccatcatcatccaaggaaaagatagttggcttgccacttgccatttcctttttaatttcagctacctcctggttagtgagttgagcctcttttatctgagaaaggagggtcggttgaagtgctagggcagtaacaaaaccttcttcaaccacaccaagattgagcttctgaaattccagtaacaactctggttgtgtgacaagttcagaagcagaaatgtggttaagtttccagctgagtgcatcggctacaacattggctttaccgggatggtaatggatgccgagatcgtagtctttgatgagttccaaccatcttctttgccttaggttcagatctggttgggtgaagaaatacttcaaacttttgtggtcggtatagatttcgcatcttttaccgataaggtagtggcgccagatcttcaaggcatgaaccacggctgccaattccaagtcatgggtcggataattgagttcatgagggcgcagctgacgtgaagcataggccacaacctttctttcttgcatcaatacacacccgaggccattttgagatgcgtcacaatagacatcgaaattcttgtggatatcgggcattataagcactggggccgttgtgagccttttctttaactcttggaaacttgcctcgcatacctctgaccatacaaacttgttctccttcttgagaagttgggtcagcggtctagcaatcttagagaaattcccaatgaaccggcggtaataaccggctaagccaagaaaagctcgaacctctgtcacggtcttgggctgttcccagttaagcacactttccactttgcttggatcaactgcgataccacccccggatatcacatgaccgagaaaggccacttcattcatccaaaactcgcatttgttgaattttgcatagagttgatgctcacgaagtttgtcaagcactagccttagatgttgtgcgtgttcttcctcattcttcgagaaaacgaggatgtcatcaatgaacaccaccacaaatttgtccaagtactccatgaaaaccttgttcatcaagttcataaaagtggcaggagcattggttaagccgaaagaaactacggtgtattcaaacaaaccatagcgggttctgaaagctgttttcggaatatcctccggtctgatcttgagttgaaaatatccagacctcaaatcaatcttggagaatacttgcgcaccggtcatttggtcaaagagatcatcgatgcgggggagtggatacttgttcttgattgtcacctcatttagtggacggtagtcaacacacagccgaagcgtaccatcactttttggagcaaaaagaacgggacagccccaaggagagctgctgtgtcgaatgaaacccttctccagttgctcatcaatttgcttcttgagctcaaccaattcatcactggtcatacggtagggttgcttagcgacaggcgtcgcaccaggaacaagatcaatcacgaactcaatgtcacgatcgggtggcattcctggtagctcatcagggaagacatcaggatattcacacaccacgggtattgattcaagctcaggtttgatgagagagttgatacatggctgttttgaggtggtggctttattggaagtgaaggtggctgttttcccattggtgttgacaaaagagatggttttagaagcacagttgatattccccttgtgtttggaaagccaatccatgcctaggatgacatctaaacttaaggaactcacttggattaggtcggctttgaactctaccttatcaatgagaataggcacatccttgcatattgttctggttttgaaggttgacccaggagattggattatcatgggggtgtctaaaagggtggtggctatgttgttttgttttgctactttggtggatataaaggaatgagatgcaccagaatcaaataacaccaaacaggaactgagtgaacaagaaaggtacctagcaccacatcgggtgcgtcaacagcctcctctgcggtcgcgtggttgagacgaccgcgcccaaagttctgagccggcttgggagcggctcggcccccacgtggagcagcagcaggggcgccacggccctgtggaggacggggctgcggtgctgcggggcgcggcggaggagcaccggtgcgacgcgggtaaggacagttgttggagtagtgtcccaacttcccgcagttgaagcagttaacatttgcagcacggttgtagcctccgggctgcggtgcaccacggttggcctgcggtggcatagcggcaggcagacgtggagcggcgtactggagcctctgcggtggagcagaagcaggacgtgcagctggagcaggctgccaagtgcgtgggcgactcgaacggctgacagtagccctgcgcgccaagaacttgcgcttgcggtccacagctacttccttctcacttgcctcccagcggagggccttgtcaacaagggtcttcatactgtcgatctcatgggtagagagaccgtgcttcaactcagggctaaggcgatcaaggcaaagttgcaccttcctcgcctcagtagtgcctagctcatcagtcgcataccgtgcaaggtagttgaagcgactaaggaactccatgaaaggcaagtccccctgggtgagattgaggaactccttcctcttggccttcataagcccttctgggacgtgagcagtgcggaagccctgcttgaacacgttccaggtgatggcggtgccctgggggagtgtagacttgtaagtctcccaccaggcagctgcagcgccctgaaggtagtaggcggcgtaggtcgccttctcctcatcgtcacaacggacgaagttaagcttgttctcgatatcgcggagccagtcatccgcgtcgagaggatcagcagcagcagagaacacaggtggctgtgtacgctgcacttccgccagcttagactgtggctgacggttgttctggaggagagcattgcccaaggcctcctgagtcgcgaccaagcggtcgaagagctgactctgcgccgcgagaatctgagccaaagtgggatccatcgcgccggttggacggctaccactcgctcccgaattccgagtgggaggtggtggaagctgcgagttgtggtggttgttgttttggtttcttgctgagtctgccgttttattgctcctagagcgggtaacgggcattctgtacacaaaacacggaagtggaaaaggttcttgagattgatagacatggcatgattcaagttgaaaggaaggacagaaatatagtagtgcttaaaggaattgcaataagttaactcaatccaaaagtacggaaaggtatagacacttaaaagcatgtatttaagcagtaatttaactttgataacaacaaatcatcacagttagaatttctggacagcaagcatggatactcgaaaatggttcataaacacgcttatcatgcgccattcattccattaaaggttccatacaaaagagcttacataaatagccaccaaaacacgtttacaaaacgcgcacacatccaaaatgtggctaaggggagtacatcagaggtcatcctacatctcatgctaaagaaactatctaagtcacctagctagaacaagcctaggtgctgtcagaaggtccgggagaacccgaagagctagaagtcatctccgcatcatcatcaagaggcggaggtgcctgcatcaccaaacggtaacagctcccgcggtaatatcggatgtggtttggcccctcaacaaggaggccagaagggggtggaatatcagcaacaacccggtgactaccaccatgccctttgacagtaggagatggtgtaatcagcttgtagtaacctgatggagggggcagctcctcctccgctggtagcatggcgtcttcgccgtacacgacctcgggtgggatggcccaaatcccagctcggggttccacctcacggtcgagaatagcgatgcgccgcctcgctcgatggagctcatgcatcagatcctcgatgatcctctcctgggacctaacgaagtagcccaaacggaggtgaggggagggcggttccccttgagcagattccagaccagggtaggtggcaaagcgactagcacccggcctagagggaacaaagcggtaatccacagcgcacttcgggctcgtgtcacggagaaagccggtagcgctgtaggcagcatcattcatagctcccacggcagtccacccagtgccgtacacaatatcgtggtgtctgtcgttgcccctcgatggaaggaccagctcaacctgatagctcctttgagaggcgctatagtttcgcgtgaagacagtgtactggggttgccgagtatagccggcgtgctgcatcatttcccagagtgtttgctgcatggtgccagccacgaagcctccggaatagtaagagggttccaagggagccatctacaagattaggacaagattacctagattagaaaccttaagtgaaagggaggatcaaggaagaacaagaagacttagttttcaggttctggacaggagcaaaccacagcaacaacaggggtaaaaagcctatttaggtggctgctaaaaaggaaatttttgcacaactaagtttctgtataggttatctacccccctcaaaattttaggaatttttaagcaagttttaagacctacaagaaattttaaagctaaagggtgcagttctgtttttccagggttcagtgggtggctcgaatttttagaccatgcaaaactgaagataaaatcacacaaaaattcaagcaacatcctacaggggtcttctaacaactggccaagcttcataatttttccacctacggtctatcctgtacaaaaagattaagactgccgactgcagtccctgacagataaccgttagttgctaaataatttactaagccatgttttagttgccaaaaattatcaaaatttttctacatgaagctaagttgatactaagctaatctggttcaggggtgagtactgttgaaagctacagaaagcaaacaaaatcctagatacccatcctgccccatcctacccatgctaggccaagacgtttttttttttattccggcatttagaatttttagtgagggttcattgctgaacctgagacgacctacccagcatctcatcctagaagttctagcaaaattttatttgctcaagtcattcaaaaacctatgcttaactagttaacctaagcatttttggcaaaaacaaacgtctctcatgggaaggttttgcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 26931 - DNA, 1635 bp, Oryza sativa
tcatctattaaaaaacggagggagtatgatttatatataagaaaatagagcgagccccaacattaaaccatagtcagcctaacattggaaacactcgcataacatatattgtatatataaaaacatgctctaggtaaacataataaattatggatctggcaatattgtatgatctgaaaaataggtacggtaaattgtatataaaatattgcgtacctttgtagatacatgccggatgtatctacgaaattaatatattaatttaaaataattaaactagtaattacctttgtttgtgtactgattggtctgaatgcaagcgtcatgtgtgttgatgtgtcatggagtcgacctatctctgctcctgcatcatgcttgtgtagcccaattggtttcttcggcacagcatcccgtcgtatccgagaacaagtcaaaactcaatcatgagggccatcggacttggtcggcggtggtaagtgtgcatgtataaaccagggaacaataaaaaacacatgagcagtactaaaagaacgagaccgatataactatgattacaaccagaagtagaacggttaacctgctgacggtagattaattttaagatttcggcggcggacgtatgctcgggagtggttggaacggaccgagatctcgtggccgacaatgctaaaccgatgtcctccgtgatatctcccaaagccaaagtcgagagattgttgtcgggaaatccatttcttaaacccatctcgtcaaaaccttgaagcaccaaaaatccccctacctggcgcgccactgtcgacccctacctggcgcgctactgtcgacgtttcatatcgcgactacggtatttgcatagtatgggaatcgttggtaccagggtatatgcgatattgaagtaaaagagacggagacaaggatttttatataggttcgggccccttatctgataggtaatagccctacgtcctgttggccgaagccggtgttgctctttattcatcaggatcacacaagtacaatatttgggataacatatttagttgtcgtcgacttggcggctagataaccaacttgtagtcgatgacatgatagtcttcctcctcgaatccgcactcggcgtgatcagagatagtgctagatccctcttgccggcctccgtaggaaccggatggggtatgtctatgctaatctctgatgttgatatccggcggcatgtcttggcttgtattgatctatgttgatcttgtggcttcccccctctcctcctaggggggtttgtatttatacccatagatgcccccttgtccaagtaaaactagggagaccaatatggatacaatccgagtagtccttgtcgtttccatacagaactctacttgttcttccttatccagaactccttctatatacgagatatgattccgtataagacttggtatatggtgggtatgtggtatccataaccttgacagtagtccccgacttcaatgcaaatgaacgagttaagtttctcgatcgaagactttagaacaactattgttgtgctcacttgaccgttctcggtgtgatcagaaataacgcttgattcctcttatcgacctttgtaggcgctatattagggttgtctaggttaat

SEQ ID NO: 26932 - DNA, 7888 bp, Oryza sativa
tcctgcagccttgggataacatatttagttgtcgtcgacttggcggctagataaccaacttgtagtcgatgacatgatagtcttcctcctcgaatccgcactcggcgtgatcagagatagtgctagatccctcttgccggcctccgtaggaaccggatggggtatgtttaggctaatctctgatattgatatctgacggcatgtcttggcttgtattgatctatgttgattttgtggcttccccctctcctcctaggggggcttgtgtttatacccatagatgcccccttgtctaagtaaaactagggagaccaatatagatataatctgagtaatccttgtcgtttccatatagaactctacttgttcttccttatctggaactcctatatacgaggtatgattccgtataagacttggtatgtagtgggctccgctgagcttagtcgattactattgggtatgtggtatcaataaccatgacagagccatcttgagtccgtttactcaatcaacccttcgtcttcctatgcgcacatctctctaggtctttttcgccatcaagaaaccctaactctccttttcctctgccatcccctaattcgatttgatggatttggaaaaaccaccatcgacaccgtcgaggtgaagaaactgcacgtggagggatctcttcccgagtgtaacaacgtggagcgctcagaaggtggtactgaacctaaacccgctctaggacaaattgtagttttagagatttcgttcagtgtggttttctacctccttcttctgagttccttctacttcttctgaatttttacggccttcatcttctccacctgaacccaaattccatcgctttcatgagcatcttcgctcaccattgtgaggcttaccttggggtagtaccatttcttgatctgttttgctatttttatgagcttcaatggatggaatcttgcaaaatctctagatgctgcggtttccgtctccaagattggatgaaggcggaatacatccccttcaactaccattcatctcggagctcatggagatcgaagtgcttctatctccatgtagaagaactctcttatgtccttgttgtcctagacgagcaaccagaacactccacctcctggacctctaaaccttccttgaccccctccctccaagccttcgtagacaaattccatagcctctgagaacaagggtctctgagaacaagggttgttgaggtataaggtcaccgctgacttcatacgtcgtcgaatccaacctctccaagctcgtgctcaccccacgttcgattacataggagctaacgacgagacacggatattagatcggggtattcgttctcggaacccacttgctcttgattcgtgtaatgactttattattgacttatgatatatgcataaccccactgtagttctcgatgacaaaaccttgggtacgagagtgggtcatgttgtcatcagtcctccatcggactccgacaaattaccgacttccatctgtgacctctcttctgttgataaggacgccaccatcaattaagcagttccctattactccgcctttccttcatgtatttttgaatctgaagacggagtaatctaaaatcatgtaggctcttcctctgacggatgaaattggcccccttgtcgatcatcaagcctcctccaccctgaaagacaaggttgcctctgagcaaactgatgccgtgatcatgccaagcggcagtggcgccaaggtgcctaagaggaaatgggcgggtgtgtccaaacactcccctggcgtcggtacacttgttcagacaagcaactctgaggtgagttccgactacatctcttgtgaacaggctctatcaaagacgacatcgttctcactcgctttcttctccaagccgccatcggagctcccccagcaccgcggaggaaactcctgaagcggcacaaaccaaagtaagtgaagtctcaaacatcgttgtcttgtcttgcatttttttgtttctgtttctattatttctaacttgtgcttctgatagcatttctcccgcgacttccgctcaaagcgtaggtcgtgtggacaccagtttgtccccaccggccgttgtcgtgaccacgcgaactctgcccgctccttctcctccttcactgcctgccatctcgtctgtgcccggagccgacaagttggccgaggcatgctgcctactcgaaatgggcacccgcgagatgctcgccaggatcgagcgacttgggaaagtcgcttcgtcctcggatgggtgcgtcgtgcaattggagagccagctcgcggaggcacgcgaggaccttcagaagatgaaggaccttgtcgcaggccacgagcaacaacggcagggactggagacacggatggtgtagacgaagggccacttggcaccaatccgtgaggggatgcagcaaatttacggtcggatggacacgctagcgcgtagtttggggatccacgatagggttcctccttactccgacgagaccacgatagtatcctcgctagccgaccttatcgagaaacttgaagaagttcccagtaaccacgctgtgggggtggccgaggacacatgtgctggtcttcgtaccgacgcatgccacgtcctcacgtgtgtatggctcacgcaccctgagatcgaccttaaggaggtcctcaaaaagggtggagccgaaccatcgtgcgaggatgtgatgtcagaggttgagtagctcgagaaaatcatgatccccttttttggttgggaccttctatacaacggtttgtcaagttaagggactccctatatctggtattgcggtttgaagacaaatttgaactcggccacaagttgaggaacctatagtgaacttgttccgctcagattaacaaatgagaatataaaaatatctcttatgttgtacatagtctcttcctcaattcttaaaactcccaattctgaatcgtctggtgtgctgcaagtagggatggcaatggagacctgataattgattcctcgtagtgaactcacatattagagaatggggatggttggtatgacataaatatcattgatatctatcctccatgaggaggaatcaaatggtcccaaacttactagcatcggcgataacggggtggagacggcgcgcggtgacccgcattcactgtagctagaccaattctagactttccagacgttttgacccttgaagcccaattaacaagtatatattaccacctaacactaatcaaccagtcaaccaccacatcttccagatccagacgcagaccgctccgccacaccggccaccaggcgcgcgcgccgccgcctcctctcgcgcgggcgctgtaccgccccagccgtcgacacgggcgcggcgctccggagcctgcagccgtcgtcgcgccgccaggcgcctccaaccgtccgccggccggcgctagcgccctccgtcgccagcacgccgtccgccgccaccgattcccctgccggctgccgactacagaccatggcttcgttctcctccccggtaagctccgacagcgacgacgcaaggtgagcacatgctacaatccctagtcccttctctgctggtgtgcgtcgcggcggtgtggatctggatcacgctggccgtggagggggttctctctttgcaggaggtggcgctaaaccctatatctcactgtgcgttgtagttgctagagtgagggatggagaacggggagatcgagggggcagcggacgacggggtgccggtgcccgcgccgcccaacggcaggaggtatcgccccgtcggctccagcgatcgcgccgtcatccagatgacctccatggagcccggctcctcctcctctaccgctgtggcagccgtcagtggcatcacgccccagccaccaaggtatatggaagcttcgcttcaaattttggagatcgaattttagcaatattctcttctagggggagtagactaaaacacttgtactgcttgaattagtataccattgcttgtgcaaatccgatcgtgcattgtcttgctcgtgcgttattaagcaaaaaaaaaaaaggatgtagtgtttcaccaatcaaccctatggtagttttggtgttaggaacccatgtgaagcactgtggggcacatctccaacatatgttggctatggaactatcattttagccgttgggcttatggccttctgtttttgctcctcatttccagatttagttatcaggacaaggctggaaagtcaaacgtgctttatttactttgtagcatacctccaactgtattgttactgcttctcaaattttgcactgatatactgaaatttgattctacttggtttcaattaaattttaatggaagagcctgttgctggttgctgttgagatactcaggaccaatcataagttcataacactggttgttgttgcttagtacaatgcttaaattgatgctgatgttttcagttgtagctaatattgcctcattggattagatgatattgccatgtgaaatgatacatcaggctcttatgtaatccctccatcctaaaatacatcgtactaggatgtgtcgcatcccgtcctaggtttgtttatttttggacagagggaatatgtaaccacattgctgtgatttttgattctgtatttatattgctatgctcaaataagttaatagaagtgctatactactaaaaagttcttactaacaaatatctcaaccatttgatttagttagttggaagttttaaaaagtcaaagatttaaccatagcatgacaatcagcgtttgtaacaagtttgtaaaaaaaatttagcacgtgcatctttttccataagttaaatacacgtcacaatagttacttcttgaagaaagatgtgttctgttttgtcatatcaattttaatttgtgagtttcatagcgcgggaagtggtttctatatggatatgggagtaccctgcacatgtcatgtgcatcaatgaaatatatgttacttgatatatattatcttatttgcctcatgaatatgttcatattttttattgcacattaagagagatttttaggcataacttctgcataatttcctttcatgtgcacctttttaattcacatcaacaattgagaggagaatttggaggaaaatgctggccgtcctgcttcaacatgtacaagctaactcaatttttatacatgtcataggaatctaacggtggatccaagcatgcaagaagatcacactgtttcacaaggggattcaaagcttgagctttttggttttgactctcttgtaaatattttgggcctcaagaggtatgatccatgctctgcctctgtttgttaagcacctaaggctgtgtttgagcggcacgcaaaactatatatgcgttaacgcataattaattaagtattagctattttttaaaaaaatagattaatatgatttttaaagcaatttttgtatatacttttttttttgtaaaaaacacaccgtttagtagtttgaaatgcgtgcgcacagaaaatgagagaggtgggttgggaaagtgacaaaagaactcaacctaaatgttttgactaatatgaagcatgcgctctacaaagaaattgttagaactattgatttttctttatgatatcagcatctgattgaaactgaacagcatgacaggagaacagattcaggccccttccagtcctagggacggtgaggatgttgcaattacgattggacgcccaaaggttattctccattttaccattttggatgaagcccagctgttaacttaagtcataggtttccattttgatagtgaatagctacatattttttgtttttaacttgtgcaacaaaccagtaacaataattcaatacatatgatttacatttttgcatctagatatggcttcagaatttaaaccaatgcacttctactggtagcgtcatctgttgtattcagagtttcattatatgtctaattacattttcttaaaagcataaacaagttgttgatttgcataattcagcttttttgaaatatcgataggcccattcccggtctttaaaatttgttcagtgttgattctgttcattgccatcatttttgttctttttattttgtatttgttcatggcatttgagtttatgacgtttgattccattacttttgttggtctggcaggaaactggacccaagtttggtaccatgatgggtgtctttgtcccatgcttgcagaatatattgggaatcatttattatatccgttttacatggtaaaatattctggatactttattttaacttcccatatttgttttgttccaaagcccttattattttttatgatttttttgttcctgtgcttgtcaatgttgtgttcccattgttcttttgacagaagcttacctgtagcatttctttcttgtactgtatggccttttcccattatagaaccaagtccaaaattagtaaagcaaaattgttaaatgtaaatattgctatccagttttgacatgttaacttattaatgtattgatcccttgattacctaccctgttattcatataggtagaagtggtatttgtgcattgttaaccctgtatcttttttatgcccttatgctgttcaatttttcaacaactgactaatattttttttcttcctgtaggattgtaggtatggcaggtgtatggcagtcgcttgttttagtctcgttctgtggtgcatgcacatttttaactggaatatcattaagtgccattgcaacgaatggagcaatgaaggtacgctgaatgtaagaactacatgtggaatagttaatagaataaggtttgctatgccccatgttttgcttcttagcgctgtctttgcatttctatttcactggtcgaacctgataccgggtatgcctaaaatccattagggagggataaattaaatttcgattcaatgttggtaatacttttagagcttgctttgattttgttcattgctgcctataaaaacttgaccgcgattgttttgatgttcattttttatgatccatagggtggtgggccatactatctcattgggcgtgcgcatggtcctgaagttggagttagcattggactatgcttcttccttggaaatgcagttgctggatccatgtaagtgtttaagcactcagatttcttttccaaacatctttagtttgttaaagaaaatgcatagcgggagatggataagtaatagttgcgtgatgcaactgctgtttcttatactgattgaaatttcaaattataaatttttcatctttcatttatccgtaattttgcatgcattcgcacatgggtctgtgacgtctgtccccttttctctctgtgtctaacttattctgtcattttcaggtatgtgctaggagctgtagaaacctttttggatgcagttccttctgctggtttttttaaaggtaggaacaacttacaagtaatactatagtcagtaagtttactttatgtttgtgaggatggtagaaaaaatggaacagtatacttcaagccttttgttaggacatgaagggtgtctatatttactttattatgcatttctgttagccaaacttagtcaaatttctcttggaggaaaggaataccaaggtgcaaaagcattgactatgtttgggagaaagtacttttaggttggctttagtgttatctttgagtatgagtaatgctcttcagaggtgcatagttggacattctcttttagttagttcagcctcctatgagtatatgaccatcattattctgtcattcacttatttctgttcttcctttttatcatgaggaatcaagctagcacggttaattgcctacataccaatgcagga

SEQ ID NO: 26933 - DNA, 1651 bp, Oryza sativa
tttggcggtgtcaaaatcatcaacaaggtgcacctgccttcttaataccagtcctcttttcactgttgtgcatttatcttggtgttttcattgcaccaaggcacaatgctccaagtaagtttaccttattgtttactttatattggatcaccattattgtactgatccataaatttataatgttggtttgcctatctagagggaattactgggttgagtataaccacatttaaggacaactggggctcagaatatcaacgcacaaacaatgctggagttcctgatccaaatggctccatatattgggatttcaagtaagttttttaccttctctagaaatataaataacttgtcattttatggaaattttatgaggaaagtaagcattacccagtatatgaagcaccacaaaatttgaataatttttcacttgaccctatgagacggtatgaactatgaactttgagcaatcttggcaatgagtcctgctcgttatttgttactaatttggattcgggtaaacctttggagcccacatatcatcgactcattagtgtcccttcagcttgactagcccagctgcttcgtaatgcttgtggttggtataagggcccttaggcctgtttgaggtgtccatggaccgcagtggcatgatggcgccatggaggcagccgcaccacaagggcagagggaagagggagagactaaagactattgtttttttcttgcttaatgaatagagatacaatcccattcctatattgatgggataacttgactcttaagaaatagtatatctctaagattaaggaaacactacctccattcctaaaagagtgtcttttagcaatgaacctgagttatttcatgagaatatgttctatttcttccgttataataaacctgcactgaagtttcaaacaagtccctaaaccttggtgcaaatttagggatctacagtgcactttacttatttctttgttttcttaaatgtaaattgctaactatattgacttttcagtgctttggtaggcctctttttcccagcagtgactggaattatggctggttcgaaccgatcggcttcactgaaggacacacaacgttcaataccaattggaacattatctgcaactcttacaacaactgccatgtacctgttctctgtccttctatttggagccttggccacaagagaagagcttctaactgataggtacatacttcttaatgctgcatattataagtgctcctgctttacaattgtagataatgcatcagctcaggttatatttatctaattcatttgattgatcccatcaaggaaggaagataatttggccttacagatttatggtgcaactataactgctactcctattctactggctgttgcaggaattaagggcatgtagtttttcttttttgtgaatctcaattgtttggtacagctataagagatccttttcagagtatatgctgcatgcttgtctgaccataactatttacctgctccttttttcttccatttgaaactaacataaacaattggcagaacatgggtttatattggcaatttaataatttgtaccatggcacaacttagataagtgttgtgaatatattctttctttgtaaacaactacttcct

SEQ ID NO: 26934 - DNA, 17518 bp, Oryza sativa
  unsure (1)..(17518): unsure at all n locations
gttaattttgtcctagtccataccgagctgttatgctactgatttcttctctggtcaactcataaatatacttaatacttgcaggcttcttactgctacagtggcatggcctgctccagcagtgatttatattggtattattttgtctactttaggcgcagcactgcagagtttgacaggggctccaagattactggcagcaatagcaaatgatgacattcttccagttcttaattacttcaaggtttctgaaggggctgagcctcactcagccactttattcacagctttcatttgtatctgctgtgtggttattggcaacttggatttgattacgcccaccatcacaatgtttttccttctgtgctatgctggtgtgaacctgtcatgctttctccttgacctccttgatgctcctagttggcgtcctcgttggaaatttcaccattggagtttatcacttgttggtgcattgctttgtgttggtatgactatatactattacaaattcattttgacacaatggcatgcatcatgagctgtaatgctttcttaggacattattttgattaaagacttctgacatgctcatgcattttaataccaccctcatccataatgtactgaagtattgtttaacttgtactttcgcacaaatattttaatgcaaccttattttgtctttataatactgctttccacttacttggatcgttctctcaatttttcagtgatcatgtttttgatatcctggtcttttactgttgtctcccttgcccttgcaagcctcatctattactatgtgagcttaaaaggtaaggctggagactggggagatggatttaagagtgcatactttcaattggcactacgaagtctcagatcattaggaggtataactctcttcttggaaactaaatatcatatttgaaactattaagagttaccttgtttgtaacactgaacattcttgtcacagcaaaccaagtgcatcctaagaattggtaccccattcctctgatattctgccgtccttggggtaaacttccagaaaatgtaccttgtcatccaaagcttgcagattttgccaactgtatgaagaagaaggggcgtggtatgtcaattttcgtctcgattattgacggtgattatcatgaactggccgaggatgcaaagactgcttgtcgtcagctggacacttacattgagtacaaacgctgtgagggtgttgcagagattattgtagcgccatcaatgtctgagggcttccgcagcattgttcagaccatgggtctaggtaacttgaagcccaacattattgtgatgcggtaccctgagatttggcgtcgcgagaatctgatacagataccgtcaacatttgttagcataataaatgattgcattattgctaacaaagccgttgtcattgtgaagggccttgatgagtggcctaatgagtaccagagacagtacggcactattgacctctactggattgtgagagatggaggattgatgcttcttctgtctcagctcctgctcacaaaagagacctttgaaagctgcaaaatccaagtgttctgcatagcagaggaggatactgatgctgaggagctgaaggctgacgtcaaaaagttcttgtatgatcttcgaatgcatgctgaggtcatcgtcgtgactatgaagtcatgggaacctcatatggagagcagtagcagtggtgctccacaggacgattctcaagaggcttacacaagtgcacagcgaaggatcagcacatacctctctgagatgaaggaaactgcacaaagagaaggacatccactaatggaggacggaaagcaagtagttgtgaatgaacagaagattgagaaattcctctatacaatgttcaagctgaactcgacaatacttaggtactccagaatggcagctgtggtcctcgtaagcctccctccaccaccattaaatcaccctgcgtatttctacatggagtacatggatctgcttgtagagaacgtcccacgcatgttgatagttaggggatacagaagagatgttgtcacattcttcacatgattagagatgtataccttctggcggctctactgccatatgattgttgtaacatcatcatagcaaagtgggcaagcagattttgtgcagattttacagctgaaagtcagaagccatcaccttgaaggctacctaccctgagataggagatctgctgggcctttcgctggcatattgggtacgtcaactacagtatgtccattctttttctcggattcacatagcaagcttcaatacagttaattgtcacaaattttgtagccctggtgttccccatacgtgtaacaatcttagaaacgcaacgcttccttttgcactgaaacagtagcaatggtatcacattttttaaaatatatttccagttgatgtaatgagcaaactgaggtggccattaatgttggcatgttgttgattggcatgacgtttatactgatacacgtgaaaatcagctgaaattattggtaacactgtacaggactttccttgattcactactgcattattgcactctatgtagtcatcaaaatttggtagtatgttggagttgtccagggacaataaaatcagctgatgatcaccagggtacttgtgatatatattttctcactttattagtgtttttgtcttgtaaaatctgggggtcacataacttgtaaaatttcacgaaggcattagtgacaaattagtgacactgtcatagcatttttcttgcaccgttgcataacattttcctcaggatgttaatcttaagctctataactacaagttcatcttcttatcgtaccgttgcatattacggtataacagcacaggaggagctcctgtttctttcaaacagaatttgttgatttcggcaagtcaaactttggtttggcaagtctgcgggtatgatcagcatctggtcgttgcgtagacccttccatggatcttgaactttgcattcgttttatgctccagctcatcgtcttttgtgcctaagacgaaatatttaagaattaagaagctgcttccatagatgtttggtaacgaaaaagattactactgtattttgctctgtgacgactattgcttataaatgagtacgtaattagcacaaggaaaataaaagaaaaaggagagaattgttaatgaaaaagaaatggcacgcgttccacgtgcatggcgcttggcctcatcatcaaatttacacgagatgtcgtcagttaagagtacttttcattttaatttggaggtaaaatttgctacaggacactaaaaaacgtgtaattagctgtaggacaccgcaaaaactgtaattagctgtaggacaccgcaaagacatgatttagctctaggacactctaaaaacacgtaatatgcctaagggcactgaagctattattttattcttttcaaacaaaaaagagagataaaaccagattgtccttcggctctctcggcttggctccaggcgtgtgcaatgagaccacgcgcggcttactctgtttggctcctcatcggctcgatcccctctactcatctgtcgccgtgccaccgctcttatctgctcatatatgtctgaccagcagcggatgtctccatgacgatgacctcgcatcaggtgattccccaatggccaccaacgagtgaccttccatgcggctgctactcctgaagggagcaaaatggggtcatggagatgggtgcaacagtgaaccaaatgttgcccagcgcacgagcgcgccgctgcaacctgtgattccaacacgatatccttccagattgcaaaaccgcgaggcaacgtgcgggctcgagtgcaggggaagggctcgagtgcgagtgaggaggaagatgggggcactgtcgtgcgcttcacgacgccggcacgcgtaggcacggtgggcgccgccgcgccctgagtttggctataattggcttggaggagaggcactgcgagtccgccctgcgtcaacggcacaaaggcatgctgtaaaagtaggaaacggtgtatgcggaggccgagggtggtcgccaaagcggaggcaatgactggaagacgaagggggcgaacggtgagactggcgacaagtggcggggagggaggacagggtggataaactcggtaggctcctcggaatggccattgcggggcttacgcgtcacatcgcggagggtggcggcgtgggagacggtggtgtgtgagagcggtctcgccgtggtggagtgtctccgccgattgacacggggtactcgtactttctacgccgtttctttctcaattacaccggatataataaaataatgtcttcgatgtacggtagctaattaccaggtttttacggtgtcctatagccaattcatatctttacggtgtctcacagctaactatatattttttgagtgtcctgtagcaaattttgcctaatttggatatggtggcatcgcaatcgcacttatgtgcctacctgcactgcacagcacacatattgtgatctgactggcaggtaccacactctaaaagcaagcatttgttcggatactgtatcacagaatttatagaatccgagaaaaaaatgtttaagcagtcacgaatcttatcgaattttttaatatacatggtggcatgctcccctgctactattactaatatattttcgaaaattctctaaattcggcgcctgatgcgggcgcgcatgcatcgggcgcctcgcgccgccgctgcctaggccccgcgaatgcatgggcgcctcgtgccaccgccgcccatgccccaccacgtgtccccactatgcgcgcccgttgcaatagtctaccggatataatggaaacaccctgttaaggtggatccgctttatttttttccatcaacaatgtttcagctagttgtactcgtgatctttcactatgtatagatcaaatgtttcagtggatttttgatactgttcaataatttcatcttgatggacacgtggtttgttgatattcatggggtttaagtgttgtaatgggtttaaatcgtttgttgcatacgttgaactaaattgtttcatctaacgatctgaccgtgtgtcactttttttaagaattgaaacattctttcgctatttgctgaaacattgtttttatatagggtgaaacaacgtctgattttttggaaaccgttgtttcatatattgtagcaaaatgtttcatgaggtaatttggttgtgttttagttttctaaaagattgaaacattttcgaactactttgtgaaacattttcgatctacttggtgaaacaacgtccgatttgtagccacctcgatatatttttttgggttgtttggttcaaggttatagtttatcccgttagatgcgtcacactttcgcattttattaggttagtatttggttcgttactataagtataacaagccacactttactaactccttgctccacatgtcataggttctgcttggaagagtttatgacattagcttttgctagaatctttcatttatcagaaaagttctctcaatcagtctaaaaatttatagttatctatactattataaaaattaaaaatgtttttgccggtacttttggtttgtcatccgtgtatgagttggtttttatgttcgttcgcttttggaaacataaatccgtatttgagttggtttttaagtttgttcgcttttgaaaatatagaaagaatcgtataagaaatcttttttaaaaacttgcatgctaatttaagatgatcggactcctatttgcagcacatgattttctagcaaaatatatatccaagcaaatttaacacagtgaatttcaccgtaactaaaccatatctctatctctactattataaaaattaaagatgtttttaccggtattttggtacgtcatccgtgtttaagtcggtttttaagtctgttcgcttttagaaatataaatccgtatttcagtcagattttaagttcgtttgcttttggaaatacaaaaggagtcgtaggggtgaagacagagcggattcggacggatagtggtcataccatatcctaaaccatattttctaagcggattcggagcaggtgcggatagtgtacggatgcggatgcggagcggattgttttcggatgtcggaaatggtgcggagtcggtgtggaattggttcggaaacggattaaatttatcggatgctacatgtatatgcaatcaatacaacattgagttaacaatccaaggaacaatagtacaataatcaataaatgactcatcgtaataattatatgattaagtgctaaacaacatgaatacatgatgcccataatataaaaatatagctacttgagtgtgacatgagacgataaaagcctttgactaaaatatctatgttaattgatgaattaggacattggatgtaccaatttatgttatatgcaatagatagagtggtcacatatgttgatattttcggattatccggcaaatggcctatcggataatccgaaaaaaatgttggataatccgcatccgttggatattagagataccatatccgcatccgcatccgtatccgccggatttctaaaagcctataccatatcctcgtttcggatggattcggagcggatcggatctcggatattatccgatccgttttcacccctaaggagtcgtataagaaatctctttaaaaaaaaacttgcatgctaacttgagataaaagtcagactcctaactgcatctcatgattttctaaaatagaatatccaagcaaatttccacggtgaatttcaccctagctaaaccatataacaattacaagattaaaataatcttcacccgttgcaacgcacgaatattttttctagtaaaatctaaaaaataaagaagccagaagattctcataagctatttttcataattttaaagcttcccagacagggtcactggataattttgtagctaaatattgctatacggccaacaatttattggctatacgtacttatgtacttacgtgtgatttgtcatacttttagcaagttaggttctggtaaaaaagttagcttccaaccaaacaaatcctctatattttcttttattacataaaagatgcatacaaacatacgctaccaccactatacatgtctaccatacttacacatctacggatacatctttctacacacactcaaagagacaaactagtggcaaatcctaagatcctattaaacgtaactttgtgaaaggaatcagactttaccaccatacaactggtgttttcccaacaacacttcgttctatatctacatctacttcctctgtcccataatatagcaacctagaactggatgtgacattttataatacaacgaatctaaacatgggacggagggagtacaagatattggctctttatttctctttctcttgtactatgtagatatagaaaatttattgggaaagtaccgatagtgtggactgtggagtaggggtgcatgcattactccagtcaccaggttcaaatcttttatcctttttatttttaataaaaaaatctgcttgttgatccagaaactcattttacatatgcatgataacgccttaaccaatacatatatgcgcaatttaaataagagtacgttttattgaaacatacagatttcatacgaattaattcaatccacccaatttttctcacatccgatccaatctgttcttgcgctaatctcttcctcacgccatgcaccacaaaccctctagtcgaatcttcatacttgggaggggtctccactcctgctgttggagaaatcgctccatcgacaactccgtatctggagagggaggacttaaataatcttgagggttatcaccacctctacatctacatctaacgaactgtgggatatgcaccaaatactggtatttaataatatagacaattagacaccacgtctacactatttagatactattctaatgtcgatcaaaaattaaagtaaacactaatgcacaatattttagtatgctaatgggaattaagagataaacctcacaaaataaatctcaattactcagtaaagataatatcaactaaagcagagtgattgacaaggtacatgtaatgccttagaaaaaaaatagaataccataaaagatatattagaagtccctaagtatttggtgtttaaaattagaagaaaaacaacagatatacggtagctgggctgcttttggctagcccaaggcccaactgcccctccacatccccaaaaccctaggaggtccctccacctccccctagccatcatttgcaccatctccctcccctctggcgccaccccctccccttctccctggtttgtgctccccttgttgctgttgtggcaaggaaggagaagaagagaaagggaaagaaggaagggatgggaagaaaggtgaagaaagaagatgcgtttttatgttgccgctacttgtcgagacctaggtgaagacacttcggaatgcaactagagttcatctcatcattggtgaaggcaagtaaacatagtggtggagcgagcggcaggggtcgcggcggtggagcagcagcgaggagcggagagcaatgggaacagcgacgcgagcaacagcgggagcgacagggatgacgtagagtgagtagcagcgggtgacagtagcgagcaacggcagagcgagcagtagtgagggcggcgacggagcaagctgcggcgcgcggcggcggagcaagtagcagcaggcggcaacaacaagcagtgaggggggtggcaacgcgtggtgacgatcacgtcgactacagatctaacggtggtgcaagcaaatcctgcggcgatagtgaatccttggagatggtgggtcagaagtgcatcgatgcagcgcgagcgaatctagcagcagtggtgagctcatcgtggcgcgcggcgaggtcttggagatggccgatccgacaacggcggcaagctcgttgttgcggctatgaagtctttgggatggcggtgagctctttcaccatttccctcctttttagtctctacaatttagcaaattcagttttatacttgaaatgttatggatacgatttgatcttatcagagcagtgagttgtagaagacgaggcatataaaaatatggtagataaaaaacgacttaaaatgtgtcccaaatgtatgacatggcatggatcaaatgtaaaaagagttgcaatggtatcgttacaattagatgaattgcaatggtattttttaaaacatgcaaagttataatggcacatatccaattaatcctattaaaatttatgatgtaattataattaaagttttaaaatttatagtaattacagtgtaaatataggcaattgtagtgtaaaaaaaatttgactatttttttaaaaaataatatcacgctataaaaatcaccatttcgaagtaggataataatataattgctcctaaaatatatgggcatcttatttttttctggtgttagggagactaaagaacggcaaacacataatcaaaagctaaaagtttgactataatctgatgaaaaaattatcgccatgttagtgatttttttaaactgaatctcctgtttggaccgtaataaaaagataaaaagcttatttttattttcaaactaaactccgtaacttcagttcattctccgcaagaacagcagaaaagaaaaaggagaaacccacaaaaactacccttcctcttatcccctccggtccagtccctccacctccaaatccaatcctccctaaaaccccagcaccgccctatccttccttccttccttccttcgtccgaccaaaacgcgctcgcctcgcgtcatcggatcaaatggtggaggcggccacgcgcggagcagagagcccttcctcctcctcctcctcctgctaatgcgccgccatggccgcccgcgcgctgggtccacctcctcctcacgccctcggcgccacgcggcaggctcctcgctgcccccacgctgccgccgcggacgcctctgcgcccccgacgcatggataccggcgtggcgccgcggcgctcggctccgcgctctccgcccgccggggaaggtctggccctcgccttttttttccctctccttgctgcgtggtatcattctggtacaccctacccttatatttttgctcaattgctcgcttgcagtttatggcgggttcgggttcttgaaatttcttatcccagattgcgtatagttgtcctgaaataatgtcctgcgaattccacttgtatttctgctggtatccttcactcgcatcagcatagctagaatgctaattaattaacccagattgcctataactgtcctgaaataacgccctgcaaattccacttgtattcctgctggcatccttcacttgaatcggagctagaatgctaattacttatttttggctgttttggttgagggaggtttgcatttttcgtggatattgattttctggttaatgttcgatcatatttctgcaggcatactttgtgttcagtacaattgatggatgctcttagaggtggcaatcttcaagtggaaccaaacatacttcattcccccaagccattgatgtctactagacgtggtaatttctttagtttagttgtccatatacacttgaaatgtatttgggattttttattttatgaatatataatgagtgtgcggttcctgcatagaacatcagttgcatttcccaggaaattttttaatcatacatttcagcaattttaacaaataaagttgtacgtcttgtttagttgcctagataattggaatgaatatcatcttttacacaagcaaaaaattcatgactgacgcagctgtttatattagaaaaatagaggtgacctctctcatttaggctctatcctgatagctgcaattgagagtatgaaaatgtattccgccaattcattatgtattcattcatctgtaacatgaaatgtaaaacactaaacagcaatacaaggaaatatttggaagaaacatgtcttttgccttcagattggaggggatttcttgtgttgtctcacatgcaccactaaaacattaattattgttactgagggatatttcatcaacatgtatgttactgcattcatcttttcatttgctattcatttttcttgttaaactacaggcgtaaaacctagtgaaatgtacatctttgtttctcaaaagtgtaccttttctaattgctaaagggcctgtttcgatgggttgaacccaaatccttaaaatctaaactaagtcctgaatggttggcaattctaccaagggccttgcttaggcaaacctatttttaaaagttaacgaatcttaaagaaaacaggttatttttaggttgaccaacctatattaacataaaagtgtcacatcaaagattatgtatggatatagatcttttaattttgaagttcatgcagatttgctcacccgaacatagactatttcctttgaaagaagtgaatcaaagcacattccttcccctatatttgtgcaagtcttatttgctaaaatcatgcactctttccgagactaatacatagttttgacatgttcaagttatattacacacacaaggatcatagaagttcagctcaggtgtttagtaaaatcggccactttgttcagcttcgtagaagttggaagaagtgtactgaagagcatcctttcccctacatgtgcaaagtttgttttagtaaaccatgctgtccatgcaactaagagtttatcatttagatatatagttcatgcaaccaaagttttgttcactgctagtatacacttttgacctctcaaatttatattataatatgaaattgaacaaggtatgcaactaaaattttaccatatagacatatagttcgtgttttgaagtttatgtcatttcccagttggtttcttacagatgactcagccataacctgtaaaggattctgtacaatatcgtggaacctcaaatcagatgtgctggatggttacataatcttcgtcactggagatccagttaccttgggctgttgggaatcagatatggctgttcagttgtctccttctgttgaaagtaacaacttatggacggccgaaataaaggtaattcctcttccaacataaatcactttgtcaaaaaactgaaatgagatggcacaacccatggacatgttcctaaattttcaatattatctatgcaattttgtagttcgcgcatcttatgttagtgcgattaagaagtaggaagcaactggacctatcattcatgtacatttctgctactgaaacattcttttaagagtcttatttctagacaaacaatttcattttatgattattcaatacttatatgctcttgtatgatgggatgatttttagtttctccattatgattatttgatgtgatgtctagagttaaaatcatatgatggtgtttcatgtttccatgattccaatggaaacaaatacaattgtcatatttctcagtgtgttgcaacaacagtacaacttcaacaacctggctgttcactttgagtttcctacacagccaaatacatgttattgtcttcctttccattcttcaatggtgttgggctgtgggcatatataattatcttcagtgactagatattgttaaacctacattattctagcacgttgtattcttctgtatctaaggtgctctccgttcaacaaatgctcatatatatttgtctgcgcttagtttcctttggtcctttactccttttacatctgaccagcagttcttttttcctgatctatctttttttattctttctcacaatttctctcgtacagaaaatttagatacaatttccaatatgaaatctgctttcccttttatgcacctttttttagttttgtttagtacaaacttttaatttgatataaggatgcttcttatttccagttacagcaagaaacatgttatatgcaatcaaatataaacttttttctattttatgtaccatcatgttaacatatttcacttactgtttgtagggaaagatttattgaatgagggaatgttgtgtgccaattttctgattgtgatgaacatcattccaaacttatctttgaaaccagccttatcttaactgtttcaggtaccatatggtgtgcatttcaagtataactattttgttcgagaggagaatgacgcctcttctgatatcatatggaggccaggtcctgagtactccttgtcaatacccccagttggccggaaaaaacatgtcattgttgtgaaagatctgtggatgaaaactagtgtggcaggcattcccactccttcctggggatcatggctgatggaagctaattttcttgaagaccaatttgctaagagtggagagcatcaaaacattgtgaaagcccattctgtcattgatacggtggatcgagcctcatcagtaggtaatgttgcgctatcttgcattcacttttatagaaatagtacatgtttccttagtgttgctgaacacttaaatgtttccagttgattggcaggtgaacatattattctgaggcttgggaacggcacacctttacatgtcaagaatatatcagagaatccatctgccagtgtccatgatgattttactgtaaccgataaagcaaattcaattaaatcaagtataagtgaacatgaaaggaatcagcctgttgaggaaccatggatccttggatctgtcatggcagcaaagaaatctgttgcagcagggaagcacgagaaaaacagatggaagtttgtcaataagaaacagaacttgagtgaagtaagtgaaaacatacctgaacaggatcaacctgtagaggagccatggctatttcaatccaaggtggtagcaaaaaaacctgtagttcaaactaaaggcaaaatagaagcaaaggatattatcagaaagctaaggaaaatggataaacctccagcgcctttggaggaggataaggcaactagtggagagccttcatcaagagtcatagtaattaattcatcagtctgcaccatgcagaggattgcagtattggaagatggaaaactggttgaactcttgctggagcccatcaagaacaatgtacagtgtgatagtatttatttaggcattgtaacaaaacttgtgcctcatatgggaggtgcatttgtggatattggactttcgaggccttcactcatgagcataaagcaaaaccgtgatccatttgtgtatcctcaaattgtcaagaagtgctaaaagagattctgcgaatttttctgattataatgatgatagccttccaacatatgaagacgaagatgatgatatgactgatggggagttggcagatgaagaaaatgatgatgagtcatcagcatttccagctgaggtagtttctgaaaatgaagaacacatggcctttttgcccaattctaagataaatatgattcatagtgctgaatttgaaagtatctctagttatgatgaagaaaaagatgatgaaattgatgatcacatggaagatgaatataatgaggatcttttgcctggtgatcagtcagaagtatccaatgatcttaagacattatcttccattcaacatgctttgagagagtctagtgatgatacaaatggaagtaggtggtctcaagttcgcaagggtacaaaaattatggttcaagttgtcaaggagggattgggttcgaaaggtccaacgctgagtccctttccatgcttaagaagccggttttgggtatgtgagataaatatgactagctatctctcatgctattctagcattacaattttttatgctttatgatcttttgtttacctttggtaatttataaattaactgcattggaacagaaatacttttgatcagaaatcttatgtgttgttactcaatagtctaccttgtttgttctttagttctaatattttcttattacgatgcggaagggacatttaataacccagagtgatgtcaaatatgagtagttgtgatgttcttaggacatttaatgatatcactatatagaggaatagagacatacaagcacttcagtttatgcaccatgtaaatcttttggtgataaatgatgctgtctgcagagaatgtatgcttatatatatgtacttcagtcacctatctattcaatgtcattatttgctaatgattcataactttctgcaaaaaattaccatgaaaaaagaggtttgtagcattctgcattgatggtcaagtaaaaaaaggatgttcatgttaactttgtaagttgtaacttacccttccatttcaaatttgcagatactggtttcccgcggtaacaaagttggagtatcgaaaaaaattactgggatagagcgcacccgattaanaggcattaccaaattattacgacctcctggatttactctgacagctcgtactgttgctgctggccattcttgggaggagttgcagaaggatcttgatcgcttattatctacctggaaaggaataattgagcatgctcaatctgctgccttagcagctgaggagggtgtagaaggtgctgttcccgtaatgttgcataggtcaaagggtcaggctctatctgttgttcaagatgatttcaatgagaaggtgatactatttgaagatagcaaaatcaatagcatacttttctttgcttgatttgttttcaaatgctttactgtattcttgaattactgccattcttcacttaggtcaagaggctagttgtggattctcctcgcacctaccatgaggtgagaaaccttaaatctaatccaattttagtctaagctttgtatccatttcctgtgattcattttcccttcccatgattctatgctgtgtgttctatggaccaaaggccaatctctatatgtcagttagtcctgctgttcaaagcagttagccacttggaaacctgtctccaaaatgactaatattttttcaggcgtgtatgttgattgattaagtaatgatagttgcgcatgcttgtttgcacactagtttttccttatgtctatagaacgttcctggcctacctactgtctactgttgtatgctattggactttctggttaggaattacatttttcaggcttataactcttttttttttgcttatgcatatttaggtcacaaactatctccaagaagttgcacctgagctctgcaatcgagttgatctttacgaaaaaagaactcctatatttgatgaatataaaatagaaaaggagattgacaatattctgtgcaaaaggtatactttttttgttgcatttgtttcttaaatagcttcattgctacatattcttttgcttgctttgtaatgtttatcaaccatttagcatagaacaaaaacacatcttgtaatatagattactttgataagtaattttggtttacctggacctggttttttcctagactacaaattgcatatcaccatttgacaagcaagggagctgtcagaaataagactgctctactgataacgagtgccatgttcaacatgagcttgtggctggcagttgcgctaatggtgattaggcttagcctagacctgttcatggtagcctgacctggtaaaattgagcaagcctggcatgatgtgtcagacgtgggcctagatttatagcccgatgaaaaaaaaagcttatgaacgacacactattaacttacatttctgttaaaggtataaatgatacaatttctgtagtatgatatgttagtgctcttttattgcagggttccactacataatggcggttctttagttatagagcagaccgaagctctggtttcaattgatgtaaatggtggtcatagtatgtttggtcaggggacgtcccaggagaaggctatactagaagtaaacctagaagctgcaaaacaagtatgtcccatgttctgtttcgtactggaaagtagtatatttgctttcaaaccttatttttctttacttatctagaatccaatccaccttttattttgacgttttactgtatgtcttactcatttacctttcagctgactatgctttaattcctaagagatgcacttggcagtacttctatttgtctttcaccaaaagtctaccagaaaaaaaaagaaaaaaaaaacatgtatagtatctagaacgacaagctgctatgtggggccatcagttcacgcacagattctgaagctgcgtagcagctttctaggtgtaagcagttagtgagatagctccttaacatctgatcaacaatttatgattaagttcttttcacttgaacatttgatttgttaggctaaagttatagccgtcctttcatatgggcttcagcatatccattatggattaagaaaggaatagacgctagttatctcatctcctgttctatattcctcacccctgttcacagcatgatcggg

SEQ ID NO: 26935 - DNA, 9545 bp, Oryza sativa
cctgcagccctgaaacaaaattcaaacaaaaatttgttttgcataacgaaaaaaaaggatgcttctccgtctacggaacaagattataatcaattttttgtggaatgatagatcaatgttggtgtcagtcattactttcttcaattttttgggcgttgtactgttacacgtggtactctagcagtatcttagggaaagtcttcagacccttaccccatccatgactcacaaacaagcaggatgaaataacaggattttgatagagccataggctaacagtgactcattcatagatgacatcgaattcgagtggggaaatgcatttattagaatttcaaacttgaatatgatgcaaaatttcttgaatgcagattgctcgtgaattgcgcttgagggatatcggcggcattattgttgtggattttattgatatgaccgatgatagtaagatatcaacttgtagaattaattatagtgtgaaatggttttcctcatacctgcatttcatcatgccgtatgctccattatgcttgcagctagcttgtttgtttttctaaaaaacttgttgattttttattctcataggaatttatatcgtacatgggtatcttttctgctgcctggtgtttaattaagtatttgctaaaatttgtcatttgaatacaactttttaacttgtgccttggcatattgtcatgcacctaacatgtggtgatgtttattgacctgaaatctcactttattatgtaacccttgtactggactctacattctgtactcaaacatacatcatacctttgtaagattcagccagcatatcacaacttaagatacaattataatatcttcacaataggaatattttgtttcttatctggatattctttccatgatttgggaatattttgttttgaatttatgtgccatcaaattaagcttatatattgagtcttcttggatttgattgaaaatttcttgagtttttaatttcctactgttattaattcatactgcgacaggtaccactaccacagtggcatttccaccagttgtgcgtccttcatactctgttatactcctagatgatactaatgattgtttgttgtttcattgtgattttagattctgactgagctatgtctgatcatgatgttttccttgtggcgttgtatttgtattccacattgttgttttccttttccccctctctctcccttcttttcattcttggtctaatgtagcattttgctccagcaaacaaaaaactagtttttgaagaaatgaagaaagcagtagaaaaggaccgatcaacagttggtgtttcagaattgtcaaagctgggtttgatggagataactagaaaaagggtatgtgggcacttcttcagatgtgtgtagttgtccactatggagaattcaactttacgagaatatagatacccatcaattaattgatattttaactgtctataatcttgactgaaatttgtaggttcgaccaagtgttacgttcatgatcagtgagccgtgtccttgttgccatggtattggccgtgtggaagctcttgatacttctttttcgaagatagagcgtgaaatctgtcgacgccttgtaagtcctacaaacttaccacttaccaatctctcaattattttttagttgacatcctcaaatccttgctattgaactttctgagatttgaccgtatagttctagattttggttcaatactttcatcatataaaatctttggtagtatatattaatttaacactcgaacactaattgtcaataacaacatagaggagggatgtagtactgtttaaaggaatgcactgaccagtatgcagctgataatctagacaaaattcaagcagcagtaacaatctgttaaactgaaacagcttgcttgtattctttcatgctgatattggttccgaatatgactttgttgatattggtatgaagtcttttattccaaatgttactatatctccatgtagacaaccagaagctagaactccatgctataaatagtataatcagtgtttaacttatttgttattaaaaacaaaatgttcctcttaaccttgtctaatggatcaggctgcctctggacataaatcagaccctgagaaaccaaaatcatggcccagatttgttcttagggttgaccatgagatgtgcacgtacttgacatcaggcaagaaaacaaaactagggctcctcagcagctctcttaaagtgtggattttgttgaaggtatgctatttgtactttttcatttgcatgtcatcatgactctttaaccgtgttgtcgtttgcttttgaaacttgttaaaaacataattaatgcagatcgctagaggttttgctcgtggggcatttgaattgctaccatattctgatgaaaaggaaactgatgagcggaaggaagagacatcagaatcgcctccgaaagaagcaggcagcccaaaactctctgtatttcctatcaagaagtggatgagccgtgcaaagagagcgaagtgaatctctaccaaagagatgatttggttgtgcgatatgctttattgttattcccagatcaagaagtacagaatttgatatggctctgttgttaattctttcctgtggtgatccaacgtcagatagacgccttcctggtcaatggtttgatagattttttttttccttttccaaaattttagatgcaaaaccacagtgtgttaactatgacggatgcaaagaagtagcacgaacattttaggtgggaggaaactagattttctgagggataggaattgttgtcagggcattgatgtggttacagtacatacatcaacatagttttattccatggcctcattagatttgttctgttggatttttggtgtacttttctcagttattttttattcattagtaaaattgaaatggattgtattttgtgcaaattacaaataaaaatttcatgttaaattcttatgctctacaaatacaatcagtcggaaagaatcttcagggtgtgctcacagatttttgtttttttttttgcgagatctgtctgttaatttcaagatcgtctcacaagtttaaacgagcaaaaacagttcctattatatgattaacataaataaaagatatacactatgatgtggaaaaaagtgtggtaataaagaaaatgccatcagaaaatataatatcaaccgtttgggatcatctgtcatgggtgcatcgggtatgcaaccttcaagtgcggcccttctcaacgagtctgaagttctcgccggcagcaatggaaaagggaagcagcggatccatctcccgagctggtggtgcactgtgcactggtgcggtcggttagctctgccgatggtgccaggaaaattgccagtaactgctatttgtcgctctatctaattaaaaaatacgcaatgcttcctgtatttttttcgtgcgtatggtttttttttttccatcgcgcatgtgggcacttccgattttttggcgccgttttctttagcgcacgctgtttttttccgtcttcaattctcaatcatagttttagccttttaagtggattcaaatacaattacatgattataaagaattacagtacaggaattacatacagaatccaaagaaagaaattacatacaaaatccaacgaaaggaattacatgaccgaataggatacaaacttctcaacctatataaaaaaaactgaaaacacaaacaaataagactcatgtatgcaccagatcctttttttttttaaaaaaatagcaattacctgtttgatgtgatatttaacctgcgattacttcatttaggatgacaaaaggtatttctttagcccttaatgatgtacacattattggcatatagcaatcaggatccttattactacaacacaacaagaagacaacttagctattcactggaatcctaatacacaaaaataacttcctaaaatgatcaattaacccaaataacttccttgaatattaaacaccagattgattggatctcataccttaattaagtggcaaccatcttttattagtaatttccgaagaaaaaaaccatacatcttctattagtaaaatgaaactttatcaccaaactattaacccaaataataccactattacttcattatatttttatttactgcacttctataatttctaaaatgatcagtatactaataaataaatatcatgatcctaattcaaacaaggaaaaccggcagtgaaattcatctgatgtatagatgtataacctccaaaatgttcacgaattaaataagtgtggtagttgttgttcctgatgaactattaattaacccccaaaatgttcagacttggacgtactgagcaaacccaatcgaggcatcctaggatgacagcatcaagtttgcaaaatttaaaactgtaggatattttaaaaaagatagtcacacagtctaactactcaaattgcaggtcgactcatttgactgtgcaacatactaatgcaactattaaaaatgcaaaccaaagcgaaatattttttttacttgcccataattcacccatgttgtctattttagttagcaggttcagttctaatcagttttaaggtgctgattcatagtcaagtatgtgcaagcagactccaaatgaactcactttgaagcagcccgataaactaattacagctagccgtaagaattaaactagaaacaaggacttgatatatgtgaaatatggacaagccctctgttatatgagataatagtattaatataaaccaattaaataggttcactccaagaataggttgtcctggaaccgctgaaggaattactgtgattcgaagaatgaaaattgtgtgcaggtgggagaaattgccaaatttaatttacctgcacaattgagccctttacagcagttggacccttcccttcaacaagatcatagcatttcaggccatcagctgtgcccaagcattttgaaatcaatcaaaccactcggaaaaaactaaattcagatgaattgatgtttacagtgagaattcaggaatgccattaatcagaaagcatgccatattatctagaaaatgaacaatgcacaagagctagccaatcaggtccatgtacaaacactcaatgaacacccagcaattattggtactatcaagttagcaactcaaccttaccattacaatcacccaattagtctaccttaatacacctaaacacgaaccaatttagttaattcttaccctaaattatgttaacagattgaaaagacagtgacaaaaagaaagcaggaccacgatggcaatttttcaatttttgatgatctcaacaatatctacaacgctatttttaaagatcacttttctttcacttttcttttctataaaggaactaacggactaaaaccaataaactgccatcaataagtcatcattccatcccctacaacttccatattctatagttgtaaaatgttcacatgtatgggtaattatgggttatacaactgggtagcccaaacagcaggtaggttcagttttatcaaacactgaaaaatataaaattagttacttaacgagcagcatatataccctgtagaggtgatgttgcagcctagatccaaggcagcaagttatggttgttcagacgaacacggcgcgggtgagctctcctcgaactcagcgggccgcagcctggcctcgagcgccgactcaacgaggtacgcgtcgaccagcctcgccatccttgtggcgtccttgaggaagccgcgcaccaggcacatcaccagcggcacgtcgagcagcgccgtgcacggtatcatcacgacgcctagtgtggcctggtccaaacgtcgcgccaccatggactccagctccagcagcagagacgcgttggcgcccaccatgctcctcgcccggagcagctcaacaactccaccgctgccgcatacgccgagagcttggtcagcccacgtccaccatcaccatcgtcattgtaggggaggctgccaggttccgcccctcctacatccagtattcagatacacccattgtgccagtttaatgttttagtgctgatctgtagtatatcatggtgaatgaagattgaagaatagctgatcattttgtttacccctttgtagaactgaaagtctctgctcccaactgctatcatgcgttccaatatatactttgttttgcatatgcatttcctacgctattcctaaatttcccctattcctatgatttgtaaatcctgtgaaccgaaataagtcgtctagtgacaacaacgaagaggcagggagagggacacaactcaactcgactaaagatggaaacatactatactccttagttcttggttagaaaactcagtggatctggcaatgataggaagttagaatactattggaaggatgtaattgtagcgctcaacaaaatacgtcttgtagtaactgcaaaaggacagtcatgaaatgaaaaccacattaaagtaagaagaaattgcaaaaatatgtggagcttattctcaagctagaagcaccacggcatctttcacctattggtagtttgagagaagcctcaagaccaaatatggcttgtaataatccagcttccgcgagataggacgatttgctcactatttgaggcgtaaattgacctactaaaatatcgcatgtttctacccatgaccctaactttacaagtccacttctgtccaaattgcatagtaaatattctgctagatgtgagttactctagtagttggacgtgatgtcatgtctaatgagccaagagttaatactaccacaagctagctagtacctattgccgcaagccaagacggtcaagcagttgtggatgatatgaccatgactactatttataaaacgattgctcacataaaatatcatgtaaattcatttcatcacaagcccctattttatctgttagtttaggagtgacatacattattgggatgcacatggaagatgtacacatcagggatggagatcaaccccacactctagaatccaattcggccacctgagattgcattgaattcaaatggctaccaaatttgcatacgagctccttttgggcaattgagtacttgttcgtaagatcttgtcataaacttttagatttgtccacctcaccataccctaaactataaattactccattcacttttagatttatatagtctcaccatcaggttcaagattgttcttggcacaggaagaacaacaacaatctgaagttcatgtacttactaaggcgcaacactcctatggtagttgtagtcggaccgccaatgtcgactcccccctctctcaaatcgaagctatcatcctctcatcgaaagatcaagaatccccgttgctacatcaatggagctggagcagcgagacgagcacgcaagcatgcttaaggcatgaactaaaggatcaacatattgcacaatcacaatcatattggtaatgattaatttatgaataaccatcttatttgcttcttgaactagcctttattctaactataattgcaaaccatattgtgatatatagctttcaaactatggtaattggattttatcacgagtaccttgcattttatcatcatgcactgggattttatcatccatatcaacctagcagacattttataatcattggtctatatttatttctttgaagaacactcactagttatctgtgtgcagtttttcaaattattttagtcaaaacaccctgatgctccagaaaggaagcatgaccggtttgcaaatttaggttgtctttggttggagatatatcattggataggagatggtgcatggtgatatagttttttgagtatatttagttggtgggcaatggtggataggacgacctggagactgaatagtccatgaagatgttggatgagtgtatctggccaaattggtcagatgaggaaatccacctttgctactcttgatcattagtaattgattagcaacaattaatacattttgttattaatctaccctataatgcaccaactgatgtttacatccttcatacttcattcatcaaatccaacggatgaaaatcattcaatgtttcacatccaacgacagtggggctcacgcgacgcgaggtcacgcggtgggggtcatgcggtgggagatcgatcgcgcaatcaatcgtatccccttactccgcttccttcctccgcaatggcaactgcgcctccgcctctcctccacctccggcttcccccaaagtccattcgatcctctcaccctcgcctcgcctcgcctcggcgaatcggattccgagcactcacaaccggatcggagtgagttccatggcctgaatcactcctccacctccggcttcccccaaaatccattcgattctctcaacctcgcctcggcgaatcggattccgagcactcacaaccggatcggagcgagttccatggcctgaatcatggggggactggccgaggagaggggcgcctctctctctcacacacacactggttcgtctcctcctcctcttacccgactgctcggatcggtcgtcattttcgcattgggggcaatttaggttttgttcgttgcctggatttttgggctgttgtaggattggatgggagtttttcaatttgttgggtgttttctcgtctgtcctgctgcggctaagttggattcgtttaggttttttttttcactgtaggatcgattttgaatttttgatatgtgcaatcgtaggtggttttatccattctgtctatgcaagtaattttatgaaaaaaaattgaatctttgatgtggagtaagcgaagtcataatgccctaagaatatggtctgctatccaataatcgtgacttcttggatgaccaaccaatgatcgtgacttatctatgcacgtattagatgttgatttcactcagcctctgatatctacatgcatgaggcattgcttagcttaacctgtcatttttttcagaattatggttcattaacagtggggatgtgcaacatatttattggttttcagtgtttccagattatttcagtacatatatatattacttgatgatgagaatggtgtgctcatgttcctattcatatgctcatgcttttctgctgctgctatgctgtaaacatgatataatcaagcgctacagtttttttaaatgctttttgaaaattcagattattgcatcatcttgtttatcaaaaattcagattattgcatcatcttggactgatggcatatattaatgtggactggtggcatatattatattttcgtagtgcgactgataggttcaactcagcatcgcattgaagcagaattagcataatgcacaatgctttacctgtctctatttatctatgctttgaagctttaatttgtgctaaattaggattggttactctggattccgttgcttaatttgtccactgcaaatgcaactccacgaccagctcaccgatcgccggacactggtggatcca

SEQ ID NO: 26936 - DNA, 19930 bp, Oryza sativa
  unsure (1)..(19930): unsure at all n locations
tatcaggtagtgctacagctactttgttttctgtacttgctacaaaataagttgatgtcaatttatggatttatgacctgctctcccctttttttcacatttcttgactgtgagagaaataataatagaaattctttgtaataataataataataataataataataataataataataataataataataataataataataataatataatcaatatgcagattcactgttgagtttgaaaataaattctttgtaatgacgttactgctatatcttatatacccttctttgtaattaacagtaatggcatcaacgttagttcaatttgaactaaccaatatgccatacattaaaaacaaatggagcgtgaaaatagcatttttcgaggtcatatgactaattcccttgaacaaagaactttaaaatagaaagggagaaaagaactgattcaatttaattatatgactcgttgcaggctgttgatgttttgtaagtcacaattggggaaaaaatttgaacttgtgatggctgaaggaacacgataactttgggttgcatcccgatgtgaacaggtaatgtgttgagttgctttttttttctccaaatgacttattaatttgcagtggtacaccatggcacctgctccttttttctatgtaagcaaggaattttggttggttctattaatttttctttggttggatgtaaggtgtagttttcaggtcattggaggctctatatatgcttgtaatccatgtgatttcctcttatcacattgaaggcatctcctactgttgatatttgtcggtccccaaataatactcatctttgcaaaatttttctttccttgaattattcaatgtcttagagtacatgaccttgcaatgccacttccttcttgttgcagcacattattcagtttgcgttatgaatcaaaaagtggttatagtagatagaaatagtttggaagaacagggagcctaaagatcctttcagtggatgtccgtgtttgggcggcttgagaccatcttaatattgtaggtgcaggaaattaaactaaggtaaaagcgagatgctgatgttaggtgtagatgatatggatacctgaatcagtccaaacctgcttaggttggagctacttctcgataggaatccaaatatcagagggaaggttgtccttgtacaaattgtcaatctagcaagaagtacagtggaacacagaggaagcaataaaagaagtggattacaaagtgtcatccttatttaccatcatatattgttttaatgaaaatattttattttattatgcatctgattgttattgtaaatgttatgagggatagtatgaattttatactatatgagtgcattgttttccgacagaaaaataatgagttggacaatttcagaggatgtgacacaaactgccatcagccaagcccactaattatgtttgagtttttgagttgcttcccatcttttagtgattatttcatactctgtggataatgttttacaccgtgcaacagagttgcctgaatatgagataatgttacggaatgaaaagcactaccattatgttagatctcatcttacaatgcttcttaatagatctgtatagctttgctcaagatctagaaagggaatgcaaatatcactccatatatataactctctttatcatttctttcttaagtgaattataaattaagttacgccgtaacgttagtacgggcatattactagttagtaattaacttgttaaaattagtgttgattagatataattagtctattttatagttcattagaatatattttggctttattaactataattaatatatattattatcaattaatatttattgttccaaacaagaaattgaaatagccatgtttgttgatcagtctagtacgttcaagaagcgggtattgggaaccttttcccccggtcgtttgtttttcttgtgcctcccatgatgacacaccgtcgtcactcgcgacgaggagcaaacgaggaacttggcccagcttagctgtggtgcacacacgcggacacgccttatccacactcacctcaccctcacccccggccctctcccatagtagtatcgtcatcacgaaacaaattaaccatagcagcagcatatcctctcccatgcttccatggattccttctagcttcgccttagcttctcctcctctacagtctacacgcgcgcatgcatagcatctatagagagagaacaaattaattattaggatttagtcgcaatggcattagccatggcgcccaggctagtccaccacccttgctgcatgatgctctccaagaacccaagaacgccgccgccaccgccggcgatgcaccaccaccatgcccacaagccgctcatcaccgcgctcaccagcacgtcgtcgttcttgctccgctccgtcgacgtctccaaggacaacaagccgctggagacggcgactacgacaaccccgcctactccggcaccggcggcggcggctccggagaccgaacaagcggaggcggtggcgtcgccggagttggagttggagctggaggaggggccgaaggtggacccgcggcggctggaggagaagttcgcggtgctgaacacgggggtgtacgagtgccggtcgtgcgggtaccggtacgaccaggccgccggtgacccgtcgtacccggtgccgccggggctgccgttcgagcagctccccgacgactggcggtgcccgacgtgcggcgcggcgcagtccttcttcgagagcaagagcgtcgagatcgccgggttcgcgcagaaccagcagttcggcctcggcggcaactccctcaccggcgaccagaaagcgctgctcatctacggcagcctcctcgtcggcttcctcttcttcctctccggctacttcctccaatgaaccagtcaccccctcttcctaattctctacctctacctctacctctactgtgcctgtttctactaattaagtatatatcagtacgttttatttttattggctaattaattaattaatctgtgtgaatacatagtgctattccatctcgaattttgaatttagatatttaaccagtaacttcatccaaatgcaggcctataattttctgagtttttcagctgctgaatcaagctccttttgaaattgaaatgaacaagggggcagggatcaagtagctagcaaggcagttctgcggttgtgacgggcctaattacatcagtcgcctgatattctatcaaatctgagtaaattgttccaaacgttccttcataggtccacatctcttctctagatccgactctctaaatattccagttggttagtttaccaaaagagagactcagagacaaatttacctttcaatccaataacctctccattaaagtctccactctaacagtgtgttgatactttttcatggtcaacatagaatcacctaacgatttgcggtgcaaacaatagagtcgccaaaatcgttagatcaaaaccggctagcagaaccgatttctagattaattcactttcacgaaattaagcgactaatttacaagcaaattagcaaagaaggtaaatatcatatttacgtgacaacgaacgactagtttctaagcaacctagaaaaggataaccttctcgctttcgtacagaagcatgaccgttttctggtgaacaacggtaaaaattaaccaaattctagggctgatagaaaagaactaaaaagtagaactcagccatgaaaataaaatatgaaatagaaaagaactaaaaagtagaagataagtagtagattgataatttgttcggggtctttgcctaaactaatctaacgcctatatatacacaagacaacggcatacggccccgttatacatggcaactcctgccaggtaggaggacgctatatcagtacgcgacgcatacgctgaatatagtaaaacatagcatgataaacaattcacatgaaaaagctaaaagagtttctgaaatttctcatctcacaaaagaaaaaaatagttaaagggacgaaagtactctttagaattaccacttcttttttgctcggtaattttctgattatgtcaaaagaaaaacaagtgtttcaaaccgttaaaactaaatgtttcatacgtaatagtgatatgattcaatatgtgtcttcagtatgtttcacaaaattcttgaaactacctgctactattctctctcctctctctccacctcatccatacatacatgctttatttcagcaagcttcaaaataatttttctcttaaattacttatccaatctatgatctgatcgtaccgttgtattcgttgtaattaaatctttagaacaagatatcgcatgattatttttgataaaagaaagcatatgtttcagtcagttaatacatgttgtttcatatgtgactgcgacatgtttcaacgtgtatcttcaccatgtttcataaaatatttaaatgtttcagttgctattttttttttgtttcaccatatataacttaatgtttcacttgttggtcaattgtaacatttgaccgtctgtttttttagggacatcggacgtccgatgggtagattcctcctaaaagtaggacgacgctatatcagtacacaacacatacgctgaatgtagtaaaacctagcatgataaacaattcacgtgcaaaaagctaaaagtgtttctgaaatttcttatctcacaaaagaaaataaagagttaaagggaggaaagtactctccagaattaccactttttttttgctcggcaattttctgattggtctacaaacgtggcagtgtacgattgctggatacacctgtcaggtaggtggcagctttgtcgcatagaccaggctaatggaccgcgtcacccgatctcctctctttaaatatttttcctctcttaaattacttgtccgatctacgaactgatcataccgatgtattcgttgcaattaaatctttacaacaagatatcatatgattatattatgtcaaaacaaaaacatgtgtttcgaaccgttacagctaaatgtttcatatgtgatagtgagatgtttcaatatgcgccttctgtgtgtttcacaaaattcttgaaactacctactactactctctctcctctctctctctccaccttatctatgcatacatgctttatttcagcaagcttcaaaatgatttttgtcttaaattacttatccaatctatgatctgaacacatcgttgtattcgttgtaattaaatctttagaacaagatatcgcatgattttgataaaagaaaacataagtttcaatcagttaatacttgttgtttcatatgtgacagcgacatgtttcaacgtgtatcttcgccatgttttataaaatatttaaatgttttagttgctgatttttttttgttttaccatatataacttaatgtttcacttgttggtcaactgtaacatttgaccatccgattttttagggacatcggacgtcccatgggtagattcctcctaaaagtaggaggacgctatatcagcacatgacgcatacgctgaatgtagtaaaacctagcatgataaacaattcacgtgcaaaaagctaaagtgtttctgaaatttctcatcttacaaaagaaaaaaaaattatagggaggaaagtactctctagaattaccactttttttagctcagtaattttctgattgatctacaaacgtgttagcgtacgaacgctggatacacctgtcaggtaggtggcagctttgtcgcgtagaccaggctcatggaccgcgttacccgatctcctctctttaaatattttttttctcttaaattacttatccgatctacgaaccgatcacaccgatgtattcgttgcaattaaatctttacaacaagatatcatataattatattatatcaaaagaaaaacatgtgtttcacaccgttaaaactaaatgtttcatacgtgatagtgatatgtttcaatatgcgtcttatgtgtgtttcacaaaattcttgaaaccacctgctactactctctctcctctctctctctccaccttatccatgcatacatgtatgtatttcagcaagcttcaaaatgatttttctcttaaattacttatccaatctacgattcgatcacacgttgtattcgttgtaattaaatctttacaacaagatatcacatgattatattttgataaaagaaacgattcgatcacacgttgtattcgttgtaattaaatctttacaacaagatatcgcatgattatattttgataaaagaaaaatatatgtttcaatccgttaatacttgttgtttcatatgtgacaacgacatgtttcaacgtgtattttcaccatgtttcataaaatatttaaatgtttcagttgctgatttttcttgtttcaccatatataacttaatgtttcacttgttggtcaactgttgaccgtccgatttttttaaggacatcggacgtccgatgggtagattcctccgaagaggaggaatcaatctgcacaaatcaagggaaacaactccgaatcaagctcggccttcctacaagcagtcatggacatgaatcagtcatcaaagggaatagaaccattttggtttgctgcttgcgcttacacactgtggaaatctcacaacaacaatttgacaacctacaatgcatcacgcagcaaatttcagacaccctaaaactttagagcctgagaaccaatgaaacaaacagacaaaaaatagcctggtgtgcaaggctttcctagagaaaagcctcatgtatactcccttgtaaatccgccaccctagtctccttttcttttttgttttctttctttttctcctttttctctcctctctttgtatctcttctatctgctttctgcttccagttaactctaacctttaacttgtaacctataaacctcatttcttttaacgaaatgactataaggtagagctctacctccttacgtcaaaaaagtcaagggcaaaaagaatgtctttacttatctgcttttggctgacaccgattctaatttcacacgggacacggccgcatgtagcgcaacgaaccaggtccggcaacatccagatgcagaccgacgcactgcatcgttcatacatccacacgccaacgcgtcttcgcctcaattgtccgcctgccacagcctccagactccagtgcaccaacactgcgatccaatctgctccaacgtgacacgtctggcttccatagtgctgcatccatcttcatctgcagctggtaatgctggtacacttggagtaatataccagtacacaattatatagtttactcagctgcagctagtatacatgcatatttccatgctaaatcaaatactaatgcaactcaatagtttgcaaatacgatcacgagtcactgcacatatacatctaactagttctcaaacaaatcactccatgaatcataacaacttatctaaataatttgtcctgctcaaataatgaaactaactcttagccaaattatggtacaaacacagtggatcccatatttactctttctttacttcttcctccctcatctcccccttcccacctgacggttttaggtggcgtcaaagacgatgacgatgaaacccacatcgagaatggcggcatggccgatgatgatgaggcagccgaggggaggtaggaattggtgcgggacaaccgaggggatatgaggtgtcgtgcatccccgcctcctccctttgaacttatgggtggcagccaccactggcaaccggagagcagggaactgaggtttgacgtgggcaggtggcggcaacggaactactacccccaacgatggcctacggctgttgtagatcaagacggcgacgacggcatatgagacttgatgatgcagatctacttatcaaaagtacattgttctttacttgcggatcagaatataaggtgaactcgtttctctctaagtctatgcgtgaaatatatgagaatttgatgctacataatattttgcacttcattactttcagacatgagagatttggaccattggctggcataaacaacatgggggtccagccggaggtgacgagtgtagcagcgcacatgtggaagatcggatgctattatgttcatgaagttcatggcgaattccgcattgatgagaaggctttcaacatgaatggcttatatattaggaaaggttatcaagtctactttccatcgaatcaaacggcatgtcattccgagctttctaccaacggcaattgcaagttgaagacatcctgtgcgggcagaccgggtgtcgcgcaagtaacaacaatggtgatgagcgtcggctttgcacggcatggttggatggagttatactatcctatggcccatcttgggttgggaaggagtctatctattatttctccacggattgaagccttccaaaaccatcagtttcaagataagaaagaaaagattcagttcggactcggtttgggccagcttggacatacatggactaaaacgcttgtttctctctcgttcgtagtccgttttggacgtgtgagcactcgttggaaagctaacttcatggcccaggtggtggatagggctcaggacacaaatttgttctggttccaccgcaagagccgaaacaaattgacggtgctgcagagaagtttccatattgtgttgtatttgattcttagttagtttctaacccatgtaatggctatatatacctttgtgcacgacccatgagggggaccacgtttattctaatgaaaattgcatcaaatttgctcttgttcttctcctaggttttgtgccgccgccgccaaactagagagagggattgggagttttgccatagattgttcttgcttttccttgtagggaaatgagggggcaatagatccacttttgcgtggtcaagtggatcaacctatcaaagcgtgtggttttgcgaattcgtggtgaaaggtgcgttgcacgggcagcgtgttgttcatcctgttcgtgaggtttcacggtttatccggatcctacgtcgagaaggtcgggcttttccccatatcatcttggtatcagagcacggttgtctcggtaggatcttttaccctagctacatattttatttctgtcctatacacaaaaaccctaaaaaaaatagcccatagtttgcaatatggttctagtgtttttttttgttaggttttaatccattagacttgtttggttgctgatcttagtgttccttcgtgttacacttgagcctatatcaatttatcttgtttgctagattttgtttcttgtcgcgttctgaattttcagtgcatatttcgttcagtaaaatagtcatcaaagttgcatagagggtcggaaatcagtgtttaaatacttgttggaaagagcacgtggtgtcctacaaatcattatctctggtcgacatattcattcggccattatctgcgtgtttcggacacaacaaagttagtggttgttctgagttttgtttgagtctatttcagtttgtgtgctagtccatatatcaataatacaaaaaaaaaatagtgagcctattctatcctttgcaaatacttttgaacccattgagactagctgtaggaagttgctcttgggctttgcacggttgtatttttacagtcatacccatattgttcaatccggtgtgctgatcgtagtggcaaaaaaaaaggaagtataagagttcaaaaaaaagagaaagcaaaaaaaaaaaaaaacaagaaggattacaaaaaaaaagagagaagtgctgcggtcaccacatctattgtttatttcagaagttagtctttatttgttttgtgcaaatctggtagcccaattcagattttgagcaatcagctagcgtctctccttgtacttttgcaacacgagcttttgatttcatatccattttgtgttagctctcttcttggttgcataggtcccattatcgttgcgtgtgagtgctgtacacttcatttatatctttggtgacgggaaaaccgggacggtcgtaatagtaggtccgttatccgcaaatcgttagagacaatttaatttaaatgcaacaaataaataaaaatcagaaattgcgagtccattacttccaaaattcatacatttacatagaaattctgttaattacatctccgtagagaaaacccctgattagaaattccaacatgaaagaaaataaaattacatgactgctaaaaggctaaaaagaaaaatatatcctaaagctccagatgtcgcagccgtagaatcttctgtagatttccgtttatatgtttatttcattttgggcatattttagatgcccactaatttgttggtttttaatatcactgcgtatatggtagcaaatttatacatagcttccttttttttggcattgcgactttatttttttatacgtagcgcacatatagaaattgctgaattttcttgagcactcgcggggcatagccaggcaagtatttgctttagcgccaatattatcgacgcggcatgggattttggtacggtgaatttgtgtcacgcccggaatttctatccaaaattccaaacgcttacatgtgtgttaaaccctcgtccaggaatcaaccgaggcacacaatgacaatttgataatagagtacaaataaataactatttaatactcgcaaataaaaattattacagaggtagatagttcctctcaaagaataacattctacgcagcggaaatataaaacgataacaaactacggaacagctatggcgactccactccacaggcatcttaaccaagaacaagcctaatcctccagatcatcaccttcactgagatactcctcttctggtgaatgaatattgcaagaatgagcatatgacatactcaacaagtcacacagcaaatatgcaagtgcacgggataacaaaggatggcataatatagctcatttgcagaaacagcatttaataaatatttaagagaatagtaaaaacagttgaataattaatcaatattaaataaacaccatacaacatacccatgttgcataggcccaacctcatttgaacaaccaaccccagttgaacaaattaaacctccaaaccaggaattatccattccaaaccaggagtcaaattaattatcacattattaacattaatgagtagtgtgagactaatcacgaaaaacattgctcaactcacccataatcgcgggtacggctattcgaatagtttaaactctgatcagaggtgtaccactgtacccacaagacacaaccccacatcatgtcaccatgtgcctcaataccaccacggtacctcggaaaggagttgtgacaataccccttgcacaacataacccattacagcgcacctttcctggatcataatcacccccttataaacaaggcatggactccccagcgacccccgtggacttctcgccacttctcagtctggcgcactataatgaatcacgctatacaaaagataaagccgttgcccacgctggcttgtggttggcacgataaatgtttcacaacagtagctcgcgaaccggtccttaattgtcatgagcacaaccatcaaaaccgtatgctcacaacccaccttaaccaggttttaattatcaattaattaacatcacacgatcaaccatcgtgagctaccatttaatataaccatcaataataataataataacatagtttataattaaaccctttagttagctaatgtttctaagcatggctaagcaaacttacatagagcatttagctgaaccaatccaatacataaggttcatgctatcaaattataacccataggaaaataaagtcatcttcggccaataattaactgggaaaggttcaccacccgatgacattcgaaaacaatgcatatttgaaataaaataatagctttaaacgggttcaacatgctcaaagggttgtttgggatctgtgtgacttgccttgggcttccgcaaacgcttcggaaccttcctcaaaggaaacgctctcctccggaacgtcggaaactaaagcaaataaacaaaatcaacaaaacagtacaaaaacaagcataaacagtacatgtggatatttttaacatgtagatctcgattttagaagaatttagcaacttgaaccacctaaaacggatctacggttatttagttatgattttccgaagttttaatctattagaaaattggaaaaaagaaagaaaaaagaagatgatgacgtcatgctgacgtcagcaatggccggctggctagggttagccaactcgccggagattggatggtcggccgcggatttggagggcatgtacacgtagaggacgacgaggcgaacccaacggtactcaccacaacgacaaacgacgcacgacgacggccggcgacgagaaggcggtggcggcggttcggcttgcgcggcgacggcgagctacggcgaccggcggcaaagaaggacgggtggccgaggttcctctcaccacggcgcacctaacggcggcgacggcaagcggcggcgacggcggaggcggcggcgcggcgcggctgaagaccgccggcggcggcggcgacctaagtgcacgcggcgacgaggctacggtgcacgggagaggacgggagagggggcaaacgaaagagggcgacgaggtggtcctttatatagcattggattgaagagatcgaactccaaacgagaggaatcgactcgggaaaaatccaaactcggttttagggataaaatcaaaacgaactcgattcggataaaatactcaacgaattgctccgtttcttgaggggaaagatagaggagaacgagaggatcaaaacccctcaaaaacccggaggaatcggggtcggattggagcggatttgagaggagaaggaggcggctcggactcggttagggcggccggccggaggttgaagacgagtccgacatgtgggccccacatgtcggcggctggaggaggaggggcggcggctgagtgggttgggccggctcgcccgcgggagaggagggagtattgggccaaaatcggcccaataacctaaagaagaggtttttagaactttttcaataaaaataatttgtgaaatgatgtttcatttattaaaaatacttcccttgctcaaataattcccagaaaaatctagaaaatagaggagcaagtatagtatttaataaaattttatctagctcatttttatgttgaaaattttcctagaaaattagggtttagcttgtaggcttttaaaataatttctaaaaaatgatttaaaacatgcatttttaatttaatcgattttttttagagtgtgacaaacctacccccttaaacggaatgtcgtcctcgagattcagaagaactggcgaacagatgaggatgagctgatttcaattcatcttctcgctcccaagtggcttcttcttctgaatgattgctccactgaaccttgcagaaccgtataacgcgattcctggtattcctctcgcttacttccaaaatactgactggcttctcaacataagttaaatcttcctgaagctctatacgatcaggatctgcttcctccgtaggtacacgtaaacacttcttcaactgagatacgtggaacacgtcatgtattcctgccattgacggaggcaactctaactgataagctacttcacctcttcgactcagaatcttaaaaggtcccacaaaacgcggtgccaatttccctttggtttggaaacgatgaacacctcgtaacgacgtaacccgaaggtatacataatctccttcttcaaaagccaaatccctgcgacgattgtcggcatagctcttctgtcgtgactgagcaacgcgcaacctttcttggataatcttcactttttcttccgcctctcgcaatatgtctgtcccaaaaacttgacgttcaccggtttgatcccaaaggagcggcgtacggcactttcgaccatataatgcttcatacggagccatttgcaaactagcttgataactattgttatatgagaattccgcgtacggcaaattcttatcccaacttccaccaaaatctagaacacaggctctcaacatatcttctaaaatttggtttactctttccgtctgtccatctgtttgagggtgataagcggtactgaaattcaaacgggtacccatctctaactgtaacttctgccaaaacttcgaagtaaactggctacctctatctgacactatcttcttaggaacaccatgcaaacataccactctggccatgtataactctgcaagcttattccccgtataggttgttttgaccggtatgaagtgagcgacttttgtcaacctatcaaccactacccatatagaatcatgtcctgccgacggtctgggtagaccggttataaaatccattcctatttcttcccacttccactgtggaatcttcaacggttgtaacaaaccggctggcttctgatgttctgccttgactcgctgacatacatcacatagagccacatattctgctatctcacgtcgcatactggcccaccagaattgttgctttaagtcttgatacatcttagtgcttccagggtgaatggaatacaaagtttcatgtgcttctctcatgatagtatccttcaacttcttattttctgggacgcaaattctttctcctaaccacacagttccgtgctcatcttctacataaccgatggcttttcctcttctcatgttcttctttatttcttggatatcaggatcattcacttgagcttctctgacttgatcaaacagagtaggtttagcttctaaagcggccacaaaacctttgctgactattcccaagttcaacttttcaaattcctggcataactcccaaggtaaacgtcgaccttctgacatattacagtagcttttcctgctaagagcatcggctacaacatttgctttccccgggtgatagtggatttccatatcataatctttaatcaactctaaccatcttcgctgtcgcatgttcaaatcaggttgagtgaaaatgtacttcaaacttttatgatccgtatatatctctgtacggttaccgaaaagataatgacgccaaatcttcaatgcatgcaccacagctgccaactctaggtcatgcgttgggtagttattctcatgaggacgtaattgcctagatgcataagcaaccacctttccttcttgcatcagcacacaacccaaaccgagtcgggatgcatcacaatacacttggaaacctttcctcgaatcaggcaaaattaatacaggcgcagtcactagccttttcttcagttcttggaaacttcgttcacaatcctctgtccacttgtacttcacttccttctgaagcagacgagtcattggtctggcgatctttgaaaagttctcaataaacctgcggtaataccctgcaagtccaaggaaactacgaatttctgaaaccgtcttgggttgcttccaacttaacactgactccacattgcttggatctactgccactcctccagacgagatgacatgaccaagaaacttcacttcggacaaccaaaattcacatttactgaacttagcataaagctgatgctcacgtagtttctctaaagctagacgaagatgctcttcatgttcttccttcgtcttagagtatataagaatgtcatcaataaacaccacgacaaacttatccagatattccataaacaccttgttcatcagattcatgaaaaaggctggggcattagtgagtccaaatgacataacggtacattcgaacaaaccataccgagttgtgaaggcggtatttggtatatcttcctcacgaattcgaagttgatgatatccagaacggagatctatcttagagaaaactgtagcaccttccaattgatcaaacaggtcatcaattctgggtagaggatacttattcttgatagtaacctcattcaacgctcgataatctacgcacattctctgagtatgatctttcttctccacaaagatgactggtgctccccatggcgaagtactgggtctgatgtatcctttctgaagcaaatcatccacctgtctcttcacctcagctaactcgttagctgccattctgtatggtctcttatggatagggttggttccaggtaccaagtctatccgaaactctatgtctctcttaggtggcatacctggcaaatcctcgggaaacacgtctgggtagtcttgtactatggggatctcttgtagagcaacttggtttaagaccgcaccatgagatttaggagaggacacaaagaaagaaacggtctccccattgctattggttaaagtcaccttacggttggcacaatctataactcctctgtgacgagatagccagtccatccctaagataacatctagatctttggattctagcaagataagcgaggatgggaaatgaacttcttctatttctatagtaacggaaggacaatactgagtcgaaaatacttgattgcctggggtattaactagtaaaggtctcccaagactaataacttccatcccatgattgctcgcaaaacttttagacaaaaaggaatgtgtagcaccggaatcaaaaagcacagttgcgggtatagagttaacaggaaacgtacccaaaaccacatctggtgcattctgagcttctgctgctgcaacatgattaacacgtgcctttggtgctggagcattggagttgttcggggctggagcgttcttcacgcgccgaggcttaggacacttatcagcataatgtcctggatcaccacaattgaaacacacccctggcttgcttccctgttccttcctgacgggctggttctgaactggagttgctgcaggacgagcaaccacgttgcggttgtcattaccacgattaccagtattgttgttgtagaactggcgttggggacggacaactgatgaagatcctccttgagggtacgatggagcttgaggtccagtaacgagacgcggcctctggttactgccctgttgtgccttgaattgggtagccctgcgcttcttctgctccatccggttatacttgtcttcctgacgaatcgccttgtccaccagctgctggaaatcccggaaatccgtagacatcanagcataggacaactcatcattcagtccctccaaaaacttctcctgacgctctttcatcgtgcgaacatctttccgagcataacgagctaaacggttgaaatcatgggaggtactcgtaaccgaacgagatccctggttgagtgctctaaattctctcttctttagagccacaacacctgctggtatatgcgtctttttgaaaacggccgtgaattcctgccacgtaataggctctccttcagccctgccttggcgaaaatgatcccaccattcagcagcaggtccatgcagttgatgcgcagcaaaagaaactttttcctgctcagtacactggatcaaatccaacttcttctccaccgcatgtagccaatctcctgcttctactggattggtagtgctggaaaaggtagggggtctcacacgtaagaaatctgccagcttgttttggggaggtgggggtggattctggttctgattgtttgcctgctgattctgtgcctgctgcactatcagattgatcagttgtgtttgttgggccagaatctgagctggcgtgggatctcctccattgttagtagctccacttccacttccacttccacttccagtgccagtgcgcgtgttcaccatctgacgataagcagagacaacaggaaagaacgacagagagacacccttagaacggagttatttatttaatttaaattctatattgctcttaactgtgtatgattacatttaagttgcattaacactatctcaccaactatcttacactctgacaagcaaaagaactagactcatgctgttacatcccaccaatgatgtaagcaacaactaaaacccacacactcacaagcaaacttaaacaagcaatctaacacagcgaactacggcaacgatctaactaagcgactaattccgccttgcgtcggaacgaagcgatggatcttcttcctctggagtagctggctctctttcttcaggatcttcctcttcttcctcatcacttatgatgtcgatgacaggttcagcacgatcgggcacaacttcaccccttacgcgaatcttcgaagctaactggagacgaggtggcggacaggttctctttcttgcggtgaggcgaagcttgggtgttggcggcggcgtttctcctttaagttcagctaattccttctgtagacggtacaccttgctctccaacttgcaaatcttgcctcgattccagttttccctgtcatgagctgctttgtctcgctccacacttactgcatccatagcactaagcatatgcaccgcatgcatcagagtggcactctcttcaccatcaggacaggtataggttccatagtcttgtccatgaggcttgtgaggatgatactggaaagctgatgaatccaactcttcttcaaagcgttgacgcaactctccaatggccaccaaagctgcttcttgacaagcatggctgtacgatcttcctccagcttcgaacttaatggacggaaggtcttcacgatcactagccaacgtcacacgaacacgacacttctcctcgtcggggtcatgggaaatttggcgatactcgggagcaacttcatatcctacctcaaaagccatcaacctcagctccctgacgaatcctaacaccttgaacaaatttctcggtgaatggggcggcatctaaagaaacatagaagagaagaattaatgcacatttttaagttagctgtaccaactagacttaactgatttaggccaaaaaggaagaaaataaaaagaaaagacacatacaaagctattttttttctttttgaatttaacttttaaacagagacaaatcagtttgaacaagtgaataaaataaaaccaaaatacctaagacctactataagcacagtacaatgtcaccattaaaagggatgagtagtactagtgccaacatgattaaatcgataccataatagatgtacagtgccgactaatcaataagatttggtaaagagaaaaagaaacattctgagaagaacaacttttgcttttataagaaaagaaattgaattaaataattttttttgcataaccttgcatgtgctgccaacttaattaatttataagagaatagagaagagcagttctatttttttcaaaatattttgaaggctacttaaggtttaccatttggcttatcctaaggtcaaggtggctctgataccaacttgtcacgcccggaatttctatccaaaattccaaacgcttacatgtgtgttaaaccctcgtccaggaatcaaccgaggcacacaatgacaatttgataatagagtacaaataaataactatttaatactcgcaaataaaaattattacagaggtagatagttcctctcaaagaataacattctacgcagcggaaatataaaacgataacaaactacggaacagctatggcgactccactccacaggcatcttaaccaagaacaagcctaatcctccagatcatcaccttcactgagatactcctcttctggtgaatgaatattgcaagaatgagcatatgacatactcaacaagtcacacagcaaatatgcaagtgcacgggataacaaaggatggcataatatagcatatttgcagaaacagcatttaataaatatttaagagaatagtaaaaacagttgaataattaatcaatat

SEQ ID NO: 26937 - DNA, 17114 bp, Oryza sativa
  unsure (1)..(17114): unsure at all n locations
caaaagaatccattgacatgagtagaggaagatgaactgagagatttttcgacttgtacacaatggccgagcctaagaatgaaggaagagcatgaatcccaccttgaaacacctctgattcttccggcacagcagagcgaggaagcagaggctgacgagatggcgtaggagcagagcggcacggcagcgtatattgcctagcaacaagcagcgcttctgcaaagcatacgcacagcacctagcctctacgctaatctcccctggaacctctccccagcgaactcttctactccctgcttgccccactccctctatttatagaggaggatccctgccattttcaagcagccgcgcgcgcccttagcatttgaaaacatttgaatggagcatgcagatcaactgatcgtgagacaatgggttaactaactgattactacaggaagcttcctttatttggatgacatgtgggccctttcagttatttgctgagtgcatgcatggttagtggtcatcgtggggcaatgtattaactgtttgagtactgcaggaagcttcctttatttggatgacatgtgggcccttttcagtttattgggacgaacatgctgttatttgccgaatgcatgcatggttagtggtgatcgtggggcttgaccacgttttcctctgctttcactgacatgtgtctctttcttttggtttcaaactggtggtggattctcttctgcatcatgcctgggctatttttttaatccatggaaaacaatcatttttggattccttgatatctctgtttaattgggcatcacaatttatttatttatttactttaatacacgctttgggtatgagttctttttaaagagacacgcgtatatattttagtcactatttttatcgagcgggctgttactgccgtaaatttattttttgcgacacgcgtcgcgtcctgacgcgcatattatcacggtggcttcgcatattatcacggtggcttcctccagcccacgtctagctatcgagataaaaatgctggactaatggcgaacgcgaccctctttagtttggcatgcgcgtgtatatgtatccacgccattatagcggcgtggacgtggcatgcatttttattttaagtcgcgactatttggggcacgatttttcactagccagataaacatctattttggtttacattttaatttttgtatgctattttatatcgtgggcacgccttttctgaaaatattcggggcgtgacaatttcgggtcagtgagaaaatcccacttcatggccatatgtttcaggccaaatttcgtatgcggatacaacgagaaagctaagtattagcgttcgccggtccgacgaaaagcgcatggaaaatatttgttcacgctacttatgtggaacgcgcatatgtattcctattttaagccaaaaattatttttgtccaatataagtgaattacattttatttcatggccatttatttcgtggccgctatttaattaaattacttcaccatctgtctcccgataaaattcttattatatatattttgtacgcactatatttgagataatacattagtttataatttaacaaattatatttaggacacgagccaaaatctgtgtaaacaatcttgtgatcagcaactaggcattttgttctagcttggattattacttaacgagaaaatatcttgaattcagaattgctaggacaaacacttagccctccaagctccacatatttactacctgtgcaattgctcctaaactatgaattcgcttaaccatcaccttttaagttgtctaccactagcagggtgtgatcaaccccttactctaaaaggaagggtaagaactttcgattggtaagaagagtgaggttgagtgttttcaacatatatattccaccagcctatatatcttgtgttcttgtataactaataatggcaggaaatatgaagttgatgttgcacactagtggtatctttttggatgaggaagatggtagaagtaccaagttgtttcactcaagatgcaaggtgcagtccgcttcttgtgccttcacgattgatgatttgagcgcggtcaacttggtcagcattgagctcatggagaaattgaacctattcacatgttcacatccagatccatatctactagagtggacaagttgcaatctcagcattacaagaagagtaaaagtgccctttttattaggggaattttcagataatgttgagtgtgatgtggttccagtgcctatgtcatcatgtcatatattattgggatggcaatggatgaagagtcatcagcttgaatctgattttagcacaaattcttattctttgctacataagggaagacatatgatacttcgcccgatgccttcaaccatgtttcttcttgatcgggagaaaaggaaacaaaggacattggaatatgtgctatccaagaagaaagagtatatagtcaagcatgggactttcccttcggctaatgtgacatgtagtgatgttgcggcagtgcatgcagcacaacagatcattgttgatggcaaatgcgccattgttggcccatggtcattgcatgatgagatgcgagaaaacccatgtgacaaagagagccacatagccaaattgagtgagagtgctgaaaagagtaagctatgtgattccactaaatgtgaggttgagtatatccaaaatattagtgtgagagatacaccagaagaaaagagagaagtagatgatagcccatgtgatgttctttccaaaattaacgcattaatctctactcctagtgttgtttctcacaatgtgtaggtggacgaaaaagagaacaagcttgatgttacacaaccagcaccttttcaagagcaagtgcctcctacaacacgtacatcttccatcgagaactttaacgataaatatgaacatattgacatgctattgcagcaaaacatggtgagtaaaggtgaatgtacaagtgatgcaactaatccatgcttgttttgttgtgataaattcaatgtcccacgttctgaattttatttgcttaatttacatgatgtggaattgataaatcataaagaagtgcttgctcgaataccccttgttgattctttgtatgaaagcatcttgagaaaacctgttcatatgacttgcttggttgtgaaagtttgtcgacttttgtgtttcatatcactagtttgtaaattatcatgttcctatactattaatctgattggtgattatgaaatagacaacagcgtttacgtgcatggtctacgcatgaattgtgacatgctttctgatttgttattgtacataagtgattgtgtatctgttatgaaaagttttgtatttctagacatgaaagagcatggtagtacatgttgttggaatcaaaacccagtacatgctttttcgtgttcttttgcaacaacacgatttcaaaatcggagcagcgtagctgaagaatggaagaatgtatgtatgttttcaccaaatttcaatacattcatgtcatttgcttcttgtgttatcttgcaaaagtcgggggcgacttttcttcaagggagggggaatgatatgagcaggtacgatgtaaataattggaaactaatttgtgcaaatgatacaatatacatgtatggctgctatgcttattgtatcgttggcaaacaagggaaccttcaatttcatggcatttgcatatatcatgcgtacacattattctctttgtttagcacaatttcagattaccaaaagccaaggacggcttttcttgaagaaagggaggatgatgcagatctacctatcaaaagtacattgttctttacttgcagatcagaacataaggtgaactcgtttctctctaagtctacgcgtgaaatatatgagaatttgatgctacataatattttgcacttgattactttcagacatgagagatttggaccattggctggcataaacaacatgggggtccagccggaggtgacgggtgtagcggcgcacatgtggaagatcggatgctattctattcgtgaagttcatggtgaattctgcattgatgagaaggctttcaacatgaatggcttatatattaagaaaggttatcaagtctactttccatcgaatcaaacggcatgtcattctgagctttctaccaacggcaattgcaagttgaagacatcctgtgcgggcagaccgggtgtcgcgcaagtaacaacaatagtgatgagcgtcggctttgcacggcatggttggatggagttatactatcctatggcccatcttgggttgggaaggagtccatctattattactccacggattgaagccttccaaaaccatgagtttcaagataagaaagaaaagattcagttcggactcggtttgggccagcctggacaaacatggactaaaacgcttgtttctctctcgtccgtagtccgttttggacgtgtgagcactcgttggaaagctaacttcatggcccaggtggtggatagggctcaggacacaaatttgttctggttccaccgcaagagccgaaacaaattgacggtgctgcagagaagtttccatattgtgttgtatttgattcttagttagtttctaacccatgtaatggctatatatacctttgtgcacgacccatgagggggaccacgtttattctaatgaaaattgcatcaaatttgctcttgttcttctcctaggttttgtgccgccgccgccaaactagagagagggattgggagttttgccatagattgttcttgcttttccttgcagggaattgagggggcaatagatccacttttgcgtggtcaagtggatcaacctatcaaagcgtgtggttttgcgaattcgtggtgaaaggtgcgttgcacgggcagcgtgttgttcatcctgttcgtgaggttcatggtttatccggatcctacgtcgagaaggtcgggcttttccccgtatcacgtgaggtgacctcgagacaacaacggcgctaggtgagagcacggccgggacggggctcactacagagctactgcttatcgcggctacgtggatggggaggcgaaggcactgcgtgcggtaggggaggcgtanacacatacgagagatgtgggttggagagagaccaatacatgagagagtgggagcgggaaggagatttgctgcatggggtgcaccattggccaaccaaatttggccaatgaccagggagtttggcctgccgaatgtcttagcaagccggttggaaaagattgttggagcactatttttgactagaatcgccaaaattttgctaggagaggttattggagatgctcttagagttgtgtacaactccaatgtttgaaataattgactaaggctccctttgattcgtaggataggaaaattacgagaacaaaaaaaatgtaggtattgaagtagtatgattctcgaatcctacaggaatccaaaatacaataattgataattggtgccctttgatagtgctttggaaaaaacaaaggaaagtttacaaggaggtcacacctcttgatgattttcctatgaaatgtgaagcatatgaatgcaatcctatggaaagcttccttccttttcctatgaatcaatgagacatgtaggaaaaaatcattaggaatttaaatcctatgaaaatcctttgccaattctatgaatcaaggggccctaagatttgacaatttagattattattattgccacatctatcattctaggaatatgcaagcttaaattatattcaccaaagagagaaactgactacatgtaacctgtaaataaagcagtgaatcgtacaatgtgaatcatactgtcacgcccggaaattcactagtaattttcgaacttatctgtgcataaaatcctcgtccaggaatcagccgaggtacacaaactgacaatttaatatacagattcatcaaattaactaaaacgataaatacttacttgagaggcacttagtcctcactaagaagaaaactgcagcggaaaataaaatctagcgaagctccggctccactcccacaggcagctcaactggggtataagccaaacgtcttctccttctgaatcctttttcttcaactgaggttgattgattattgcaagaatgagcatatgacatactcagcaagccacacagcaaatatgcaagtgcacaaggataccaaaggatggcataatataggctcatttgcaaaagcagcatttagcaaaacatttaagagaagtaaaacagtggagtaattaatcagaaattttaatcaacactgaacagcacacccatgctgcacaggcccaaccatcctgaacaaccatacccggctgtacagatctaactccaaaccaggagctaagcaaaattattaccaggtataacatctataattattgtgagagatgtgagactaatcacgaaaaacattgctcaacccgcccataaccgcgggcacggctattcgaatagttttactctggccagaggtgtaccactgtacccacaagacacagccccacaacatgtcaccatgtgcctcaataccaccacggtatctcggaaaggagctgtaacaataccccttgcataacacaatccaccgcagcgcaccattcctggatcataatcaccccctttataaaacaaggcatggactccccagtgacccccgtgggcttatctccgccacttctcagtctggtgctccgcaatgaatcatgttatacaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaagtaattaattaaccaatcacgattaaccatcgtgaactatcattaagccatcattaaataataatgagtcataagttatcccaataatgtgctaatgtttctaagcatggctaagcaatcatatctaatatctagctgaaccaatatatatagctcaactagtcaagttataataacccaaggtatcaaggaataaagtaatcaatgcaaacaggccataacaaaggaatagattcacaccacccagtgacattcgaaaataaatgcaaagttgaaataaatagagaatttaaatataggatcaacatgctcaaaggattgtgtttaggatctgtgtgacttgcctcgcaacaatcggtcttcaaataatcttcttgaatacttccggcgcactcacgaaccttcgcaacgacggaaacgacaagctaacacgcaaaatgaagaaaaagactaataaaaaccaaataaacaatacataaaaagtaaacaaacatgtagatcataattttagatgaattatgagacttgaacggcctcattctgacttcaaatgaatttattatgaattttactagattaaatctaattaaagcccatttaaaaagaattaaataaatttaattcaatttatggataattttaatatgtagatctttattttacacaacttttgcaacttgaaccacattaaactgagttacaatgaattagttatgaatttttaaagattaaatcggattaaaacacttatatggattttaattgaattatgacgcaataatgaattatttttgaaaaggaaaaggggattattgcgtcagcggctagggtttgcggtggaccgggcgcacggcaacggttcacgggaacggacggctgagatcgatcctatccaaaacggacggccgagatcaaccggtccacggccggaccacaacgggcggcaatgatgacgtcagcgatgacgtcaccaccggcggcggctcggcaacgcatgctcgccggcgaacgacggcgcgacgatgcaaacggaggacaccaacgggtagagggcgacgcggcgaactcaccggtgaccaaagcaacggcggaggagcaacggacgacgtcagcgatgaggtcgaagcggcggagaagatcgggtcgacggtggcgacggtgctccggcggtcttcggcggcggtgaagcggtggacgaggacggcgacgcgacggcgaccacgacggcgacctccccgagcgacggcgacgactggagcgacggcggcgcacggctggagcagcggcgacgatggcggcgcgaagttacacggcgctagggcgcttccaacggcgagagacgaaggcgagggtggcgacgggtagcggcggacttggggatccttttataggggctagggcgtggcggcgaaggcccacggcgaccggcgacggaaaggaaacatcggggtttggaggaaagagaccgatccgattcgacctcgaatccacgaacttccaaagcgaaaaagacgatgattccataagagaaaaggaagaggagatcgagaagatcatttcccctctattgatttcaccggatcaggaaaggagcgagcaaaaaggaaagcggcggcgcacggctcggctagggtttcggccgggcgacggcgcgaggttgacgacgggcctgacaagtgggacccacctgtcagcgactgagagagagagaagagagcggcggctcggctacgggccggctgcgactgcggactgggccgacttgggccgagggagagagagaaggttttgggccgactttcggcccaaagccaaaagagacttttaaaaacctttttcaatttaaattattcatgaaatgcaattccatttattaaaaatacttccttggctcaaataaatcccagaaaaatctaggaactatagaatcaagtaaagtatttaatgaaattttatctggccccattttatattgaaatttattaattaaaattagatcttctcttctaggcttttaaaatcatttctaataattccaattaaacaaccatttataaattaaggattttttttacataagaaaagctcttaacaattataattagattattaatggattaactaattactgaactgttctttgtatcatttaggaattgagctctgaaaaatccgagaaaatttcagagagttgacttaatcatggagaatttaataaaaattaaatccatccatgctttatatttagaaaattttatttcccacatttaacttcacttgtaaattaaagatcatttaatataaattctaataataatttattaaataatttataaatcctgaaacaaaaatcaggatgtgacacatacaatgtgaaacaagtcgcacagtggcacatgcgcccttggacaatcaacattgggcgacagatgtcaagggagctctaactgtgcaagtgatcatcgagtatctacaggtgtgggagatggtggatggagtgattctacatgatggcacccccgatcagtttcggtggaagctcttcaagacagaatcatagacctgtaagtcagcttacgagtccttttttgtcgggacattccgatttgctccttggagaataatttggaagagctgggcacctttgaagtgcaagttcttcgtgtgtttggcaattgacaatcgatgttggatggcggattgtcttgacaaacgggaggtgtctcaccccgccgtctgtccgttgtgtgattaagctgaggaatctattcaacacattcttgttaattgtgtctactcctagcaggtttggtctctaattcttcaaaggatagggctgatcttcatctcaccaagccaagataccatccgcttctcgagttggtgggtcaaggctattagaggtttggataaggatagaaaaaaggtctcaaatctctcattatcatggtggcttgggagatttggaatcataggaatgcatgtgtgtttaatgaggctagtcctagtgttatgactgtaattcaaactatggcaaatgagtgtaatctttggtgtttggccggccggagccactaagcttggcgagttccttagaaggtcgattatcccagttgggtaattttgggttgtgtgagccttttttgttttgtaagtagcgtcttttaagtgtttttggggagaatggtgttttagtcttttccccatttttatacctttttaatgaaattatatgcatactcatgcatattaaaaaaacattgcggatattattatttatcgcttgcatttttgctttagtttactctcggtctgtttttatcaagaacttgaaactaatatgaaacaaaagtccctgaattttctggaggggacataattgacttgtatcttgccattcaggttttgtagagccattgattaggaatgtataattgaaatacaccgaaacaagattctcagctcaatttctagttaagttgtagtttcaaattaaaacaacaaaagcctagcataaaattagaatttgtgtaatcggttggtaccaaaccagacaaatgaacgttgtaccgagcactctctgaccactgatgtctgatgctactctgctcatgctccatgtggttcagtgaaggcaccttgtgctagcactccgtggaactccagtgacttttgaaccgaaattcctgtagcctcgcattccaagtatctctaacccattttgtttcatcaaaatttaacaaaacaaaggaaaaaaaagaataaagtttccttgacaatcctgctaaaatcttaattgcatatgcttagctgtcaagtttcttttcaataatggaatcgatccaagctctagatcaaacatttgctatttgccctcacactgagaaaccaagggcctgtttggcacagctccagctccagctccacccctcctggagctggagctcagccaaacagtttcagctccaccaaaactgggagtggagttgggtggagctctctcacaaaatgtactagagttgtggagctgggtttaagcagctccacaactccactccagactcaactcctggagttatatataggagttggagctgtaccaaacaggccccaactatttatcagcaaaaggggaaaaattgtgagtcatgtacagcaacaactaacaactcaacttcacttgctatgaatttagagctaacatgtacaaaggacatttctgatggatgcagaatggcacatggagtaacttatgtttctcaccaacacaaaagctggaaagatcatcatcctcttttgcttcagttcagggtggaattttggggtgtaacaagtccatttaaataagcatgttgtttggtgagaaactgtgcacagcagagaacctgaagaatggaaaatgctcacctcagcccagcttctgcaagtttaagttatggaagaacaaggccaagcacaatagttgagaggtttcttatgtacccgagttagatgcggtaatgccactgccaattcgttgcgcggaagccgcgccatcgcaccatccaactccccacacaggtggcgcggtggcgcgtcggcggccgtccaatgcggcgtgcaaggcgaggcgccaccatccaactccccacacgaatggcgtggtggcgcctcaccttgcattccgcattggatggctgccgaccttgctcttcccttgcacctctgatggccgtagagctagatagcccttgtcctaatcgagatgcacccctagccacccaccgcccttccactgctcctcacccccgccgcgctgcatcatatcggattggaggcctgtcaacaccgccttatatcataaccctttattgactaacgcgagtaccgactacgcttgcgtccactcgggcctttcacccccctacatctagcatgtacggcaaatggcgggtcgaaatcaccctccctcatcctttgcgagagggcgattccgaccatgcaagttcaattggcttttccggaacttcatgttcaaattaaggtagtaggctcatgtgaaatctatcctattgctagtgggatacatcaacgagactacgagagcagagttatcaaagttggtaattagggatgagaagtgctatagcacgctacacgcattgtttaactacaacatgtgcctctctcttcgttcctccatatgacattttttcttattattcaccggattattaattatttttatattattcaccggattattgaaacaaattacttactacatgcttcacaaattacattttgttaaaaaaaatctactatattacttaaccatttgttttaagttatttgttaagtttatttataaaaaaaatatttatccttagataccgcgtcttattgcctaatcttaccaaataattgcttttcaattttagttcgcctacaattaggcttccagcatatatttctctccaacagttattttgtaacatatctctactgttataaaaattgaagatgtttttgcctgtacttactttggtacgtcatctgtgtatgagtcggtttttaatttcgtttgcctttagaaatacatatccgtatttgagtcggtttttaaattcattcatttttggaaatacagaaaggactcctaattgcatctcgtgattttgtaaaaaaaaatatccaaatgaatttctacagtgaatttcatcttagctaaaccgtacaatagtaataagattaaaatagccttcaactgttgcaacgcacgggcattttttttctagtatatttaatttatgagttggtccatgtgttttgactaaaaaacagaaaacatatgagcatctgatttaatgttgggttttatgacttaatagaaataatgtagtttttgataattctccatctaaattttatatgcagttagtcttcaaactaacatattggtttcggttttgggtccaactacaaaagtgtgaagaggataaggaattcttttgtgttgcatgctattagttagagacaacgatcatgcaaattttcatcaattttggatagaaatttactaatataattgctatttgaataaattatatctctccctcatgttggaggtggctttttaatgtgtcatcaatttattctttgttatatacttttattcttagttttaagccatgaactttgtaataagtggttatagcttctacagaagcaaaggtttaatttaattcataatattaaaaaaatggtttcaatttcccttgagttgagagcaaggaatgtgtgtcgcgatattttcctaataaaagagaatcctgttctgcaaacccaacaacgctttttctaccgaaaatcatatctcgaagtgacatttcggtctaaactagacaaactatgttttctttttaggactctgtcatatgttctcacgtcagtctccctttgagaccgaatcgttatttccaccataccagtccatcttttttgtttcctagtcattgtgcaaaattctttagaaaaaaacatttcagggttggattcgagttccgtttgtaacaaggggctcaaacttttataaaaatatttgtcccacgtctccttagtacaatctagtgtacaacctagtaccaatgatccacatgctctacaaacattgttgtcgggtacaacccttcgacagtttccatatttttggaacccacaatgataaaggagtatatttaacgcatgaagtttattatgactaattatgctatctcaagtttgtcttgttgtgattcaaagaaacaattggtcctaaagaagcagagcgactagagcaagatgacatgcaaagaagcggagcgactagagtgagatggcatgcaagagaatgatttcaatgtagcatctacatcattttgttgtgcatcctcattaccaggtatatacgtttcgttggaggttaattctatttgctagagaactaatgatattacatgataaaagtttgttgcgcttcttttcatatgtacacttctatgggcaagatcatacactaagcggagagtaatggctatgatggatacaacaatttctcatcacatcataggtaaagccattgttacttttctaggtaaagccgtgatcggttagatgacgtttttctcgttactgaaccccgaaacttatctcatgcattccaattcctatttgcaatattgcattgcttttatcttgttcttactagttttttacatttgtttcaggaatatggttgatctttcttgacaagaccaacaacccacgaagaggtgtatcgatcgctgttgatatttcttaacgatattactagaaatatattttccagcaatgacgtagaaatattcatggtatatttatggtcacagatttgatccacaagcgcacggatataccattatagcatttcacccgggagtattccaatgtatcgtatttatttaatcccaagggaagatatgataaaagagtactatgctaatagtttatatattacttatatacatcaaggtctatccaggggttaagtaattcaaagggtatgtgcaacacagaagaaagaaatatgatactctcacaaaaatataatatatgctaagtggaggaagaataagaaaagaaatcattcctatacttctaatatacaaacatctttagtttacacttgttagtatacaattatgcaaccaataccccctaacagtgccctcctggtgttttgagagaccacctcggattgccgagttccttacgacaacctatcatggccgtccaaccggggctaaatatggaggagtaccctccctaggaaagtgtctaggaatatatactatcgtggaggaatacccatactgagctgtcaccatcagcagcccacctcgactgacctgtaccatatatgcccagatagtgatacttattaatctagacactaggtctacattattgaatactactctatatcccccgagatgacatagagccaccgagtaatcagacactaaacccacaccattgcacctcactggtaggctagctacacaactatattgatacaagtataaaatgaagttggtactcagataatataaatggaataaaataccgaagatgtataaagaggaatattctattaattcaattagtcttacaaaagaagagaggaaaggtactagagccatacctgaattctcctgaagatccgaggactaagaatactattctaattcctactccactaacactaggatactactaaacttgagagagggagagagctcttcttcttgagtgtgtgcaagagtgaaggatgagagctccttaaatagcctcccaatgacggttgtggtggttgaaatggtcagaaatgccctccaaccgtcattggggagtgatccacgccgtccagccaaagccctggatcgaagggcgctggggggggagggagggttcggccgaaccatgggccagcccaaccagcccacattttggctagtggcctcttcttcttctcttttcagacttgtgaattttgggcttattggatcgtgttaattttgaattctcggcccatccatccataagtctgattctcgacagcttccgattggttctttagttgttttactgttgattctcctccattttatgttgtaatctctgcaagaggttaattgccaagtacaagtggaaatagtttattctagaacaaatgtgcactgcaagcataactagttcttgagtgtgtgcaattcttttctagaacaaggagctctcatccttgtacttggcaattaaccgtcattgggaggctatttaaggagctctcatcctttattttagtaatattgacgggcgaaactggtctataacgaccgtcaacaatcgctatggctgttgacggttgttaagtaccaaattcgaccgtcaattatctcaaaaaaaataaagagaactcatatttcttacacgcatattcatttcaaataatgtagttccacttgtcattggagaataatgtgaatgcagggattatcaaccaaatgaaggtgaaaatgagctgacatgcgaagaaacacagttccgaccaattaggagagtgcacaaggatttaagggcccacaaatcaaaagcaaaactaacataattgaggctaatccaccatgcaccaactcaagggcctagacatcatgctcacaaagaaaggcggtggagaggttaccctggttcggccgaaccaggcttggtccctctcatctccaccttccacatggcaacccctcattggttccctatggcagttgtaggtgataactgtcattagtaaccatcattgggcagctataaaaggagaagaagctctccctttcaaaatacacacaagaagcaatctctctctcatttgtattactctctagattaatagagtttaggctaagagtagcttactattttgtttcctagtcctcttggagattcgagtatggctctagtgctcttttctctttgtaagacttctttatttatcggtgttcgtggttcatatactactttgtcaattatatgtttccttgatgtttttatacttatttcatatgctatatatgtttaggctagtcgatctatgccatggcatcgttttagtgattttaatgggtgagctagttcttacttttccatctgtagggtgggattttcgggggagctatatgcattatttagcaacgcaaacatggttcttgggttgattaaatgttgttggatgcgggtataccccacgggttatagagcttaggcagcacatggtgacaaccatgtccgtcctttgtaatactccatgttcgggtacgacgcaagaattggtaaaatgtcataaccacactggcagaccagtagggagcggtctctcggtagtgcctatatgcatagaacgaagtcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgcagga

SEQ ID NO: 26938 - DNA, 927 bp, Oryza sativa
ttaaaaaacggtggtagtacttgcttatggtttacataatgtctgatatttaatctgctcgctatatcctgataatactagaaagttcatgcagttttttaagtacatactcgatattctctgctatatatcttgccttctagaaaatatttttcaggaacaactgagcactcaagtaggttatggtcgagtgcaccccatcatcgagaacgctctcgacaaatgcttagttgtcacacgcaacctaccaacgaagaccgacgacctatcacataaatagcgacggctacggctgaactatttgggaataggttgttaatggataattcctcgcaaacgttgtcggcttgatcacccgacatgattgcgaacatacatccagatatgctataagttgggtatatgagtcatgctggccacatgagatgcacatgtaataaccaactctagcgcccctataggtgattaagagatgcctactcctagttattgaccagatagttgtagcgacatcccgccgcctatcaatttaaatcacttgtggaccgttgaactccatctatcactgtcgaaagctccatgtctctacggtcttacaccgggatcgaccaagtgagtacggcagatattgataaggggagtcgtggataacaagagatgctttcgtgaatacggtttgtttccgtatgcctatcagttgcctataggtggtcgagatacacctacacctggtcctcgaccagtagatcatacgatctctcactacctaaaaattcatcttcaggtgatcgagatacgcctactcctgatcttcgaccagtcggttacagcaatctcacgacacctaacgcgacaatcaacattgtcgtgatagcgacaaccaagaccgactagatcgccgttgtcgccaagacgacaacgtccagg

SEQ ID NO: 26939 - DNA, 3642 bp, Oryza sativa
tatgcgttcagtaagtcatttaaaatatttacagaagatgcctgtcataaatagttatggaaaaacaatactgcgaaaaagtcaaatgagtataactatcgttaatttctgtctaatcaccatcttgcagtaactttgtgtcagtcaacccgtaaggttacaggtcctaatctgtccaaacagacgagcttgagatataagcattaattttcagctggcttgcaaaatcgtgatgttcctttggtcgatgtaaattaaccttttctgtttcagtaaaaaaaaaaatcaccgtttatagcaaactgagccgtgctaattactgagttaagatataaatgtttgtttttagttcttcgatgatcagactagctacagtatcaccaagtagcataaaaacaaacatcagcacacccatatcttcgataatcagactacactatcaccaaattataatactagtataagaacaaacgtcacacccatatcagaagtgacgcgtataggaacacttggaaaagaacttgtttgataaatcgagggaagagaattaagagtttagatgagagaattggtgagattaatatgagaatttgattcttaattttattattttgtttggtagagatgatgcgaacaaattgagatagagacgggattttaagtgaaaatatatggttaagattttcttaggaaacttaaagaagtaattaatttcgtttcaactctcaccccctaccttactactattaaagagtatggagttcctttcttaattcttcatccttattctactataacttgtagctcctcaaactaaatagaataaccatcattccatactctcaatcccttctaaaaactaaaacttccgcaaccaaatggagcattgcatttaaacaaatagatgaaaatgagtgcatacgagaaactaattaagcacgaacagaagtcacatttcatgcatccaacacaaaaaaggtattactgagtcaggataaacatagatctcctagtcactcatataatctcaaacctctagaccagttatcctaatcaatcacttgaagtttctggtactcgtccccagcaattgcatcaagcatctcatcttccggctccaccaccccattgttctcaagaaacaatctcatcaactcatccgagtatccactaagtgtcatgactccatccttagttgcggttaagcctgcagagcgtggccccttaaggttccacagtacgatctgaggtaccacgtcctgaaagcctaccctcttgaattcttcgcacaccctccgatattcttcatgccacggacgcgacgacaatggattaaaatcttcatgttcaatcagctcaaccggacgcactgatgccttctcaaaaaacttgtctgtgaatatgaatatggtcttcaccatattgtccggggtaacaccactcgttactgcccttgtaattatcccctcaaacaccttctttaggttaaacctctcttcgcaaggcatctggcgaataaaattcaacttttcccgatagctgccaacaggaagcacaagagggaaatagtttgaagcgaaggcatgcaccgagttcgtccatggaggcgaactgagttcagagattaagaatccaagccccacacagatcttcaacaacttctggccttcacttttgaccagcccccccttgttgacgtcgcagaccgccatacaattgcacagagatcccttcccacggagatgatcgaccaaagtgcgccactgctgagcagcatcctcccttcgtttgatgttgctggcatgcgatgccaggccaagcgaggtaatgatgtcttgcagaaggggtggctggggcgccgccttctttgccttgtgcttggcggcctcgcggctatctttgtggtctttgagaaacgccgtgaagcgcccttcatcgtgcttcttgaacaagtgctcgtaaatcctcatggcctctgaggccacgcgctcgtaaggcagatcagaccattggtttttggacatataaatctcgggcagctccaggtccttacgcagcggcacgagaacctcgcggcggagacggcggcgcacaaggaagatgtaatgcttctctttcatgttggcgtagctagcgtctgattcgcgtggaaagagaccgcgagcgatggcctcacataacaatgtggattggtcgaaggacgagtctggtgagggacaacatttggcggtgagcccgatcttggacagcttgccggacttgtggtgctcgagatcggagcggaggttttgtccacaaagaaactggtgatggagttgaagaggagacgatagttgtcatcttcatggtatattttcatggccaacttggcgaggcgggccgccttgagcaccttcttgctggggctgcccttcaccggcgcctcccccacgacatcctctgtctccaggttgacggcgtcggcgagcaagtggtcgggctggggctggggctggggctggggctggacctggaccgcatcggtagacgccgcaggcgtagggtcgtcgtcgtcgtcgcgggcgcgcttccggccgctcagtctggcgaggtcgccccctcaggccttggacttggccttagcgaccttgcgtgcatcagcgccgtggatgatgcggtagagaagctcggggaagtccttgatgtagccgaactcggcgaacgcggagaggttgccggcgagcgtgcgtgggtggtattggtgcatccagagcgcggcggtgtagaatccctccctgtcgcccttgccgttgtcgcgcacgccgcggaggttgaagacgagcttgagcgcggtgagggcatcgtgctcccaggcggcggcgaggaggtcgcggaggtgctggggcggcgtgtccctgtcgacgagggcgaagaaactaaggcaggggttgccaaaggcgccactttgcaagtgctcgacgacctccgcgcctgcgacatgtcccgcggtggaggtggagcccgcttcggctgacgacgacgcattcccgacggggaggcccgcgacgggagggccaaggattaggtggtccccggcggcggaggacatagcgcgcagcggcgaggtggaggagggttttgggggtttcggcttgctctctccactctccatcacccgtgctctccaggaaagggaaggggtttccttgtccttggtttttctccgcctgcctgggtccgggttttggttttggttttggttttggggtttcggcttggtctctccgctctctctcccactctccacccccgtctccaggaaggaaacattgggttgggcgaggtgccaaagctacgtgtcactgttttactcgttgcagctggcctccatgccctgtccccatggaaacagtgaacccgcatcttctgacctgatatgtgtgtgttgattcggtccgttgcctattggtctgctctgtactctactctgcacagtgacgttgcagcctgcctggtccatggtgcaccgagcgtatatgctgctactagtcaaatttaaacccaaaaggcatctatattccattttgaaatcaaggcttgaacggagtagttcatatttaaacccaaaaggtatctacattttgggtgtgtttagttcacgct

SEQ ID NO: 26940 - DNA, 8493 bp, Oryza sativa
aacttttttgttttccattagcacgttttcgaaactgctaaacagtgtattcctatataagaactgttatttcttcgaaagatcaaataaacttacaaaagtaagtttataatggttttgtcttgttctctgtgtcacgaaattgtcattgccaaactctaaaacgaactcaacaacataaatgtattgcccggaatagcccgtatgtatcctttcgccacctacataatcttaaagagatcttctggaatgctttaaattaattagaacccttgatcaataatgatctaacggacagagagagaaggtactagaaaaaaggtattaaaggagtgggccaggtacgaaaggtgaaaggagtaattgattttcattaaattatttttcggtaaatggcaaaagcggtggacctcgtttccatgatcgccatggcggatggcgcgggaggaggtgttctgattagggccgcgtcaattgatttgagatctccggtgatcgatctggtcaatctatctgcaggattggattgttcgcttgatcgcttcatcactagttggtcagttggtgtcgtttttctttcgtatcctgtagctgtgatctcggctgcctgacagcctgaggcccttgtgcttctgaaacttctgattaatttgatgatccgaacctgagatgagattgactgccttgctgttagttcgatcattcaagatgttcgatcgattttgattgtctcatcaatgtgcatgatcgacctgctcgagtacccattaccctttgccttcctggtgaatggatttgtgcagtgtaaaaaattttgttcctaaattaccctttgaagattaacggtggataacacttcattaagaggtacctcaggtaccttccaagcactgtaaaagacctcttaattaaaagggtatacagcgagcggcatactcccggtgcaaataatactggccaattccggccaaattccgcttggtattgaccataatgaccagatttgacgtaatatttgttcatgtgtaatgtaagtgatatttatgtagaatttgctctagttgattggtcggggaataagccaaatgacatatttataaacaaaaataatttataaataaaaattttatatgcatgttcttaacgatcaaaaactaaaggctgaaaaataaacttcgataaaataaacccagaatgaactctaaatttaaggttgaaattttattatatctataaagtaatagaaaaaggagcctccacgttcgctctcacgacctagaaattctcacattaatccaaaaaataagaaaaaagaaaaatagaactagattaggattagttaaaaactgaagaaagaaaaaaaaggcatattatgaaactcgaatcggacaatctgtccaaaacaaaaaaaaaaggaaaacctaatctttctttttccttttagaaaaaaatcacgttttatgtgtgcaatgtccgattggacaatgaagaaaaaaattacctaagctggctacagtaaccgtgtacagcacaaatcacaagcgtgcatgtatgtgacaggtactatccaatattggctcactgtttatctctattctctccgttgcaacaaatcgaatctctgatgacgggttcagatgtgcagactcctgttgtagtggaaccgtatcctctgacattacacaataatgtcatggtgtgacattctttcaaaaatccacaccatccattctaaatcaacagtcatagattatttggcatgcaattaatcaaactaattagtggattgtgtagttataaattgtccctagatcaaatattgcattttcaagagacaaacatcgttgttgactggtggaagaatccgcaagttactagcacatgatgataattaggtatctccgtcagaacggcgcaattctgaatatacaagccgatgggttaatgtttaatgaagatgaggatactgctttagtgctaacaaaaaaaaattccttcccacctattaagtacacacctacataatctgttaattagtttgattagttagatagcaattaatatgtggccattgatttagaatggatggagcggattaaggaatgtcacactgtgacattactatataatgtcagaggatacggttcccctgttgtatttatccatatatctatattatcttaatgtaataggaaaaagggccaccatgttagctcccacttcctagaaactcccataatataatccataataattagagaaaaaaagagtccaaacagaaccacgtggtcaacaattcaatacatctaaaattcagaataaaaaaataaataaaaattagagaagagtctacgtagatgtacaatttagaaatatccgaaactcggattaaaatttaaaaataattaatattgagataaaagtacctttagaaatacaatttaggcaaaaaatagataatattaagagaataagtacctaaaatttggagagagaaaataaatattatgaaaaaaattgttcatgtatgagtattatataaaaatagtttgaagttggattagaactaaataatattctttccgtcccaaaatatatcaacttctagcctctataatttgtctcaaaataatataggtataaatataatttataaatacctataattaagattcaaaaaatattatagaaaatggatttttttaaaaaaaatagtaattgagagagtcattaagaatacaatttttagaaaagaaaaaaaatgagagttcaagtgaaaagtagaaaatacaattcaaactatgtgaaattcataagtaaaactaaataaaactaaaaaagagtccacatataaatacaggagcctccacgttcgctctcacagcctataaattctcatattactcggagaaaagaaaaaaatatagtctatctataaatacaatttgaaaaatagctgaaattcaggattaaaaaataagggatattggaagaggggactagagtccatatagttatacaatttagagataattgaaatttggaatgaaaaaaagttaaatatagagttaaagtccatatggaatacaataaagaaataactaaaacagagttagaactaaaaaaataagaaaattaaaagtagactttatagtccatatagaaatacaatttagaattacaaaaaatcaaaactaaaaataaacaagattggcagaagagactagggtccatataggcataaaaactagaaataataaaaaatcagaataaataaaaaaattagaaaattaaaagtagagattagagtccatatagaaatacaataaagaaataactaaaattcgaagttaaagataaaaaatattagaagaagagtctagagtctaaataggaatacaatttcgtggaattcaatttttttaagaaaagaatactaaaagaagagtcaaaagtccatatacaaatttagaactaactgaaagtcaaaaattaaaaaaaataatagtatatcttagagttcatatagaaatacaattaaaaaagaacgaaaattcaagataaaaaaagattgagagaagagtctagactctagagcacctattggaatacaatttagaaataattgaaggtcgtaattaaaaactaggagtattgaaagaagagtatagtgtccatacatgaatacaatttagaaataaccgaaatttgaaatttaaaaatgaggaatatggaaagaatagtttagaatcaatataaaaataattgtaattcgggatttgaaaataaagaatatggaaataacataactttcaaattaaaaaaaaggaatataggagaactttgaaactgaaaaaaaaaagaaatattggaagaggagtctagactactctagagtctatataggaatataatttagaaatactccctccaacctccatcccataatataaggcgtccacgcattttaacattccaccttcaaaacattttgaccaatatttagtacaatataaattgaattttacttgctaaaaattatatcattggattaacatttggatttactttcaaatggttataattttgttactacagaccttatagtatatgagaaattataagataaaaaatagttttagagaccgtgtcaagtttgatcatgccttatattatggtatagagggagtaactaaaataaggaattaaaaaataattataactatcacatatatacaatacaacatgaatactacacattggttagtttggtcaagttcatatagaatttaaaaattatgttgccatttttaatatattttaataataaaatgtgaaaatagatatgttaataagtgaaaaaatatataacggtactagccgtgcaatctgcgcgggccaccatactagtttaaattatgacagataagcataaatataagcgaaaatatgaggatgcgaagtgggagttaggtttagggtttgtatatggctaatgggccaagagaaaggggcacaagaatgaagagatgggctaaaattagctaatacaaaagtatcgggtcaggcatgggttatccgtgaaaaataataatatacgactattgcccgctatgttcttagatttcagacggacgtgtccgcgggtaaaatattacacccatacccagtgagcggaggcagcggccgggcaccacgggcaattgctcgggctccatgcgtacaacaacactgctccaatgcatatgcagcatattactcgttaatcatatacttaatcactttgtctcgtaggttataatggagattaatcagatgaataaacagaaaacgaggcagcaaggaccaaaccatcgaactgtagctaatccagttttaaattaaaggacgtgttttagataaacataatagttgtggggggttaaaatggactttatcgtttacaaatgatctgaatcaaactcgatgttaaaacgagggaccttattgcacataagaaccattttgtccgctgagccggggcaggtcgacctctccgtccccttcacccgcgggttcccgcgccgatctccatcatcgggagcggcggcgccgacggcgtccaccgcatactctcgcctctgaatctttgcgcccaagtcgatctacccgttccctcggcctcgactcccatctcctgcgagttcgtcgccgcctccgccgatctccatcaggcgagcagcggtgccgtcgtcgtgctgcttccgcctccgccctccggtgagcacacccgtaccgacgcacatcctatttctttctcatccctcgctttcgttgtaccgcaccttttctttttgccttatcttctcatcatttggacgctaggtttaggttgccccctcccccaactgaacccccatggccccgcccttggctggtacaaatttcaatagttgagctaagaaaatatttggagacacctatcaacattatcgttgtctatgcccgatacatctacggatctaccccttgtgaattggaggtctgaaaaagatattgcaaggaaacattgtgcttaattctaatgacattatggattttaaaatttgtatattttctggtaactgttttgagtcctgtccaacaaactcattgagtgaagagtatttactcttttatacttttgtaaagttgattttggatcttacaggaaagtcatcatcattgacataaaacctatatttgtgaccttttaattagtaaatccgtgttagttttatggtgctgcttttctgttctgatccacattttgcacctttttttcttttaaaaaaacttatgcttcagtgctgagaagatgcggagcggtcgttatgatctcagaagtaacttgaagagggatgaaaaaactgattttgtcatgacgtattcaaagaagcatagaataaaggaggacatagtttgcaatgaaggagagatagctgagtccttggtttcaggtttgctggtccttcctcttttctgcatgtctcttatatctcttgctgagcattcacggttgtgttgtatgtaactaggtgacttgccctgcgaatcgaatcaaggtgtcttctggagtgagctcagtggagaagttgcatctaatctgtccaaaagtgttgtttcacttgccctgcacgatggtgattatatgtgctgttatacccttcttacttttccaggcatatatataaacaccgctaattatgaatgatttaaatcacaatcttatgtaggaaacacaatgttatttgtatgctcgggcatagctgtacaccgtaatggacatgttataaaattgctgacctcagcaagcttgcttaaagcttttaatgacgcaagaaaagatcatgataacttgaaggttggtgctgctaatcatcctttactattttttcttcttacataaggtagttgactggttgtgatcattgcttactcttcacctgattcttcattataggttgaagtgcaccatgaagacactgttgtcatagggtttttgagagaatataatttagatcacaacatggctgctgtcattgtggagaacttacctgatcttcgtcctgtgcctttcaacaatgttcagaaatttgtaccgcatagcaaggtagtagctctaggccgtgatatctctggcaaattaatgaccacaagtggggtattgattggtgaatcatacaatggatatcttatgtcgtccacttgtaaattctctgaggtacaccttttcttttactactgtgaggtacacgcttgcattacaacaaaaatatttaatcccttttgttttatacctctgaggcaataagatgatgatttttcctacatatcttcttgttccatttcactttattttgtccaatgcaactagtattgcctgtaatcctgttctgtttggtgccaggtttatgaaggtgggccactttttgattttgatggggactttcttggcatgaacctttccttcactaccgagggaaccgtatttgtgccaggggatagagttcttgaccagcttgtgaattgtatactcgatcatgaggtcagatttgctgcgcggttagaggctttgaaggaagtctggtatgttttgcatattttgaatgggacacatatcctgctctctccctgccatacgtgatttaatgaatttagctgttctttatgccaaacagtttatgggactaggttttgctataatctggatagttgggtgttgttccttttgtaggttttctgacattgtagttcctctgcagttttcaatgtgttatgttcccataatgcaacatgattctctcccacctataccaagatgtttctctgtcctattggcacataacactacctccctgtactagattagtcacatgtttcaatgtttaatgatatttgtctaattttattagagaaaggaacattttgtccagatttagtggtcacactgctatgaattatgatgcctctagacactggaggttttatataacatttgttcaattctcttgctttcttgaaatatttatatccataatactccaggtcctcttttatctatattgtttgttcctacaattatattcatgctggtgttgcatataaattgtgctggacctggtttgataaattttacttttggctactcatgttgatatttttctgcagggttggagaaagtcccagcggtgagatgcctagctctcatcaaggtgagcacagtgatactttaggcttctagtattttggtatatgcaattcatcgttatttctaatattctgtatttgtacataaatggtgtaaattttaggttttacacttacactcttgtgataactatcgatgggcttagctttttacggttgtcatggagttagcgacaatcagttaatactgttaccctatgctcatgggtattgttaagcagaatcaatatattgtggtttgcaactcgggttatcatcatatattgatcgtctgtacttatattatgtgtggaattttagttgaatcttatcatatactatattagtgttaatcactcactattgatattgatacgccagtacatagagatgttcttaacaaggatcgatacggggatctagaatccttgggctatcctgagcccccaaaatcgaaaggtaagtaaaaccctgtaaatatcgtgacagtttcatgcattgtgtttttgtacttactgtaccacttacactattttacttggtatgttcaactagatggcatgattttggcttatacttttgaagagccttttggtgacatatttggtaaaggtgtctggagtgaactaagtgaagatgttgcctctagcatatgcgaaaatactgtcgcacttgcttcattcaacggtgatttttcagtattgtgctgtttacggtttcatatttgtactctaatcataactaactaatgatcaaaattatgatatccaggagataaacgaactt

SEQ ID NO: 26941 - DNA, 9877 bp, Oryza sativa
acacagttgaagtaaatagttgcatcagaatatgagttaactatgattatttgattggcattaccaattataacttctccatttcacctggataggctggcattggagggcctcttctttgtttcgatggaacctttgttggcatgaacttctacgatgagggtgtagaaggcaccgcattcctatcatggtgtgagattcgcgagatcctgaagtattttaagacaaaagggtatgtctagatctttttggttattcaaatgctttgatgatgtgctccttccagtcacaaaatagtgatgttcacatgtagttaaaccaattgactttgaccatagtaattatttcaaatgttaagctttgaatgtataaaatgatacagtaaaatatcataatattacactagattaacattttggtgacttttttgaagttaattttttatgttctgccatgttgactttgaaaagccaaaaacttgatcctttagtaaacagaggggatattgtacaaattcatgttttgaatgtataaaatgatgcagtaaattatcataatattacactagattaacattttggtgacttttgtgaagttaattttttaagttctgccacgttggctttgaaaagccaaaaacttgatccaagtaaacagaggggatattgtaaattatcatgtttcaaggacgtgctcctgtaatacttgtgagaacaattaattttgaattgttgttgaagcaggttcagtcaaatcataattttccattgaattctttgttgtgtttgatagggctgttgctgaacatagccatggtaatccatctgatgtgcttgattggaagattgctggagatgatagtgttcaccctgataggtattatgatgcattacactactatcacgttaaatattcgtacaaatttgtggataacattacattgtgggcaaattactgaatggcagatggccggttcctatgccgtattggactcttcctgaggatctggtccaacgtaaacttgcagctaaaataagaagacaagaggccatcctgtgttgaattgatccccatatcactatcttgtgaacctgtttaacgtcgagagacctagtttctaactttatcacaatgattattgtctagttagtgttgcatgtattatagtgcttggtttcataaattattactaatgtttctgagtagtgtttaagtgctctgccttttgagcccgactgcccgagggccatccgaccagtgatggacgtccgagcgtgcactgtgatgggccatatagcctatggtcttccatgcccttcttgtgctacaaatatgtaatcatcctttgtactcccttcatcacaagagttgcacgtacttatttcgtttcagttttttctcaagagttttacgtattctgcatgtgtctcgaaagactaatcgcgcgggccttcgttttgcggctgaattgaattgtccacgcgagcggcccttggttccttttaattaaaattgatgaatctgcggctgaattgaattgttcacgccaacggcccttcgttccatttaattaaaattgatggattcatcaacgttttcctcaaaggccaccctcgccgctgctgcgccaatagcaagatggataatgggttagtccgctatgtcgtcagagatggcaaggatgaagcagcggtcgctgagtttgatagcgagcacggcggcgccgacgaagcaatgcaagaatctgactctatctcgtagtagtacgtgattgattccctagccggcgatactgaagtgatgccagcagaatcccagcagggggaccgtggacggtgagctcgtagcccgtggaaggcatcatcgtgggaacgacactgtcgtcgatgcgctgcatgccgatggtgacatgcatgaagctatccatgcacttgtgcacctctcatcgatcaatgagtggatattccagatcaatgagttcatgatgcttgggcagccattgcatttggattgaggagggattggaggcaaagaatacgaagactgaagggctgattgaggagcaaagaactgattgagaagcaaacaattgagtggcgatctggcgcccgacccgcctgctcccgcgtggtcgccgccgctgccgcatcgcaggtcgccggccaccggccgccgaacctcctcctctcccgtctcaccctgtcggccggcctgcccacccagactagaagagaagtgagagagaagaagggaaaagagagacatgacgtggcatcctgatacatggggcccatatagacccacgctaactcagcagtcacgccagataaaaccggtatcaagtgaacagtttttcaagttgagagacgtggttttacggttggagacgattttgcaactcgatgacaacttgagggaccttgggtatactttttcctccattcttcccccaagctgcaagggttaccccatattcaggcccaattactggggcaaaaagcagccgctagggcaagggcctactactacagcgttgcgccgtccgcctgcgtccttgcttgatgcttcgcacgcgcgtgacggcgccgccgttcctcgcctctctcctctctcctctctccgccactccgcctctcccccatcccatcgtccacccggcccgagctgcggaggcgcagacctccgccgctgcgcccgcatcggcacagctacagaccaacgcggccgccggcgctgggagctcgggacgcgaggacagcggtacagccggacccccggctgactgacgcagtgccgcctgcctctgcccgtcgcggcgtcgccgttagcctcttctcttgctctctgccctctgcgctacggctgccggctcgtgtgactcagtggctgtgaagtccttcccagcgggcgagacggcgacccggctcctgcaggttatacctctagcagtttagctcatagcttcattattcccatttagtcattgtgtttgaactttctgccaattgccactaccatttgctaatctgtgattagtgaatgggatgctgacttgctgccgctgtagtttgtaggattggtaaaacatgaagagaaatggggatattgctgttgaactatctatacttctatactatgagctggtggttctgccaaccaccaccaccaccaccactgaaatatgggccatggtgttagtataagtttctgagtgcttggtcagcttttttctgtacttctgtagaatagttgtgtagtctttactctctagctggtatttgaagtactatataaactaaagttctttaattttatattgatttaccttttgtcatcttgattcaactaaagaaaacccacaaactttttaggttttaattgtaatttaaaatgacatagacagcacaattcattgaagagtacatattttgtaatcatatcaaaggacatattgttagcacaattggagtcatctatctatactgaaacaaactatgccatttttctttctgtttgttaatacaaagaagctaatatttgttgcaacacggatgtaatttgtttgttgctgttttgaatctggtgtaacgcacaggtatttggctagtctatatttattatttgtaccttttgaacttgcttgtttcattagtcgattatttgttttataagatgttatttgctatatttgtatctctttttaccaaatttatacttgcaatgttcaaaaatttttggcatgtaatgtgaaattgtgaagtagggctagtcaaccataaattcctggctatgccagtctccgtccggttaccagaggagctcaatccagttgcttgcagcttgtatcaggcggtgagcagctcactcctgtagatccgcttgcttgcagcttggatcgggctgggagaagcttattttgggacaaacggaaggaggcaaagatgaactttttatggaacggagggagtagggtggaacagaaaaaaaaaaaagaaaacctttgctttgctttggcaaggaagttaaaccgcatgggtccttactccttaaatcctagctttgctagctctgctccccttctcatttttcttctcttcctctggatcaaatggagcacaaactttgtttaatgcacacttgcaaaaattgagcaccgcaccaacactgccggatgttagcaccctaagcagcagcccacaggttgtcttgctgggaggagctcgctctagtggtggcgggctcatctgggtagcggggtcttcgatttgggtggcgcgagagtacccagccattgtggttgttgtccagagagcgagggagggtgtacggtaggaggtgtacaaagtgagatggaaatggatccccgagtaacatagagaagaggccaagaagggatccaatcacatctctctcgcaatccaagattgggaattccgaccaacataactctcaacgacccgctgcagtgctgcgatttttgcatcccaacctccatatagagggtcaaacaacgagatctctttggttaagacattgaatattctatcattgtgctgttttttttttcttttgctatttctactgttgcagcagctctctctctctctctctcgttgcagtactatgctgctaattgctttctttttattattttgtttcaaaaggttgtcttattgtataaatctataaatgtttgctcctagttgtagcgcctctttgatttttcatatttcgtttttatttaaaatgaacatcactataggttcatgattgggatttattattttgcagttgagttgccatggatattgagcgacaagttcaagagacatttagtaaccactataaaagcgtggtgctaatcagaaggggatcagatggcatcggcactggctttattattggtaaaacaaggaaaagttatgttgcgatgacatgctaccatgtcatctcaggtaacccctctggtgctttaaaggtcagactacctagggacacaaaggattatgttgctgagctgctatatgagcatcagggttatgatcttgcaattattaaagttaatggagtgagtggagaatgcccaattcttcaatttggtgatttagaaggtgtggcgcatagggccaatgtcgttcagcttggatatatccttgggtcacagtttgctttaaacttggacccctcagtatctcctggatcagtcatgtgagttattttcttttgttatttttttgttagcttgtctagtttatactaacttatatagtagccacattatttttttttgttatttttttgttagcttgtctagtttatactaacttatatagtagccacattaatatcttttatttgttttaaagaagaccggcaaaccaaaatggaatgatgggcagccaggatgttgtctacagtgccgctgcaagacatggcgcctcaggatctgcagtgatgtttgatgataaagttattggagtactatattcaatgtctacaaatagccaagttgcgtatgctcgatcaagtactactgttcacatggccttgaagaattggttgcatccaaatgtgagttgtttctgctcttttttaaggtagtcacttaactgttgcttgtcacctaattatattttatgacttcttttttcaggatgctgcaataaccactgagaagatgatagaacttgtagtaaaacctctaaatgattcagagttagacgattgattggactggctatggattgcaagggcatgtggactcaatgggtgtagactctattaatgtaatcgcccatggttgtttgttatttttattgatgtcctctttccatgggaatatgttgtctatgtaatttttaatgtttgaaattatcaatagttagctagctattagatcttgttcttttcagctgatggacagcttacggatagttattgcatgcttttaaagctagaattcctttcaaaaaaaaatgttatcgttgacaactttttctaaattgtgggacagtgatagtattagttaaacccagtctctatagtaatttttggctccgttgcccgtgctttataaacaggaaggctaatacatttacaagtgaaatactctatttgtttttgtttggcattgattagtttaaaattgaactaaccaatgtcatacattgtggaatggggatagtattagttaagccccaagttagctctagtcttcaaatttttggctccgtcaattatgcccgtgctttatgaacaggaagggtaatgcatttataagtgagttgctctggtggtaatctatctactcagctgacactcttctcgtagttgacactattagtatggatggttaaccgcgtgcactaatgtagaattgtagattgtagaatccaaggcaaatcttttgtttgctgagaatttctgaagagtttaagcgtcggatgtgaatgatgtagctctcccctctgtgataagagttgccaatatatgtcaggccaccactattttgccggtcatgcattgccaaatctaagggcactcacagtgaagaccctcatttgaggagcctcaggacgtttccgaggacgtgacacatcagaagagttgcacccttttcgattttttttcttttttttggggggtgggaaggggaggaggtattatacccggtttttattgttgagggagctgactacgaaaattaatttgtaaataaaacttttatatatgtgttcttagcgatctaaaagcaaatgctgaaaaataaagttcaatgaaaaatcctcaaaatcaaatccaaatttaaggttgaaaattcaaattttgactgataagcataagtataagcgaaaagatggggcttaataaggtgcaacagattagggaggcaaaaataaagttattcctatttgagggagttagggtagacttttgccatgtcaaaatgtcaatgaagcacatcaacacgatcaggtcacacaagcctgaatcgtcgtcgggtaaaaaacggcccgctcgactcatgtaatacggcaagagtgtaaaggtagacgcccctcagccacggagacaccaaccctaaagtgtcttgcggtctcgccccgccgccatctgtgtagtcgccacctccccaccgtccctctcttccaagttcttccaagtttcagttcaccggtggagagatagcttcggcggaagacagggaaggaggtcaatctgccgcgtaagttgtgctcttcactcatcacttcgttaattttcttttctcagcttgggtgtttgatcttgtgatggtgttttgctctaattttgcccccaaactgcatttcaatgaagaaccgtagatctgtgtgtagcaactatatttggccattgactttcctcaaaactccattccgcgaccaacaggcacctgccggatgcggcgagctgcggtgcgccttgtagtgttctttgttcaagggctggggttgggacttgggactccgcgagctcaaagagagcaccttatcttctgttttgtttgtataggactaatatataatattgcttttgggataaattgctattgtgttgttagtttatgagataattagttgatatgattttctgttttgtataggactaatggagaatatggagaatgaatttcgtagggtcttcaacatgtctctccaagtgttgtgttagtggaacaagtcggacggatcgactattactgtattggttcgattattttcagtgataaaaaaaaactttcatactcacccagtcctcaattacttcatctgctgcgaatctgtctgtccgtttctccgatggttttaaacagtcagcatccctcattttaaaacaagatgtacaagaaagtgcaagcggacaatgtgaattatgcatcttgatgactgattatcattccaattccaagacggtggagttctttgaaggtgatgttgatcattcatatgcggttgctatcgcccctgagtcaaaatattccgtacacaacatgcccggttttattatacataggtcacttgaagcagcaagcgatagctctgaaagtgtgtacaaaggttctgaggattatttcactttcgcatgccgatatggagacacaagtccgaaccttgtgagcagattaatcacaggtccagtttttaatctgaatgggcaagttttagggatcgttgttgatgatattgagtataaattctggcccaagaagcccaggaaggaagatggtagtcaagagattattcatgaagatcttttctatcgcgctggatatttcttaaaggttgctatgcgtgttaacaaccttcagcaagacttgaggtcgatggtaaaagacaatgactggcagaatggtctgaagaaaatagctactgaaagaagagtgtaacagcaaaaaggagcatgattcctgagatgaacagtaatagtttttggtcgcgatccctaaactgtttctgctgtagtttagttgtctgctaagtactttggcttgaatcagtcatatttaatcgtactgtaagactttatttgtcgcaaagtgttggctctgcagactttatatgttttcattcgtaccgatcggttgtaattaatttatcagacttgaggtcttttgtttggaaaaagttcatttttgtcttaattatcaccaaattcaaatatcgagcgatcttcagatatgcttattattagatttgttttatcgtatattttgaataggaaatattggttcaaactgtttgtgattttgctatatgatttaaaagtttttagctgtcaaagagaagattaaactaccagtattgtttgctaccatgtgcttgcatggtcattaccggtaacgtaagagcaagtttaatagtatagtccactattagctccaaaacatttataattaatgtaatagccaatttatataatagttgtttactatactataattatctggtcccacttgtcatacacacattatatcttggagttcgtgccgtagctggctacagatctgtagcccgctgctcttctctctcatccgttatctctgtagaatatgtttatagctggcttatagcctgctattgtacctgctctaatgaggcaaatacacatgatgtgtggcccactgtcagtctgtcattagctgttctaatctaatactatatgtcttccgacatatgatcctcgtctcctcgatcctcttttttttctagtccctcctaattcgagctcaacacagataaacattcagattgctacttgttgcacttgcacctgatcgttgcaacagctggtgagaaaggaaaaggattggattatacatcaccatcggcatctagttaaaaaataacaatcaacaagtcattagtggattacattcacgtttgcacaatttactccctgaatttaaattattctccactggacattttcaaatccagactatcaacattagccaaattaagttgtgatccctaatttgctccaaaaatttgtgaaaatagaataagtccaattatataagatgtaaataaataagtagagcatgctcatctttcctggaaaataaagaacccatgcaatacctgcacatgtaattcaaaatggactccgatgattcccatgcaacaagaagctgatcacacacatttcgtgcacgtttcattaaaaagggcaatcatttaaaactctcttactctatttggtcagcgttaccactactagaaaacgacttttagcgacattggccttttatttttccacacgggtatgatcctcgcagccaaatatctgcctacgaaaatgtaaaccgaggtggattttcgtcatccgcctgtgaaaatcattttttctaggcgga

SEQ ID NO: 26942 - DNA, 2963 bp, Oryza sativa
gggacggggcctaccgcgcgtcaacgacgatgacgacgacgactaccgagcgacgatgacgacgatgactaccgccggccgcgtcgttgccccttccctcgacccctcccctcccagatccggcggaggggaagggcgtcggcggtggcgcgggcagagggcgttggctacgacgacgaagactactgcaggacgacaacagccctaccgcgcgacaacgacgactagcgccggccgcgtcgctggctcgctgcccaacactcccctcccagatccggccgaaggggggagggaggcggcggcggccaccacatgcaatagaggagttcgccggcgacgatgacattgtgtttttttaagtttacatgttcattgatgttaacttgctgtggatttgaatccaatgcttttgtgttgcaagtttataatgtctgtgattggattttgtttcctggatgagatttgtgagaatttatgatttgtgatttgaaaccctagggaggggtggggttggcgggaaatttttttggcgctgaggatattttcgcaggcggggctacagtagccccgcatgcgaaaatagcacctgcagctcttgggaagattcgaactactgcctgttttggtccgcctgtaaaaattagggatttttacagtcgtttggatacaggcggaaggttttgccacctgcgaaaatgtgttttgaccgcctggaaaaacgtttttttagtagtgtactacattagtttgctaaatctattttctctgggcttccacagttttagcagcgtatatgatagtcaatagaaatttgtaacaggtaataaaccattccaaaaagtatttctaaaaactgaaccttttggccatgctaattgagagtggctggcgtggcaggctggcatggcaggacaacgctgccacgccagctgcttgtggcatggtagaattatttggccacggcctgacgtggtcaaaaggttcagatttggaaatacgttttggaacgatctagtaataaaattaaaaaaaataaaaaagtctaaataataataataataataataataataataataataataataataataataataatctctgagctaacctgtgacagaaagcaaaattgcaaaatcacaataggttgttgctgcaaaatgcaaaatcctgttttgtgaggctcctggctgtcacaataggttgttgaggctgtattcctgcttataaaaaaatcagccaacaatgacgagcatgtaaattagttttggttgcagcaaaaaagcttattgcacagctatatatagattacaatcaagattgttcaattttgctatatatttgtcgacaaattttctcctgaaaatttgacagatgtaattacaatacagtcgtagtgtaattacattgtaatttcaatgtaattacaccacaactacaatgtaacttgtatgcaacttttaaatatctctccataacatgtttgttggcggatggcatgagtcccttcgaccgaatctgccgaaacccatggcgaagaccacgagccaaggatgatgcgaggcgaagggtcgcacgagtgcacgccgaagaaggacgacttcgccatgccgaagaaggatgacttcgccaggaccggttcgccccggcatccagcccagagaaggacggcttcgccaggtccagttcgcccccgcgagggccgaagtagccttctcggcccaccaagcttagaggccatagggccggcgatcgcctgatggcccatcaagggcccatgagcctccctttacgttatgtaaccctgtaaacgtccctttcataagggcaactatgtaaattcctcagtacaccctagaccctagaagtgagaatctgtaacggggctataaatagccccctagggccatgtaatacaggggagaaaattcaagaaatcaatatacttcgtttctttccaaccactgttaagtaaccacgtctttcgacgtatgcggttgtcgtttcgacaacaatgttattttggtaaaatagaggtcatgggaacaaatcctctcacgtgtgtgttgtgacttttttcttcctaacctacaaaaaacttgaaatagatctaacggtttaaaattatgtgaaagttacatacaaattacattgcagttacagtgtaattacatgcaagttatagtgtaattacgctacgattgtactgtaattacatctgtcaaatttttagaagaaaatttatcgacaaataggtgatcccagattgtttacatgaactttcaacactaaaacagggctcgggagttactttgctctggttgctggaccaattagcttaaatgaacatcaccttataagagctatgattatagtcctaatgattgaggataactttcttaacactgaccaaaaccatatgagagctaatgacccatgtatggtcaaatcactactacaaagatggtttttgcatacgggggagaagggttttcgcatgcggttggcacaaccgcatgcaccaaatcgtcagcgaagatcgtgatctttgcatgcggctggcgcaaccgcatgcaaaaatccgattttcgcatgcgggagcttaagacgatcacatgcaaagagaaaaaatcacgaaaaaaaaataaaattccaaaaataaaaaaaaaagcaaaaaagaaaccctagcgccgccgcccgagctcgccagccgccccggttccgccgtcgccctcccgcccgcgctcccgattccgctgccgcccgcccgcgctcccgctccagccgtcgccgcccgctcgagctccggctaccgctggccgctcccgcctccggatccaggcaggacgaggcccgccaccgccggatctggcccagctcctcgtggtcgtcgttggcgacggtgaggcggggatgctggtggcgccgctgcccgcgtcgacgcccactcgtcgtcgtcg

SEQ ID NO: 26943 - DNA, 7686 bp, Oryza sativa
caaaatcaaagttgtataacacattgagatctactatttttcttttggtcatttcgccatctgtgtttgattgaactatataaaatttgaattttaaaaataagaaattcaaataatttttcaggtagtaaatgatttgaaatcaaaaaaattgtcaagaacaaagttgtaaaacacatcaagatctatttttattttggtcatttttctatatgactttgtttcgacagtttgaatttgaatttcaaattatgacaacttcaaacaatattttcaaatactaaatgatttcaactgaaaaagtcatcaataacaaagtggtataacttatcaaaatctataacttttattttggtcatttattcatccaaaaaagtgatttgtaagattattcacaaaatgtacatatctcttatatagttttataaactataagagagatatgtaaattttgaaaaaatgttaccatcactttgtcagatgaagaatgaccaaaatagaagttatagatcttcatgagttgtacaactttgttattgatgactttttcagctgaaatcatttagtatttaaaaatattgtttgaagttttgaaattcaaatttttaattgataaaacaaagtcacaagaaaaaatggccaaaataatagtagtaagaacataataacatggtagagcatgattttagaaatatttaggaaaaagaattatccaatttggtgttcatatgagtgagatacactattttcaaaattttcaaaattatttttgcatacggctgcttaagacgcccgtatggaaaaatcgattttttccatgcgggcgcttaagtgagccacatgcactcttaagaggcccgtataggaaaatcgatttttccatacaggcatcttaagcagccgtctgagaaaatgctactcgatttttgcagacgccactagttatggtccgtttgtaaaaataaaggggtctcgtacagaaaaatcatttttgtagtagtgaatacaaataagatatgttaacacgcttttacttgcaacaataaggagcatatcaagtaacatgattttacattaccatgaccatgccttcatgcattaaatatataaaaaaaacacatctggacaaaatcgccaaccttcttttgttccacaaattagaactatggagtgaatttaattctaaaagatcattcatggatattgccatagatggatcattcatgatatagccaataggatcaatagttaaatacacatacctcaaactctcaacatgctggtatagattatctcgactcactctagcccaaaaacatgttgtcttattgaacctctcctatcccttagcttcaataaattgaccatgttctagacagatggccctccaataattgttttcttcttttaaataatcttccttcacaaactgcagcaagtatggtactaaaatatgtgccatgttagaattctagatctggacatcacatttgacagacgaccatataatttcattgtaaccttgaatgtccacttaaaaaaaatgaagttacaaactgcgatttttttagagataattgtttctctgcgaactttaggaccaagagtagtctccatatccattccaagaatttgtttgtctatcttgctgagcgacaaattaacttctagattactaaaagcatgaacacacctgatgtagactgagaagcggcaagggcacagcaatggtgaagatatatatagaagaccatgtgcgaaataagaacatttcggtgcagtaccgccaatcctatgtaagttataacccactgaatcctaaacctcaacatgcaaatataccacattatcatccactaataattattacatttaaacatcatgcaagtaagttatattatctataatattataatttattaaattttagagttttaaaatgtaagcatgttaagtcataatcccacataattcacatgatattttcaatatatttctttatcattttttataatatcatatatatgttatttccctcttctctcattaaatcacatcaatagattgtttttagtattagatgattaatctatggtccaaactatctcgagattagctcactcattttcttttttcataaagcaacatcaccttactattatatttgaatcatcattctatatataatttaaatttaaattatcataaatcatatcaacttacataagtttacgttgtctagttatcttatagattatttttacttattgttatcataataaacttccgccgcagcacgtagggtttcacctagttagtacaagaagcaagactattttaccaaccaaaaaacagaaggggatcagggcctttggccgcgttcttttcagtggttgggtttggatgattagctgcacgtaaaacgagaaacgcgatcagcatataattagttagtaagtattaattattaaaaatttgaaaaataaatttatttgattttttaagcatcttatatatagaaaattttcgcacaaaatatactgtttagtagtttgaaaagcatgctaacggaaaacgaggaatatatgaactgcattagagaaagtttaatagtataacccaactactaacttcaaatcatatatagccaatctaatagctcattcatacaactaggaaggtagctcgcgtattcgtgtgggcatgtaccgtatgtaagacgaatttgagaaacttatagggacaatataccagcaaaataatatctgcaatgtttcaaaattgtgattgtttttcatgaattttcttcattagcatcacaaaacgaatttaattgttatttgtaaaattatctattgaagattggggctggtaacttatggtacctaagaggctaagacatactccctctctgtcccataaaaaatcatcttagattcatagttagaagttgacttttttttgacggaaggagtatgactcttgaagttccatatggaaagagaaaaaacttaagttataaaagatattacatatacaaccatatataattaatggttgtactgatttatgtagaaaaattgatactataacaatattattggatggcagacatcgattggtcatagctatggataatttctcataggaaattatgaatatgtgtattgtacagggatacaaattagaaaaaaatagtagaggctacgagaaaaaacaaaatatatgaccctcaatttttacttaattcggtagtccattatttctgaccattggatatttagatgatctaacatattgtgcatattccaactaaccaaattattcgtcttccctcatcaccaatgttggacatgttaatccggataaatctatttatctatgatttacatatataaaactttaagtataataaaatgtacacactactctgccaacgcagccaacgatgtgtgcgacaggttcgccacggccggcttcaacgtgaacatgatcacgtatacctgacgtagcagctgcaccggccgctggtggtggcctcgaacctcctcaccaacttcaccggcacggctgattccttcgccagccacctctggaccatcgccaccgacggcgttctatcccagctcggcatgctcggcccctcgtcgtgtcggcgctcgtccctgccctccgccccgcgtcgtgcagtgctgctgccgccgccccgtgacgacgactatttagactacgtacgtatacgtacgtacgcacgtactgaggagagggtggatctatgggagaagaggagggttgtgggattttttttttctaaagataaatataatagttgaaaatagtaggtctagcgatttattattacagaatagtgggtctatcgatttattagaacgtcacgtgatggcttaattaggagcgtggcagcttaatagtgtttgtaggaagtttattggacttttagtatataatggatagagagaagatacttacctataaacatatactacaccattaatatatggtcccatctctcatacacacataacgtattggagtccgtgctacagctggctacaaatctatagcccgctttccttctctcttctcttctctcctccacatgtgcttacaagctgacttatagcctactactgtactcgctcttaggccctgtttagatcccacacacaaattttataccctgtcatatcgaacgtttgaacacatgtatgaagtattaaatataggctaaaaaataactaattgcatagaatgcgactaatttgcgagatgaatcttttgagcctaattgctccatgatttgacaatgtggtgttacagtaaacatttgctaacgacggattaattaggcttaataaattagtctcgcggtttactgacggattctgtaattagttttttttattagattccgaacacccccatacgacaccatatataatatccgatgtgacacgccaaaaatttacacccttgaatctaaacacccccttagatgtttagaacgcggcccaagacatctctgaaattgtgcgaggaaactactgattaagagatcgattgttgcttcagatttactataattcgcgcatgacccttctatggcaattattgctagtacttcctcttagagcaagtataatagtaggctataagccagctaaatgttgaggtggaggagagagagaagaagcgggctgtaaacttacagccggcttggacacagaaaccaagaaactctgtgagagagacaagtggaccatatattaattgtaaagagctaactattatatgggtaggctgagagaaggctatcaaatcttatagccaacaggtcggctatattattagccttgctcttaagcagctcctgcgtctctcgttagcatgtaattcaggtcatccagccatatgatcttgctgcacgcatgcaattaaatcattcagacatgaaagaatgcattatcaacttaattagggacatatagaaattcagtgtcagacagcggtgtaggatcgaacaaaactaaacaaacctaccgaagtgtggataaatggtagagaaaactgaaaacccagaatcttttgtagaataaaagatttacttcgaacggagtagacgacaaagctctatcgccgctggtcacaccgcccgcttgccgccggttagaccaccgtgtcgcctaaggttagaccgccacataatcaaccttggagcgttccttaacctaaaacagcctgttccctttcataatccgattgatcagcatgggcttcccacacctccgaggcctcggaaaagcagtagtcagggagaggcttcgtatcggaaacgtcaaaatccagattaaggccgtggcgatggattggagaagaagacgacgacggatgagggatgtgtaggggcggggagggattcctatctctcgcccgcggcccagcaacagaggtcgcgcgacgccgcacccccccccccttcccccgctttttttttcgattttctcatttcttttcgtgttattttctgatttttttttaatcttcaacacatgttttcaaatctttacttaaaagttttcaaatctctagtcgaaagtttttaaaatttgtcttacaaatttaaatttcgagttgaaaatttttaaagtttgagttgaaagttttaaaaatttgaatttaaagtataaatattgagtcgaaagtttttaaatttcgagttaaaaattctaaaagtaagtttagagtttcaaattttaagttgaaagttttaaatttatataggacttttaatttttcaatagaaagttttaaatcggaaaacacgcacgggctttccagggtggggggttgccggttaggagcctctttctagagcaatgctacatgtactaattttttcttactaaacttttactaacaattatctcaaccatttaatttacgtagatgaaagttataaaaaatctagatgccacatagcatgacacaacagtattagtaataatttagtacgtatagccttttccctctagtagatatcacactatacatgagcagatgagctctcaaggatcgaattccctatagatctgtcgacagattttcagttaaacattataattataattacattgtaattttagtttactatcactatataccttcaatataaactttttttcccttgaaccaacttggcttaattgctttatggtgtacggttaacagggcagtgcaactagagctcttcgaatcaatccccgctatgcacgcacttgtgtttttatccatcgtattagttagcacaaatctccacgcaaatcatatggcctaaaaatcgataaatctttaactgaaaatctgtcgacagatcgatagcgaattcgtttctttttcacacgcatacttttcaaacagctaaacaaagtattttttcattctttttaaaaaatagataatacttaattaattatatgccaagaagttttatgtgcgtgtgagattagtttcccaaaccacgtgatacgtacaatccaatactactcgttgctctctgtatcaggcgctcttactactccctccgtttcaaaatatttgacaccattaacattttagtacgtgtttgaccattcgtcttattaaaaaaattaagtaattatttattcttttcatatcatttgattcattgttaaatatattttcatgtacacatatagttttatatatttcacaaatttttttttaaataagacgaacggttaaacatgtgctaaaaagtcaacggtgtcaaatattttgaaacggagggagtatttcttactatccgggcggcatgctgagagggtggcggcggggcacagtccccgcaacaatctcagaatccggtacgggggacaaagaggtgaaactggcaacggcggtagggagctccggcatgggtggccgcgcatccgatgtcagcgtcaatggatccagctccccctgtctggataaggtgcccttgcgccggatctggcaggggccgtggccggcaccgcgggggcgcaaagctggcgtggccggaagcggcgatcaaggccgtgcgtggcggcgcgatggggcacggaggaggtcaagcggcgcacgttgctgagcgatgcgtgttagacacgggagctggcggccagagtggtgggtgtggtggatttggccctccagtggctagatcaggagcgggcagcgacaaagctcatggcgagcaggcggctccaactacgttgcttctcgcaacggtggcggagctcgcggcgactgcagacgggtggaagcgtggggtggagtgcggaagcgctcccgtggtcggtggcggaggaggacgacagcgtaagcgatggttgcacgacacgaccgtcggcgaggccgaaggcatggaggccgtcaccgtgaggccagcgtaggcgtgggcaatgtcagtgaggccggcacagatgacgccatggaggctgtcatggcgagtccggtggcggtgatggtggctagccgatgaggcgcacgacgagcatggtgtgatggcttgtggctggcgagcgcggcgcggaggttgaagcggtgtggcagctgtggtgggcctgcagcggcgaggctacagccatgggaggtcggaggtgacagtgatgcgaccaagcg

SEQ ID NO: 26944 - DNA, 5596 bp, Oryza sativa
  unsure (1)..(5596): unsure at all n locations
tagaagtgatacaaccctaccagtctaccaccacagccgtctaccgcactcctccagtccccaccgcgctgccgccgcctccttcagcccccaccgccgccgccgcctcctccagcccccaccgccccgctccctcttccagcctccaccgcaccgccgccgccgcctccgatctccgccgcgccaccgccgccgtcctccaccgcgccgcggccaacgcctccgccctccaccgcgccgacgatgcctccgtcctccaccgcgccggcgacacctctagcaaattttttcgttccaaactttctcctcaaaaattttggtcagaccgagaccgagaccgagaccgaatttgccggtcctgagtttttttggatgaaattcggtcctgagtttgcaaagaccgaactgatcgaaaaaccgaagaccgagaccgaatttttcggtctgaccaaatgcccacccctaatggccacactagacgtgccagtgccccggggggggggaggggatccatccttctctttcaccctttccctctccaacttgcccgcgtggatggatctggagcgcatcgaaggttaagaccttactctgatggccggccaacggcacggtggctgcgcattaagggagattagctggtgatggatgctatatttgacgggcactcgttgacgcgggagagtaggaaagcaatgggtgaaggcctagcctctgggccggcaatggcaatgcttgtgagcgtcgctttctcccttcgggtgttgttacactttactccttctccattggtttctttaggtgcgaagcatctaggcccccatcattgattttggtaattaatgacaagcgctaattgtggactaactattttcttgagttatacattttgagttaggaccacgtgatatgtatgcatggatgatcaccggggactaaattcaatggtgcaaagcaaaaggaacaaagatggtaaaactagaggttttattttaagtgatcgatgagttgggcgatcaaaatttgctagttttattcatagctttgtcgtactataaagaggggtaatgacctaaacaaagagatgataaaaatgccacattagatcatttgcatttagacttggttcacaattaaaattgatttacttctctatctaatgccggtctgaccgagggcctaatgccgatctaactggcaggtgttggccggtctaaccgatgggaccttgccagtctgaccggctggcctagtaccggtggtcggcctctgggcgaaaaacccaagccccagagccacagccagtcggtctgatcggccgccctatggcggtttgaccggctcccgtgtgtctgtgcatttaatgcactgcaacggctagttttctagccgttgcaaagtagtccggtctgactggcgaccctatggcagcctgaccggcaatgcactgagttggggattatgacccacacggctagtttttgtgggtgggagtataaatactcccccaccaacagcaaggagctctcttggcacttgcttcacttgcatataccccttgtacactctctcacactctctagtgcttgtgttcatccatttagtgtgattgagggttgattagccaatagtgaagtgcatttgattcattgtagagctagtgtggcacttgatcatctccgagccaggtcattgcttgttactcttggagtttgccgcctcctagatggcttgtggaggtgttgcctggtgacctctccaaggagattgtggagaaggcccggcgccggttgtgagtggtttgaagttcaccaccttcggagtaaaggaagaactacccctagtaattaaggctcgggtagtccacttcgtgggtcggctcccaccttacccaccccttgacaaagggggcttgcggtggcttcgtggttttgagcggtgaagttgggctcgcctcaatgggaagtaggaaaccggcgagtttccgaacctcaggtgaaaaactccttctctcttgtctcatttgcttattctatttatatttgtgcaatttactttcatagagacatatttaaacccatatcaccctacgattgcaaaacttatattatgtgtgcaatttactttcacatatacatatttgaggccgtatcaccctaggattacaaaacataacttagtttcttagttaaccttgtatctcaccaagcctaacaacttaggttagttttgagtatgtgtcatttagttttaaatcgcctattcacccccaactaggcgacatcacgatcctacaaggtgaaaaccataacctggttttttagaacgggcaacgacggcactcttggcatcgccacctccttggaggcgttgtttagaagattcattcgtgttgtgtgcctgttaggcttttcagtagcaggatcaagcgcagacgcgtggtgtggttgtattttccttttccttactatagtctcccagtaatgtagacctttttttcttgttatatatcaatataaacgtcataatatcttgtaccgatttcaccgtacatgaatgtcgcggttgctgtttttgatggtcgttgagacagatagtttggtactatcagatttcagttccgtagctcctggatcatgatagcatcagtttcatcatcagttggtctgcgatttcatcgtaggctaataaatagtacttcttcttcttctgtaccctaatatatataagagatttcgatattttgcttacactgtttgactactcatcttatttaaaaaatttgtgcaaatataaaaagtaatttagataataaaataaataaaaaaataaaaaataattctaaattttttttaaataagacaaatgataaatagtgcaagcaaaatatcagaacctcttctatcaggagagggaggaagtatgtgacatgttctagccttttggaaaggagaatctactgtttgacctgagcatctgaacagtgcgagccccaaaactgaagtcaacctggtgaatcttgggaagacaaatgatgccttttgccatggaaaaacatttcaaaagtccccaagaccgaagcagaaatggagatgctactactgctatttgtctctttggcctatttttagagcgctcatgtctttctgcctcaccgctgcctctgcctccttccaaatgcttcgccccccgagctctcctcggcgtgcgcggcgcagcgccatccaccccgacaactcctcccaacccccaacctatccaaacacattttcttgcccgcccctgcagctccctccaccgcgccacccatccatcgccagccatgcacaccctcgctctgacgaccctgtcacgttgagctacgctcggaggaggacgccacgacggcgaccgggaagaagatgaacccgctccctcccccggccagccggctgtgggaggcgagcatccgcaagctcaagtactccaccatcctccgcggctccgtcgtcccctccggcgccgccttcgatggtgcggcggcggcggccaccggaggtgaccccgtcacgctcaccccaagcctctccgtcagctcctccacctccaacaccatctaccagtacgaagacggcgacgacgacatcgactccgtcctcgacgacgtcgacaccgacgacgacgacgtcgacgaggcgtccctcggcgagcccagccactccgaccagctgctgcccagcggagacttctaccagggcgacctgcgcggcgacctcccccacggcgccggcaagtatctctggacggacggcagcatgtacgaggggtcgtggcgcggcggccgcgcggccgggcgcggcaagttctcgtggtcgtcgggcgccatctacgagggcgacctcgccggcgggtacatgcacggccaaggaacctacatcggcgagctcggggacacgttcgccgggctgtgggcgaacaacctccggcacggccgcggcacgcaggcgtacgtcaacggcgacgtgtacgacggccactggcgcgacgggctgcaggatgggcacggccggtacatctggcgcggcggccacgagtacatcgggacgtggaaggccggcgagatgcacggccgcgggacggtgatatgggcggacggcgaccggtacgacggcgcgtgggaggacgccaagcccaaggggcagggcacgttccggtggtccgacggcgggatgtacatcggcctgtggtgccaggagtccggcgagacgcagggcaagggcgtgtactacccgccgtccggtggcccggcggtgccgttgccccgggaacccaaggaggtgatcacgaagctgctcgaggagctggagatgtccgaggggaagacggtgtcgctgctgccgtcgcagaaggtgctgacatggcccggggtggagcccgtgacgaagaagccggtgtggcggccgccggaggtcgccgctgaccaagggatgtggcggccgccggaggtcggagctgaccaagggaggaggtcgagcaggaggaacagcatgtcgtccgacattgacagcctggttgagggggaggacggcggcgaggagactcgcaacgacaggtcatgggtgcggacaccgtcgtgtatgcgcgcgcccacgctgccgaagccggggaagaagcagggggagaccatctccaagggccacaagaactacgaactgatgctcaacttgcagctgggtatcaggtgagatgatttgcttcatgtccactaatgttattacacatgttgactaattgacacttttaagatatggtaattaagaatttgcaatttgttgtctatgacatgtgagtccaatagcaagaatcacttgtaagaatgacaaatagttaattattctgtcattggtgttttctgaatgctgatgcattggtcttctaaattcgatgcattgacatttgctgttcatattatttggggatacagacatgctgtaggaaggcagtcagctcctgcttcattggatcttaaatcatcagcatttgatccgaaagagaaggtgtggacaagatttcctcctgaaggatcaaagcatactcctcctcaccagtcatgtgatttccggtggaaggactactgtccattggttttcaggtcagtatattaagatactgtaatatatggtcattcttttagatttataatatattgacgtgcaaagattttgagatactgtaatatatggtcattcttatagatttctaatatattgacgtgcaaagattttgagtgttcaaaaaaaaattgataagttttttagataaggaaggtaaattacatccccagcctctacatccaggatgcaatatgtcattaaatgtaccgttcaaaaaaatgtgtcattaaatgttccttctttattttgtcctacagagagtaacttcattctcttaactgttgctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 26945 - DNA, 8081 bp, Oryza sativa
agtgggccaaatacaacgaccagaaggaagcgatgccgaaagctgcattccagtttggagtgaagatgcaggatggcaggaagacgaggaagcagaacaaggaccagaagctcacgaatgacctacacaagattaacaagatacttgcgaggaagaaaggtgacaaagatggaggggatgatggtgggcattatgatgatgatctacctagtggcaagaagcagcgcgcctgatgcaagccactaatagtttatcctgcgagaggtgtaaaaatgtatttgtactaggaattacagcgccatgaacaaacgacagttgtaatgttcagcgttttggccggtgcagaagggaataagaatggggagctggaacggtgaaaatatgtagtttgtccatttttataacagaacaatcggtaatttgctttgttctactatgaaaagagaaaacatcaacgaatgcccaattttctgacaatgtacgcgttaagtcatatcctttaaaatggaaaagtgatttcatccctcgaggggatatcccctcatttcgtgcatgccacctaagggtgtgtttagttcgcgaaaaaaaaaatttttgggtgtcacatcggacatttagccagatgtcggaaggggttttcggacacgaatgaaaaaactggttctaggactggtagccatcctccagggcctgcttacctgagcatctccgcgctggcttcgactccctggtgctcctagtctcttggcaactgtggaaggaacataaccatatgtggcttggtcatatgtggctttagctagtattgctgcttttgggaacttgtcaggagtgtagcgtggctcggcccattctcgttgtttggagtttgtgtttagccgccgtagttttctaagcttcagccttttattttgcattttctcccttcctctggcataagccggtctggctgattgtgttgtgtaactataattgttttcttctaatatattgacgtgcaatccttctgcacgttcgcgaaaaaagtatttcacatcaacctgttaactgaacatcttagtgtcagactcggatgaggaacagcgaggatacgatccgtatggtttcatccacaaaatgctcacactgtaatgcagaggcaattagcgcccaattatctttcatgctgcgagtttgcattccacatttggaaaaactttccagggttgctttgcctaaccaccctctgattaacactcacctagtgcctaattcttttgcccttcatgacaacctaaaccccagcttcagagttggcacaaacgagtcttctccctacacgtaccagaatgccatttcccagctagtatatgcacggtaatttggcacgtgcaacctctgcaatataatcatccgaattccatcacgtagatttctgatttatcacatattttcacacgtgcgaagcatgccggaattcattttctacgcacgtttttgatttttttttttcatttttaaatttatttttttaatatttacagaaatattatatcagcggaaagatttacaaaaatggaccttgccgccctccatttgggcggcaagctgacgtggcacacggcgtcatgacttgtgcgcattttacgctaagccccttgcagctctctgtaagggcggcaaggggctaaatgtgattttggccctgccaaaaaagcaattggctagttctttttgcatctgagccccttgttgcccttacgaattttgcacggtggccccttgccgcctagacagagggcggcaagggggccacgtgcaaaattcatagcttcccaaaacgactgtcatgtgtccatgtgccacgtcagcttgccgcgcaaatagagggcggtagggtctatttttgtaaatctttttgccgatataatatttctgtaaatattaaaaaaataaatttaaaaatgaaaaaatccacgttttccaggcttaaaatggccgtgtcgaattaggctcacatttcggtacggcccatttgtccattcggcccatgtccaacacgccccacggccctctaaaactcacgtgctaaaaatagcccaattcgaaaatttccccacggcgtcgtcgcctccgccggcgaggtgggagatgaatctctccgctaccttccgatcggcgaagatccctcgcgctcttcctcccaaatccggcgagcccgccgccgccgccttggcctcggcctcgtgcgcgcccgggaatccgtcggcggaggccgcgaaggggaaggcggcgttgggctggtgcgtctacctcatcgcctcctcccggatctcccgcacctacgtcggcgtcaccaccgatttccctcgccggtgattccccgaatccctttgattcactgtttctagagctgtttcagaagattctgtgggttatggtggctccgccagttagtgattgaaatactgcccccaatttatcgctattgttttgttaacactatgagatgtgatattaggcctgaaagttacatgattcggatgacaattggactgaaatccttgcgattttcatatatttagtacttttttaggacttgggaaaacaaatgaagctcaggttattgttcagtccctttagtgaagataattgaacatggattgattcctttcaaaaaaaaatgagcatggattaaaccttaatttgttctacttttagcaatgtatgttaaacatgcataatattttctactgaataagctgttgcctgctcttgtttctacctatcttcaatttatgacgctgtgatttacaagcagaactgtgttactcgttgggcataccaaagcttgtccttttattcgtgtataaaattgtagttgccttgaaatattctactcgtagttgtcttgctcaggcaggcttgtatacatgcttcaatatatggggtttttttttgtgtgttgatcatcggttcttgttggaatacatagcacttaacatggttagaacttagaaagtacaaagatgagaagtaaatttatactccctccatttcagattgtaagactttctagcattgcccatattcatatagaagttaatgaatatagacacatatatatgcctagattcattaacatctatacgaatgtggacaatgctagaaagtcttacattatgaaacaaagaaagtacatctttagtcgtaccacgttgaaatggtaatcgtgtgttgatgaaagtatttttattatttctagcctgagacaacataatggtgagttaaaaggtggtgccaaagcttcctctgctggaaggccatggaatctcgcatgccttattgaaggatttgtcaacagaagtgaaggttattgattgtaaccatcattttccaacagcttcagacttggttgagatgttactagaattgcgtatagccatatagtgctctagcttgtaagtgcaacttttcctttccagttttcacttgatttagggagtcatttcattttttctgaaattattttgtatcataggttggtacttttctgacatgttaccctaggaagctatgtttatttagccataccaaaacaatttgacaacatgactgtctgtactggtcacttcttttcttgttttgtttagtattatataattagtgtttcatcaaggtttctatgttcattgactctttggcataaagaaacatttagttattgttacctctttttctgcacagagaaacattaacattgtctatgtgctttagatactcaggtgccatctgcatcttttgcatcgaaatgaaatgaatgtttcccttttcaagtttgcactactacgtaagaattcctatttactgaattatttgtgtgcagcctgtgaatttgaatcaaaatggaagaacatctcccggaaaatggcacgcaaaaggagtgaacctagcatgacctcattgctgcagcatcgagatatggcattgagcagagtgaaaaacgatctggcctgtagccatctgaaaatcaaatggcactcaagttgaagttatttctctcatgttggtatgtacatgcatttaaaactatgcaaaaagtcacctgttactttgtaatttgtgagtgtgcttcagcataggcttttcaaattccatatttatgtttgaaaatcacttgtcttcaagctcaacactgttatctcgcagaatgatgaagctggttgttgtatttgtttatttaagattaagatatgaaacattgaaaattaagggtccggtgctttgcaaacattgtgtttctttacttggagactgcaccggtgtccaaaatgttatcatttatgatattgctatttcgatatatttttcttcaaaggttctccaaactacctggctaccccagaagcccagattgagtatcgtcaagcataaatgctgttatccttgtattgccacaaatatttgacgtatcagatacacacacagagcggaccgcgcgtgtcataaatatttgacgtatcagattctgtcaaacattattgacgaaatcttgtgttaacagtattaaagccatgcgttgatgggaaagattgaagccatgcgttgctacacgaaggtcaaatggccaaaccagaagaacctcaggtgataaaatatttaataaccagacaaactaaccaatcagcctgcgcgctctttaaccggattacatgattatgctctattctacataactaaagcagaattttcactgcagttaaatgtttttttcagcagtaccattttcagcaggcccgccattcgccagctcaaatggtctataaggcacgtcactcattggtcgaggaatcaatcgacctccaaaatcttctgggaagaactcaaaattgggaccaaagttgaacctgacttgacagtttggttggtcaggcagtgtatacattgacgcagctgggtagtaccgccctccaggaatgtccacaaaagcagtgccctggcatatcccattcttgaagtagcatatctcgctacctgcatttgcaaaatggattatttgatgaaaaaccagtgagaggttgaacagataaaacaatggatgctacaaagtaggaagtgtcatatagtgcaactttgcaaaacaatcattgttaggaccctgactttgtatgcgaaaaacaaacaagtaaccccttttctgtttaaacaaaaaagaccatgtaggcaagacagagagatctagtggaagatattaatgtgcacctattacaggatacctgcactgaatatctaatattgaaacttttcaattagtgcctttgtggcaactaaaatcttactgtagtgtctttcatattcaagtaggcataatataatgcaagataaggtggaatgttgactggataagtaaaaacacccaaggtaacctctttgatgtaggagggagaccttgagatcaggattagtacagtatcttatgttgtacttgtgatgtagacaaatcacagaacggaaaaatataagtatttatagttcagtataaatattatagaatgtatcgtcagatgaagatatagatactcttgaacaggacaatgaggtaaattttgttacatttcatggatatttcttgtctttgattgagtggcaaattaataagttatgcatattgtaaggctgctgcagaagcaaatcgttacattttcatgttgtgcttcctttgcttttctggtttacattctcaagatagcatcactcaagtaacataagctgcttcctttgctttcctggtgtacattttgacttatgaactgtatgttgcactcaccattaccatattatggcattatgcttctgcactaagcgcctccaataatacagatgaagatatgcaataactatatttcttggtacagaacactatgctttggaaatgatttcaagagaagtgagtgaaaactatctagtttgtgcaattgagatatagtgactactgacacacatgtaggtaaccttgtgtccaaacagggatcaagaattttctcaaaggttgaataggaaacatcaaaacaatccccccaagctgaccaatgggattgagatatttactacaaactcgtgaaactgagcaatacagaatgcaaaagaccgatgaagcttattagctgtacttttcagttttgtaaggacaagtgcactactatcaccctttaaccattggaagttgtaatgtttgttgtataaccatgcatctataaaaacactgcctaaaacctaaatcacttatttttttatgcaattctgccattggtaattggcacacagtattgcatataacgtcatcagatgtgcacccttgttattatgtacagaatgttatttgtgaaatagctagttcatacccatttgttttgtgaaacatagcatgtgttattttcctagcacggtgatctgcaactagtccactaaaacacatgaagtaacaccggtggcactcaccaggaacaggatcctaaatcctgaatcctaaatcactttaaaatgaaaatctactactggtaattccgtaattggtacaaattctacattatgccaagtattgcatataacatcatgaaacctgcatccttgttattacacagaattttatctgtgaaattgctagttcataccaagttgtttcatgaaaaatagcatttgttgttttcctggctgacaatctaccactagtctattgaaaagtgtagagtcaaacacaatggtagtatggtactgaccaggaactggatccggcgtcttctgctcagccgccttgggagcttctgcgcggaaaggaagccccttgtagtgaaccaggaagggctgcttgggctcatacagctccccgtcaggaagatgaatgtagaagccgaggacatcgccatcgccatagccttgctcagcgtaattggccctccatgccttgtgcaccttggtgccatccatgtcgcggtatccgaatccaaacacatcgtagccaacgggtgcgtggatgtcagcattgttggtagcccatccaaggcgggtgtggccggtgctgccgaggtgaaggaccttgacctcgaagtaccaagcgccggcagcgacgccgcgggtggcgcgcaccatccggtagccctttgtgctgccggcggtgaggcggtcgtcggagacctcgaccttgtcggacttgaagacgcgggagaggagcacgggccgatcgggcgcgtcgtcgttgcgctcggcggcgaatcggggcgccggggtgaggacgagctcatcctcgccgctggagggcttggggaggcggccgttggcgccgccgctgccgccggcgagggcgttggccggctgcttggccttcttcttgcccttgcgggagttgggcctggtccagacgctgttgctgttcttcttcttggacttcttgctcggcggcgccgggggcgcgagggccatgtgcttcatggcgccgcccaacgggttggtcccgtcgtcgtcgggtggcgcggcgacgcccgaggcatcagcatcggatgcatcggcgagcgcggcgtcggagaagggggtctcgggttcggcggaggcggaggcgggggtgtcggggagatttggggtatcggcggcggatggggtggcgtcggacatgggggtatcggcggacgcggggtggaacgcggaagggggtggggagggaggcgcatcgtcgtcggcggcggcgtccgccatggggagggtttctgtgcgatttggggtcggaattggggatttgggtggttttgctgctctctctcccgcggtttgggtttggtttgcgaaatcgcgagcgggaggaggatgcggtgcacggcacccggcacccggcctcccgcgagtggaaacggtagagcagtttgccgttttctgcctgcacaccgccgaaaatatatctctgcgatcactggagctagcaaaatcgatcaaaaactgctgaaacttgggctgcaaattgaactagaatcggactacatctgggtttcctccctggctcaacccgtactactgctgttctgggtgctcgaagcaaggtttaatcgttaagatcc

SEQ ID NO: 26946 - DNA, 3789 bp, Oryza sativa
cctgcagcccatcatacttgcataccaaagttgatttagcctttcctacaacaatagaagcataaaagtgaataatactagataggggaacaaaacaaacagtccatatacttatacatatcaatatcaggtaggagtgcatctccagtttattgttcaatgtggcatacttgaattcaagcattcaccaactagcccatttgtataaattgttctgctccgcagtccatagagaacactttcgttgaacaaaatcagcaacaagtgtggttcgttttttcagatctttctccagtaactaacacaagctatgatgcagccagtggaaaaccagatttgtcaggcctcaggtgtgatcattatacatgtgatcaaatgctaactgcttcatccatataaccattcagctatatccagtcaatactagcatgctgctacagaaaaggacaaagcaatttcttaaacgcctatatgccaggtttttttgtgtccatgctcaaagttcaacaagttactttggcatatcgatgctaacccattacatgccaaaggaatggaaactataggtttaaacatcatcacaggaatatgaaggataatgcgaccatcaacacaagaataacaccactaatcaaactattttatccacagtgcgtttagctacaatttccaatatcaacaactagacaactcgcaatgcatgaacaactgaatatgtgataaaataatgatgtatgagtgactggccacaaccgacaacaccaaaaacagatgaaactatttgaaattataaggatacaacataataaaataggaggatgcttgcttctatggttttcagcctgcacctctgtcttatgcaacataaaaaagctaatgtaagtacaataactgaacagcaaaacttgcaaatcagatttttttttccagtactgaatgtaccggctaccaggattttcctttcctggacatcatatttatggcacatggttacatacttacatgttcattcatattaatcataactagccaacaaaccaagacaaccctatactaactcaggtcccaagagattctcaaattacaccctaattaacctgccaatctcgatattctaatgcattcaaacaagaaacaaatgctatgcattggaaaatgcactaaatgactgaattagtgaaatctctaaatacaggctgggagggggaaggcaccacacggtgttgagcatatcctcacaaatttctaaagccacaaagctaaaacccaaccaacagttgacaaagataacaagaggggaaattggggacaccaatgaatacaacacaatttgccaggggtcattacaaacatgaaacatcataaaataatctagacccattttgtagctaacagtaccagcaaatatccagtcatcaatgtctagttgattgacccacaacttacattggaaccaaagaatgtagaattacaggagcgcacaattaatcctcctaattacgtcgccagtaatcagtcagcatgcgagaattcatcatatccctctattcgacaaatgatgaggacacgaatgactacaacaccagaaagaatcatcctaatcaattggccaaagcggaacatttgatacccaaataaaggccgcccaattcatgattcctagtcaaaattaagcgtacctagtcctcaattctcaatccacaacactatttgatcaaccaagaaccttacctagcatcaaaggaagggccaaacaagaactgaaaaattgaaattaccagaggcacggtgtctagttgtagtagagctcgaggcccatcccgtcgtggatctcgtagtccctgagggtgatgtggtccttgtagatgttgtaccacttctggatgcggatcttctcgggcctcgtcccggtctgcgccgccaccagcttcttgaggtcgccgatggtgtcgtcctcgttgcacttcacccgcaccttcttccccagccggtcgttcagcaccacctcgatcatcttctcctcctcctcctcctcctcgaactctctcctgctccctcctcccgaagatcacgcaaaccctagctcagtcctggccacggcgagacttggtgttggaagcggcaagggagaggagaatcgtgtggcctcgcctgctcgccccgctctcggtggaggagcagaagaatcgagaaggagatgagggagcaccggagcagtagcagtgtagcacgaatttttttcatttttagattttttttaatatttacagaaataatctatcggccaaaaaaaatacaaaaatagaccctgccgccccagtggtgggcggcaagctgacgtggcagacggcgggtcgaccgtgccgtctgccgccgtcggccaaaattgcaattcccccagagggcggcaaggggctaattgcaatttttgccgcccataaagaggttgcgctcgtactttttgcatttgggccccttgctgccccagtagagggcggcaagggacccagatgcaaaaagtacggccaaacgatttttctattttatgttaataataaataaagaagtatttattggtaaaacttgttaatattgttataaaaatgtattgaagttggttgtttcgcaatttcatatgttaaggaaggtattattttgtaacttattcgacgtattagtactcggataattaataggcctatcgcagtctcggttgtagaaacattatatggacttaaacaaggagaattatgtaacatgaagaaatagtagtacaatttgaacatgatacaactatttccattgcggttacatatatgatattagatttgaactaggagggaggtagtgcaatagttgaacacaacgacgatgtagtaatgggacaaggaagcatgacagtagaaatttcaatatgccaagttgtccgataatagctaacccctacgtgagtatccctctcctctctcaaaacgcgctttagtaaccctgtattgctctggtagttcaagctacacaacacggcaaggtggagttagaacccttctggtgtctatccattctttgtattgacatctccttggtggttcctaggaggaaagaatagatgtaaagcgagcaaagttagtaaatattgtgagaaaataaggattcatgtaatcaaaatattcttaccatgaaatcgtcgtcaagaatatttggacaaacaaagaaccttcgacccaatgttgtaggctttatggaacgaagaacctgacaacgatcaccacacctgcatcttggacgggcttcccatggagggagtgccgtagttagcacccgccagtcgctctgttgttcacgacattgtcgttcataagccgcttttctctgtaagtattgctcagtactttcggatgcgaaataccagcgaccttcttgtaaacaagtggttaggtcgaaaacgggattttctgtatcgacccactcgatgtatgcgcaagccgtagtgcgggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattagttggcatcgatcaccgctaggcagagaggacgctggcaccaatgtggtagtaggtatacacaagaatcgctacgccagtttcggatcctcaacaccccggggtctaacctttgacgaaagccggttggatttgtaatgaagcaagt

SEQ ID NO: 26947 - DNA, 19751 bp, Oryza sativa
cggcaaccgacggacgggattcggggtgccctaagaaaggagaagagagagattagagggagggagatgaaccacggcgaccggcatttatggccgaagtcagcggtataggtttaactcaccggagcacgaggggatgcgaattccggcgatgaatccggacggggaaggggtggccggggtggagcttagcctcgcaaacccgacggtgccgacggcgcggtgcggcggcgaccctagcggcggctagcggcggcgggagtagcggaaacggcagcaacgggtggttgcacggcgcgggagcgatggggagcacgagggagttcggcgagatggggaaaaagcgagagggggcgacggggaagcttaaataggggaggggagtcccggacgtggccggtaggggcgagattttgctggccaacgtggggagtgggggaggagagagaggcgggattcgaaaattgaatcccggccttctcgggcgcgggcgcgagcgcgagagagggggaagtgggtgcgggagatgcggcgcacgcgcgggcgtggccgacgcggcccggagaaggcggaggcgtgggcgtggcggaggttgcgggcgcggcggcgccggctaaaggaaggagacgggcccgacaggtggggcccacctgtcggcgtcccgaggagagagggaggggcggcttgggctggcccacaaggaggagggcgcgcgcgcggcggggtggactgggccgacggcccaagaagaggaaaaggagggaaaaggaaaaagaaaaggaggaaaagaatttccctgggatttaaaatattgcatgctcgattttaattggttaaaattatttcgagagctctgaaaattccactaaaaatcttgttagtgaatttcgacatgtagaactcaagaaaaattccacatgccaattccgattattatttgcattgatttaatagggttaactcttgctttgcaccggtattttcttagggtctcttattaattcgattttaggctaaggaggagaactcagggtgtgacaaacctaccccccttaaacggaatctcggccccgagattcggaggagctggcgaagaggtgcggatgggcggctttcaactcatcttccctttcccaggttgcttcctcttctgaatggtgactccactgaactcggcaaaacctggtgaccttgtttctggttcttctttcgctggtatcaagtatacgaatcagcttctccacatatgtcaggtcctcctggatatcaatgtgttccgaatcagcctgttcttcaagtactcttaagcacttctttaattgggacacgtggaatacatcatggatgccgatcatattggatggaagttctaactgataagcaacttctccccttcgttccaagattttgtagggtcccacgaaacatggtgccaacttgcctttggtttgaaaacggtgcactccccggagcggagtaacccaaagatacacataatcccctgcttcaaaagtgagctctcttcggcggttatccgcgtagctcttctgtcgagactgggcaattctcaacctttccctgatggttctgactttctcttctgcttccgttaatacctctgtcccgaacaattgacgctcgcctgtctgatcccagaagagaggtgtgtggcacttccggccgtataaagcttcgaacggtgccatctgtagactggcttggtagctgttgttgtacgagaattccgcatatggcaaacatctgtcccaagctccaccaaagtcaagagcgcaagctctcaacatgtcttccaaaatttgattgactcgctcggtctgaccatctgtctacggatggtaggcggtactgaaatttaaacgggtccccaattcttcttgcagtttctgccaaaattttgaggtgaactgactacctcggtcagatactatcttcttgggtaccccatgcaaacacatgatccttgcgaggtacaattctgccaatctctttcccgtataggtggtatgtactggtataaagtgagccaccttggtgagtcgatccacgactacccagattgaatcgtgacccgatgatgtccggggcagtcctgttataaagtccattccaatttcctcccatttctattccgggatttgaagaggttagagtaagcctgctggcctttgatgctctgccttcactcgctggcaaacatcgcagagtgcgacgaattcggctatttcccttctcatgctgacccaccaaaatttttctttaaggtcttggtacatcttggtgctgcctgggtgaatgtaatactgtgtctgatgggcctcggtgagtaccagatccttcagctccttgttgtcaggtacacacaatctttcccccatccagattgtgccatgctcatcctcaaggaaatcccgagcctttccgactctcatgttctttttcagctctgctatttccggatcatttacttgagtggctctaacttgatcgacgagcgtaggccgtgcttccagagcggctacgaacccgtgttcaacaattcccacgttgagatgctccaactcctgccgcaattcctcacacatgccctcgatgcatagagcagtgcagtaacttttcctgcttaatgcgtctgccaccacattggctttccccgggtggtagtgaatgctcatatcatagtctttgattaattccaaccatcttcgttgtaggagatttaggtccggttgggtgaagatgtatttcagactcttgtgatccgtatatacttcacaacggttgccaatcaaatagtgcctccagatcttcaaggcatgaaccactgctgccagttccagatcatgggttggataattcccttcgtgtggacgcagctgtcgtgaggcatacgccaccactctgccttcctgcattagaacacacccaagcccgtggcgggatgtgtcgcaatagacttggaagtctttcatctggttgggcagaatcaaaactggtgcggatactaatttcttcttgagctcctcaaagctcttatcgcactcagctgtccatttgaacttctcatctttcttaagcaactgagtcatgggtcgggcgatcctagagaagttctcgatgaaacggcggtaataacccgcaagtccaagaaaacttcgaatctgcgacacggtcttcggtggggtccatttggtaaccgactccatgttggatgggtcgacggccacaccctgagctgtaataacatggcccagaaatttgacttccgtcaaccagaagtcacacttgctgaacttggcgtataactggtgctccttcaacttctcgagtaccagacggagatgatgctcatgttcttcttcggactttgagtagataagtatgtcgtcgatgaataccacaacaaacttgtccagaaactccatgaacactttgttcattagattcatgaagaatgcgggtgcgttggtaagtccaaaagacataaccgtgcactcatacagcccgtaccgagtggtgaaagccgtctttggaatatcctcttcccggattcttaactggtggtagcctgatcgcaggtctatcttagagaacaccttagctcccttcagttgatcaaacaaatcatcgatccgcggtaaaggatatttattcttgattgtgacctcattgagtgcgcgataatcaacgcacatcctcttcgtcttatcctttttctccacaaaaatgaccggagcaccccaaggtgaagtacttggtcgtatgtaccctttctgcagctgctcatcaacctgcttcttgacctttgctagttcgttggccgccatcctgtacggtctcttgtaaattggtgcggttcccggtgccaaatcaatccggaattcaatctctcgcttgggtggcatggtagtgaggtcttcgggaaacacttctggttactcgcaaactatgggaatctcttccaatttcctcgaactcttctccttagtgaccactgggatttccgcctcaatctgattcaaggagaccccttgctttggtgagactaatgatttgtacactacggtttctcccttctcgttggtcaaagtgactgtgcgattcgcacaatcaatgactcccttgaacttggtcagccaatccatccccagaatgacatctaggtctttggaatcaagaagaatgaggttggctaggaatggtgatttttgaatttctattgttatagaagggctgaattgtaccgaagtggagctattccctggggtatgaacccgcatgggtgtgctaagttcctctcttattaacccatgcaccccgacaaacttctttgaaatgaacgaatgcgttgcaccagaatcaaaaagtactgttgcagggattgagttaacaggaaacgtacccagtacgacctctggtgctgcttgtgcctcctctgcggacgcatggttgacgcgagcctggacaaaccttggcccggtatgcctgggcttcgggcatttgtcagcgaagtggccaagctcgccacagttgaagcaggaccctggttttgtgccagtctccttcttggcttgcgcggacggggctgactgtgttggtgccattggtgggcgtggagctgcaccgcggttgggctgacctccatggtgctgactgccactggcgccctggtggaagttgcttgagttgaacgggcggtgctgcggacgatcatggtggtaggtccaccctgctatccgggagtgaagcgcggtcggtgctgactaccttggttggaccggagctgcgccgcctttctcttcccgtccattttgttgcgctgatcctcctgacggattgccttgtcaaccagcctttcaaaatcagcgtagtccccagatatcagttggttggtcagctcgtcatccagacctgccatgaacttttcctgtttctcggcgtcagtgcggacatcctccagtgcatatcgcgcgagacgattgaactcgtgaagatactcggtcactgtcctgttgccctgatggagtgcccggaattccctcttcttttgtgccacgaccccgtctggcacctgcgccttcctgaagctacgacagaactccgcccaagtgacttcagtgcctagcgggcgggtggccatgtgattgtcccaccaagctgacgcgggaccttgaagctggtgtgtggcgaaagcgaccttctcctgatcattgcactgcaggagattcaacttcttctctatggcatggagccagtcattcgcctccatggggttggtgatgctggagaaggtaggtggcctgacgcgtagaaactctggcaacttggactgagggggagggggaccaaactgctggtgctgttgttcggcatgctgcagcatcctctgatgcatctgctggtgctgctgctgcatttgctgcatcatggctgccatcatctgagtctgatgtgccataacttgggccagtgtcggattctcgggaagtggtggcggaccattgccggaatcactgttggggtgcacaccatcagcgcgttcttcgccgttgctgccctcgccagtcgtgcgggtgccagttctggtgtagaccatctggaggaagggcagacggggaaacggagaaaaacagatgctcaggaactaagctttattatatagaaatttaaactgcaattgttctgatctgaattaaaacactttaaacagcaagcaaaaatccttattgggacagccatatcataggcacatgatatcgaccatcgactgaccccaagcaagcaacctaaacacacaaactaacaagcagaaactagacagtcgataagctaatggaaaacgagcctaatgctcggaacggctcctgcggtcggtggagtcgaaggcgtcctcctgctcatcaccaggtccctctgagcgactcctagagcctggcagataagtctcgccgctgcctggctctgagccactggagctgctgctgctgcggtcacggctgccactgggagtagctggcaaccaacctccgttgccactggcggggcccctgacggctgatgcaggtgcgaaggagagcgcggatgctagagctgacatgggaacgggagctggagctggcgctggagctgcaggaactgctggagctgcgggtggaactggaggagctgctgacggaggtgggttcctgggcgcaagctggacgtgcacgggtgccgttgtcgacttgcgaggcgtagtgcggatccggactccccttggcgcgggaagacccttcaactgagcattctccctcttcaggcgcgctatctcgtccttcagagcgacgatcctcatgagcttcccatcattcaaggccttggacgccttgtgcaggtccgagtgcatcctgtccatccccctcatcacagcgcacatgtgaccgaaggtggtgtcgttctcaccggctgtcggacggaaagaactgacatcgctgccgctggctcgacgagggtggaagcggtacgccgtgtcgtggaagatgtagttgtggcgctcccatagtctggccatcatcaggtaggctgcctcctgacatgcgtgatctgctgtgcctcctgacgcctcaaccgccatgttagcgaggcaagtccccacgtagccatggacctccaagcggacacggtgaggaagctcgccactgagcggtggaatagtcgtgtactccggtgcgttggggtagcccaccaccagtgtcatgcgtgccaactctgccacgaagtcatccatgccttctccgtggtggttgggtgggtgctcggccatctggagaagacaaaggggtaggatcaatgcatgctcaaatccaaattaaataaagcaataaaggactcaaataacagaatcgaataagagcgaaattttatgcatagatcattttgcatgagagcgaataaataagacggacttacatagaggtaaaataatggggaaattagatacatacttataataacaataaaagcataaataccttacaacccatattcctgagctaaaacctagtgcattcgcccatcaaatcccaactgacggtcaaaaacatctcaaataatttttactaaaaccctagaccgacttgttttgacaaatctcacttaaacgagcgacacgatttttcccttgaaccacaagaacagatcccaaattttcccggaacaattccaattgcaaagaacttatgcaatgaaaaggattcagagggctcttaggtttccatttggcttgtcctacggtcaaggtcggctctgataccaacttgtcacgcccagaaattcccaaatagaattccaagcagaatgtgcattaaaacccccgtccaggaccggccggggtacacaaacgacaatgttgacatacagatccacgtcttacaaacattataaaagtcttacataaatgcagcgaaaaaacaaaagataaccggagctaatccttgacttgaactgcagcgggaacaccactccacaggcatcctcgacggcacggacgaagcctactcctcggagaatccgccatcggatacacactcgacattgtcgttcataagccgcttttctctgtaagtattgctcagtactttcggatgcaaaataccagtgaccttcttgtaaacaagtggttaggtcgaaaacgggattttctttatcgacccactcgatgtatgcgcaagccgtagtgcgggtctgccgaatagagtagtgttacgaagaataaagcgattgcccatacggaatgaataagcatatgcagataataaaatacctcacggtcatagttagggcacctaaaaaagcgtcttcctcgaatatcaggattcctcgaagccattagttggcatcgatcaccgcataggcagagaggacgctggcaccaatgtggtagtaggtatacacaagaatcgctacgctagttcggatcctcaacaccccgacgtctagccattgacgaaagccggtaggatttgtaatgaagcaagtggggaagagagtactgaatgtgactgagttctgaaagactgtgaggcctcactcgttaaggtgacttatataggcgcaaaaaatcgagtgatatccctgacatgtgaacgtggcggggcatggtgggtacgcctgatcggcgccgaaagttacattggtcgtatgcggcaaatggcgggcaaatactcgtatcgcacgcgaataaaagaggctgcatcggtgcggcagaaagtagtcgtgcatgcgccgaaaggtatcgtgcacatataatgtcacgcccagaaattcccgaatagaattccaagcagaatgtgcattaaaacccccgtccaggaccggccggggtacacaaacgacaatgttgacatacagatccacgtcttacaaacattataaaagtcttacataaatgcagcggaaaaacaaaagataaccggagctaatccttgacttgaactgtagcgggaacaccactccacaggcatcctcgacggcacggacgaagcctactcctcggagaacccgccatcggatacacactcgagctctgggattgggggaaaatagagcaaggctgagtactatccactgtactcagcaagtcataccggaaaggggggtatgatgcagggattcaacaagggatagctaaacaggttcatttgcataaatactggcatttataaacaggaattgaatgcgaaaacagttgtaataattaagcagtattaatcatccactgtccaacgttacaccacgttgcaacaggcccaaccatccacctataccatccaatttcattagactaaactaaggtgagtctaatcacggtgagtctggttgaccgcccataaccgcgggcacggctattcgaatagttttactctgatcagaggtgtacaactgtacccacaagacacagccccacgacacgtttccgtgcgtcgacatgccaccacgacataccggaaagaggccgtgacaggacccttcgcataaccccctctagccaagcacaccacacctcaggtttcacccccgttcccagcgggcaacgggcagtcccctctcgtgcctagatgaatctggaagcgacagaggccgtcgcagggcccgccccgctccatcacgcccacccttgcctggatgcgtcagctagagaaaagctacactacaagcccagccgttgcccacgctggcttgtggtaagtacgataagttcttccagggtttcccgcgaaccggtccttaattgccatgggcgcgactagcaaaaccatgcacccacagcccaccatgtgattcattttatttaaccaacaccagagcggtggtactaatccaacattatcatataaacctatagtctaggttttaaatgagatttccccattgtgtgctagttgaactaagcatggctaagcaattcctagtccaaagtctaatcatgttataacccaagctaacaaaggagcatggtatccaaaaagcatggctgtaacaataggtaatcatcccatagtataattgcaaaacaaatgcggtatttgaaagaaaacattaggacatttgcaatataggatcaacatgatcaagtgacaagcatgacttgccttgctctgctgctggaggaacctcggcgactatttcaaaatacaccggagcgtcggaagagccggaatctagcgacatacaaggcaaacaatgcaaacaggctataagactactgaaacagagaacaaaaccatttttaatggattctacacatttttcttgatttactgagacttgaatgggcttaaacggagctcggatgaattagttatgaattttagaagattcactgtgtttattactataacaaaaatccttaaataatttattgcgcaatattttccagggctgacgtcagcacggggggaggcgcggcgccgacaggcgggccccactggtcagcgactcaagggggggcggttcaccgtggaccgggaccacacgggtggtccaccgccggtccacgggaccgatggcccagatcgccctcggggccgatcggacgggcggcgataaaggcggccgccgggctcggctcggcatcaaagccaaccggccggccagggctagcggcgacgcacgcggccgacggcggcggcgaccggcggcacgggaggcggcggcaaccgacggacgggattcggggtgccctaagaaaggagaagagagagattagagggagggagatgaaccacggcgaccggcatttatggccgaaggcagcggtagaggttgaactcaccggagcacgaggggatgcgaattccggcgatgaatccggacggggaaggggtggccggggtggagcttagcctcgcaaacccgacggtggcgacggcgcggtgcggcggcgaccctagcggcggctagcggcggcgggagtagcggaaacggcagcaacgggtggttgcacggcgcgggagcgatggggagcacgagggagttcggcgagatggggaaaaagcgagaggggccgacggggaagcttaaataggggaggggagtcccggacgtggccggtaggggcgagattttgccggccaacgtggggagtgggggaggagagagaggcgggattcgaaaatcgaatcccggccatctcgggcgcgggcgcgagcgctagagagggggaagtgggtgcgggagatgcggcgcacgcgcgggcgtggccaacgcggcccggagaaggtggaggcgtgggcgcggtggcggttgcgggcgcggcggcgccagctggaggaaggagacgggcccgacaggtggggcccacctgtcggcgtcccggggagagagggaggggcggcttgggccggcccacaaggaggagggcgcgcgcgcggcggggtggactgggccgacggcccaaggagaggaaaaggagggaaaaggaaaaagaaaaggaggaaaagaatttccctgggatttaaaatattgcatgctcgattttaattggttaaaattatttcgagagctctgaaaattccactaaaaatcttgttagtgaatttcgacatgtagaactcaagaaaaattccacatgccaattccgattattatttgcattgatttaatagggttaactcttgcgttgcaccggtattttcttagggtctcttattaattcgattttaggctaaggaggagaacttcagggtgtgacatataacaacaacgtagtcattacacaagcatacagtactggaaagtgaagcaaataaacaaagagaagactgctctactggccctgccccgcgccgcgaccacgcttggtcctccgggcatgtgctcgcacgtggtcctgggagcaggtgaaacgatccggtggcacagcacgggtagcacgagagggaagaactgcctggaaccgatccctaaaatacctacatgtcccatgtaaaatgaactccactatgccaactagtggcagtccacggacacccagttgtaaacttctgccaaatttgttgtcattattccatatctagcaccacctgtgtcatacgccttggcccatttctcttttggttcatgcagaatccattgaaaaaatttccgaatctccaatccagttcttctaaccaatgttggactatccgttgggagaggtccaagagcttgaggagggtcagcatcggcggtcgatggagccgctgcacgctgatcactgcatttggctgtcaactcatcgaatctcttccaaagctcattgaattttttctcctggttctgattgcatagcctcttaaacatgttcataagctccttgttcttgaattgcttgaagaaattagctcccatatgacgcatgcaccacctgctctgtacatcttcccactcaccagggtatcctcattccatactcccaaactgcaactcttctatcgctcgcagaatgccagcgtgcctatcatgtatcaggcacacatttggcctcataccaacaactattgttttaaccaatttcaggaaccaataccagctgtcggtattctcactctcaacaaaagcaaatgccaagggcaatacctgattgttcccatctacccctattgctgttagtatctggccccgatactttcctgtcatgaatgtcccatcaatgcagagaacaggacgatagttcacgaatgccatcttgcatgcatgtagagctaagaacgccctttgcagcacactcttgccaggatgttcaattgaggggaatttcttcacttcgtaagagctcccagggtttctttcctcgataacaccaagcaggcgtggcaaattgtcatacgaggcttcgtaagttccaaatctcatctctattattttctgtttggccctccaggccttggcatagctaatagtatacttgtatgtctcttcgatgtgtcagattattgacattggtttatatgtgagattatcgatgacatgcgcatacatctcagatgcaacaaatgcacatgtaatgttcctgtggtatttctgaacactaggtagaaaacatgtatgcttggtaacgactgacaatgttcaataatccttccatttccccttgtacgcgtgcattctccagggacaaccatctttttccttaacacaccgaacttcatattgcgaccggttggacttggcaacccaaaactctctatgaagtgacactgcaaaatgttttaccgcctccttcatatcttctgctctactataaatcgctccctgaataacctcattttctttgtactcccatctcacactatcctcttcagagacgactagcccagaaaaatcctcactagcccattctgttggattaatatccgtctcatcatctgacaaatcaccttcctctacacgctcgttgtcagaatccttcctctccatttcatccacaatggcaccgacagtctccccctcgtcggccactccacctggttgaatgcccactggagctactacacccctgtcctctcgtgcgttgacctcctccacagaagtctcatttacttcagcacttggtccctcaccatcatccatgttcatctgcacacatggatccttcgggtgaacaaacgaaaccatagctagaggccacccgcgttgcaatgcattttccacataccatctccacactcgagagttttgaactggcattagttcccaataaaaaccctcagctgcccgacttactataacattgattgttatgtcacttgtctgtagatcaactctcaagcccctcattaaccatccttttatagaaggtacactctcctcagccggtctatcaattcccctttctgatacaataaaatctgacagatctacccagttggcccgtaacggacgtttcctgggccatggtaaacttggaatatttgtttgttcgacatatctgtcaacgaaataactagatcatattactctttcatgcaataaacatctacaacgtaatatcttcttgtgtatgccaatgcaacggtaaagtattgattccaaactagcagatctacatagttaccgatatctacaatacgcacttctagattagtacaactaaaaccctaaaaatataatgcatttattcaaacaaagttttaaaaaatacacactatttaactcaatagtcacatataggatctatgaatattacctgaaatcggcgtctgaatccggcagggcttcgccccttcttctcttctcctcccctttcttctttttttttcactagatttgagggggaggaatgagggctgggggctgggcagcaggccttttataggcagcgaggcttgccgcccgaccagagggcggcaaggggccgcctgcaaaatggtcggccccgactggcttttttgcattcgggccccttgctgccccaacagagggcggcaagggctttactgcaaaaaaccctccctccgtcaccgtccgtccctcccccgttcgccacatcagcttgccgccccagaggtgggcggcagggtctatttttgcaatttttttggccgatagattatttctgtaattttttttaaaaaaaaaatctaaaaatgaaaaaaattcagtgtagcactgctagattgtgatggccgatgggctgtatgggccttgtctacttaatggactatagtagacagttctgaataagttcacttgacgttcctcatttttccgtcgagtttatatggaatccctaaattgcaatatcgaaaatcttggaataagttcactttgactctctgttcgtatcttattggtatctctcaaccataataccggatatctcaacctcctaactattaaaattggtgtaatttgactcactcagcggttttggagggcgctttcccttatgtggcacctacgtgaagtttatactttttaattctaataatgccacgtaagcgtcacatcaacgtcatgtgaaacgaagaccaagtaacaccgccatgtaaccaccacatgagctaaacaaacgggatgcgaaggcacatagtcggattggggatttagggtggatccgagtcggaaccaacagactgcgagaggcgctcgcaccagaagcgcgaggcggcgcgggccggggaacggccacgttcaggcagcggggccaggggggacacgacgctgcccatggagcaagtcggcgcgcccatgaagcagcggtgcaactgttgcagcgctcgccacggggacggtttaggttgtgttcttaagggtgtgtttggttgcaagccacactttgccacagtttgccacgcctaaggttaggcaaatttgacaggtgtttggttgtagccatagttgtagcaagattcccctccaataaattgggtcccacgtgtcaatggctcaaaaaagtgtggcaagattctcttaggcttagtaagttgtggctaacaatttgatcacctcaccttaggcaagatgtggcaacttttgttggcaagtaatggtaaagtgtggctgggaaccaaaaagcccctaagtccatgatcccaacctcactctctcgtttaccgcgcgcacgcttttcaaactgctaaacggtgcgtgttttgtaaaaaaaaatttatagaaaagttgttttaaaaaataatattaattcatttttaaagtttttaagctaataattaattatccacgcattaatcaaaaatgcttctatccggacgtccgatcgaacataaaaaaatcggatgcctgcgcgcatgtccttaaaccgtgtaataagattaataatagtgcccatcgcaatccctcatcattctccctctcatatttatattgcgtaggcatttttctcttgaagtagcctatgtaactgctctgacataaagtagcccatattctctctctcgtatgcctctaccgctttgacataaagtagtctatattctctctcgtatgcctctactaccacacatgcttctactccttaatgaataactccaaataatcttatttcacaaattatttatctaatccgtaatctaaatataccattgtattcaccgcaattaaatcttcataacaagatctcacttaactatattttggtaattttttaaaaaagtttttttgttgtaatggattttttagttgttgcaataggtatttaataacgtttcaataggtcatttgggaatgttgcacgaggtgtttttttatgtttcaagaggtattttgtgatgtcttcgattgatgtttcactgtatcattttttaatgttgcacgtggtgttctttaaatgttacatgaggtattttgtgatgtttcagctaatattttactaggtcattttaaagtgtttcacatggtattattttgatgttataccaggtactttctgatgtttcattaggtattttgtggtgtttcagcagttacaactcattgttttcatatataatataaaaatgtttcagttatgaatgtaattaaaaatatataatttattaaaaatataattatgtgggatctctttgaaaagatttaattgcaacgaattcaatggggcaatcagattaaaaatcggataaataatttgtaagaaaaataatttatagtttgttaataaaatgcacacgataagatatttgcattcacaagaataaatgagagagaaataatgcgtgtatatgaaggctgatagataaaaagtgatacgtacatggtgcatgttggggatgcatgatgcgtgccgaggagtggccgtccgattttttctcataattcggacgtccgatttgcagtggctttccgcattaatccattgctccgttttccgttttccatagaactccagtaaatccgtgtgattggggatttggggtggatccgagtcggattctctctcgattccgatcggccgggacgcggagtccgatcggtttcttcatctataaagtctgcaggtaggggcgcgtttatctcctgatccattccccccaactcaaccgctgcggcgttccgcccttgtcgatctcttgtgcagggagggcggcgtgttgctgctgcagatggaggaggccgctgcggtcgcaagagggctaccaagggatttccctcccatcgagagctacgtcgatcgtcacggcttcttccataatagctggacggttggcagccgtagctactccagcatcatgtttcgtccaagaagtacgccgccattaacgctcgcagaagttcacgagagcactcgcgaggacgtgagggaggccatcagtgagggggtgatacgattggacagagccttcttccaacagcttcacgatcatatccagcgccagccccgtggcactggcactgccatggatggagtagtagattgtcaggatctcaagaaatcaacaagagaaacaagaacacacaaggattcaggcaactagtttggattgatctgctccaacccaacaggattgagccttccgccgccaccgccaccgagatgccaaatcatagttgtcttcctcgagttcatcttatttatacagtagcatctccctactcacacgacacacacagtagccagctgtacaacagatagctgggctacgcaacccactcggacccatggtaacgaggattgggctttggccctcttgtgggtcttgctcttcctggagtagtagtctgtatctcctctcctggacttcagcttctgcttcatcaggttctccttcttcaggttccttctctccctgttcagcttctgcttcatcaggttctccttcttcagtacccatagtgacaggcaggttcctgacaatcccctccccatgaaatttggcttgtccccaagccaaggctccagggaaacgcatcttcaaatcttccagatcctcccatatggcttgttcatgctgtaaataagatcgccaatgatcaattgccaataaaatagccatacattccttttcatatgtagaaagtccaatagttctgggccctagggctctgctaatgtaagctataggatgcttatcttgagataatacagctcctatcccacattcactggcatcagtctccactgtgaaagttttctgaaaatctggaagggcaaaaactggagctgaggctaatgcttgtttgagggtgttgaaagccttgtcagcttcatgtgaccagacatatgggattcccttcctcagcatctgtgtgagaggtttactaatgattccaaagttctttacaaactttctgtaatagcctgccaatcccagaaaacccctcaatttcttaactgacacaggtacagcccaatctaatacatcctgtattttagagggatcagtggaaacaccatgtactcctataatatggccaaggtaagatagctgctgttgtgcaaatgaacatttactgattttaactctccactgatgttccttcagaagttgcagcacttgtctgatgtgatccaggtggctagaaaaatctttactgtagatgagaatatcatcaaagaacaccaagacaaacttcctgagtactgacttcagagtgtcattcatagctttgagaaatgtggctggagccccagtcaatccaaaggacatcaccttatactcatagtgtcctgagtgagtctgaaaagcagttttgtactcttctccggccgccatcctgatttggtggtacccagaccagagatctagtttggtaaaccactgagcaccagtgagttcgtcaagtaattcctctatcacaggaacaggatatttggttttcacagttatggcattgagctgcctgtaatcaatgactaacctccatgtgccatttttctttttgacaagtattgcaggagaagcaaagggactttggctatgctgtatgacaccagaactgagcatgtcagaaatctgcttctcaatttcatccttgagagctgggttgtgtctatagggtctgaggttgattggtttagctcctgggacaagggtaattatatggtcacatgttctccttggtggtaatccctcaggttcctgaaaaatctccttataatcctgaataatgtgttgtacctggtctggaatgttaatatcttcctgtctagttataggctgcagttgaaccaggtactgagtgatccccttctactcattccattcaattgatggcatgtaacaggtgaacattgcacaggagtggacagcagtccttgtaccctgatgctggcacgttgatgattgaattccatccacttgtttgcccaatcaacctgcatagggctgatagattcaagccaatccattccaaggacgatatcatagtttcccaagggcaacattctgaaattgttgcagaactgatacccctgcatccaccatttgcagttagtaatttcatgtgtgcaactcatagttcctccatcagcaatcctaacaatgagaggttgttttagtttctgaattcctgataacttcagacctacttccttatcaataaatgagtgtgtgctaccagagtccaccaacattagtaattccatatcctgaacccaacccctgagtttgatagatcttgtggactcagttccccaaactgcttgctgtgaaatggccagtaagactccctgctgttggatctcactatcttcaggactggaatcagggtcagcttctgaattaacagttagagcttccaataattcctccaccacatgtaactgtatagaactggcacatttatgttccttgccccatctttctccacatgtaaagcacagacccttagctcttctataggacctcagagcagccaatttttcatctctggctctagctgcctctatacctctcctgtcttcagcactggtattgctggactttgtattgagcggattactgtaattactgatgggtctactgcccttaattccaagtactgagtctgatcttttaggagctggtgatttaatcccttcaattgcctcttcctgcaacagagcaatagcacaagctgtatcaagatcctggggtctttggaccattaccaccaccctaatttcatctctgagcccttcaacgaacttggtaataaagtatactggaatcagggaggagtcatatgccatcagttggtgcattaaaccatcaaacttctccacatactcagctacagtaccagtctgatttaagtgaatccattgtctaatgagggcc

SEQ ID NO: 26948 - DNA, 929 bp, Oryza sativa
agctgcaggaagcgcaggtgagcgaggcgagggagagcgactgcgctgtgtgctttgagggcttcgaccaaggagagaagctgacgaggatgccctgctcgcattgcttccatgcgacctgcatcttggattggctctcgctcagccatctctgcccgctctgccgattcccgatgccaacggggcagtagtagccatcagctacactattgtctgaaagtgtcttctagagtgattggcaacggaggaactgttctgccaacgctcaagaaatcttttgttgattggcaacggagaacaatatttaccattacgaatcccacacctgaaaaattgaaaagaaaaacagataactgaaatggttaaaagtagtcgatcattttccccagcccaatatccatgatgaaaatcaaatggtcctgatcatctagttgtcaccaaaatcaagtaaaaactattcaaataaatttatttcattttgtgcttcacttgaaaaagtaatcgacaaatctgagcccatgccaaaaaaaaatatagcctttgtgacaccaaacagagaagaaaaaacgtactccttaatgctaccccatgatccatttctacacaaaatggaatgctcattaacatcctaataactatatgaaactccgcgctttgctattagtatgaatcagtaaaaatatcatagctagacatcttaagcccatagaatttgtatttttattgatcattggaaaaaggttataaaccattatgttgatgtggtttatgataatttaaatagcatatagattgataatccaaaagtaaaagtaagacgatatggcttcatgagagaagaaaatgaagaaaattatttaggctatagattaatcatctaaaggttagaaacaaggcaaaatttgctataggacacttaaaaatgcgta

SEQ ID NO: 26949 - DNA, 4458 bp, Oryza sativa
tggggatcgcggtgtccttcttgtcgcgcgccatcgtgcctttcgcccgttcctaggtggcggaggcagcaagaaggctagcaagaaggctatctcgtcgtcgtcgaggaggaggaggaaggtcgggctggagctaagcttccacgcggaggacggtgtgtggaggaaggagatactgatggaggagcagtgccagtcgttggacttctccggcatgatctactacgacgtcgcagggaggcgtctggagcagccgccaccgccgcgcacgctgctgtgcagcccgctgccgtcgtccatcaagctcgcagccaacgccgctggcggctactagccagagacaccccctgctctcacgggcttgcagcaaatctctgaacttttggagcaagcttagccagccgccttcctctgctttcttgctgcttttaattttaccttcttcgacatagcaataggtctctgcttctgatctttctttttctctccttcccttggtgtgtgtagtgacaagtgatcacagatcagtactatataaaagagttctatggaagcttagcttatgttttctgaaactagctcttgttttacaactcccactgtttacaactataattttgaatctttggtcatctagttgttcattagtaccatttactctctgactactttttagctctgcttttgtcgccgaaatccatgggagctccgccgccaaggaacgtctcggcgacacgcgcgggcggtcagcggggggcttgggggtggggacgaggccggtgccaacggcatgctacacaaccacgccgtcgactacgcgctagcacctgtccaccatgggcaagccaatagagcttgctacatgtgagcatcggaactcggaacaaactgaaagaagggaaaaaaagataagggcaaaattgtcattttatgtgatttctctctcattgattgagtggatattatattttaatgcgttcagtatccagcagcaaattaccagaattttgaagtgttctcgagcaaattcacatctttataatgttccacagctaattacgtatttttttgagtgtccttagcaaattttgcctagaaacaattgagatgatatgccatatttatgggcgatgcgcaaagatgggcatgaagaagaggtggaaagctattcggtggataacacctaccataagaatgggatggtgatcgaatggtgtgacggggttatgtatttagataggctcttgaaccggtagcttcactttggtatgaatagtcacggtgccatcgccgccgccaccaccaccaccaccatacaacctactatgatggcgtacaggaatggtagtttcagtgatgtccccgcgtacaggaacagtgggttcggtgctgtgcccgcgtcgagcacggccatggccgagctgcaggaggcttgggcgagcgaggcaaaggagctcaattgcatgcgctgtttaactggaggtctttgaggtgggagagaagctaacgaggatgtcctgctctcattgcttccgtgggccctgtatctcggattggctaagggtaagccatttctacctgctctgccaacagaagaacaatatatgaaaataactctcttttctgtgagaatttaatttcgtttgttcgttaaattcaaagaaccagcatgttgtttatttttggattcttaacacactaaacctttcttttaaacctttatttgtgatgaaaaatacaagggaaaattgtgtaccagtgtaacctcggcccaagcctatataacccatagcagtgaaatgggccaagattaataaacatgggaaagtgctgagcttttactggccaaaatcgtgatggacttcgagccactcccctcagccgccggcgacgccaccgccgacgagactcctcccggtcgcgccgtctgcagctccggctgcggccgcccaaccaccgtctgcctctgcccgtaccttcccgccacgccgctccccacctccaccaccgtcgtcatcctccaccacccgcacgccctccgccgcaacccgctctccaccctccccctcctcgcccgctccctctccaacctccgcctcatccccggccgccgcctcctcccttcctccgcccccgtcatctctcgctctcccgtcctcctgctcttcccttcgccggacgccgccgacctcgcttcctggtgccgatccacgcctccgcccgcgcgcgccaacccgacactgctactgctcgatgggacatggaagcaggccaaggagatgcacgccgctagcctcccgttcctgtcctccttcgccgtccccgtctcgctgcccgtcgactgcggcgttgacggcgacagcatgttcgagggggagcttgtggtgaagaaggagccgcacaaggggtgcgtgagcactatggaggccgtcgcgagggctctgcggctgctggagccggaggggaggggagaagagatcgaggagacgatggtgggggtgctcagggcgatggttgccttccaggctgagcatttgcagcatcggccgatgaaaccgagggtgaagatgaggaagaagaaggatattaagagggaggaggagatgaagaggaacacattggactggagtgactgaatcactgaactactgaagcatctctggacacattggactggagtgactgaatcactgaactactgaagcatctctggacactggacatacagtagctcattgccgaatcgttgctggtcattttggaggaatatcgctaacattatcaccaatgagcaaggtttgatctcttttggaagcatagtctacggttactagttctttatgaaaactaagtgagatgattacattttgatggctgtatctcaaaaattgcagcaaccatgcatgtttgactgttcgaaatgtttcaggattcaccagagtacctagatagactaaactataggaggatcatgaatcatgctgttctctgttctgaagacacttgtagggctgaagttctcattggaacttaggaaggaatgaactttatatttttccagagtaaacaacactgtttatgctactagatagcggggcttggggggtctacatgaacaattcatggtaattaaaggaattgataatcatcatgtagccaatgctaagcttgaccataccgcatatgtgctgaactcctgcttggctttgttctgcatcaaagaaaattgtatttgtttagattggtttagaaatgtttagcaatgttgtgctagctagcaattcagaaatgttcagaaatatttgtttagattagttctgaaatgttcaaatatgttcggaaatatttgtacagattatttctgaaatgttcagaaatatttggtccgactagttcagattatttcttgaattcgtataagttcggtatgttgctatgtatgtttttcagatgcacatgtacagaactttacaaatgtagtggcctagactagagcagtgtattgatcatcttcttttagaggatttatgagaaatattgtaagggctaaagggcatgacaattggtagtgcccctgtggggttactttcagtttcagtaatattaacctgtatatctgtacatgtgctagttatacagtaaattatctgctgtagctagcaactccactataaaacatgtcaaacttggcatattcttaacttgatgcaatacatgagagttactgatcaagtagtattcaattttgtaggcagatgctcacaagaatattcatgacttttgtgatttctgtaaacttgttcttcggttacaagaaacaaatgcgtaggttgatattgcctccatgattatcccaattctttatttgtttgattatgaacaaaatgccgtggagtgcagatttttgtttgaagtgcaggacattcataacagtgtactagtggcatgacatttggtttgttgcttactgagtgtgctccttccttttttattttgcaacttatgtgaccttgaccttttgtagtgatcaagagaaggagagggcaggagatgctttaagtgtttcttgagcaatttgtgcaacaggtattgggaactgttcttgagttttgcttttgcatgcaagttggagatgatatttcttcgacagaaatatgaggcggttgaagatggatttctaagcagaatgtgggttgaatgcagtttactgatgtcagattgttttggagctgtacctatgattttactgggttagatttccaaacagtactctgttgtaatgttctcttgtttgatgtaatgcttttctgccactatatgagttctgccttagtgaaaactaggcacaatctaaaatttcttgcgaggtgacccaagtcgttttgttaactttttttttttcgagaatacgctcaaggcttgcgtatcattgtatcacaagtgacgccgggggggggg

SEQ ID NO: 26950 - DNA, 10027 bp, Oryza sativa
gggggggggggggggggtctgagcagcccggagggccgcttccctccccctcaagctttgctacctcggcccaggatttgctaagggcctagacctatattacactacgacatgggtatgtaggggagtcgcaccgtagctatggccagcgccatggcatgccacaagagaggatccaccggtcctcgatcatcttctcctcctcttcctcaaactctctcttgccccctcctcccccgaagatcacgcaaaccctagctcctgaccacggcgagacttggacagaagatcacacaaaccctagttcctgaccaagttggaagctaaaagcgagaggagaaaggcttggagttggaagctaaaagcgagagcgagacttggagttggaagctaaaagcgagaggagaatcgtgtggcctagcctctccgcctgctcgccccgctctcagtggagttatggacgagtagaagaatggaataaattcattttatgacccttaactttgacagctacttcgattttcgtcttgaaccgatacacccgatatgttaaaaccagtgcaatatagattttaaggtggtttgaacaacggtttcaactaacgtgatgtctacgtggctaatttgatttggtctttatctggcgtggcatcgacgtgtcacattaagcaaaattcaacaatttaaaaaataaaacaaaatatgtgggcccatacgctagttaaataataagattaaaaaataatgggatccacatcagtgggcccatttccttcacctcatcgcatcaattctctatctcctcccatttcctcttttttcttgctccgactacggggtgagcaccagcgtgtcgaggttggactgcagcttccgctcgtcgcgctgctcctttcctcgttgttcgccgtgcctctccatgccgccctcggcggtggcggtttgcgggggcatgcgcttgacaagaggtcaccagacccaccaccaccatcttcgcctcgaccttggccgccattgtgccaagttgagctccgctcacatgcgtgtgcccacacacacacaccgatttaagaacaaatacttaaaaataaaatacaacgaaaaaaaccataaagcttataagctaaatcctaaatgatgggttgtcaatgttgagcaagaaaattgacattctaccattctcaaatgggtgctttgctaaaataccactccacaattgaaattcgccagaatgtcactctcaactgggggctccgcccaaatgtcattttctttcaattaaaatagttgtccctttcctccatctttgatgaccaaaatgcccttggttgtgtggcggtgtgacgtagaggcgggctagtgagcgtgagcagcagtgtggcgacagaggcgcgagcaatgggcggtggctggatggcgcgggaggaggtgcagcgacggacgacgcaaggggaggggcggcggagaggcaaccagcgaacgcgagcagtagggtggcgatggagaggcatgaatggggatgatggttggatggcatgggaggaggtgcggcgatagggcggcgcgaggtgggtttaactatttgccactcttacaaagtgacactcttgagatgccactcttccaaatttctttacagaaatgccacaaggagagagagctaatatttatgaattaccaattttacctaattagaacgccatgtcagctttgcaagtatgataggagacttaaaatgactcttttacccttgggtcaaagtaatattgattatcatatgagataaattattatggacaaatattcattgaaatatgagggaattatatacaaagtttgtatacagtattcgttgaaatatgagagaaatttatacatgatcttgttatgcgtacacaaacatcaaccaggaaacagacacaagtatgtattaaaacagacaattggtagattaatttctcaaatcaatctactaatttcgtagatatatgcgagatatatctacataggtacgcaatattttatatacaatttatcgtaatcacgtggttttcatatataaatgcaacaccgccttggccaacaggagtagggctattacatgtgtgcccgaatctgtataaaaatcattgtctctcgtctcttttacttcaatcttgcgtataccatagctccaatgatccccatactctatgttggcagtatctcatgagacccttcgaccagatctgccgaaaccgtgcgaccagtcaggattcaggctcaaggtgttaagttcatcggggcaaagccccatggtgaaggcggtgaagccacatggcgaagacaatggagcgaggacggcaaaagatggagccccatggcgaagactgtacatcctgggcgaagggtgcccgccaaaggagggtgacttcgccatcctggccgctttggccggcctttgggccggcattcgccaaccaggcccattagaggcccatgtatgccaatgacactgtatacccatgtaaatgtccctttcacaagggcaaccatataaattcccctgtaaaacctaaaccctaataggggggcctgtaacaaggatataaatagacccctagggccatgtaaaggggatcctaagaaaaattctcaatctaatacactttactgttttccaaccatcgttgagtaaccacgtccttcgacgtatgcagttgtcatttcgacaacagctggcgccgaccatggggacctccaagcgaaactactgagagcgaatgcccaccaaagagggtcgtgaaggagaaggttacaaggtgaaaggaaagcgaagctgggggagagatggccaccgaagagggtgtagagccttcggcgcccgtcgccgaggatggcggagcgccaccagcttcagcacccgcgccactgctgccgtcttcggctcctatcgcctcgctggggcaggtgccgaacacgcctgacacgatgaaggcggctgcagcagcaagggcactccaaaccagggcggagatcctttcgacaagccatctgctggcgccccaagccgctccatcacaaccggcaatggtctcgactgcgctcgtcgccgcacaagtaaaccctgaccccgaaacacaagccgaagccgacatggaagccatgcgacagaatatgacacgactccaaggcatgcttcgacagatgcaagaacagcaacaggcgtacgaggcagcgaggcgggccaaggccgcttcggccccaatcctccagtattcggcaggctatgtcccaccccaagtctacccacaagccacgcaagtgccagcatacttcgtcgggcagccttcgatcgcagcggtacatccggcccctcgcgggcagccgcaagctcagccggtcactgttcaagtacacccacaactgcccggccaagtgtcacaagcaatggcaaaaggggcttcgactcggcaggcacagcttcaagctttccttcagcaacttagccaacccagaacacaagtcagggtgcgcccagttggttgccgtcgaatcagccaggtctgggggcttcgccttggagtcagggaccgcagttcgacttcatcaatgctgctcaggcaccagctgttcggccgcaagcaccaacgccaggcttcggggcgaaccaagcaccaaaccaggccgccatggcgtggccccagccaacgttcgactcatccatggcggctcatcaagcaccaccaattggaaccgcgcagccgaacactgtggcccaaccttacgcgcaagccgttacctcgcctttcgccacgccatatccgcaacaaggtgccgtgaacagggcaggggcgaaaaggggctaccactgagtgggggaatcaagatccgtccaatcccaccccagttcaagttcctacccgtcccacgctattcaggcgaaactgacacaaaagagttcctatccatctacgagtccgcgatcgaagccgctcatggcgacgagaataccaaggcgaaggtaatacatctcgctcttgacagcattgcccgttcttggtacttcaatttactagctaacaacatttactcatgggagcaattgcgcgatgtctttgtccttaattttcgaggcacctatgaggagccgaagacacagcaacatctactcggcattcgccagagaccgggggagtcgataagggactacatgcgtcacttctcgcaagcatgatgccaagtgcaggacatcactgaggcatccgtcatcaacgctgcttcggccggactgctcgagggcgaactcacaagaaaaatcaccaacaaggagccacagacactcgagcacctgctccgcatcattgacggatacgcgaggggcgaagaggattccaagcgacggcaagtgatccaagtcgagtacgacaaggcctcagtcgccgctgtccaagcccaagtacaagcgcaagtatccgaaccggctcctctcgctgttcgccagtctcaaccaccggtccaaggacaaccgccaagactaggccaagctcctatgacttggaggaaattcagaactgaccgtgcaggcaaggcggtgatggctgtcgaagaagttcaagccctccgcaaggagttcgacgcccaacaagcaagcagccatcaacagcccgttcgcaagaaggtctgaaaagacctctactgcgcttttcacgggcgctcttcgcacaccaccgagcaatgtcgaaacattcggcagcgtggcaacgtgcaagatccaaagccaccacaaggacaagccaccgaaccacctcgcgaagctattcaagagcaagcgccaccggccgaacaccgccaggatgggcagcgcagagtaatccaagtgattacaaggaccgacccgccgaatcagctgtcaaaacggcaaaagaagatgcaacagtggatggtgcacaacatcacttcggcaggcgaaggggccccgcgatacctgaactagcagatctctttcgagccagaggatgccgaaggggtgctgttcccacatcaagaccccttggtgatctcggccgaggtagctggcttcgaagtccggcgaatcctggttgacggggggagtttggccgatgtcatctttgccgaagcatatgccaagatggggttgccaaccctagccctcacccaggctccagccttgcttcgtggttttggcggcgaagtagttcaggtattgggccaagtacaactggtggtagctttcggcataagtgaaaacaggcgcgaagagcagatactgttcgacatcgtcgacatcccatacaattacaatgccatcttcagtcgtgcaaccttgaacaagttcgaagccatctcccaccataactatctcaagctcacgatgccgggcccaattggtgtgatcgtcgtcaaggggcttcaaccttcgaccttatcaaagggcgatctggtagcaagcaggacagtggacaatgttgaggccgaaccacatgaccatgctaaacgcatgccgaagcctgcacctcacggcaaggtgatcaagatgcaagtcgacgacgccgatcccacaaagtttgtcctgctagggggcgatctaggcgaagaggaagctgaggatatcctgaaggtgctcaagaagaacattgacatcttcgcctagggccccgacgaagtgggaggtgtttcgaaggacctcatcatgcaccatctggcggtcaagccgggtgccaagccaaggaagcaaaagctgcgcaaaatgtccgctgatcgccaggaggcagcaaaggccgaagtacaaaaactgctcaaggcgggggtgatccaagagatcgatcacccagagtggttggcgaacccggttctggtgaggaagtcgaacggcaagtggcgcatgtgcgtcgacttcacagacctcaacaaggtatgcccgaaagatgacttccccctaccacggatcgaccagcttgtcgactcgacagctggttgcgaactcatgagctttttggatgcgtactccagctatcaccagatccacatgaatccggccgacatccccaagacagccttcatcacgtcgttcggcacgttctgccacctcagaatgcctttcggcctgaggaacgccggagcaacattcgccaaaatggtgtataaggtccttttcaagcagttggggtgaaatgtgtaggcttatctcgacgatatcgtcgtaaaaagccgcaagactctcgaccatgcgtccgacctacaggagaccttcaacaacttgcgcgtggctggtatgaaactaaaccctgagaagtgtgtttttggtgttcgcgcgggcaagttgttgggttttcttgtttctgaaaggggtattgaggcgaaccccgagaaaatcgacgccattcggcaaatgaagcctccgtcgagcgtacgcgaagtacaaaagctcgcaggccgaattgcggcgatcagtcgatttctctcgaaggcagccgaaagaggtttgcccttcttcaagaccctccggggcgcgggaaagtttagctggacacccgaatgccaagtcgcgttcgatgagctaaagcagtatctgcaaaacccacccaccttggtcagcccaacaccaggaagcgaaatgctgctttatctagcagcttcgccggtggcggtcagtgcagctcttgtccaagagacagagtcaggccagaagccagtatatttcatcgccgaagctttgcaaggggcaaagacaagatacatcaaaatggaaaagctcgcttacgctctagtgatggcttcgcgcaagcttaagcactacttgtaggcccataaagtcactgtgccatcgcagtatcctttgggcgaagtactatggggcaaggaaatcaccggccggctcagcaagtgggcggcagagttatcacccttcgacctacattttgtcactcgcacagccatcaagtcccaagtcctagcagacttcctggccgaatggacaccggcgttcgcccccgaacccgagtccgtcgaacagccttgggtaatgcactccgacggctcgtggtctcaaaagggggcgggcgcctaggcagtactcacttcctcagggggcgtgccgattcattatgccgcacggatgcagtacggcactaccaacaacatggccgaatacgaacctgtactattgggcctaagataagcataagaattgggggtacggagcttgctcattcgaacagactccaaactagtggcaagtcatgttgacaagtcttttgacgtcaaagaagatggactgaagaaatatgtggaggccgttcggtctatggaaaagtgcttcgctggcataacggtcgaacacttacctagaggccagaatgaggaagcagacgccctggcgagatccgccgcctgtggaggcccgcattcgccaggcatcttttttgaagtcctatacgcaccaagtgtgcccgcagaaagcctagtcatcctggcaatcgaccaggcagaactgggcgaagatgcagaggactggcgaacaccgttcgtcaagtacctcaagaacggctggctcccggaggatgaagcagaagcgaagcgcttacagctcagagccacaaaatacaagcttatctctggccagctgtatcgctctggggtgctccaacccttacttcactgcatctctttcgccgaaggagaggaaatggcgaaagagatacaccaggggctgtgcggtgcacatcaagccgcaagaacggtcgcctccaaagtgtttcgccagggagtctattggcccactgtgctgaaagtttgtgtcgagcaagccaagaagtgcgaaagctgccagcggcatggccgaagccaaactgcacctcagtacgagctacaacctatcgcaccagtatggcctttcgccagatgggggctagacatcgttggcccattccctgtggcgagaaatgggtacaagttcgcaattgtagccatcgaatacttctcccgctggattgaggccgaaccactcggtccgatcacttcagcagctgtgcagaagttcgtatggaaaaacattgtctgccgtttcggagtgcctaaggagttcatcactgacaacggcaagcaattcgactgacaaattcagagaaatgtgcgaagggctaaacctggaaatcaggttcgctttggtcgcacacccacagtcaaatggggcggccgaacgcacaaatggcaaaatccttgaggcactcaagaaaaggcttcagggggtggcgaagggtaaatggccagacgaaatgctatctgttctctgtgcccttcgcacgacccccaccagaccaaccaatttcagcccgttcatgcttctctatggcgatgaaacaatgaccccaactgatctaggggctaattcgccaagagtgatgttctctagaggcgaagacgggcacgaggtgtcactcgaactccttgaaggggtaagagtcgaagcactggaaaacatgcgcaaatacgccacaagcacttcggcaacttataacaaaaaagttcgcccgatagagctgttgcctggccatctcgtcctaaggaaaaaggcgaaccctgtggcggtcgggaagcttgaatcgaagtgggaagagccataccttatcaagcacaggtccaggacaggctccttttgcctagcgacgctggaaggcgaatagttcgaccattcctggaacgctgcttcacttaagctcttctatgtctagaacgggtggcacccaaattgccaacttgtaaaaatgtataatactgttatgtaagcctttcggcactatgtaagcccttcggcacaaaaatgcaaaaaaagaggaaaataaaaaaagagaggaaaaaaaactggatgtagggttattatccgccgtggaggcacgaaccaatataaaatccttgtgtttttcgcctctttacctgtgtgaatgataattcgtggaaaaaccccaaggcaaatgtcacgcccagaaattcacgaaccataatttctaagctgaatgtgcattaaacccttgtccagcaccagccagggtacacaaacgacaattgttgacatacagatccacgtcttacaataatataaaagattacaaatgcaacggaaatggaaaaagcgagctaagcctgaagacttgactcttgcagcgggcgactccattccacatgcattcctgatggtagcgacgaaaccaacctttctgagacagctccaactgagaagaactttagctctggagtaggggaaaagagagcaagactgagtactacccactgtactcagcaagtcataccggaagaggaggtatgatgcaggatatatccaaaggaggctagaggttcatttgcataaagctagtatttaaaagcagtagttgaaggaaataaaacagttgaagtaattaatcaatattaaccaatcactgtccaacactacactacgttgcaacaggcccaaccaaccacctgaactacaccagttcattagctaactaggggtgagactaatcacggtgaatctggtcgaccgcccataaccgcgggcacggctattcgaatagttttactctgatcagaggtgtacaactgtacccacaagacacagccccacaacacgttcccgtgcgccgacatgccaccacgacataccggaaagaggccgtgacaggaccttttgcataaccccctctaaccaatcgcaccacacctcaggtttcaccctcactcctcgcaaggcagcgggcagtcccctctcgtgccacggtgaatccggaagccgatcaaccggacaccccggccgacccaactccatcacgcccacccttgcctgggtacgtcggctagaggaaagctacactacaagcccagccgttgcccacgctggcttgtggtaagaacgataaattcttccagggcatcccgcgaaccggtccttaatcgccatgggcacaactagcaaaaccatgcacccacagcccaccatgtactgtattttaataaactaacaccattg

SEQ ID NO: 26951 - DNA, 1076 bp, Oryza sativa
taaaccaacatctaatcattttgatacccaagttatcaatggcataaggtaaacaatatatggctgagtagtaggacccatcccacatgatattgtaaaacaatgcaacatttaatagaaatgcgggacatttgtaaattgggtacaatatgatcaattgtgatgcatgacttgccttgctctcgcactgatgaaaccacagcaacgtcttcgagaaaccgcggatcgacgaaacggccgaaatctacgcgacaaacaaagcacacaagcaaaacatgctataagtctactgaaacaggaaacaaaaccatttttaatggattctatacatttttatgaatttactgagacttgaatggacttaaacggagctcggatgaattagatatgaattttagaagattcactgtgtttttactataaacagataaatccttaattgatttattgcgcaatatctcatcccagggctgacgtcatcaacgagggggcggcaccgacatgccggacccacgggtcagcggcttaagggggaggtccgcggtggaccgggtccacggaccgggaaggagacggcgcaccacgtggtgcacacgtcgcgccgacgtggcgcacacgtggcggccacgtggcagccacgcgggcggcgggtcgggtagatcggacggcgggggcggctcacggccggccgcacgggctcggctcaagccggcccgacgccatggcgcgcggcggcgcggctcgacgcagcggcggcgaccgggggcgaccggccgacggcggagggcggcggcgtcgcggcaacgcggacggcgctagcggcggctaagcagctaggtggcggcgcaaggctaagcggcgcgggagagagaggaagggaggaggggccccaccgacgacgattgacgacggcgagcgacggagggcgacggcgatggcaggacgagctccgagaccacctagcgaacacgaagaaaggggttagagagagagaggaagatggaagagggcgaggaagccgacctaatgctgcagctatggcggtgctcaccggcgcacggtgcggaatgggttcc

SEQ ID NO: 26952 - DNA, 16090 bp, Oryza sativa
tgggccttggccttcggccggcccagcggggaggggcaggggggagagaatgggccggcggcccattcgaaaagaaagggagggaaaaagaaaaagaaaaagaaagaaatgaatttccagggattaaataatgcttgtgctcaattttaattggttaaaattatttctagagctctgaaaattccactaaaaatcttgttagcatattttgacatgtagaactcaagaaaaattccacatgccatttctgattattatttgcattaattcaattagggtttctctctcttttacacaggtaatttctcgagaccatttattaattactttaggcttgggagaagaacttcagggtgtgaaaaacctacccccccccttaaatggaatctcgaccccgagattcggaagagctggcgaagaggtgcggatgggcggccttcaactcatcttccctttcccatattgcttcttcctcggagtggtggctccattgaaccctgcagaacctggtaaccttgtttctggttcttctttcactggtctcaaggatgcggactggcttctccacataagtcagatcttcttgaatgtcgatgtgctccgaattggcttgttcttctggtactcttaagcacttctttaactgagacacatcgaacacatcatggataccagccatgttggacgggagttctagctgatacgcgacttctcctcttcgttccaagattttgtatggtcccacaaagcgtggtgccaacttgcccttcgtctggaaacggtgtactccccggagcggagtaacacgaaggtacacataatcccctgcttcaaaagtgagctcccttcggcggttatcggtgtaactcttctgccgagactgagcgatcctcaatctttccctgacagttcagactttctcctctgcttccgttaacacatctgttccgaacagttgacgttcgcccgtttgatcccagaagagaggtgtgcggcacttccgaccatacaatgcttcaaacggtgccatttgcaaactggcctggtagctattgttgtaagagaattcagcataaggcaggcttttatcccaagctccgccaaaatcgagtgcacaggctcgcagcatatcctccaatatttggttgactcgcttggtctgaccatcagtttgcgggtgataagctgtgctgaaattcaaacgggttcccaattcttcttgtagtctctgccagaactttgaagtgaactgactccctcgatccgatacgatcttcttgggtaccccatgcaaacacatgatccttgagaggtaaagctctgctaatcttttgtccgtatatgtggtatgcactcgaatgaaatgagcgacctttgtgagacggtccacagctacccagattgagtcatgtcccgatgatgttctgggtaaaccagtgaagaaatccatcccaatttcctcccatttccattccggaatctgaagaggttgaagcaaacctgcgggcctctggtgttctgccttgacccgctgacaaacatcgcagagtgcgacgaattcagctatttccctcctcatgctggcccaccaaaatttttccttgagatcttggtacatattggtactgcccggatgaatggagtactgagtctgatgagcctcggtgagtatcagatctttcagctctttgtcatcaggtacgcatacgcacaatctttctcccagccagattgtgccatgttcatcttccaggaaatcccgggcttttctgaccctcatattctttttcagttcagctatttcaggatcatttatttgagctgctctgacttgatccataagcgtaggccgcgcctctagagcggccacaaacccgtgttctacgattcccaagttgagatgttcaagctcctgctgcaattccttacacatgccttcggtgcccaaagcattgcagtagctcttcctgcttaatgcatctgccaccacattggctttgcccggatggtagtgaatgctcatgtcataatctataattaattccagccatcttcgttgtcggaggttcaagtcaggctgagtgaagatatacttcagactcttgtgatcagtgtagacttcacagcagttgccaataagatagtgccgccacattttcaaagcgtgaaccactgctactaactcaagatcatgagtaggataattggtctcgtgtggacgcaactgccgcgaagcatatgcgaccactctgccttcttgcatcaaaacacatcctagcccttggcgagatgcatcacagtagacctggaagtctttcatctgatccggcagaattagaactggtgcagatactaacttcttcttaagttcttcaaaactttggttgcactcaactgaccacttaaaattttcatctttcttcagcaactgagtcatgggtctggcaatcttagagaaattttcgatgaaccgacggtaataacccgcaagtccaagaaaactccggatctgaaaaattgtctttggtggggtccacttagtaactgactccacattcgacggatccactgccacaccttgagcagtaatgacgtgacccagaaacttgacttccgacaaccagaagttacacttactgaactttgcatataactggtgctccttcaatttctcgagtaccagacggaggtgctgctcatgttcctcttcagactttgaatagataagtatgtcgtcaatgaacaccacgacaaacttgtccaaaaactccataaacactttgttcatcaagttcatgaagaaagctggtgcattggtgagtccaaaagacatgactgtgcactcaaacaacccataccgagtagtgaaggctgtcttgggaatatcctcttcccgaattctcaactggtgatagcctgatcgtaggtctatcttagaaaacactttggcaccctttaactggtcaaacaggtcatcaatccttggcaaaggatatttgttcttgataatgacctcattgagtgcgcgataattgacacacatcctcttggtcttatctttcttctccacaaagataatcggggcaccccaaggtgaagtactcagtcggatgtatcctttccgcagctgttcatcaacttgctctttgacttctgctagctcgttagctgccatcctataaggcctcttgtagatcggagcagttcccggtgccaaatcaatccagaactcgatttctctcttcggtggcattgtagtgaggtcttcaggaaacacctcaggatactcttgtactatagggatatcctctaactccttaggacttttctccactatttctgtctgttccttaatagcagcctgattcagacttgctacggacttctgcgacactggagaacggaaggtgatcttctcccctttgtcgttggttagggtgatggtgcgactcgcgcagtcgatcactcccttgtgtctggtcaaccaatccattccgagaatgacatctaggtctttggattcaagaaggataaggttggatagaaacggtgaccttttgatctctatagtcatcgaggggcagtagtgtgcggtgttcatgtcatttccaggggtatgaacccgcattggtattttaagttccactaccgacaatccatgtgtcccagcaaacttcttggaaatgaaagaatgcgttgcacccgaatcaaaaagaactgttgccggatatgagttcactagaaacgtgcccagcacgacctctggtgctgcttgtgcctcctctgcagacgcatgattgatgcgggcctggacgaacttgggtccagcacgctttagcttcggacacttgctagcaaagtggccgtgcttgccatagttgaagcagggtcctggctttcctgcagactccttcttgagctgttctgactgggctgacatagctggtagttctgactcagctggtgccattaatgggggtggagttgagttgtggtggtgctgctcactactgttgtgactgccaccgttgtagtcgttgttgaagttacccgagtggtagggacggtgctgacggacgatcagggtggaaggctcacccagctgtcccgtcatgaagcgaggcttctgactgttcccctgaggagtcctgaactgagctgcctttcttttacggtccattttgttgcgttgctcttcctgatggatagccttgtccacaagcttcttgaagtcctcgtaaactcctgagatcagctggttggtcaattcatcatccagaccaaacaaaaacttctcctgcctcttggcatcggtgcgcacgtcctcaggagcgtagcgcacaaggcggttgaactcatgcaggtattctgtaactgttctggttccttgttgcagtgcacggaactctcttcttttgtgccatgatcccctcgggaatctgtgccttcctgaagctttgacaaaactctgcccaagtaacctccgttgcatctagacgggttaccacgtagttgtcccaccaggcagaagcgggaccttgcaactggtgtgtagcaaaagcaaccttctcttggtcgttgcattgcagaaggttcagtttcttctcaatagcatggagccagtcgttggcctccattaggttggtggtgcttgagaaagtaagtggcttgatatagaggaagtctaacagcttggacaaatgtaatggtggaggaccagactgctggttctgctgcgcctgctgcaacatctcatggtaatgttgctgcatctgttgcatcatcattgtcatcatctgaatgaccattgggttctcgggcggtggagatggaatgttgctagatgcaccactggtatgtgctccattgatctgctcttcgctgccactggcgccgttggagtcacggggatcattccttgtcttcaccatctggaggaggataggtagaaataagagaaaggaagaaaacagacggcttagaaactaatctttcttatatatttatgtgcaattatcttaatcttgattaaaacacttaaaaggaagcaaacaactcctaattaaggcagccataccactaacacatgatatcgaccgccggctaacccacaagcagcaaacctaaacacagaaactagcaagcaacagactaagaagacgataaagctaagggcggtgactctgaagctcggagcggcgcttgcgatcgaggaataggtctgacatctaaagaggacagagggataggaaccaatacatgctcaaatccaaattaaacaaagcaacgaatgactcaagcaactagccaaacatgatgatttttatgcatggaacatttttcatgaacccaaacaaaagatactaatgcaaccgactaaacaataaattaatgcacgaaatagatgcatagctataatgatacgcataaaatctccccattgaacctagacacgacttagtgcatatcacctaataaattcccgactcactgtcaaataaattccgaataaaattttactagaccctagactgcctctagccgagaaatccgattaaatagcgatcaagatttttcccacaaatcaaaagaacaaaccccaaaattttcccgaaactaatccaagtgcaaagggcatgtgcagatgaaaaggtttcagagggctcttagggtttccaattggcatgtcttacggtcaaggtcggctctgataccaacttctcacgcccagaaattcacgaaccagaatttctaagctaaatgtgcattaaacccctgtccaagaccagccagagtacacaaatgacaattgttgacatatagatccacgtcttacaaaaatataaaagattacaaatgcaatggaaaaggaaaaagcgagctaagcctgaagacttgactcttgcagcgggcgactccattccacaggcatccctgacagtagcgacgaaaccaacctttctgagacagctccagctgagaagaactttagctctggagtaggggaaaagagagcaagactgagtactacccattgtgaatctggtcgaccgcccataaccgcgggcacggctattcgaatagttttactctgatcagaggtgtacaactgtacccacaagacacagccccacgacacgttcccgtgcgccgacatgccaccacgacataccgaaaagaggccgtgacaggacctttcgcataaccccctctaaccaatcgcaccacacctcaggtttcaccctcactcctcgcaaggcagcgggcagtcccctctcgtgccacggtgaatccggaagccgatcaaccggacaccccggccgacccaactccatcacgcccacccttgcctgggtacgtcggctagaggaaagctacactacaagcccagccgttgcccacactggcttgtggtaagaacgataaattcttccagggcatcccgcgaaccggtccttaatcgccatgggcacgactagcaaaaccatgcacccacagcccaccatgtagtgtattttaataaactaacaccattgcggtggcactaatccaaaactatgccaataatcaaagtctatgcattaatgtgattccccttttgtgtactagttgaactaagcatagctaaacatttcttaaaccaacatctaatcatattgatacccaagttatcaattgcataaggtaaacaatatatggctgagtagtaggacccatcccacatgatattgtaaaacaatgcaacatttaatagaaatgcgggacatttgtaaattgggtacaatatgatcaattgtgatgcatgacttgccttgctctcgcactgatgaaaccacagcaacgtcttcgagaaaccgcagatcgacgaaacggccgaaatctacgcgacaaacaaagcacacaagcaaaacatgctataagtctactgaaacaggaaacaaaaccatttttaatggattctatacatttttatgaatttactgagacttgaatggacttaaacggagctcggatgaattagatatgaattttagaagattcactgtgtttttactataaacagataaatccttaattgatttattgcgcaatatcttatcccagggctgacgtcatcaaggagggggcggcgccgacatgcccgacccacgggtcagcggctcaagggggaggtccacggtggaccggttccacggaccgggaaggagacggcgcaccacgtggtgcacacgtggcgccgacgtgccgcacacgtggcggcactggcagccacgcgggcggcgggattggacggccccgatctacctacgggcccggctcaagccggcccgacgcccatggcgcgcggcggcgcggctcgacgcagcggcggcgaccggccgacggcggagggcggcagcgtcgcggcgacgcggacggcgctagcggcggctaagcggctaggcggcggcgcaaggctaagcggcacgggagagagaggaaggggaggaggggcctcaccgacgacgattgacgacggcgagcgacggagggcgacggcgacggcgggacgagctccgggaccacctagcgaacacaaagaaaggggttagagagagagaggaagatggaagagggtgaggaagccgaccgaaagcggcggccatggcggtgctcaccggcgcacggtgcggagtgggttccgacggcggaatccgacgggagaggggtggacggggtggcccgctcgacggcgaacgcggcggcgtcgacggcacggctcggcacggcggctagcggcgactggagcggtggcggcggcggtggagaggagggcgacggcactaggacggtggagggcacgagggcgagtggttgcaaaacaaaaaagagagtggcggagacgggggtgctttatatagacccgcgggggtcaatcgtggccgggatggccgcgatttcgccggccgacgtggggaggtgggagaggagagagagaggcgggattcgaaaatcgaatcccggccgtctcgagagcgggagcggcgggatagtggggcggcggttgcgggacgcgcgggatgcatgcggggtgagggcgacgtgggcgcgggcacgcggggaagagcgcgagcggcggttgcgggcacggcggctccggccggaggtgggagacgggcccgacaggtgggccccacctgtcggcgacccgaagggaggagggaggaggcggccggctgctgggccttggccttcggccggcccagcgggaagggggagggggaagagaatgggccggcggcccattcgaaaagaaaaggagggaaaaagaaaaagaaaacgaaagaaatgaatttccagggattaaataatgcttgtgctcaattttaattggttaaaattatttctagagctctaaaaattccactaaaaatcttgttagcatattttgacatgtagaactcaagaaaatttccacatgtcattttttattattatttgcattaattcaattagggtttctctctcttttacacaggtaatttctcgagaccatttattaattactttaggcttgggagaagaacttcagggtgtgacagcaaacacccgatcagcgaaaacgctaggggggcaaaacgaatcggccgaagcatcgctcgccgaacgttgaaaccgcgacagcttgtttcgaaaaaaaccaaccgaacaccgttatactcaatccatgtgaaaacgtaactgctctcagcacgaaatgtcacggattgaaagcggaagttgaaagctaaaaagtcagcatacctatttcgctaatatacgcaaaggggccgacatgtttcgacctaacgaaagcacgaaaggtgccaatgcgaaaaatagcgaaaaggaaataaaacacacgtttattaacttcggaaaaatgattgaagaatactgccatacaacatggtacaagcaaagaaagcaatggcttcacggcctacctcacaaataaattacatcttcgcccccaaagcaatccccactcccaaagaaatggttcggcgaacatggttcgtcgtcactactaatgtcatacactaccctaaggggggaagggggcgaaacacaaactagactattttcacgcccgaaaattcactagtaattttcgaacttatttgtgcataaaatcctcgtccaggaatcagccaaggtacacaaactgacaatttaatatacaaattcatcaaattaactagaacgataaatacttacttaagaggcacttagtcctcaccaagaagtaaactgcagcggaaaataaaatctaacgaagctccggctccactcccacaggcagctcaactggggtataagccaaacgtcttctccttcgcaacttgtcttcaactgaggttgattaattattgcaaggtgagcatatgacatactcagcaagccacacagcaaatatgcaagtgcacaaggataccaaaggatggcataatataggctcatttgcaaaagcagcacttagcaaaacatttaagagatgtaaaacagtggagtaattaatcagaaattttaatcaacactgaacaacacacccatactgcacaggcccaaccattctgaacaaccatacccggctgtacagatctaactccaaaccaggagctaagcaaattattaccaggtataacatccataattattgtgagaggtgtgagactaatcatgaaaaacattgctcaacccgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcacaacacaactcaccacagtgcaccattcctggatcataatcaccccctcaaaaaccagaggcatggactccccagcgacccccgtgggcttatctccgccacttctcagtctggtgctctgcaatgaatcatgttatacaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataatagtgaatcataagttatcccaataatgtgctaatgtttctaagcatggctaagcaatcatatctaatatctagctgaaccaatatatatagcccaactagtcaagttataataacccaaggtatcaaggaataaagtaatcaatgcaaattggccataacaaaggaataggttcacaccacccagtgacattcgaaaataaatgcacagttgaaataaatagagaatttaaatataggatcaatatgctcaaaggattgtgtttaggatctgtgtgacttgccttgcaataatcggtcttcaattaatcttcttgaatacttccggcgcactcgcgaaccttcgcaacgacagaaacgacaagctaacacgcaaaacgaagaaaaagactaataaaaaccaaataaacaatacataaaaagtaaacaaacatgtagatcataattttagatgaattatgagacttgaacggcctcattctgacttcaaatgaatttattatgaattttacaagattaaatatatttaaagcccatttaaaaagaattaaataaatttaattcaatttatggacaattttaatatgtagatctttattttacacaatttttgcaacttgaaccacattaaactgagttacaatgaattagttatgaatttttaaagattacatcgattaaaacacttatatggattttaattgaattatgacgcaataatgaattatttttgaaaaggaaaaggaggattattgcgtcagcggctagggttttcggtggaccgggtgcacggcagcggttcacgggaacggacggccgagatcaaccctatccaaaacggacggccgagatcgaacggatccaccgcggctcacgggaacagcgacgatgacgtcagcgatgacatcagcgatgacgtcagcaccggcggcggctcgggagcacaagctcgctggcgaacgacggcgcgacgacgcaaacagagggcaccaacgggtagagggcgacgcggcgaactcaccggtgaccaaaacaacggcggaaaagcaacggacggcgccggcgatgaggaagaagcggcggcaaccttcgggtcgacggtgacggcgatgctccggcggtctccggcggcggcgaaggggcggacgaggacggcggcgacttggcgaccacgatggcgatctccccgaacgacggcgacgacaggagcgacggcggcgcacggctggagcggcggcgacgacggcggcgcgaggcggcacggcgctagggcgctacaagcgacgagaggcgaaggcgagggtggcagcgggtagaggagagctcaggggtccttttaaaggggcaaggaggcggcggcaaaggcccacggtgaccggcgacgacgaaggaaagctagggctcggagagagtagtcgatccgaatcgaactcgaatccacggatttccaaatgaaattaggcgatgattccaaaagagaaaaggaagaggagatcgagaagatcatttcccctctaaagatttcaccggagaaggaaagacgcggccgaatttggaaggagacggcggcggcttacgctagggtttcgggcggcggcggactgggccggactgggccgagggaaagagagagagggttttgggccggctttcggcccaaagccaaaagaagacttttaaaaacctttttcaatttaaattattcatgaaatgcaattccatttattaaaaatacttccttagctcaaataaatcccagaaaaatctaggaattatagaattaagcaaagtatttaacaaaattttatctagcccaattttatgttgagatttagcaaattaaaattagatcttctcttttaggcttttaaaatcatttctaataattccttttaaacaacaatttataatttacggatttttaaacaagaaaagctcttaacaattataattagatcattaatgatcaaataattactgaactgttctttgtatcatttaggaattgagctctgaaaaatccgagaaaatttcagagagttgacttaatcatggagaatttaataaaaattaaatccatccatgctttatatttaggaaattttatttcccacatttaacttcacttgtaaattaaagaacatttaatataaattctaataataatttattaaataatttataaatcctaaaacgaaaatcaggatgtgacaactataacgacgctgggcgattgcttcctgacgatcggatttctgatggtttcgccaaaagcgaaccatatcctcccgacgttcggtatggacactatcgtagtcttccagggttcgcccgggtgcgcccgcatccagctggcaaccttcaaaaccttgtagctgttgccgttgattatcatctcacggtaaactggccgaaacggacaccacaccttcggcaaacccttcaccgctacgaacttttcgtttttacttcgccaataaccaaagagggcccgaatacacagtttccggcgagcaccctgataaaatagcacagcaaaggcaaataggaaaaacgctgagttaagacatgaaaaagtgggcaaaatggaaaaactgtcgtacgcgaaaataatgcgaagataacgcgaaaatgatacaagcgcatatgccgaaggcttcaagcacaacagttggctaaactagggtcattcatttcatatgttaaaaaagccgcttttggctacaactagaaggacagagggccatcgaccaaatatacattgttcgccctccacgacgaacacaaaaataaagccacaaaatctaaaaagcaggcggagggcctcacacctctgggtgatcctcggcatcgcctctgcccccgccggccgtcggctcttcgccttgatccgccgcctccgcctttgccagttgcttgagcaggcacgccttagcagtggagcggccgtccttctgccagaactgcttacgccaagctcgcagagcgggcgaaacgtcctgcggactaatttcccagtcccctttcgcaaagttggggaactcggcgacgtgctcgcagccgaactgctgcagaaggcccaaggcgaaagtcgcggacacgcgcgcacagctgtcgccatacgtagtggcgcagtccgagaccgcaccgccggcctgctgagtccactcggagaagtcgaaggcggaagcaccttcgccagggactccgcgcattctcgcccccatgtcagaaagggcgaggcgaagagtttggctacggtctttgcggactcggtggctttcgccatctccagcgtgaaccgttgcgcttccatcttggcattcgtctccgcttcgacgacctcttggcgaagagcctccatctttggctcggtaaagttgtagtagtcggtcagagcggcggaatgagcctgctcttttttgagctcggccttgaggcgctcaatctccgccttcgcctcactcccctcctccagttcagcccgaagccgcttgttctcggccttcgtctctttgagggcgtgggcgaggccttccatttccaggctcttgcggcccagttcgtcatctttggctcggagacggttcttcaaaccatcaagacgagcccgcatggttcgctcggtcgaacagtgggccgcgaggatctggttcaaaggtaagagagatagagcgaatgttaaagacaaggtgtcgaaaggtggcgatcaaaataaaaaacgacaatcaagctacgtacccgaaccgccaagctcttgacggcagagcagccctcgtcgaactcgttctgctctgtgaacagactcgagctgccagccggagaaacgagtttgctcaccccctcgacaaacgggataagttctgcccgggtttcgaaatcgccaggggcaaaatggggcacggcaagggagtaatccgaaacggatgtttcgaccgccgttttcttctccttcccaggggcgagcggcgaaacaaccggctggcgaacagggctgccgaagaccctagccgcggtcttcgcaacctgatcgattgaggccgaagccccggcgacactcccgccaaccctgcccgcatcgaccttaacgccgggagcggtcgaaagacccaagcttcgacaggcgggcgaagtaggggtctcgtccgaggactcgtcgtcactaaagacgcgaccgacatcgacgagcctcttcccggaggtctttttaattgaaccccccttcgccaccttggccgcagcgatcgcgaccagcgccttcgccccctccacatccttttggcggagaggggagcagttcgactccaccccagtctcgacaggctcggggctcggggttggagtgtagccgggcgtctcggcgcgattatcggcggcttcgccagcggccttttcgcccacagcttccgtctcccccacatccccctcctcctcttcgtcgtcatcttcgatggtctcctcgtcatcggtgtcggagtcgggggcccttcgcttatgaggggtcctttttacctgccagcgcatccgcttgcgcgaaggccctgcatcgtcatcggtcctgtgagggttcgcccggggaggcagttcgccaccataaacccggttcacccggccggccgcctgccgcgtgagcagctggctgaactcagtgaccgacacgtcgccgatcatctttcgggcttcagtgtcggcctgtgcaagagtcaaaactgcgaggacgaaaggtgcaactatatcatgcgtcaaaccgggaaaaagagcgaagcacaaaagtatggttaagcatagactcaccattcgcccccgcaggcatgacgagcttcggcaagccgtcgacctcctcgtcttggtcgatcccgacttgccacgactgggaaagggggaagatgtgaagcatgcataactcctccaccaagtcgcggcagctgaggcgagagcagatccggcatagcagaacgaaccgggcctccatggcgccatcgacgacgaccttgggcttcctgttcggcgagatcgccccgcgtcgccacctgagggcattcgccgcatcagacccagcctcgaaggggatggagtggtagaaccactttgccatccaatggcgatcccacttcgacatggttgcgttcaccggctagagatcggagcgctcggggcgaacattgaagttcacgctcccgaatacagtcttcttcgtcccggccggggtgaccaccgtcttcgagttcacagtggcgaagaataccacgccgaagaggtcggcgctcggttcgaatccggcggtctggcacgcccagtcaaagatggcgatgcggacgagcgccgacgggctcaggtggggaagctctgtcacgcccagaaattcccgaatagaatttcaagcagaatgtgcattaaaatccccgtccaggaccagccggggtacacaaacgacaatgttgacattcaaatccacgtcttacaaacatcataaaagtcttacataaatgcagcggaagaaaggaaagacaacaggagctaagccttgactagaactgcagcgggaacaccactccacaggcatcctcgacagcacggacgaagcctactcctcagagacaccttcttccaacacatactcgtgctctgaggttgggaaaaatagagcaagactgagtactacccactgtactcagcaagtcataccggaatagaggcatgatgcagggaatcatcaaagaagagctagagtggttcatttgcataaagcgagcatttataaacagaagttgaaagattaaacagttataatacttaattaatattaactatccactgtccaatgctatcccatgttgcaacaggcccaaccatccacataaactatcggg

SEQ ID NO: 26953 - DNA, 18078 bp, Oryza sativa
ggagtgggcgcggggaacccggcgctcgtgcgggcgtggtcgacgtggcccgaaggaggcggagacgtgggcgcggcgacggttgcgggcgcggcggcgcggcgggaacggcgggaggtgggggaaggacccgacaggtgggccccacctgtcggtgaccccaggagaggagggcggcggggcggcctggctgggcctcggcctgcggccggcccgggaggaaaggagagaatgggccagcggcccattcgaaaaaaggaggaaaaagggaggaaaaagaaaaagaaaaaggaaaaaggattttccctggaattaaaatattgcttgctcaattttaattggttaaaattatttctagagctctgaaaattccactaaaaatcctgttagtgaatttcggcatgtagaagtcaagaaaaattccacatgccaattccgattattatttgcattgatttaaaagggtttactcgtgctttgcacctgtattttcttggggtcatttataaattaaattttaggcttgggaggagaacttcggggtgtgacaaacctaccccccttaaacggaatctcggccccgagattcggaggagctggtgaagaggtgcggatgggcggctttcaactcatcctccctttcccaggttgcttcctcttctgaatgatgactccactgaactcggcaaaacctggtgaccttgtttctggttcttctttcactggtatcaagtatacgaaccggcttctccacgtaggttaggtccttcctggatatcaatgtgttccgaatcagcctgttcttcgggtacccttaagcacttctttaattgggacacgtggaacacgtcatggatgccgatcatattggatggaagttctaactgataagcaacttctccccttcgttccaagattttgtatggtcccacgaagcgtggtgccaacttgcctttgttttgaaaacggtgcactcctcggagcggagtgacacgaagatacacgtaatctcccgcctcaaaagtgagctcccttcggcggttatccgcgtagctcttctgtcgagactgtgcaatcctcaacctttccctgatgattctgactttctcttctgcttccgctaatacctctgtcccgaacagttgacgctcgcctgtctgatcccagaagagaggtgtgcggcacttccggccgtataaagcttcaaacggtgccatctgtagactagcctggtagctgttgttgtacgagaattccgcatatggcaagcttttgtcccaagctccaccaaaatcgagagcgcaagctctcaacatatcttccaagatttgattgactcgctcggtctgaccatcagtttgcgggtgataggccgtgctgaaatttaaacgggtccccaattcttcctgcagcttctaccagaattttgaggtgaactgactccctcggtcagatacaatctttttgggtactccatgtagacacatgattctcgagaggtagagctccgccaaccttttgcccgtatacgtggtatgtactggtatgaagtgagcaaccttagtgagtcgatccacgactacccagatggaatcatgacccgatgatgtccggggcagtcctgttataaagtccattccaatctcctcccatttccattccgggatttgaagaggttggagtaaacctgctggtctttggtgctctgccttcactcgttggcaaacatcgcagagtgcgacgaattcagctatttctctcctcatgctgacccaccaaaacttttctttgaggtcttgatacattttggtgctgcctggatgaatggagtactgggtctgatgagcctcggtgagtatcagatccttcagttccttgtcgtcaggtacacacaatctttctcccaaccagattgtgccatgctcatcttcatggaaatcccgggcttttccgactctcatgttctttttcagctctgctatttcagaatcatttactctgctctgacttgatccacgagcgtaggccgtgcctccagagcggctacgaacccgtgttcaacaattcccacgttgagatgctcaaactcctgccgcaattcctcacacatgccctcgatgcatagggcagtgcagtaacttttcctgcttaatgcgtctgccaccacattggctttacccgggtggtagtgaatgctcatgtcatagtctttgattagttccaaccatcttcgttgtcggagatttaggtccggttgggtgaagatgtatttcagactcttatggtccgtatatacttcgcagcggttgccaatcagatagtgcctccagatcttcaaaacatgaaccactgctgccaattccaggtcatgagttggataatttccttcgtgtggacgcaactgccgcgaggcatacgcaaccaccctgccctcttgcattaggacacatccaagtccatggcgggatgcatcgcaatagacttggaagtctttcatctggtcgggcagaatcaaaactggtgcggatactaatttctttttgagctcctcaaaactcttatcgcactcagctgtccatttaaacttctcatctttcttaagcaactgagtcatgggtcgggcgatcctggagaagttttcgatgaatcggcggtaatatcccgcaagtccaagaaaacttcgaatctgcgacacggtcttcggtggggtccatttggtaactgactctacgttcgacagatcaactaccacaccctgagctgtaatgacatggcccagaaatttgacttccatcaaccagaagtcacacttgctgaacatggcgttagctggtgctccttcaacttcttgagtactagacggagatgttgctcatgttcttcttcggactttgaatagataagaatgtcgtcgatgaacaccacaacaaatttgtccagaaattccatgaacactttgttcatcagattcatgaagaatgcgggtgcgttggtaagtccgaaagacataaccgtgcactcatatagcccgtaccgagtggtgaaggccgtctttggaatatcctcttcccgaattctcaactggtggtagcctgatcgcaggtctatcttagaaaacactttagctcctttcagttgatcaaattcgaacaaatcatcgattcgcggcaaaggatatttgttcttgattgtgacctcgttgagtgcgcgataatcaacgcacatcctcttcgtcttatcctttttctccacaaaaatgatcggagcaccccaaggtgaagtacttggtcgaatgtaccctttctgcagctgctcatccacctgcttcttgacctcggctaattcattggccgccattctgtacggtctcttgtaaattggagcggttcccggtgccaagtcaatccggaattcaatctctctcttgggtggcatggtagtaaggtcttcggggaacacttctggatactcgcagactatggggatatcttccaatttccgcaagttcttctccacggtgtcctctgggattttcgtctcaatctgattcaaagagacccctcgctttggtgagtctggtgatttgtacactaccgtttctcccttctcgttggtcaaggtgacggtacgattcgcacaatcgatgactcccttaaacttggtcagccaatccatcccaagaatgacatctaggtctttagattcgagaagaatgaggttagctagaaatggtgatctttgaatttctattagcactgaagggctaaaactgactgaggttgaactatttcccggggtatgaaccctcattggtgtgctaagctcttctttccttaacccatgcatcccgacaaacttctttgaaatgaacgaatgcgttgcaccagaatcaaaaagtattgttgcagggattgagttaacaggaaacgtacccagtacaacctctggtgttgcttgtgcctcctccgcagatgcgtggttgacacgagcctggataaaccttggcccggcacgcctaggctttgggcatttgtcggcgaagtggccaagctcgccacagttgaagcaggaccctggttttgctccagtctccttcttggcttgcgcgggcgggcctgactgtgctggtgccactggtgggcgtggagctgcaccgcggctgggctgacctccatgatggttctgactgccactggcgccctggggaaagttgctagggttgaacgggcggtactggcggacgatcatggtggtaggtccaccctgctgcccgggggtgaagcgcggcctctggtgacttccctgaggtgccctgaacagagcggccttcctcttcctgtccatcttgttgcattaatcctcctgacggattgccttgtcaaccagcctttcgaaatcggcgtaatctccagatatcaactggttggttagctcgtcatccagacctgccatgaacttttcctgcttctcggcgtcggtacggacatcctctggtgcatatcgcgctaggccattgaactcatggagatactccgtcaccgtcctgttgccctgatggagtgctcggaattccctcttcttttgtgccacgaccccatctggcacctgcgccttcctgaagctacggcagaactcttcccaagtgacttcagtacctggtgggcgggtggccatgtgattgtcccaccaagccgacgcagggccttgaagctggtgtgtggcgaaagcaaccttctcctgatcattgcactgcaggagattcagcttcttctctatggcatggagccagtcattcgcctccatagggttggtggtgctggagaaggtgggtggcctgacacgtagaaactctggcaacttggactgagggggagggggaccaaactgctgatgctgctgttcggcgtgctgcagcatcctctggtgcatctgctggtgctgctgctgcatctgctgcatcatggctgctatcatctgtgtctgatgtgccatcacttgggctagcgtcggattctcgggaagtggtggcggaccattgccggaattgctgttgggatgcacaccctcagtgcgctcttcgccgttgctgccctcacccgttgcgcggctaccattcctggtgtaaaccatctggaggaaaagcatacggggaaaagaagaaaaacagatgctcaggaactaagctttattatttaaactgcaattgttctgatctgaattaaaacacttaaagagcaagcaaaaatccttattaagacagccatatcataggcacatgatatcgaccgtcgactgaccccaaacaagcaacctaaacacacaaactaacaaacaaatgctagacagtcgataaactaatggaaaacgagcctaatgctcggaacggctcctgcggtcggtggagtcgaaggcgtcctcctgctcgtcaccaggtctctctgagcgactcctggagcctggcagataagtctcgccgctgcccgactctgagccactggagctgctgctgctgagatcgcggctgccactgggagtagcagacaaccaacctccgttgccactggctggacccctggcggctgatgctggagcgaaggagagagcggacgcgggagctaacacgtgaacgggagctggagctggagctgcaggaactgccggagctgcgggcggaggtgggttcctgggcgcaagctggatgcgcacgggtttcgtcgtcgtcttgcggggtgtagtgcggatccggactcctcctggcgcgggaagaccctttaactgagcattctccctcttcaggcgcgctatctcatccttcaaagcgacgatcctcatgagcttcccatcattcaaggccttggtcgccttgtgcagatccgagtgcatcctatccaatcccctcatcacagcacacatgtgaccaaaggtggtgtcgttctcgccagctgtcggacggaaggtactgacatcatcaccactggctcgacgagggtgaaatcggtacgccgtgtcatggaagatgtagttgtggcgctcccgtagtctggccatcatcaggtatgctgcctcctgacaggcgtgatctgctgtgcctccagatgcctcaaccaccatgttagctaggcaggtacccacgtagccgtggacctccaggcgaacacggtgaggaagctcgccactgagcggtggaaccgtcgtgtactctggcgcattggggtagcccaccaccagcgtcatacgtgccaactctgccacaaagtcgatcatgccttctccacagtggttgggtgggtgtccggccatctagagaagacaaaggagtaggatcaatgcatgctcaaatccaaatttaaaaaaagcaataaaagactcaaataagagaatcgaataagagcgaaattttatgcatagatcattttgcatgagagcgaataaataagacagactcacataacgataaaataatggggaaattagatacatactaataataacactaagagcataaataccttgcaacccatgttcctgagctaggacctaatgcatttcacccatcaaatcccaactgactggcgaataaatctcaatagttttactaaaaccctggactgacttgttttgacaaatctcacttaaacgagcgaccaagatttttcccttgaaccacaagaacagatcccaattttcccggaacaaatccaattgcaaagaacatatgcaatgaaaaggattcagagggctcttaggtttttccatttggcttgtcctacggtcaaggtcggctctgataccaacttgtcacgcccagaaattcccgaatagaatttcaagcagaatgtgcattaaaatccccgtccaggaccagctggggtacacaaacgacaatgttgacattcagatccacgtcttacaaatatcataaaagtcttacataaatgcagcggaagaaaggaaagacaacaggagctaagccttgactagaactgcagcgggaacaccactccacaggcatcctcgacagcacggacgaagcctactcctcagagacaccttcttccaacacatactcgtgctctgaggttgggaaaaatagagcaagactgagtactacccactgtactcagcaagtcataccggaatagaggcatgatgcagggaatcatcaaagaagagctagagtggttcatttgcataaagcgagcatttataaacagaagttgaaagattaaacagttataatacttaattaatattaactatccactgtccaatgctatcccatgttgcaacaggcccaaccatccacctaaactatccaatttcaaaagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggaccattcgcataacccccctctaaccaagcacaccacacctcaggtttcacccccactcctcgcaaggcagcgggcagtcccctctcgtgcctaggtgaatccggaagccgcataggccgtcgcagggcccatccaaactccatcacgtccacccttgcctggatgcgtcggctagaggaaagctacgctacaagcccagccgttgcccacgctggcttgtggtaagtacgataagttcttctagggcatcccgcgaaccggtccttaactgccatgggtgcgaccagcaaaaccatacacccacagcccaccatgtgatttattttaattaaccaacaccaaagcggtggcactaatccaacaaaaccattagaaccaacagtctaaacattaataagatcttccccattgtgaactagttgaactaagcatggctaagcaatccctagtccaaactctaatcatgttataaccccaagctgacaaagagacatggttcaacaacagcatggctatgacaataggtaaacatcccatagtaacattataaaataatgcaatatttgaaagaaaacaacagagcatttgcaatataggatcaacatgttcaagtgacaagcatgacttgccttgctctgctgctggaggaacctcggcgactatttcgaagtacaccggagcgtcggaggaaccggaatctagcgacatacaagacaaacattgcaaacaggctataagactactgaaacagggaacaaaaccatttttaatggattctacatatttttcttgatttactgagacttgaatgggcttaaacggagctcggatgaattaattatgaattttagaagattcactgtgtttattactataacaaaaatccttaaatattttattgcgcaatattttctagggttgacgtcagcacgggggaggtgcggcgccgacatgcggggcccactggtcagcggctcaggggagagcggttcaccgtggaccgggaccacgcgggtggtccaccgccggtccacggaaccgacggcccagatcgccctcggggccgatcggacgggcggcgatagaggcggccgccgggctcggctcggcatcaaagccgaccggccggccagggctaatggcggcggcacgcgcgcgtcgcgttgccggcaacggcatccggcggcggaggcgacggcgcaaaagcgacgcgaaagcggcggcagcggacggtggcaacgaccgaaggcgacggcgagcgcgggcggcggcgacgcacggggaattgggaaagaaaaggaaaggggagggagtcctcaccggaggggacggcggcgtccggcgacgaggagcgacggagggaggtcaacacgcggcggacggcgaccgggacgacctaaagaacgaaaagaaagagattagagaggaagagaggggccataggagacgggaatgccggccgaaagcggcggacatggcgaccctcaccgtcgcacgatgggaatggcgctccggcggcgaacctcgacgaaggcggggtggacggggtggatctcggccacgcgaacccgacggcggcgacggcgcggtgcggcggcgaccccagcggcggctagcagcggccggagtagcggaaacagcggcggcaagaggttgcacggcgcgggagcgatgggaggctcgggagagttcggcgaaatggggaaaaagcgagagggggcgacggagaagcttaaatagggagagagggggccggacgtggccaagagaggcgggaatcgccggccgacatggggaagtggggaaggagagagaggcgggattcgaaaatcgaatcccggccatctcgggcgcgggcgcgggcgggagagagaggggagtgggcgcggggaacgcggcgcacgcgcgggcgtggtcgacgtggcccgaaggaggcggagacgtgggcgcggcgacggttgcgggcgcggcggcgcggcgggagcggcgggaggtgggggaaggacccgacaggtgggccccacctgtcggtgaccccaggagaggagggcggcggggcggcctggctgggcctcggcctgcggccggcctgggaggaaaggagagaatgggccagcggcccattcgaaaaaaggaggaaaaagggaggaaaaagaaaaaagaaaaaggaaaaaggattttccctggaattaaaatattgcatgctcaattttaattggttaaaattatttctagagctctgaaaattccactaaaaatcctgttagtgaatttcggcatgtagaactcaagaaaaattccacatgccaattccgattattatttgcattgatttaaaagggtttactcttgctttgcacctgtattttcttggggtcatttataaattaaattttaggcttgggaggagaacttcggggtgtgacaagctccacctggaaaaggcgaaggatctcaggcaacagtacgttgcacggaaaccgaagccctgccttgaagaacatggcgaatacaaccgtccggttgtcgccgggcttcggcaccacggccttccccggggcgaaagcttgcccctccaccaccgcgccagagctgaccaactttgccaactcgtccttatccacaagtgaaacccctaaaaaggcggtgttgtcattgtcgatctggccgggatcgcggcccgtcgcggaggccggattcggtttgcggggagccatggcgagaagcatgcgctgtggcaaaaagggtgaacgggcgaacgacctagcgactctaagggcgctgtgaagaaaagagagagaaagagagtgatcttgcggtgaaaatgacgggggagcggcggtgaaaaaggggaaggggagatatatatagcccacccaggcaacagttcaccttccacccaaccacgagccgccgcgtgtcataagggtaggcgaaatggtaaattcccattgaccaggccgcacagtgacaagcccacgaaggaaagcccatcactgttcaacccggcccagcgaaagaataataccaacttcgccgattcgcagagtgtgaaagctgtaacacattactaaccacaggaataatgtatgcgcagtgcacacatcctttacaggattccaagacaggtttcggtaggagcatcggtcaaaagggggcgtctcataccataccacatagtttgcatggtctcggccgaagctcctatctcacccttgcccgtgaggggcttgttggcagtatgtcatgagacccttcgaccagacctgccgaaaccgtgcgaccagtcaggattcaggctcaaggtgttaagttcatcggggcgaagccccatggtgaaagcggtgaagccacatggcgaagacaatggaacgaggacggcaaaagatggagccccatggcgaagactgtacatcctgggcgaagggtgcccgccgaaggagggtgacttcgccatcctggccgctttggccggcctttgggccggcattcgccaaccaggcccattagaggcccatgtatgccaatgacactgtatacccatgtaaatgtccctttcacaagggcaaccatgtaaattcccctgtaaaacctaaaccctaataggggggcctgtaacaaggatataaatagacccctagggccatgtaaaggggatcccaagaaaaattctcaatctaatacactttactgttttccaaccatcgttgagtaaccacatccttcgacgtatacagttgttatttcgacaacactctataaataccatctgcgggtatagcccatcatataaaaacactatttatcatatatataaaaaaaggttatcatgagcaaatattcgtttgaacaaattcaacacaatataataatagatttaacatggtcacgcccatacaaaaccgaagcatccacgctagttcaatatatattactaagctaacatgttcacaggtccatgataacattttttttagatataataaataatatatttttcatatgtttgtatataatttctctcatattctaacgaatatttgcccataataatttctcccatatgataaatagtattactttgatttgacctaggggtaaaagagtcatattaagtctcatttcatacttgcaaagctgacatttcattttaattaggtaaatttggtaatttataaagagtagctctctctgctgtggcatttatataaagaaatttggaagagtgtcttagtgtctttccgtaagagcggtgaatacttaaaaacccctggggggggcagcatgaaccctgccctcccaggctactgctaccttgctgacgcaaaaggatggagatattttgatgatttaatcaacaaatagggacaaaactattttaattgaaagaaaataatattacggttaagtccccagttgagtgatattcgtggcgaagtctcattttgataatagtagaatgtcaattctctccatcaaagcgagggttgatgagaagacactcgtaagaaaattaccctcttcaaatatttgaacgtatcattgtgatttgtgaatgtcacggcaaaaaatccataatggtgattttgtttccattcttattatcggcaataaatgtaggtgaacagtagtatgagaaataaaatccatgagatagaatatagtctcggattacaggtttcatctaatgctaaataagttaaccacaagactattcgaaattacactgtattccatatagtattccgaatattccaaattgtgcctactaatgcggaaatgtttttggcagaggcaatgattatatgaaaccaaacatttcattcccattagtaattacactctattccgtagagtattctgaatatccctaattgtacccactaatgcagaaatgtttctggcagtaagatgatatgaaagtgaacaattcatccccaccagttctccattcttgttgatcaccggagtcccgaactctgccgaaacactcaccgcgcagttgtgcgagaactcatgtccattcaatgtcctgagcacaaacaaaatcagcattttattattatatagacgactattgctgtagcttatttacttgattatatggataataaatcaaatattttgaaaaataaacttaacaaatattagtttaaaacaagtggttaagcaatgaaatagaagttttttttgagagaacgtatttttcaaagcacgaagcaaataatctgctgattaagctgaaaatgacagggatgatatacatacatatgtgtgacatttcctggaattagttgcccatataagccattatatacatacactgcttcggacatctgaagcggctgattgcacatttcgaccctcttaaaaagatcggtattgaacttttcatcacccggacagcaatagattccaaccaatccatttgtaatattacagtgcttgggaaggggttttatgcattgttcccccggaaagtcaaccgtgattttatcagctgcaatatttccctcaaacgcacgagcatctgctacaatatatgcataggtcggatcacactccacaataataccattttgccgaatagttctttctggagttttttcgatggcaatgttcaccacacttctataaatgccattatacacctggggcacaaacagacaatttatgtacttatgtagtgacccgtcaaattagataatacggtactgtagtaggcactagttgctcaggatgctcagttctctgtgtgtttgtgtgtgtgtgtgtgttggggggggggggtagccaaggcaccatagaaacacttgccgattccgtgattctgggatccacctgacttaagcataaatctactaatctaaagccgacagttttgctggcatcctatttgtccatttggcactacaaattgcaagagatttggtgaaatcatgtctctcgcacttggtcactctagatcaatccggaaggtggaacgacatattgaccattggaaaaaaaaacatagagagaaagaaggcaggccctggctgctctctctactaggaccgtatggcccaatatacacatatgggcttattgcgcatggacggaaaaagaagaaaaaacaaaagaacataacgcataaaatcattcgacaaataagatatactacaggtaaagatggtagataaatacgatataatatgggttaatttcagaaattgagacaagtatgatgactatatttataatatactacgctctccgtccctaaatatagcaacttctactaatgtatttggacatggccaatgtgctatattttgggaaggagagagtatatttctagaaagaaacaataaacaacaaaattaaatgatataaattatgtaacaatattgtatcaaactttgcattcctaaaaatccttttttaagaatatttagtttccgatagattctcatacatatagaaaagtacaaatcacagcaatttcgagataccatatccttccttttatttttactaatagtatatatagttatttgtcaaacttaaagagactcaatccaacaaaattaatggcaagcatatattattattactatgttattttgatttacaatccattaacacgtctttttagtgtatactttctgtaggaattaaactaagttagatagtaacaaaaataactaacccatgtaaaaattatacaaattattttctgtgctatagaagagctctaaataatatgcaagggccataaactaaccggcgccaactggggcgtctatttttctagtaaatgagtaaacactcaccggatctggcgccggatccataggaggcgggctagaggcggaggtgctggaagcgcaagggaacgacggcgtggagcgagagacttcgttggaggcggtaggggcccagcgcctccgccgcgcagccagtcactaggccgcaccagatccagacatggatggatggagacgaatgaggagggaacagttgacgagcgcgtgcccagactccgccttggcctgcgcccactctgggctgggcaccgccgaccggccgcctgctcgccgcgaggggggagctagcaaagggagacgacgagacgagagaagaggcggcggcgctcggttcaggggcgagggagagagtgtagtgtgcgtgtgcgtgtgcgtgtgcgctggtctggtgggcttcgaggagggagggtaccacggactgtttagggcttgtgggctggtcgtttagtgctacttactaggaataagtctattttgcctcccacaagtcttgctcttggatgaatctcacccctcaaccgtaaaaccgggtataacgcatcccccaacttctaaaaccgatgcaaatagagtcccttggtgattttaatagcggtgtcatcatacgtggcacttacgtggcgggttgacttaatctttatcccatgtagtattgacgtgacactaaaaataaaaaacctagatagcatccacatgttagtgagtaaaacaataaaaataaatatcagacccacgtatcagttaccctttctttctctcaggtcttcgcctcttccctgcgagtgacaggggatagatgccaggagggagcaccgtcttggcgttgtccgtcccgtcgagagggcggcatataacacacggccacggcgctcctcgaagtccagccggcggcgacgttcccgtggactgcgggatgagctggcgtctcagaaggtggtgctcgccgagatggcgcaggaagtgggccttcccaccagtgagtgcatctagtgtatcatctcgacggttattgtcgggaggtcctccttggggatgctagtgtgctccccaacattattgtattcaacaccttgctcatgggctttctcgaggacaacaaacactaagccgttttctgacgttgttagcaaactgagctcacaaacactaaaccattcccgaatcttttttctgctagctcaagaacagtaaaagaaaacgattttttaatctgcatcttggggttcttgcagattcttgggatgacggagcgacgcaaggcccgggagggcaccgccacctacttgtcgtcgcaccactggatcaggagagggctatcgccaaacattgcctatgcccatcgcctcattgccgctgccaccaaatctgcttcgctgcccttgctgcgggcctgcgtcgtagtgacgagcatgccaccacttagagtcaatgacgcataggccatcatgtatatgtgacatatatgagtacagcggtaaattattaattaccacttataggagtgacaaataattaaatatctcaaatttaagagttaaaactctatcaaacatactcttatctcattacgttttgttccgtacctagacaaggcacggccaatcctgtccatccgatcttcgaatcaaatagaccagatctcctcgacgcaatccccttgatccgtgcctccacgcctctcccgagggtacgcctaatgggcgatcgatcgccctggggatggggtagcgatcagattcgctccccacctccccctctctcccttcacctggttttctttttttggcaccgcattacttttctattttagtaaatttatatacctaaagtttatacacctcaagtttacacatctaaactttagagaccaaaagtttataagtcaaaagtttatatatccgatttaaatttgaatttgaattcaaatattttttatatatagtatttctatacatctaaagtttatacacctaaaatttatagacctaaagtttatatacccgatttaaatttgaatttgaattgaaatattttctatatatagtatttctatacatctaaagtttatactcctaaagtttatagacctaaagtttatatacctgtttcaaatttgaatttgaattatatccgattcaaatttgaatttgaattcaaatattttctatatatagtatttctatacatataaagtttatagacccaaagtttacatatccgattcaaatttgaatttgaattcaatttttttatatatagtatttctatacataaatttttctaactttttgtttttttaaaaaaaattgtggagatgtgtaaacttgaggtgtacaaactttagatgcataaatttactaaaataggaaagtaatgcggtgctaaaaaaaaaaaaagaaaactaggtggagaaagagaatcagatctgatcgcccctagcgaggtagcattctcgctcccccgaggccccgacgcgcatcgctccgcatccggactttgtccccagtccccatcccacacactctcatcccgccgcctccgccactttcgcgacgcaccgactacgcgtcccctccatgtcgcgcccacgcctccgtagcgtccctggcggcccctccacacgccggcgtgcgcccccgccttctccaccaccgtctccgcgctcaaggagttcatcctcgctcggtggccgcaaggtcaggcaggagattcttgatagagtagatggattttgtcacctgatctgctgcatatttgatttgatgaaaacactagggcttgtgacctgatctgccgtcgtttttctcgcctggtgtttgtgtgggcgtttctttccctccctgttcctaccctctcctgtggttttgctcgtgtccgatgactgttaaatcggtaatttatccttctctgaatggacattctgaccaactgagtagcgcgcaattagtccttctccccgtagcttcaacagtgttctagaacttgataattccccttctgagtgtacttgcatcatccataaaaaaaaccttgacctcgcgaatttggatattgtattgtgggaagaatatatgtggcagagaaccggaaagacacattttaggcaatgattcggaatttcagatcataaataagtgcgatgatgggccaaacaagaaacaatgtcgtcttcctttgccctatgtagagtaaagacgaattaaatttgaaaatatactgttcatactttttttttcagaaatattcgtgatgaaaatctttttgcagaaatataccgtcgatctcacataaccattgagcatgacgtcgtgggcggtatcgtgcagggaaagccggtctcgctgattgaaatagcgataccggactgccaccgattcaattagtgattaattatcatgattagcgattaattaattaattattaatcactaatcaggataattagtcactaaatattattagttaatagttaattaggtaattaatcactaattaaaaagtggagatcattgcatcagtgagacagtgtcgctgtttcaatcagcgagaccgctcttccgttccgcgagactgcgcggtctcgcccttttgcgcaacggttgtgcgagatcgatggtatatttctgcaaaacaatttgcatcctgaatatttcgaaaaaaaatgaatgaacagtatattttcaaatttaattcgagtaaagactcaaagaagatggcacaatgccatgttttataacagtattatgcgcttttcgtgt

SEQ ID NO: 26954 - DNA, 2076 bp, Oryza sativa
tatatcaattaagttagagatatgattattagttcagttagagataagattagatcagcccatatcaattaagttagagataagattattagttcagttagatataagattagattgaatccttacttaggggtcaagctataccatctatataaggatgggattgtgtctattagcattaaacaacgaatatcaattagtctaatctctccctctcaacagtgttcttctccctagcctaaatctacatcccttctccaggagccgacgctgcccggctatcttcccggcagtgtttatcccgtcatgtactcatgtcctcgggtcatgacagtctggctgatgttttgccaaaaaaagatgctgattataaatgggtgtctgtttacattgatatcattggaccactgattttctgtataactgaggaaatgtatagatcaacaattgtcagagaaaaaaaactgactatcacacttagacatgggttcttttcttgatgtgcaatgcttgggtgaggtgctcctgcctgagtaaactagacaagtatctgcaaacaagatattcctcctgcagtacttttgccctcattgactgcacacacactgaattacaactggaagtttgaaaatggtgcaatttctgtttttctgagacactcgattgattatgaatgagaattaatgttttctggaggtcctcagattgacctgcattcaagggatcttttgtaattttgtaaagatttcacttaatcataattcatacttgttatccttattggattccaaatttattttattcaagggattgttcttgccatttttatgacagacaaggaaataactccaaaaactgtcaatgacctgaagctcattaatgccggaaggatattggagaataaccggacacttgtggagtcccgtgttcgagtagaagttccaggaggtgtaattacaatgcatgtggtagtccaccctccacaatccgacaaaaacagtggtattgccgccaatttgatctgtctttttttacattgttttctttttgcactgggtcaatcaaatcaaaggattggttaaaatttacatttacaagatgtttagatgtgatctctctgaattttgccaataaaatagattgtagtttgtcttgctcatgtgaatgacaatactatacctgagcactaatctaggattttttttcttgacatacccatgtctttttttgattgactttcattcatacatctaggagcagtaaatctaaggactggagaaacacatgttttgctagaaaaaaaatatttactgtcgtggagttatgatgatcaaaagagcacattgtgttctttttgtaaatatcaacaaatgctaattgttttgagaaggctggaacacataacctttatagtgaccagttgtttgttaataaataatttgaccctttcctccgatcatgacacatgcatctacatttgactacttattattctccaggatggatgattttgagtgagtcaatcaattcataggattggttgaagagtgatccttgcagttgcaagtaagtttgggaaatatctaggacccatgctttccctacacttaggggaatgcggctgttggtagttggtactcaaatccattgtagctgtttgtactcagatccgttgtagtaacgaggtaattcatgcatttttgcagcatttcaagtcaagcttgcaaaatctgtagtcatgttcaagtagtgagtgataatgagattctttttcgttgacctagagtgatttcttcacaccctggctaaaccagagatcaaacctggccaccaaagtgccatatcatttttctgcggtcaataaaaatcatcactccctgctttgatgatttctctcgctggcactaccctgctatgatgggaacccattgttgataaatctgatgcaaccaaactacttccgacattcctctcttgttcgatattaggttagtggggctaacctagctctccctggttttccatgcagagaggagaagaaataagaaccagagaacattatgggcagagtgaaca

SEQ ID NO: 26955 - DNA, 1505 bp, Oryza sativa
tcagcaattattggtattacaacttgcagatgcacacagaatatctattgagaaaaacaaatatcttggaggttggttgtgcagcagtcttatatccttttcatccttttggggacaaggagtcactttggcttgtatgctataaacttttttttcttgctttatttgtttgtactttatagacatgttctcatacatgtgcatgagtggttgaaattatgacatagttgcttctgacttctgtggaaatgagaaattgaatctttctttggaactgtgttatgtccacatactgcagcaattccagattttttatttggaatatgaactatgaagagtgaacactcgcttgattgttaacttccttttaatttgaaatatcaggggctagtgtgtacttggtatttggaccgagtcagtcagttatgcagagctgaatattaatggtggatactgtagttggacattttttctaagagcatatgatatattcttgtgaaaatgaagactcagatgcttgaactaccatgttgattgacatttaattttcaccttttgtgttttaaaggtgatatgcaaatacacatctggtcattggattggactatgctctacttcacaaagtactaagtgaaatagaaaagtaggcctgacacagagggtgggaaagatacacagccaaggtactccccaccatactattgttttagtctcagtgttccataccatttgatcataccttttcttgatagtttagaatccgtagtattgtggacaacctgtcagattcatggttcatttcaaatgctgtaatatattggtaagagtgattactgctgtcatatttcttcagtataggaaattacggagttgattccattgtttatttatgacacaacaagttgtcaacctcttttagggccagtcctctttctttaattggaggtgattaagagagatccatttttctcttgttggactgccaagccaaattattctgttattcatgattcttccaacctgtttcttgagagcattatgcacaactaagtagttggatttgtatggtgatgcttctttaatgccttctttatttttattccgagtgataaaaatgagacatatgttttacagtggctgctggatcattcttagtgaaacattatttcatgtacactattgtgaggatcatcattaccaccttgtagaataatacaataattggttgcatgcatctcttgatttgagctataccaatatgaaattatcgcctcatgtccttcacccttgtctggacgcagacacctttgtaagttagttattaagtagatggtctatatatttagcctgtgcacttgtgttgttgagggcaacaaaagaagatcaggcatctcattcagcacggcaactgtaaaggtatatttccttttagttttaattgatgtttgcttcttatgtgatggaccatataatataatatggacactaaatccattcttggttca

SEQ ID NO: 26956 - DNA, 556 bp, Oryza sativa
cgcgtcgcttttgcgccgtcgccttcgccgccggatgccgtcgccggcaacgcgacgcgcgcgtgccgccgccgttagccctggccggccggtcggctttgatgccgagccgagcccggcggccgcctctatcgccgcccgtccgatcggccccgagggcgatctgggccgtcggttccgtggaccggcggtggaccacccgcgtggtcccggtccacggtgaaccgctctccactgagccgctgaccagtgggccccgcatgtcggcgccgcacctcccccgtgctgacgtcaaccctggaaaatattgcgcaataaaatatttaaggatttttgttatagtaataaacacagtgaatcttctaaaattcataactaattcatccgagctccgtttaagcccattcaagtctcagtaaatcaagaaaatatgtagaatccattaaaaatggttttgttccctgtttcagtagtcttatagcctgtttgcaatgtttgccttgtatgtcgctagattccggttcctccgacgctccggtgtacttcgaaatagtcg

SEQ ID NO: 26957 - DNA, 824 bp, Oryza sativa
atgctactgtataaataagatgaactcgaggaagacaactatgatttggcaactcggtggcggtggcggcggaaggctcaatcctgttgggttggagcagatcaatccaaactagttgcctgaatccttgtgtgttcttgtttctcttgttaatttcttgagatcctgacaatctggtatcagagcctctcttgcttctcaaattctcttgattctgcggtgaaattgttccttggggtggattggagctgatcttcggatcggcaccgcgaaaaggaaacttgccccctaaggttcgcggaattcggagcgagagcagtaggtacctgatccagatccgaggccatggagactgataagaagttggacctccttctgcaacttgtggaagggaatgagaagaaacgagttgaggctgatgagcgcaccagggcggagtaccaagatctcaagcgtacggtggagtcacggattcctgccgtggagaagagggtggatgaactgggagccgcgttccaggagttgaatctcaaggtggacaagctcgagagtaagatgatgcaagctgccaaggtggagatcgggacaggaagtcagctcaaagaggaacaaactaatggtatgggtgggagcacacaaacccacccctctggtatgcaagacccaaattcaactccctctgcttttcatttctgtgaatcatttgcttagaaatctggtggctgtggtggtactatggaaattagtggtagtgttcccccaatgatatgcccacaattcagtggtgataatcctcagatgtggaaggccaactggggtgcagg

SEQ ID NO: 26958 - DNA, 547 bp, Oryza sativa
agctccaatgatccccatactctatgttggcagtatctcatgagacccttcgaccagatctgccgaaaccgtgcgaccagtcaggattcaggctcaaggtgttaagttcatcggggcaaagccccatggtgaaggcggtgaagccacatggcgaagacaatggagcgaggacggcaaaagatggagccccatggcgaagactgtacatcctgggcgaagggtgcccgccgaaggagggtgacttcgccatcctggccgctttggccggcctttgggccggcattcgccaaccaggcccattagaggcccatgtatgccaatgacactgtatacccatgtaaatgtccctttcacaagggcaaccatgtaaattcccctgtaaaacctaaaccctaataggggggcctgtaacaaggatataaatagacccctagggccatgtaaaggggatcccaagaaaaattctcaatctaatacactttactgttttccaaccatcgttgagtaaccacatccttcgacgtatacagttgttatttcgacaaca

SEQ ID NO: 26959 - DNA, 585 bp, Oryza sativa
atatgatcctaagcgtatgtttagttcaagggataggatgggtcgggttgggttgattctattttttaggtatttagtttggaggtagatgggattgcacaaagatccaaattgaccttgtctcttaaaaactgaccaaccaatccaaatcacatttctcactagctgacatgtgggccatcccttaagaagtagtaccacgacacaactatagatccagacatccgtgacaagctaatgctactcgttggagatgactcatctctaacaggtcgaaaagtatcacattttaggtatggttatagggataacccaccatagatacaaggtcatttgtgacgggtcacagttgtaacatgtcacatatgacctataacgggtcacaatcatgccccatgaaagataaaggtcatctgtgatgggtgtaatgagatggcccataacagatgagtagtcctaacttccacccatcactaataacattatttgtgattcacacataacaagtctctcaagtttctgcatggccgtggtaaaatcataaacttctggctagtgatgtgtgaggaatgatatagtaatatt

SEQ ID NO: 26960 - DNA, 3310 bp, Oryza sativa
  unsure (1)..(3310): unsure at all n locations
aataataagctgagtgaataaaaaaaatcctttttttttttgccgggaactgacagaatgccatcgacggtggaagaagaaccaaccacccaaggaaaaactacccccaacctctataggaggctactcggcattagttttaaacagccctgcttcctttcaaaattgtaatttcttctttgatcttctcaaataaaaaaaatgattttattaaagaaaccgtaggcccaaagaaactatatatggaaccagtaaaccatttttagaatctgataacattgcaaaattaatatcatgaactgagtaaactaaaatgggaaggatatgacaagcactgaccttcgggtgcctcatccattacaactggtacatcagcaggtccttccaaagggcttgcacactgaaaaggtgttcagaaaattttaggacttctgttttcatttctaaatgactacagagaagtcacacagatcttcaatgaatctacctttgtcctagagaaagaaagatcttgaagttgttgcatagcatcaattagcatgttcgttgttcggaacgaatgtggcactctgtagatatcacatggtgaaacctggaagctaggaaatgtaacaagagatggcttccagaaatcttctttgcatgcaccaaagtaccgagcaatcaatcgaccatcatcctctgacatcttattaaagattggagatgcgacattcacatcaactttgcttttctttgagcaaggaatatacttctctatggataattcaacaaacttaacttctggattataaacatgtggaacctatagggtgcatcatgaatttacgcaattagctcctccagatttaagaagcaactttatgaacacgatgataaaaagaattaccatcctaggactatcatggtattcaaatctgcgacgatcacgcaataacttcttcatagttttagtatttccttgcttacttaagtaccctttcatctcctgtccgctacaagccaaaaccagtttgggaagttaaggtaaccaatgcctgagagagaaatacatttaaaaaatgcaatttttgcggcactttggcaattttcaattttcaccaaccaaaaaaaggatatcaactctcccttcgttcttccttccagtccttcccatacgttgaatcatccttaatgcggagatgttggcatcaaaacaaaccacaagatcaacctccataatatctagtccttcctcaccaattgatgttgccactaaaatattgtattccccagaccggaatttctgtaaacaatttacagtcagatagaagaaaaaaatgcaaatcatggatgagcagagtatatagttcaatacatgcaaaatagcttgttgcattttctgtgtctggcccttcagttgatcacctaaaggcaaaaaacttgaaataaataaacacatcatatgattcatatgtttaaatgcataaatgctccattcatagaatattactaccactaaactacttggataaaggaaaatgtaggagaccactatgtttatttcgtatggtcattaccatccaaaatgctacaaactcctggagaatgaaaatcagaccagaacacatattctaattgaagaacttagcatattgaaataaaaagtaaagaactatagatcatatgtttcaaaatcatacttctatgaaatcagtgatctacaattaaatctcagctgatcaccgataacacattatcatacctgtagaactttgaccaatgaatgcagcaggcctcacaagttcaccatcaatatttcttagggagcacaatatttctctgtgtttcacagtataacaaaacattcaagccatataatagattggttctgacagacaattaagcaaagcacgaatgtacattgtttctgatgcacagctaaaataacaaacagattgtttgctggagcaaggagatatacacaatagcacagaaaattcaacaaaattatagggcatcctgagtcttaaaaacaacacagagaaactaagacatgaatgctagctatagttgatagggaactgtttaaaagatgcaagacccactaactgacttaaaaccaacccctacaaatgaaagtaaaatatgcatatccagtgcatagtgacatgttcagcactagtatgccttaattcgccgtttataaattatagctggttgtcaagaaaagtaaagaaattggatcagaagatttaagatgttgacaaaaagatgtaaagcttagttttcccaagctgacttgcctccaactatccatttggtgtccatgtttaatatgagctattgctgttatcaaacacaacttccttctgtcctgacattgtaggtttccatgtattaattcagtactccctctgattccatttataaattattttatacttgtgcacaagggtttagaatatcacactggaaattgaatcgtgtattcggagtggtatcatttatgtataaacattatgaaagtaactattggagtattggtcaatgcggcatgaataaaatgaacatgtatggtaatctgactagcatactactagcattctctacatattgctctttgacaatttcatctagtactcattctgttaaaattggtacaggataatcagtggttccatagatcaagttaaaccccatgacatacattgcattgaaccntgaaagaccaatgacctgtcagtccaatttcactaagaacgcgtcaataccattctcatgataccttcagtaaaagttgtttaagagaattgctaatagattaacccctgtgaaacacatggtgccaaatggcttctgccttcaacatatttatcatcggataagctagtaagctacccacatgcaaacaataacaatgataataaactaataacaatacaaaaccaaaaagaacagccagaaaaattatgcatgcatcaaattttcagtgtaaaataagaatttgcaaattgatataatagagaaaaagactactgcatagtttcttacttgacgcattctcggtaatgtgcaaagataatgacccttgagtcctttggatttttgcctgtgtcaacataacagtatcaaagttgtcataaataaacttgaaacttcacaatgtttgccctggttttgttcatgcaaggaaatgaattccggaatgatattgaagtcaatcaataaaagtttcttcctatagggtgtgtgtatcttgtgatgcaatcatgtgaatgaaaaaaaataacatgtaacatccgatcagtgtgctctatagagaaataat

SEQ ID NO: 26961 - DNA, 1463 bp, Oryza sativa
catctaggcaagggtgggcgtgatggagcggggcaggccctgcgacggcctctgtcgcttccggattcacctaggcacgagaggggactgcccactgccttgcgcggagtgggggtgaaacctgaggtgtggtgtgcttggttagagggggttatgcgaagggtcctgtcacggcctctttccggtatgtcgtggtgacatgtcggcgcactgtaacgtgtcgtggggctgtgtcttgtgggtacagttgtacacctctgatcagagtaaaactattcgaatagccgtgcccacggttatgggcggtcaaccagattcaccgtgattagtctcaccctagtgtaatcttttgattttggatagtttaggtggatggttgggcctgttgcaacgtgggatagcgttggacagtggatagttaatgttaattaattattacaactgtttaaatctttcaacttctgtttttaaatactcgctttatgcaaagaaccactttagctcttctttgataattccctgcatcatgcctctattccggtatgacttgctgagtacagtgggtagtactcagtcttgctctattttccccaaccccagagtacgagtatgtgtcagatgaaggtttctccgaggagtaggctttgtccgtgccgtcgaggatgcctgtggagtggtgttcccgctgcagatctagtcaaggcttagctcctgttgtctttcgtttttccgctgcatttatgtaagacttttaagatgtttgtaagacgtggatctgaatgtcaacattgtcgtttgtgtaccccggccggtcctggacggggattttaatgcacattctgcttggaattctattcgggaatttctgggcctaacaccaccgggccgtacaacggcagcgtgattaccgtgctcggcagcaaccacatagtggacgatgtccgtgagatgccgatcgtcgaaggcaccggcgcctttcgctttgctcgaggatatgtgcaggcacacacctatgtaggatcaaatcacaagaactaagccaacaagagagggggtgaatggttggtataccctaaaaccgaaaacttttagcagaaataaaagttaccctcgaaatcgacggaagtcggtctgaccgaagatgttctgccggtctgaccgagttgaatctccggtctgaccaccgagatcgcttgctgcgcctgtcaccgccgccggtctgaccgccgtgctcccgccggtctgaccgccgcaatgccaccggtctgaccgccggtgacttaccggttaaaccgccgaaacccggtgaaacacaaatcgaagaactcttaaagtagatgactttattgattatctctatgtttacaaagtgcaccaacagcactccttacaaaaattttgactaacgcgaaatcctaactcaaaactcaactcaattgctctcaaaagcgataccgggaagc

SEQ ID NO: 26962 - DNA, 1511 bp, Oryza sativa
aatcaacaatcaaaattcatgatttcatacaatttataatgcaacatcttaacaagcacataggttgaaaaataaacactaaacacatatacctattgcatttatcactctttctcaaataacctttagcacaaaataaccaagagaatttttgaattttttcttttcttgagcctttttgctcatatttttctcttttattccaggtacatccctgtcgtcaagactgtttccagggattcagcacccattattttgctcacatcgaatacgtccttgtcgtcaagactgtttccaaggattcggtattcatttttttcatatttttattctcttttcacaatgagcaattaaagctatttgaggaataacaattcaataaagcatatatatatatatatatatatatatatatatatatagcatttacaaatcaaaccatatgctagcatcaacattgcatatttgcttaattcaagtatagaatttaagtgtcatgcatcatctcctttaaaagcgaaatctaaatctcatgaaaagactagaatacatacaagctatgctatagacaaataaacctttaaattattgctagcatgcacaagaaaataccatatgcataaacaaagctctcttttatcaatttttctcattgtcatattattgcttgataaaaccacgaggtacaaactccccctcaaaccatgccaaaaggatgaattatgcccaattcaccacgaagaaaagcaaagcgattagaatccaaaggtttagtaaaaatatcagcaagttgtaactttgtgtccaaaaactgcaattcaacatctcccttctcaacatgatccctcaaaaagtgaaaacgaatatcaatatgctttgtgcgtgagtattgaacaggattcttagcaatattgatagcactagtattatcaaaaaagagaggtactttctcaaaagtaagaccataatctttcaaagtagataaaagtcaaagaatctgtgaacaacaactagcagcagcaacatattcagattcagcacttgattgagcaacactagattgtttcctagaagaccatgcaatcaatgatgtaccaagaaaatgacatgttccactagtacttttcctatcaattctacaaccaccaaaatcagcatctgaatatccacttaagcatatataagatgaagtagaataccaaatttcaaactcaagtgtatgattcaaatacctcattattcgcttgaccgcttgacgatgtgaagcacgaggagaagcttgaaagcgtgcacacaaacacacagcaaattgtatgtctggcctagaagcagttagatacaacaaagatccaatcatacttctatactctttttgatcaacagcttcaccatcttcatcaggacccaacacagctgtagaaccaattggtgttgaaattggtttgcaattctccatcttgaaccgtctcaaaagatccttcgtatacttcgtttgatgcacaaaagtacct

SEQ ID NO: 26963 - DNA, 1184 bp, Oryza sativa
aaatcacatggtgggctgtgggtgcatggttttgctggtcgcacccatggcagttaaggaccggttcgcaggatgccctggaagaacttatcatacttaccacaagccagcgtgggcaacggctgggcttgtagtgtagctttcctctagtcaactcatccaggcaagggtgggcgtgatggagcggggcgggccctgtgacggcctctgtcgcttccggattcacctaggcacgagaggggactgcccgctgccttgcgaggagtgggggtgaaacctgaggtgtggtatgcttggttagagggggttatgcgaagggtcctgtcacggcctctttccggtatgtcgtggtgacatgtcggtgcacggtaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatcttttgattttggatagtttaggagcggggcgggccctgtgacgtggatctgaatgtcaacattgtcgtttgtgtacccggccggtcctggacggggattttaatgcacattctgcttggaattctattcgggaatttctgggcctgacaagttggtatcagagccgaccttgaccgtatgacaagccaaatggaaaaacctaagagccctctgaatccttttcattgcatatgtcctttgcaattggatttgttacgggaaaattgggatctgttcttgtggttcaaggggaaaaatcttggtcgctcgtttaagtgcagatttgtcacaaatcgagtcagttctagggtatctagtataaactactgagcattctatccgtcatggcagctagggatttgatgggtgaaatgcattaggtcctagctcaggaacatgggtgtagcgcccgttccgtcgtggcacctagcgggaaaattatctcttaaaaaccctaattgcgaaatttgtttctttgcttgttgtctagtgtccgtgccatctcaagatctcaaatccccgatctatcgtcgagttcaattccgaatccaaatccttccaaatcaaatccctccgcaaaagtctattttacctcccccggggtcgatgggccgaatttctctcggcccatctcccccgggg

SEQ ID NO: 26964 - DNA, 9369 bp, Oryza sativa
ccgaccgcctggtcgccgccgtcgtcagcgcctgcccgcgcctgtcgcccgtgtcgccgctccgctccaaaccgccccgccgtcatccccgtcgtcatcgcctcggccccgcctctccgcgcgcaagccgccaagggacggaggcagagcccctcctcccactgccgcgacgcccccgctcccctcctccttttcccagagaggcaaggggcgagctccccttttctctccctcttttcccctttttccctctcgccggcgtcacctctgtcgccgttttggccgctagccggagcgctagctcgcgtcttgaccaccctaagtcggttctcaaaccgacattgccatcccataaacccaagcctcccccttcccttcctctcccattcgcctccacgccattgtcgccgcccccgtgctctgttcgccgtcgccgttcgtcgttgcgcatgtcggaggagccggcacgagcaaggacgcggaagaggactccgggcgcaccctcttcttcctcttcctcggcccgaggccggagagattactcccgcgccgtcggcctctcgtcactgcgccccgcccgcacggtagtgcctccctccgttcttcctcctcgctccacctcccccccttagttttcggtggtagcgcgagtagcctccccgtagctagccggcgccgccccgaccattgccgtcgctcgccgtgtgctcgccgccgtcgccgcccgagctccgtagcacccgctcgtcgccggcctcgctcggcgtagctccgcccaatccgacgctagcaacggattcccgtagccgcgtagatgctctctccgccgggaattggcccctcgtgacctcgtcgccgttttccccttttctctccgccggttgccgccgccgtaatccgccgccgcaatccgccgccgacggactccctccggcgaatccgagccgttggctcgtctcccctcgtctcgtgcaactacccagtgtgctcgcttttgcctgtatcgccgtggttcgctccgccgctcgccgctgtcgtccgccgtccgttccggccggcgtcgtcgtctacctcccgccggcccgcgtggcagccacgtaggcgccacatcggcgccagctcagccaagaccaggtcgagccgaccccagtcagtccctccccgtgtgcgcattccaccgcgagccgtgaggctgcgcgtgggcccgccgcatccgcgtccaccgcgaaccgcgcgcgtgcaccgcgtccctcccccaccctagtgccgtgccgcgtgctccctccgcacggtgagccgagccgctgacaagcgggtcccacccgggaccgcgcgtggtgagcccggtccacaggctctctctctcctccctcccgcgcgcgcgcgtcttgggccgctctgggccgccttcttgggccggccggctcgttaagctcggccgagccaccctttctctcaggccgcgccctagccgcccgagggaagtctattttccctccctctttccttttcttttcttttctttttcaaaaaggatttaattaaatccttttcctttagaccaaaaatccaataatcttagaaactcaatatcttcccaaccgtaaatccgtttgactccgttcaacttccaaaattcctcaaatctcgagatctatctaatggcacgcttagaggtctttaatagggctttattttcgccgtttgttgagttgtcccgtttcgcgtgtagtttcggagcccgaagacccgcagtgcgctgatttcgaggatcaagctccagatctcgagcaaggcaagccacctttgaacatcttgagcctatatttgaaatttaattatgttgcttgaaaaatattatgcattgataggactgcacttaagctgcttgtcccatctgcaaggcagattggcggacctacccaatttgttgcatttgatccttcctttgttaattgtgataccatgtcccccttgtaaccatctagttgcgtctcgatattcgtgcaccctgcacgagtatcgacggacgccttcaaacttaaaattttgagtaacaacttgggtaaaacttgggttttacaaaagacttggaaaacctgacacctgggtcggtgcttgcgaactaaatgaatttccaaaaccgcggaccggggaacgtaccgggtgtacggttttccgctcttgcacttaaggaccgtttccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctatgacggctttggaaatgccttgtcatgaaagcttggaggtctcccgacgtggctgatccccacgggctgggtgatccgggttagtaatgtcatgtgggtaaagtgtaccccctctgcagaggttaacaaactgttcgaacagccgtgcccacggtcatgggcggatgtgaggtgattcctagcgtagttttgtttaactactgcttgtgaaattgctgttgtggaaaggggttcgatgtttgaaaaatctgtagctgatagaatcagctaggcctgggtggccgtttgaaagttgttggcccgggtggccgtttgaaaagctgttggccgggtgccaaccttgtttcaattctaaagactgatacattacacatactctgaccggacgagacgcactgtctcatccgtgtcgtttgagaagcactcacttagttgtttttagaaaagagttcaaataaaatcaattgcaaaaacaacagcctctccttgaagcctgcattaaacacttatttcccctggcttgctgagtactcccgtactcacccttgctctatataaataatccccccccccagttgctgaagaagatgaagcggatcctgctgatgaggagttcttctaggagcaagccggctacgatgagttttagggtttcggcctagttcccaagtcgcgcctgtgttgtttggtcctagtcctggcttccgctttccttttgtaatgcagttgtgagctcggggcctgtccgcagcccaacatgactgtacctctactctataataaagagacctctattgctgtgataatctgtcttcctgtgataccagcactgtttcctgggactggtatcgattaacaggttaatttggagcgtcacgggctagttccggtcggtactagttcggggcgtgacaatgggttgcaaggtatttatgctcttagtgttattattagtatgtatctaatttccccattattttatcgttatgtgagtctgtcttatttattcgctctcatgcaaaatgatctatgcataaaatttcgctcttattcgattctcttatttgagtcttttattgctttatttaaatttggatttgagcatgcattgatcctactcctttgtcttctctagatggccggccacccacccaaccaccgcggagaaggcatgattgactttgtggcagagttggcacgtatgacgctggtggtgggctaccccaacgcgccagagtacacgactgttccaccactcagtggcaagcttcctcaccgtgttcgcctggaggtccacggctacgtgggtacctgcctagctaatatggtggttgaggcatccggaggcacagcagatcacgcctgtcaggaggcagcatacctgatgatggccagactacgggagcgccacaactttatcttccacgacacggcgtaccgatttcacccttgtcgagccagcggtgatgatgtcagtactttccgttcgacagccggcgagaacgacaccacctttggtcacatgtgtgctatgatgaggggattggataggatgcactcggacctgcacaaggcgtccaaggccttgaatgatgggaagctcatgaggatcgtcgctctgaaggacgagatagcgcgcctgaagaaggagaatgctcagttaaagggtcttcccgcgccaggaggagtccggatccgcactacgccccgcaagacgacgactgcacccgtgcgcatccagcttgcgcccaggaacccacctccatcagcagctcccgcagcacctccagttccgcccgcagctccggtagttcctgcagctccagtaccagctccagctcccgttcacgtgtcagctcccgcgtccgctctctccttcgctccagcatcagccgccaggggtccagccagtggcaacggaggttggttgtctgctactcccagtggcagccgcgatctcagcagcagtagctccagtggctcagagccgggcggcggcgagacttatctgccaggctccaggagtcgctcagagggacctggtgacgagcaggaggacgccttcgactccaccgaccgcaggagccgttccgagcattaggctcgctttccattagtttatcgactgtctagtttctgcttgttagtttgtgtgtttaggttgcttgcttggggtcagtcgacggtcgatatcatgcgcctatgatatggctgtcttaataaggatttttgcttgctttttaagtgttttaattcagatccgaacaattgcagtttaaattcctatataataaagcttagttcctgagcatctgttttccttcttttcccccgtctgattttccctccagatggtttacaccaagaatggtagccgcgcaacaggcgagggcagcaacggcgaagagcgcactaatggggtgcatccccacagcgattccggcaatggtccgccaccacttcccgagaatccgacgctaccccaagtgatggcacatcagactcagatgatggcatccatgatgcagcagatgcagcagcagcaccagcagatgcaccagcggatgctgcagcacgccgaacagcagcatcagcagtttggtccccctccccctcagtccaagttgccagagtttctacgtgtcaggccacccaccttctccaacaccaccaaccctatggaggcgaatgactggctccatgccatagagaaaaagctgaatctcctgcagtgcaatgatcaggagaaggttgctttcgccacacaccagcttcaaggtcctgcgtcagcttggtgggacaatcacatggccacccgcccaccaggtactgaagtcacttgggcagagttctgccgtagcttcaggaaggcgcaggtgccagacggggtcgtggcacaaaagaagagggaatttcgggcactccatcagggcaacaggactgtgacggagtatctccatgagttcaatcgcctcacgcgatatgcaccagaggatgtccgcaccgacgccgagaagcaggaaaagttcatggcaggtctggatgacgagctgaccaaccaactaatatctggggactacgtcgactttgagaggctggttgacaaggcaatccgtcaggaggatcaacgcaacaagatggacaggaagaggaaggccgctcagttcagggcacatcagggaagtcaccagaggccgcacttcactcctggacagcagggtggacctaccaccatgatcgtccgccagtaccgcccgttcaaccctagcaattttcccagggcgccagtggcagtcagaaccaccatggaggtcagcccaaccgcggtgtatctccacgcccaccaatgacaccggcacagtcaggcccgtccgcgcaagccaaggagactggagcaaaaccagggtcctgcttcaactgtggcgagcttggccatttcgctgacaaatgcccgaagcctaggcgtgccgggccaaggtttatccaagctcgtgtcaaccacgtatctgcggaggaggcacaaacagcaccagaggttgtactgggtacgtttcctgttaactcaatccctgcaacagtactttttgattctggtgcaacgcattcgttcatttcaaagaagtttgtcgggatgcatgggttaataagagaggaacttagcacactgatgcgggttcataccccagggaatagctccacttcggttcaattcagcccttctataacaatagaaattcaaagatcaccatttctagccaaccttattcttctcgaatccaaagacctagatgtcattcttgggatggattggctgaccaagtttaagggagtcatcgattgtgcgaatcgcacagtcaccttgaccaacgagaagggagaaacagtagtgtacaaatcaccagactcaccaaagcaaggggtctctttgaatcagattgaggcggaaatcccagtggacaccgtggagaagaagttgaggaaattggaagatatacccatagtctgcgagtatccagaagtgttccccgaagaccttactaccatgccacccaagagagagattgaattccggattgacttggcaccgggaatcgctccaatttacaagagaccatacagaatggcggccaacgaactagcagaggtcaagaagcaggttgatgagcagctgcagaaagggtacattcgaccaagtacttcaccttggggtgctccggtcatttttgtggagaaaaaggataagacgaagaggatgtgcgttgattaccgcgcactcaacgaggtcacaatcaagaacaaatatcctttgccgcgaatcgatgatttgtttgatcaactgaaaggagctaaagtgttttctaagatagacctgcgatcaggctaccaccagttgagaattcgggaagaggatattccaaagacggccttcaccactcggtacgggctatatgagtgcacggttatgtctttcagacttaccaacgcacccgcattcttcatgaatctgatgaataaagtgttcatggaatttctggacaagtttgttgtggtattcatcgacgacattcttatctattcaaagaccgaagaagaacatgagcaacatctccgtctggtactcgagaagttgaaggagcaccagctatacgccaagttcagcaagtgtgacttctggttgacggaagtcaaatttctaggacatgtcattacagctcagggtgtggcagttgacccatcgaacgtagagtcagttaccaaatggaccccaccgaagaccgtgtcacagattcgaagttttcttggacttgcgggatattaccgccgattcatcgaaaacttctccaggatcgcccgacccatgactcggttgcttaagaaagatgagaagtttaaatggacagctgagtgcgataagagttttgaggagctcaaaaagaagttagtatccgcaccagttttgattctgcccgaccagatgaaagacttccaagtctattgcgatgcatcccgccacggacttgggtgtgtcctaatgcaagagggcagagtggttgcgtatgcctcgcggcagttgcgtccacacgaagggaattatccgactcatgacctggaattggcagcagtggttcatgctttgaagatctggaggcactatctgattggcaaccgctgcgaagtatatacggaccataagagtctgaaatacatcttcacccaaccggacctaaatctccgacaacgaagatggttggaactaatcaaagactatgacatgagcattcactaccacccgggtaaagccaatgtggtggcagacgcattaagcaggaaaagttactgcactgccctatgcatcgagggcatgtgtgaggaattgcggtaggagtttgagcatctcaacgtgggaattgttgaacacaggttcgtagctgctctggaggcacggcctacgctcgtggatcaagtcagagcagctcaagtaaatgattctgaaatagcagagctgaaaaagaacatgagagtcggaaaagcccgggatttccatgaagatgaacacggcacaatctggttgggagaaagattgtgtgtacctgacgacaaggaactgaaggatctgatactcaccgaggctcatcagacccagtactccattcatccaggcagcaccaaaatgtatcaagacctcaaagaaaagttttggtgggtcagcatgaggagagaaatagctgaattcgtcgcactctgcgatgtttgccaacgagtgaaggcagagcaccaaagaccagcaggtctactccaacctcttcaaatcccggaatggaaatgggaggagattggaatggactttataacaggactgccccggacatcatcgggtcatgattccatctgggtagtcgtggatcgactcactaaggttgctcacttcataccagtacataccacgtatacgggcaaaaggttggcggagctttacctctcgagaatcatatgtctacatggagtacccaaaaagattgtatctgatcgagggagtcagttcacctcaaaattctggcagaagctgcaggaagaattggggacccgtttaaattttagcacggcctatcacccgcaaactgatggtcagaccgagcgagtcaatcaaatcctggaagatatgttgagagcttgcgctcttgattttggtggagcttgggacaaaaacttgccatatgcggaattctcgtacaacaacagctaccaggccagtctacagatggcaccgtttgaagctttatacggccggaagtgccgcacacctctcttctgggatcagacaggcgagcgtcaactgttcgggacagaggtattaacagaagcggaagagaaagtcagaatcatcagggaaaggttgaggattgcccagtctcgacagaagagctacgcggataaccgccgaagggagctcacttttgaggcaggagattacgtgtatcttcgtgtcactccgctctggggagtacaccgttttcagacgaaaggcaagttggcaccacgcttcgtgggaccctacaaaatcttggaacgaaggggagaagttgcttatcagttagaacttccatccaatatgatcggcatccatgacgtgttccacgtgtcccaattaaagaagtgcttaagggtacctgaagaacaagctgattcggaacacattgatatccaggaggacctaacctatgtggagaagccggttcgtatacttgataccagcgaaagaggaaccagaaacaaggtcaccaggttttgccgagttcagtggagtcatcattcagaagaggaagcaacctgggaaagggaggatgagttgaaagccgcccatccgcacctcttcgccagctcctccgaatctcggggccgagattccgtttaaggggggtaggtttgtcacaccccgaagttctc

SEQ ID NO: 26965 - DNA, 682 bp, Oryza sativa
ctcccccactccccacgttggccggcgaaatccctcccctaccggccacgtccggggctcccctcccctatttaggcttccccgtcgccccctctcgctttttccccatttcgccgaactctcccgagctccccatcgctcccgcgccgtgcaaccacccgccgccgccgtttccgctactccagccgccgctagccgccgctagggttgccgccgcaccgcgccgtccccgccgtcgggttcgcgaggctaagctctaccccggccgccccttccccgtcgagtttcgtcgccggaattcgcatcccctcgcgctccggtgagttcaaccgctatcgccgctttcggccatgaataccggtcgccgtggttcatctccctctctctaatctctctctcttccttccttagggcaccccaaagcctgtccgccggttgccgtcgccggtaacgcgttcgcgtgtgcgcgtgccgtcgccgtcgccgcggccggtcggccttgagccaagccgagccgggtcgccgccgccccttcctccccccctgagccgctgaccggtgggccccgcgtgccggcgccccttcctccctctcccgagccgctgaccggtgggccccgcatgtcggcgccgcccccccctccgtgctgacgtcagccctgggatttattgcacaataaatg

SEQ ID NO: 26966 - DNA, 1386 bp, Oryza sativa
tcaccggaggatgagattgcctctagcagatggtgcagtagttggtgagtagaaggtagcaagggtaaataaaagaatctagatgggatgggaacaggaactggaagaatgatattgttgagatgtacaaggctacaagcttcattcaggtacttatttacatataccattcaacctaccaaaaacagtactatcatcagaagtgtatatggaacagctcaaatacaacgaactgactaagctcctgaattctcactatattggtatattatatcgaagttctaaacagaatggactagggctgctactgctttgcaaaagtataatcagtaaaagtgtaaaggatattctttcatgctcaaggggatgatgctcagaagatccacagttaggagcctaattatgcactatgatgacatgcaagtgaaacattgtaatagaagtgtttgtagagtgtaggcaatacccttctttatatttggcttcgattgactgatgtgctgccttgataccatagctcaaaagcattttcataatgccataaagtaaggttagagcttgaaaagatataccaatttcctttttgtctgctaaaggaatatttggcgggggtgcttgatcaaatttgtcctttaacatgcgcaactggtgtggactccactggaaaaaataagcaattaataatgcacatgagtagcaaatcagaagtgcctgagcagcaaagcatcaggacagaagtagataaattcttcacctaaaatgaatgcatctagatgatcgatgtattaaagacagcatgaacatacatttgaagcatccctgtgatcaatgaccctagcagaacgcaatttaacaagactggacgtataacatcaaaagcttatcattgacttgttcagcctcatcgccaactggtatctgcattgaaacaagtgacccttcagaagagagaaacagcatagacaacttacaaatttatcactgtccatgcacacctctaaaggttcaactgtgcgcctctgaatataacggctgacttcaggatcactttcatcacagtgaaccaactcagaaatgcgcaaattgttgataacattttgtatagctggttgctttgctgaataaaacaggattgaaaaattagcaagcatctccatttttcagcacttctatttaattttgaggagactaacatcctggtgtagcagtcagagctaaaatccttaacggcacacgagctgcctccaactgtcaacaaagcagaaaagtagaaaaataacaagcaggtgtcagaacgactcattcatttacaccctaccgatatcatcttcttcaaatgagcttgatatggaggaaacccatgaaagataaccaacaaaagagatt

SEQ ID NO: 26967 - DNA, 6150 bp, Oryza sativa
agctctagtgcaactgtgtttttactatgcgagaaaagaagtgatgctgtttcttccagaaataaatcaatatttggttgccacttgcattctaaactactcataaagcaacacatggaactttcaaagacaaagtacaattgtaaaatatccaataaaaatattaaaagcataggacaattggacaaacaagagaaataatcaccagattgtatatcattctgtagaacttgtggagtgacaaagaacactcttttagacttccaaaagcatgatcgctttgaggggcttagattccccttcaagtcaattgtccactcctgcaacaagtaaaaagcaatagttccaggtactggtagagaagaaaatttgatcttcaactgataccagataagcatgaacatctacagaaagaaattaatacctgtggtattcccactgtattatggcatgcctcaatttgctgagtaacaagaggacgtgtaggtgcagtaaatactattttccctttattttttcagatttacaagataagaagaccaactgtcagaaagggtttttcccaatttacaacagaagaggaaaaaagttccagcatggtacaaaaaattaccttcaggaaaccatctaaagtagttatacatcactactgctgcaataaaagttttgccaagccctgttggtaaagccactagtgtattggtaaataaagccttctctacaaattttttttggtactctcggacttgtacattagctgcaacacatgaacaaaagccacttaaattacacagctgacacattgataccttggttagagagctaagttattatgtgtaacctctaactatttacaaagcaaacatgattacagcagaagtgaactacaacaagaacagaaatgagcatttgagtggtgtttcagaagttattttttgtttcgcttatattggaatcgttacattattaatcactgaggaacagaatgtttgcacatctatgttggagagtggagacagggagtccaggagagttccctggggagttagaaggctatacaaaaaaaaaagattctgaggtccaaatgagcaatcaaaatacttagtacaccaatactgaaacatgcactaattaattgtgtctaaaccaggttattcttgcatgccaatgaaaatgctctagaaaactactgatgacggagtgattcttctcgaaatgcaggtagaaatggagaacactcacttggataaatccaagttcgcgctgcctcgtggtccagagcaacgccgcagggcttaggcacgacatcctcgtccgctctacgcgagcacccctcaccggcgcggtcactggggcgcccccagccgccactcggcgggaccggcgccgctgcgggcggcgaaccaggcacaggggggcccctggcgccactcggtaggatcggcgccgctgcgggcggcgaagcaggcacaggcggccccctctccatcgccgccatctgtctcctcctggtgaaggagtcgacgaatcggtcgagcgtcaactgccgcgtgccggccgccgccgagggctccggcggcggtgccgactccgacgcggcggaagaagacgcgagggcgcatcgcctgtcgatctcctgcacggccgcctcccagtcgaagtcctgcgggggggaggttagggtttcccggagcaaaggtgaaaacgcgagcggagggggggtgaccggaaaaagagaaaagagcgcctaagttgtttgttgtcatatataataatggcggggtcaacggcggcggcggaagcgggcgcgccaattcgccgcgggcgggaagtttcaaaaaggttgcgggttggggaattttgggagggggaggaggcggagggattttgggcgggaaacgaaaagttttcggaggcggtgcgcgcgtgcgatgctggtggtggtgatcgcgacgaaacgggcggcccgtgtgatttgggcctcaaagaacagtactgctagtaaaattacggcccatatgtatctgagaaatacggcccatataggataggatggaagaggattgtgggctacgtgacgcctaaataagaaaaagtacaccgaagatctctcaactttgtcgtcgggataaaaccgttctcgaaccacaaaaccggtatcacggatcccttaactatataaaaccggtcacaatttgttcctcgacaattttgatcctggttttgtcctacgtgactgctgagtcagcgtggaacccacgtagaccccaaatgtcaggatgccacgccaacacctttctctttcccctcttctctcccttctctctcacttctctacgctgcgcaggctagccgacgggaggggaggaggccggtggggcgcggtcccgcggcgccgcccgccgcgcgctccgcgaggtgggccgcgacggcgtcctagtcgtcgccggccgccccgtctccacccagttctccaccgttggtgcagacctttcctctggcgttctggcgccggcgccggcggcgtcggcggcgggaggcgggtgtacgtgagcaggccggtggggcaaggcaccacatcattgcagccggcaagccaccgtccgacgccgaccaccgccacctcgccgccgccgtcggcccccaccacctccacgaatctcccggcgaacgggtggtactccacaagcgccttccccagcgcctccctcgccggctcgccaccgccgccgccgtttccgccgccggcctcgaacacgtgcagcgactgcaccaggtggcgccccgccacgcggtcgagcaccgacagcggcagcgtctccgccggcgtcggcgacgacggcgccaccagcgacctgctcgtcctcgtcaccgtgaatcccatatatactgtgataatctcgctagcttagctagcttagtttttgtatgtgaattgaatgtgtgtgtgtgtgtggagatgcaagagccagtgccatgtgtatatataggctagctagctcgagcttatcattagttaattaagctaagctatgctcgtcctcgccaatgtggttcctccattgaacaacgggatcaatgctgagcctgagaacctcgcttctgggtgttcaccatggtaacaaatcggtttgattgcccagtggcggcggtcctgcactcctgcctcgccccaccggtgaccgacctcctcacgtacacccgcctgcccgccgccgacgctgccgccgctgcggcgccagaggacgggtccgcgtcctcgccagcagtggcgaactggccggagacggcgcggccggcgacgacgacgatgccgtcgcggcccacctcgcggagcgcgcggcgggcggcgccgcgggaccgcgccccaccggcctcctcccctcccgtcggctagcctgcgcagcgtagagaagtgagagagagaagggagagaagaggagaaagagaaaggcgttgacgtggcatcctgacatgtgggacccacataaggtcccacgctgacttagcagccacgcaggataaaatcgggatcaaaaccaccgagggacctattgtaaccggttttctatagataagggacccacgatatccggttttgtggttcgatgacgttttttatcccgacgacaagttgagagaccttcggtgtacttttcccgcctaaatatgacgggctggaactgggagttcggctacgtgcggcccatacaggatggaatgggctcgtatgcaaagtgaggcccaagtgattcggtccggaaggcatcacgaagagaggtccatgtaatatgggctgaaatggtgctgtatccatgggaaacaatgtatcccgaggtcaaggtgcttcatggcttcatgtcccatgattttatcatgctcatattttaagtattgtagtataccgttactctaataaaaaataatattagttggttacatgcaacatatttaatgatgtgaatttactcttcgtttacataaataaacgaagatacatttattaaatgatgcccattttggaaaaacctcaataaccttaggccatgtttgacaaatgggatagagaaatgatttcccacccactaaaagacatctttaaatcctaaccattcattctccccctttcatttaatcctaacccttcattcatttcccaatcccaatcccacctctcatttcccattatccaaacacacccttagagaatgattaaaatgggatggaggaagtattttgatgttattgatcttgttaacctttactagaggatgatcaaattgggatctagggattgataataagcattcattcctagataaaaaaaactaacacttgtaatgcatgcaaacgagcacggatgcaggtcctctgcagtactgcatgtgcagtactactcactgacatgtgggcccgatgtgcagtactactcactgacatgtgggcccgagggcctgtggggcccacatgttagtgagcagtactgcacatgcagtactgcagaggatctcaattggacgagcacatatgcctctacaatctatatgtgtggtgggaccattctacattcgattggaccattcaacatatctacatagcagccatttactactccaactttatacactcttagggtatccacaatatagcattttagcaggtaataagcattaaatactcacttattacccggtagtaaccattgtaggactagtaagtagttgcagcccggtaacacggctacaatcgggtaacaggaattaaactatcttatttgcacggtgtttctgataaaatgcatggaaataagtcacggctagagattgccatcggtgattttttctgaagctggccctaccttgtttcctactgatatgctgatacattgtggagtgcatgattgcttactactacttgtagacctggcccatactactgacacactactaccaagttgggcaagtaacattgatgttgcccttaggatgggtcacatctcattttaggttgagttattttgggatggagggagtaagggtgtttagtggtagaagagtggttaaaaataatatatgaagaaatttaaattagagatgattgatgttaaagcagtatacattctaaaagaatgatagtactgaatgtgctccccaccatatcgataatttcttcatgtactttaatattacaaaataatcttgcacagttctatcttatttcatttctaaggctcccatttgtctcggatgaaggtgaagattttttttgcgcacataaaataaggcaagccattaacacatgattatttgagtattaattattgcaaacttaaaaatgggtttatttaatattttagagcaacttctatataggagtttttacacaaaacatatcgtttagcaatttaaaaaatgtgttaaccgaatccgatgtataatttgcatcttaataataaacaatcggggctttggcctacaataacgtattattctaaaatcagtaaaatcaaagtgtttgattgttattttgtaatgaacaattggcatatgatattatcggttttgatatttggagattattgacgaagtggatttagagatgattggaattttcaggtgatgaacaagaattactaacaaagtggttgcttatcagaccaacgtatgtgagcggtctgaccgaccgacgttgtgttggtttcagtttaggatcgattctttagatatccatggataattcatatttatgatttctagatagatactagtgtgtaatattgttatttgctattagtgagtcaagttggtgagaacttgcactcagatatggtttcttggttggtgcatgtgtaagtgatttgcctcagaagagcgttgccaatgatgaatcgggagtcaacttgggagaagatgacgtccagacgatcaagatataatgcaagatgcttaggctaacgattaatgcacgtggttagtgaagattccatatggcatatgatggagatattgtgtaacttttagttctgctaaaaatttcagttttttggtacttcaaccattcacctcttctggttaacttagttcttacagtccgatcctacaaaatcctcaaaactaatactccttctattctatatcaatcatcattcat

SEQ ID NO: 26968 - DNA, 7491 bp, Oryza sativa
tgcatgtgggacttaaagtctgcgtgtttcttagttctcttccaccatatatgctcacattaaataaatactaggacttttaggcgcgcttcgcggcgccctaccgttcattaattaagagctatgtagcttatagatggtaatagggaaacatttcattaagagctatgtagcttcaaagcagagcaaatagcatgactatgagagagacgctgagagcacctaatctaaagcaatgaaaacatttgaccaatgtgaaggcttcgaacttcaggagtagcctgaacagtaaaaaacatttgcatacttcaaaaagctctactaagattatataaggcatattatcacatccgcaattgtatataattttactatcaccatctgtaatttttgacacgaaaatatttacagagttatgtacaaaagcttaaaaggaatttttttctttaatttacagagttatttaccaattcatatccataattatgggatggaaggttccatttgtacaacctacaaaatgcacaaatggttcatgaagtatttcatgtaatataaatgagcatttagatatgtggaatctgatatggaacctttggtggctataacttaactgaccaagtgaacttcacctcaaaatcagatgcaaaataagaacaatataatggtgtgtgccaaattcacttgagtttctagtttcaaaaaatcaattcgtccttacaaagcaaaccaaacctctgactgcacaggatctacagagcaacagatcacagctccaaagtatattgacctgcctgcaaccttgtggctccacgcattcagctcttttggtgtaactggcactcaacgtatgaaatttcagcatggaaaggaactgaaaggttcatttttctttcgaagaacaaataaaaaatgtaatgtcaatcaccaaagaaaattgtgtagaaagtgaaagagtatagcaattagcccacttagcagtttgtactgatttcaagttctactggagcaaattgcagtgtccctaagcagagcatgatgggtgtaggaatcttggtagatatttgcataggccatatcattaatctccgacctctaaccattatgtgttcaattcatggaaagaggattttgtgccatagctcaccacaacacgtttcagatccaatttatagtatttatatattaccaaacatgttcttaatttcatcattgtaacagaaacttccacacaatttcttcaccaattgctataggagcactaaatatatatcagtttaaatcagcatggcttagccctaaattagtagagttcattctgcatcttcaaagactaccaatgctgacttgcatcagcaccacagtgaatcatccaattacttagccagacctacagtttgtaattttagtcaatgatttttgcctctcaaatcctaaaggccaaatgaagaacagagttaccttcaagtgcttgtaatgatctcaccgagcccaacaacctaaatgctattggttggtctagtccaaaaacctcaccagaagcatcacaagtccaaaaacgtacttctattagtaaatgttgagcttctctgaaggtttttgttctaacacaatctgccacataacttcaattctgatgttaaggagcagaaatagagcctgaattctgcaatataaaatcctttagtgagcaagtatcaagtccagaaacctttagtaagcaagtatcaagtctagaaaccaatataagtgtatacttgaaaatgcaattaatggaatatatcaatgtatacgaaaataggtctagcccattcagtttctttaggaaaaaaaaagagccaattcagtttcattatgtgcaaggtaatctttatatgttgtcaaccatgtagctagaagcatcaacactaataaacatttgcttatgtaaatgaagcacaaaggcatttagaaaacaactcccccctaaacaatctctaataaacggggacattcatttctttgaaagaagcatatatgtaatgtgaatcaacaaataaaatgtgtagtaagtgagagtaaacatcaattacctcgatttgcactgatctcagttctctactgtactaaaataaagaatccctcagcagagcaggatagattcacagattccttgtagtcttgcagacatttacataggccatagcattacttgtaagaggcatgcaaaatatcatacctccgaccactgtaataagcaatttgagatagtggctgagatgatggtgagcaatcatatcagaacatgcagtgaaggtttcgttaaatatgattgtcatttagaaaaagagttcaaggtgaaccattgtggaactaaaatatcacctagtaaaattgaagtggaagtaggaaaaggcaaaaaaaaaaaggttcccaaaatacctatacatatggattctcaattaatgatgaagttgcatacatccattgcccctaagtaaattacaccataaataacaatggcaaggcaattgcaaatggcccttggctaggcgacgacagatggttcccagattacctgttgctggccagatctgcaattgcgaaacagtgtcggcgccgcacggcagcggagcttcaaacttgagcagaagggcgccaacccactgtggagatggagaaggattgcatcggctgaagagagcacaaagcaaaaggaatcaaatatgaattacagagacaaagaactactaaccaacggagaattcaacacaacaatagcccatggcaatgcaacatcactgatccagaccttcatggcgagcttgagtgcatgtacccaccggatctagcgataggccagcagatcgatcacctcgttgtcgttctccatcaccagcagccctggttgatctccatcaccaccacccctacttgaactgggaagagagaggagtagtattattatggtgtgtgtgtgtgttgggggaagggagggcgtcggcggcgaggagaagcgcaggagggggaggccggcgtctacccaccggatcgagtggcagggccagcagatcgaccctctcgccctcgttctgcatcatgaccactctccctgcttaactgggaagagagatggagagattgggcagggggagggcgacgaagcgacgacaggcgtcacggccaaacctcgccccgagccccacgtggtctggtccctccgcaggttcaccacggcgtcgacgattcaccaacgaccacagcagcgcctggacgaaggagaacgcgcagaggagtttgtgaggaggcggcgacttcggtgcggctagggtttttggatggcagtagagggcagccaaaagttaactcccccgtccaccctcgcgtgatggacggcaaaaaagctcgaggggcaagccgtcgtcgccggcgaggagaaggcaaagcggcggcggcgcaagggcaagggaaatgaagagaagggacgggggaacagtagtggctagggtttcgagggaatggggggattgggtgttctttttttttcataaaactcccttactttctctttttcagggcgctgtcctatacttggacagtcatatagagggcctaaggcagtgaacttacattgaggacttaagaaagattatcaaggtaagagaggatttttttgcaaaattaccagctccagcgctcttcatcgtagatgcttgatcggacgacgctgctggcgagtaaccagagcgcaccaaaatcaacagccttctagcgcgcggggggcgacgtggatacacgcgcgtgcgtccacgccgtcccaaattctctcgtgcgagcacttcgcccttgcttttaattaccccgattaccccgatatggtagttaaaatttgcttggttttgataaaaatttatatggggatcaatatggaatagacgaagtatattctaaacaatactatcatgtgggcaatttatatttatccgtaacaaagcataactatttagtaagttgtacaaaatctgatttctacccatacttatttttgcaaatataggctgtgttcggtggtgggtgttgggaacccatcacccacgcatgaaaaacggagcggtccattaacgcgtgattaattaagtattagtttttttttccaaaaatggatcaatatgattttttaagcaacttttgtatataaactttttacaaaaaatacaccgtttagtagtttgaaaagcgtgcgcgcggaaaacgagaggggagttgggaattcctgtatcaaacacaaccataagagcaagtttaatggtctatttgatgagcttctaactgctgcagcttctcatagaatcagaagctccccaaacagtccagcttttgatccaaattatgagaagatatagttatataatccagaaaatgaactagaagccagaagctcagaaacccagcttttccagtttctcagaagctggcttccaactagctgctttttataatcttaagctcctccaaataggctctaatactatagacaacaactattagcttcaagttatctataatcaatctaatagccaattcatacaatagttaactacaaatatatactacatcattaataattggtcccacatgtcatacacacgtaacgtttcagagttcgtgctgcagctggctacaaatttgtaacccgttttttttctttctcctctcttgtcttctccatataagtttatagctgacttatagtctattattgtacttgctttaaggtgtaatttaacttcaagaaaagtatgagcattcgtgtcgatacctcgaacgggtcggatatcaaacttggtgaacaggaaccaaacttcaacgcaaggttcttaatcaatacaagctgagctaggatgcaatccccacttcgcataatttgaattaatttgacgccaagaaagtttgaaatccaacttgcacacgttagagcagatgccaggctataagccagctataaatatattttaaagagataaaagaagagaaaaaaaagcatcgggctacagatctgtagtcagttgtagcacggactacaagacgtaatgtgtgtatgatagtatgacgaggtattaatagtatagtaatcaactattgtatgaattagctattacattgactatagatgatttgaagttagtagttgactatactattaaacttgctctcagtaacactcttaacttctaacttaaaatcactaaaaatagactagtagtactagttaataaacagtcttttgtcgtttagaattgaaaaatggctgggtctactgtagcattcctcttcttctttttttaaaaaaagagaaaaagttcaccgctcgaggagcgggcagttgtggactcttggagtttgtttgctaaatggctccgtctctttcttacaagttacatttgaattaacttttgttttgaagactgcaagagacggccatatattataattgcagttcacaatttgatttgacgacggaacggtcaatatatactatcttcattttaaattaaattgactataaaacagactagtgccccggtctatgttttgtgtcactcgaaatcaaaacaatggctagatccatcttgcgtaagcagtggttgagcaaaataaatgatgaatttaaaactatatgaacgcaattcacgtgttcgtttgacaaattagttggataaatggttcccgaagctaggggggttttcttataagtaatccatctagataatactctacatcttactgcaactccacgtatagtattcaacgaattaaaaaaaaccaatgaaccactgtcgccgctgtcatcgaatatacgcggccgtgggcaaccgcatcggtccacgccagcggcgaggcgcttaagcccgtctgcgaccatggcgtcctctgccacaggcacggaccgcacatcaagccatttgacgagattgaagaagaaaaaagaaaaggcaacgaagaagaagggaaacgggaaagcagctaacaacacaggatcgccccaccggtgcgccgtccgtcgcgctgccctcccgctacttaaagatacttacttcatcctagaataaatcaacctctcgtacaagatatgatatactctctctattctaaattgatctatatataattttttttagattattcctaaatgatctacgtatttgtgttgattcattaaatctattcgttatttatgcattggagtaaatggacattaacgtatgtatccatacacacacgtatttataacccatatgtaatatcttgattttctattggctaggaaatagtggagatggtgcatgcatgaagtttgttgctagagtgaatataacactataaaagagttattagcttttcttggtcttggtatacctataaaatatgtagatcaatttagaatggagagagtatcctgtaactatgaatctaaacatgcatttaagtcttataatgttttcacttcatcaatttttttattacacaacactaacatttactccctctgtccaaaaaaagacaaaccgtgggtttccgtgccaacgtttgactgtccgtcttatatgaatttttttataattagtattttcattattgttagatgataaaacatgattaatactttatacgtgacttatctttttaattcttttatattttttttaaataagatgaacggtcaaacgttgaacacgaaaatcagtgtttgttttttttttacggagggagtagtatataacaacactgttttacgacaatcccattgacttggttcgcggtcaatcacaaattcgcaatcataacagacgctccccaatccccagttccccaccccccacggccccacccacacacaacaaaaccaacaaaaaaaaatcccaaaaattcgaatagtatctgccaatcgtcctcatcgccggccatcgccgccgccgtcgccgccggccgaccaccgcgtccgccattacctcctccgcgaccggatctgctttccccaccccccctctctctctctctctcttcccctctgcacctgcatcgccatcacgattcgtcgattgctcgccaagtcaagtccactttgaaaattccatcccaactgcctccggcctctcccctcacccacctcgcggaagcgcccttatataccacgcgcttcgcccgccacggcgaccccgacgacccgccccgcctcgccccccaccgccaagcgccgccgcgtgctcgaccccgaccctgacccggacgccgccgccgccgcagccacggggaactcgccgctgggcggccgcggccgcagcggcggcggcggcggcggcggcggcccccgccaagccaacacctcggctccaccacgcggctcgcggctcccgctgccttcgtctggatcgcctccgcccgctccgtttgaccctttcgtcctcttcgcggatccggcgccgcggccggcgctcacgcgggaacaggtga

SEQ ID NO: 26969 - DNA, 2040 bp, Oryza sativa
agatagataacacgggccgttgtcttagcaatatcagtatgatccattcgatacgtatggactttagaacaatatacttttggttttgtggagtttttgttgctagtcatatgcttcacccaaactagtacgtgatgatgaaaaaggctatatttcattttgagtaatactttttatgtgtaattctagtcccgtggtctcttcaccaaaactggacatatttcttctcatttagttaactactgcatcacatgtaccttgatgcagtaaagtagttcattttgggggttgcgtaccgtgtaaagctattaagccatcattgttggaaccgattgtgatttgatattacaatcaacaatcacttatatggactagggatatgtatgctccatttcttacattatcttgggggtatataactgtattcttcatgtctctaaccccttacaatgatcatatacaggttatccaaatttatagtagtttttatgagacgagtagttatccaaatttatccaactatgaattattttttctagtggcatctcaaccatatcaaatgttgtatgaaccaactgattagacactcttttctgtacggagaacaaaactcatgaagatgagaagtcttatgacaatttcattcaaatctatatttgtgtcgtgttattgcacatttcaaaatccatactctacccaatgtaatggaaaactggctacactttcgtccatatatatgagaagaaacatgtattggactatgtattgttcagatgacctaatgtactgagaaatgttggaattgatttctcaattattattatttctttcaaacttcttatcaagtatgagaaatcttctgaatttcttttgaaattgagtgatataaagttgcaactcatttctccttaataaaacatttgaggcagcaagcattggttaaatttttgaatcctactattttttttttgtctaaacatgctctgcatttcttacaaagtctgtgaaagactgagagtagttcatatctggttctatatttcacaggacatacagacagcattccagacgggaaaatttactgctgctcaaaatcctgctaatagggaaaaaaaccgctacagtgatgtcatgccatgtgagcattatcaacttgtgttggctgctgtatgttagccaagagacctccatgacgtattattagtttgacttaacttctcttctttagttgatgaaacccgggtacgtttaaagccctcagcaagtgatcacccttcaagcaatgaatacatcaatgcaagccttatagaggtaaaaacacaggggcatatttcctggtgtttatgttatacacgagtttccatctttttcaatactgaatgtttcaaatcctagatgggacatgggacctctggatttgttatagccttataggttatttatgtggtataatatttacagactgatgaccaaggtcaaagtcatacaaagttcatttccactcaaggtcccttggtcaagacatttggggatttctggcagatggtctacgaaaaccagtgtcctgtgattgttatggtcactaaatttgatggtgccaaggtgctaatgttgtacactcctgaattctcagtttccaagttttatttacttgtctttacaacatattattgggttgctctttccctgcattatgttgaggctaccccaactccacttatccaactatgtcctacatgttttaatatttttattatcattatcattgtcatgctgaagtcttaatttcacatctccatggatccccctcttttgctttgttcaaatgggcatgaatttttttgttgactgttgcaaatctggatgcggctgttacatacttgcatgtatgcatcatctcagatggttttattatcatcatatattgatatgtaatctggccattggaagatgaaatagcttgcatctctatggagggcacatatacatcacctagattgtcatatgcaattgagaacataaaatgaacagaaaattaag

SEQ ID NO: 26970 - DNA, 936 bp, Oryza sativa
atgttgttatttattttatgtactgcagttagtgaacatgtgactcgtgaaaagtgacaactgtaccctaaatctgacgcttagcctttttttttattacaaaatatggtgctccgttgatcttttgctttgtaaggacagtacgtataaagcagcaatcggtgactttcttgtctttaaggcttagttgggttttctggattacggatatgctttagttggattgtcagaatattatccatcgaaataacagtgcctgaggctacctaagagtagcacagaataaggatcactgcagatactgtcctaattcaacattttactctgcaggatcaatacaagttttgctatatggcaattgtctctgagctgaacgacctgctatcaaattcaaaacactgaatcatttctatggtatgtttcttgcacgagggccttactatacgcactatccattacgcggtatcacaagctgtacaaacatatgcttgtttgcatcagtaatctcgaaatgttgcatatctcaattctcgtctcatatcttctcctctgcaggaacaatcagtgccctgggtatctctgacagattgtcgcccttcaactccctcaattctttaagcctagctaacagcattcatgtatgctgatgatgtacagcatgaagactgaaaaattcatgcttcagcaggaagctttctctaacttctccacaccaagaaccacgtgtatgatcccaggttatgcctggttctgtatccaaagctgatgatgatgatacaaggtttggaaatttgcagcggcgcttctcctgcccacccacctaactttgtgattgtttggtagcttctcctgcatcatgcatatgatgaaatttttcggaagttttaagactcagctttgtcacttttcaagcagtagtgacgctgcccccatttg

SEQ ID NO: 26971 - DNA, 21438 bp, Oryza sativa
ataaagacatgttcctaatttgtgtattaaataataaagacatacacgcaaaaccatcaccgtgaatgtactcatctatgaatattcccgaccttgtcctggctatacgtttattgtgagtgaggggatggatggtctatatgttaacgaaagagaaaaacaagttagattggtctactagtttctaagggataatgtcaatatgtatcttagaagaatatttcatttcaagaatgatcccgttccacctgttctctaaccaaatactttcattcaaaagtagactcacctgttcatcttataaatcaaacacatgcttacatgcccatatcacaggagcgactttctaatgtttgtaggagtatgtacaaaaattgccaaggtcgttcatgtaatgcacagtgaatggagatatatataatgaggtttattttaggggtaattaaatttaatgagacgttccagagggcggcttctgcaaaggagcagcacatgcacattgttttgctcattatattttaccagtcccctgagttaaaaggcagtgacgtaatccagcatgtaaaattttaagctatggcgatcacttaagctaaaacgtcattatgcgagttgaagtttaacaaagacacgaaaaaactcaaggtatttaattaattagacccactgtccattttgtctaacagttgacgaaagcaaactagattagattgctagtaaaaaaatatttgacattcaaattgtgcaaaaggggaattaatctagcattgacttctgctcataatgtgaaaggttccgttcagatcagggggtgcaaaatttataatgaattcttcgtgaaaaggtgagagtaccttcacgaagggagtacatcacatcacaagatgtgtttaggcaagtaatacaaacatgatgacgcttatttaataactaagtccattgactgtgaaaagcacatgggaataattccctattgatccctacctagtttattttccctggtataagtaatcaaaagctagctagcacagtactgcaggtgcttctcaagcaaagaattaagtaacctactatggatgaaagaacaatgagatgcatggtgtgcatgttagtgcaaatataaattaggagaagtcataaggttccatatatactactttggaataatggaataaacttagggatcttctttgcttttctcctctaatttcattatccacacccagccaattcaacaaacaatgggtggcaaaacaacatggtttttaatttgcgtgtgtaagaaatgtgctaatttcactcaatgtttcacaaggttggcacatgcacattattttcattcttcttccgaagtgctaatcttggctatcagtacattatttaatatttaatagcatccatcctattgggtactttccataaatacagtatacatagacctactggatttatttttataaactcttatacttattttagaatgtaaacattttatatttcctcaagactttgaagcaaaaaagaaaatattttctttagctaaatgtttcatccaaatcaagtaaattgtatgtagatttaaattacaacaaagctccaataaaatgcatagatgatacaatggcagcgctttaacttttaggaattgtttcttggtgatgaatatttacaggaacatttcaattatgggttgtatttaattctaaattgtgaactagtgcatttcacataatgagattactaaattggttgaatgatttctgatttgtctcatttagcaccgaactggaatacaggatgatgaacgggaaggtgttaatttatttcattttagacatcatttaccataaagagcacaattctaaagttagaatgttaataggcaattttgtgatatgaaaattgttattattttcttagaatgcacatcatgaaacaatcctaatttttctttaaaattaaaagagtacttacaattgctggaagttgatgtgagtctatagaatcatgtacaatggatataggaatttagtacaagcagaaaaggaaaggttagctaaaaataaaatttacccatctgtatttttatttccatacccatataaaattttacaattaattaatacgaaccttcaaattctgtgttgattcagtggacaaatcaaactgatttccacgatcattgggttcattgcaactagtttgtataatagataatctaactatctaattattgtatcaaagaaaatgttccaccaataaaaatgattagaattggggaacttacttccatcaccttaaaatgatatgagaatatggaatatagcatgcttagaacttttgttacattttatctataaatataagtctttaataatcattatctcatcaccataaaaatcgttgttttttaatgcaattgatttcctttttgacaacaacccccctcccctattccacccttggcaatccacaacatatcatttcctacaaccacattactactcataaactggatttatttttttcttaatgtgtggatcagatttggaattcaaactaaaattgtgtcggatagttgatgctagttgtatcgacttcactattttttcataaaagaattcaactgtgtttaataagtgggaacataacatacattttgtgcatttatatgtggcaaagcatccttcgctattaatatttggtgcatttagatgcaacgaaacatcccccgtgattaatgtttcattgtaatctttgaagtatatttgatcattaattgtaacaagtttttcatttatgtgtctcaaacatttaatgtcacatttttttcaccttaattgttaccctaccaagcattcggcacgtgactattaaatgtattgcccgtccttcctcgaccctcaccgtgacctcctacccaactctcaccttatagacacttatcatcaagttgtccatgccactatatcctcaccttcccaaacaaagtgttgctatctccatcacgccgcacccctcgtccagttgtccttgccatcgcctagaccatgagctttgccgcccctgtttggagagaggtaaggtgcggcaaagcatcctccaccattaatgtttcatcataatctcggaggtagatttcatcattgattgtaacaaggtttttcatttatgtgaccgccagccctttctcaaacatttaatatcattcaagtaaaaaatatttaatattattttttacttaatcgttaccctaccaagcattcggcgcatgcctattaactgtaacacacacccttcctcggtcccaccaccgcctccttcctcggtcccaccaccgcctccttcctcggtccccaccaccgtctcctaccccacctaccatcaagttgtccactccatcatatccccaccttcctacacaagtgtagctatctccaccgcgccgcacccctcgtccgacaatctttgccgtcgctttgaccacaagcttcgccgcccccgctcagagagaggtaagatctaggcttcacaaatcctagagggggtgtcgaagcactaatcccgaagaattcaccaatccacaggcgtggttttcacggggaaaacaaaaggtttcttcgatttttctaaatctagtatgcactctttcgcaatctagtatgtgtacctttgttttgcttagaaacatgccatgggtagtacaattttttttcagcagtgcatacttagctagctcttctggcatatgactaaccaaaactggaaatgatcagagaagtatgctcgatctactcatatatttttattcaggagaaaaatagagcagatctgatatgtgtgtgtgtgtgtgtgtgtttggggggggggggggggggtgttgaccatgtcctgttctctgcctgatacaccagcagtcaaccattaaactaataagagagaagaacacatataataaacctggatttaatttttcgaattctttactgagtagacttttttgccaccaccctgttgctctacattaaatcgcctcttcaatcgcttcctcctttttgctagctgctccatttttcctccttcgatgttcatctctgaacatataaacacgttcttggcattattattcctggttcttgatataatcgatccgagctgtttttatgatcattttgcatgctctccatggccaacctctcgtgttcgtccatggtcagataggatctcgtccgcatcatcacacggtatagtttttgagttctttgtgatcagatcatgaagatgagtcgtttctgctctgtggttggcatcgtttgcggctccccgtcgtcttcaggcgatgaagcttttgcttcccatggcgagcagcagcaggcgacgacgacgacgacggcgcagtcttctgggaagagctcgagctcgaggaggaagacggcgccggaggcctccggcgagcacaaggcgggcggtgaagcgccgccaccggcatccaagaagacagcattgctcgacaagggcaaagagaaggtatgatatctataggttactactcatgttcgtcttcatcttcttgtttgaagagcagatgctactctttcttgatgcttgctaattttgtggttaaaaactggatttgatgcagtggttttatgcattgatttgatttctttgggatgaaagtttcagaaatggtggtgttccagggagaagaatatgctagggcatcatcatgcatatgctgggttgagataaaaagaaacatcataaatgtgggatttaggatctacgttttaaacatattcacattttttttttgcggggaagacacattcacagttttttaatttgtggggaagacatattcagctttgtgtgtgtgtgtgtgtgtggaagacatattaatagattttttttttatttgtggggaagacatattcacagtttggttatgtttttgcggatcattcatgaaaatgcaccatttccttttaaaaggaacctatctatttcaatatttgtgatgtggctaatcaagaacaatacatcgtgcatcaattagactaaatctttctttgatcatttaggtatcagaaatggacacttctgtcaggagaaccagcaaaggaatatcaggcaatccatcagaggattccaacgaaccagtggctaaatctccgacactgaagaccgtgatcggcagcataaggaactatattgctaccaaaaagggtagaaaaataaagatcctggcctttgaggtagccaacacaattgccatgggttccaacctgatgaacttcctctccgaggaaaacataaggtacctgaaacgtgttgtgcttcagaaccaaggcgtccaaagtctgatctcagatgatcagagccagttgcttgctcttgttggggatgaaattaggtaattaatgactttttctataaatttcaatgcttttactatttatataaattattacttatatgtgtttttcaagatttcttacattcattgggcttggtttatgcagacaacagttcaaagattttgcggcatctgttgctaggcttgggaacatgtgcagggatcccaaatggcacaatcttgaagggcatttctctgggtaaaattttagctgccaccacattactgttcttgtataattcatggctcaatcatattttattctatctgagtgttcatttgtgtgcctcttgtcactgcgcagattggagtatggtcccataactcaggagtattcccatgaaaaagcagcatccaagatggaggatctgatggaacttgtgactaagacaaaggtgtgttagtcacatattttctaatgtcattaccactgttggttcaacacattttctttttaggaaccactgaaatgatgttgctgttctattttcttctgtgcagatactgtttgaagcattgcgccgattgggagtctccgagaagatgtacagggaagccaagcagacaggtgcttcccaaaaccatttgtgtgatcagcacaactaatcagaaatatgtctatttatgttcttcacatcagttcttaacatttttttatatgtgcaggtatgccacttgagactttccaaaatgcggtgaacattgaaaaagaaatcgtgcaaagcgcaaagaagaaagcactttgggtcaagaagattgaaaaagtacgtaaaaactgtgtgatatgatgattaatgtttatcacatttttcaataacgaatttatgttaaatacacaaatgctgtttctgttgcagattgtggaggaacttgtgtacattgtgcattacttgccttctgagatcaattgtgtcttctacaaggaacatgaagaggatagatctgtgaaggctaatgggagccctcagcaaactttagggtctgctgatctccagctgaattacgcaaggatcgttatcgccatacaagttttggtaagattctttgacagtcattaggccattgttctaggatcttggtcattgatcaagtgtagtcgtgcatgatataaacatatttccggttttcagttgatttggcacactaactgaaatgtcgaaactgattttatttgttcataaagtttcaatcgcaggtatccgtcgcatcatcggttccgcaatgtgctgtagattcattgttccatgcactgccttatagaatcagatcagttttgctacctaggatgagacacggcgattttgacgaccaggtgaccactcttttctgtcaattccgattacctgacaaaaatgtgtatcctgtatatactgttcatcttcatttctttctgaactttgcatcttcttattgcagaggacagaaacgcagatcgccgatgagatgaccaggagacttgaatggctctatccaatggcagaatttacaataaggtactgtaatctcttgccatatacaccaggttcattcaatgaataataacctgatgctcaccttgtacatatctgaacatcaggctgtctcagcacactggaatgatcagagaatgcctggtatcagggtatataactatgactgtcgtgtctattttgtcatgaacaatatgcaaaagcacaattgctgatttcactaataattcctcatgaaattcttgtaggagcctcagtgaccgtgatcaacgtaagatgctcaaggttcagacactgtaccatgctgataagatgaagactgatggctgcatcattgacatggtgatggaccttcatcttctcataaaagccgcgagactgagggctgatgcgccgcaccatagcggtcctcttgatcaaccagtgagtaccagtggatcatcaaccagctcggctagcacaggcatcagtggatcgaccagcttcggtaacattagcaccacttggtcagatattgatgaagatttcatcgccgtgatcgattagattcaaggtgtagattccctgcaaattctgatgtagggagagggatgcctgaaaatagagagggttttagctgagaactgagataatgcagaaatttagtttatagctctttagatactagacaaggttggtttaatgttcgcgcaatatttgagttcatgaatctgtatttgaggagctcacatgtacattttgtgcaaatggttggaagagagaagaaaatgtgctgaacatttttcctccaaataatcagaatttcttctccaatatcatatatactagtgtgatcaataattaaagatcatgcttaagcagggaagcagggatgcttttttgggccacttcaccttaagatcatagtggggatggcagaaaggagcagtcatgcttaaagcaatagctagtgctcttttttttttctaaaaaatgtcaaataaccttgataagatttctgaacttttgtcatggatgttgcacgcgtgcagactatacgattacttgtttgcaggtaccatcattggcaaattatttttgagggtaacaccattggcaaatcgatgagtattttttcctcaaaattgacacttgcatcttgcaggggcttaaattagcatgaacactttctcaattgaatggtgatgaacaacataatgtgtctacaacacatgtgctgatgctttcttgtttactcttctactcaatgagatactagtatatgatttcaccattgtttagcaatgagctgactaaccaaaactgcatcaatgcagtctctgcagactgaacttagtttgtgaagtaaaaatgtgcatcacacattttcaggtaaggaaataaataaatgcattatgcatcacaaacaaagctcccactggtttaagaaatcaggattatatgacagaagtttgttaagcctgcaactaaaagttgtctgtgttcttcggtatagtgtgttactgcaaccaagaaagttattactgaaagactaaaccaagaagaaccaccttttatagagattctagaactccattttttttgtatcaagatcaacactgcagcaactaaactcccctgtgttcttgagtgaatcactttcaacaagggccattattttcagaggagaaggcaaaaacactcttgtgaaaaattcagagaaatgcaaacgctttgtgtgaagcatcatctccatcttgttgtgatcagtgcatgacgtagacgttgtactcgacaatggcgtcgccggtcttgaggtccagggtgtgcgtcctggcctgggcgtagccgcgggcgaagcggaaggcgccggtgccgccgatcaccggcatctcccggacgtcgtcgaaggggcagttgcggccgagcacggtgaccacgctgccgttgtaggtgccgtcggtgaacaccaggttcattgcctggaggaagcccagcttggcctggtctgagcccatgtacagcccctgggcccggcccatgggcttggactcgggctcgggcccctccgtcagcggatcgtccatgacgttgatcatcccaaagaaggaccgcgatgacgggtccaccgggtccaccacccgcactgccgtcggtgatggcttgctcaccttgtcgtggaagtagaagtgcaggtgagtcgtcggtgaggatgctgacccgcggcgggccaagcccggcctggtttcttctgggcgggccgccctcgcaaccgccgcaagtgtgaccacaagggtgatcaccaccactcccttggcctccattgttgagctcaatgtgagcaaccaagctagcttcttgctatcgtgtgagtgagtgtcactacttgatgtgttgttcaggtgaagctcatgagctacttatatagcagtgccaccatggtcttggtgtgatgagctctatggcgtgcaagggaaggcgacacgtggcgggcggcgattggtctcaaaggctggtgattccaggtgaccttgtagtactggaagcaagagaaaagatcacaagtggtagggttgatgagcacagatgcaatgttggctttacctttggaatggcacaaacggaggcatcgattggttgcctgtggttgtggagcaaacactggaaaaagttttgtggttggtcggcttctagattgtgtcaaagaaactgatcaccaagctaagatcattgtggatcatatggattattttactagtagaatttctttgccactaattgcagagggaccagatgatctgggttgaagctactggtgtacgaaatcaaatcaaatcagatagtttgcccttcttgttgacggagacatcttggacatgatgacttggatgttggtttcagatgttggtagaagtagtcgttgaagcttgaaagcagctaagctatactacctccgtaaaaaataaaaaatccaaactgtatgggatgaaatatttttctagtacaacgaacaatcttatgctagaaaatatcccatccaatattagttgttgtttttttttgacggagggaatagactatagggtgatctactactactgctctcctatctctgtcagacgctcttcatgcgctctgaggcgcatactagatcgatcactagatgaatttgttttcacaaaatagatgaaacaaaattgtactccggaccatcttggtttgaagccaagtcataccaaattgttgacccttttaatagtactttgttagtatttgttttgctatcaaaatgtgccaagaacacacattttgataaaaaaaatggtgttggagcaaatccaactagtgtattctagccttttctgttgcgttcctcctcttcaatttggggattatgtacacatttatagtctgtacaagacatgggaaattacattcataaccctacagacctaaacccttcccagtgagcagataggcccacctagggggtaactgagtcatttcctgggagacaaatgcagggatggcgcccattaaggcggcatcttggctcactttggggttcccctgatggcccggctacaggctattacttaggtaatatccctcccccagtccatggcgagctctggtctctgcctcaccagccgcaccagggtgtccgagggtggttggcggctactagtgcgctttaatgaacgcccatccttgctgatgcctcgggctccgtcaaggaagggagatgctccgaagctggtctccctcagagctgttgcgaagccctaatggagcctcacctccggctcggtgacaggggattcccctctggagccagtcagccaggccacaatccttagacttggctccggtggagagcccgaatcctccttttgggtcccctgaggatacctccgaagcggaggcccccctcgacgcattaggaggctctccggaagttgctgaggtcgaagctacttccccaacaatggcactaccaaaacataccacattgccatctttttggcatagtaccaaatcaaacaaaccctccctccgtaacacatgtcaggtattagctttttacacggtttccaacatatactatgactattaatttcaattctactatcatgatacttctatatatattatgcatcatatgaaaatgtatttttaaatacgaatctaatgatacatgcatgtacaacactattagtcaaaatttttaaacatagacattgttgaaaacatgactttttatattttaggatagaacgagttgaacggatcgcaacgaaggctgaggttgaagataaactttgaaggcaaccggattctgaaattctttgtgtacagatgtaactgatgcttttgaagtagtgtctgttactccttcccctatctgacaacaaacaggtcgatcacttgaggcatactctcaaatgatgctccagctacaacatcaagaattcagctctttcaggagtttgtcagtgtgacacaaaacttctctagagaaattcagctagctgcaaaatactccttgttgatatagttagacctagtactgaacttgtatcagctgaattctgaaatgtatcaacattcaacaacagtaatcaggttaaagagagtcgagcatgacgcatgggttacgtcgtgctgacctggttgccgacatatatctggtaaccatggccatatgggcccacacagacagtgacacctcctatctctcaacgccgtatatatctttttaaaagaagagtaaatttatatagccataaatacttagatttaacgtcaaatttattacagaactacagatttaaaacatcgtatcacaaaactatatatttagtgataaagttataaaaaatacatattttagagtttatatccatagtattattgaggttggaaaaaaattgtagtttatgataaaactgatgttttaaatttgtagttctctaatataatactttaaatttatttttttgtgaaaaaataatgtcaaatatgtagttttgtgattcaattcattaacactcatttagataaaaggaattacaaataaattttgaaggatttcgattcttaccaaaatttccctattagcttcttttggaaaaaaaaaccctttcttaccaataacccctttaactcctaagcaatatactcccttcgttccaaaacgtatgacgccacttacttttcacataacgtttgatcattcatcttattaaaaaataaaatattatttattttacatatatttttacatattatactaaattttttggacgaataagctatacgacatttttttctgaggaatcaatatgatattgtgctatttcattaaaatatagaggtaataaagtaaaacccctaagggttaaaagagaaaactatacatggctgagagcggtctatgctagcaaggtaggaggtctctaagcctctttgggcctgtttgagggagcttctagcagcagctgttagaagctcccccaaataatccagctttttatccagattcttagaatctgtagctgtggaatctgaaaaatgaactaacccagcttctccagattctcatcagctgcttctcagaatcttaaagctcccctaaatagactctttgtcctggctacaaccaagctatatgacaagatcttatatataccccatgtttttttccctttgagaagtcggatgtgttctcgtctttcctctctagtatatctcctacaaaacaagttcctctaaaattcatgtgttttatttcctatggaccaaccaaattcgcgatcttttaatgtggtttttggatcatagggactaattttagtcactgtcatatcggatgttgggacactaattaaaagtattaaccgtagactaatgacaaaacccattccataaccctggactaatccgcaagatgaatctattgagcctaattaatccatgattagcctatgtgatgctacagtaaacatgtgttaatcatggattaattaggcttaatagattcgtctcgcattagcctccatctatgtaattagttttgtaattagtctatgttcaatactctaaattagcgtccagtcatccgatgtgacagggattgtccctgtatccaaagtgccactaaattcatatgttttaaaaatcctaaaaaaccccgatgtgtgagatatctttgtatgttttccccttttctgtgtcttacaagccgtatggtgcaaaagaagcactaaagcagagcacaagacgacacaacccggggactggctgataataaccgcttgaagagaccagcggttaaggtatcttcgtcatcaccggtgagtactgtgaatatgtgcgtgagatgaattgaatgaggccatatatcgcacacaacaacggtgtgacatcgcgatcgaatttgttaggagttaggtggcaggaatttggagcaacttggagaaaaaaaaaggtgaaagaggacacaaggatagatatggtggctattggtcagataccccatattgtcttacaattatcgttcaggtattagccggtctacgggtgtcttaaaatgacctgcccatatgtgataaaaaaatcattgtggccagtggcggagcggcctggccccctccaacaaaaatagtttcacatataatcacctatctataattaggtaattaacctaattagtgtattaataattatataattaggtcccctgcaagacttttaggctcatcctatatatagccaaatcctggctttgtcactgattgtggctcatgagttttcgatgctgcccgaagcatagagtgccgccgggcctgggccgcccatgcatatattataattggttggcctacgcatataattgtgtgaattatgctatcactgaaccagaacgtttgccacaattcagatgtgttgagttgttgaaagtatatgcatgtgacaagttatattcatgatatatatgtgtaccactcttcatgattaagagcaatagtaatgcgtcccaaaattttaccgacctcacataccacatagactaagaaccatattagctatatactccacaatgcatgttacttatagtgggtcttacctatctctctcctcacttttatctctccccctctctctcctctcacttttcccaccagtctctctctctctcgggcggaggaagcgaagcggcacctgtggcgagcagggctccacacctccacctctcctcgtcagggccggaggcagcgatgtcatcgtccgagcccaaacctctccactgcctccttcgccgtgggtcaaagctgccggagccggagccattgctcaacctcccgctcctccgtgagtccatctccatccctgccgacgagccggacaccaccaagcacaagcgagcatcggggcactgcccccgcagctctagaagcccaaacaacatcggcagtggccgccgccacggccacaacgatggcagtgtagaggagaggtggtggcatggcccaagcggtgacgacgccgggcggggctccacgtcgggcaggcaaaagatgcggacgacggcgccgccgagttacggatctcgggaggctcttctccctctccgtcgcctcccttgtcggctccgaatcgacctcggcggcgcggcctctctctcttcgtcgactccttcttccaccttctatcttcctcattgctgctgccacgcagtggcagcctcctcgagctcacgctgtggcggcggcgacctccccgagcccacacgtcggatctggccgaagaggcggtctaggcggtggcgtccccaagccctcgcggtggttgcagaaaagttggaggagaggagcggcaacttcggatccattgtacccgcttcccaaggctcatctcccttgctttttttgacaatgttagctgaaaaataagtgcccttatttggacgcgtgggcttcaggtgggtagcgccagagatggatgtggtaccaaatctccaacgtgtcacacataggctgaatgcaaacaagaagctcggtgaatggcctaactactcccgccatcctataatataataaccttatatacattttttttatcaagagcctgacgggtcccatttcttttattagaaataaaacatcgagctacagtagtcttcaaaaagaaacaggaaataaaaacggaaccttccacagagaaatgggggttaagaattcaaaagctagccctattacaaggggttcctgactcttttcagaagttttgcctgaacagatatctaacagcaaaaaagaaggagagggaattacaaaacatcatcacttatatctatctcatccctcaatccttttattgttgattctccatccgaactgcgagttgtagacttcatttgccgccctatcttatgagtctggatcccagtagcagtcttcttcgacttgcctcctccttttgcagtagtgcccaggaatcaactcaatggcaagccaaaaagatcacatcagtggggtcttttggataaactttttcaaaacaagctttatttctagatttccagatggcccaaattatagcagccattcctaccataactaagtctttcatgttcttatcaagtttttccaaccaatctccaaaaatgttttgactatcaagggctgggttcagattcaggacacaaattgcagtgttccacattaatcttgccaggggacggtcaaaaaacaagtgttgcacagtctcctctctatcacagagctgacattttttatccccttttctccagcctctcttgtataaattgtcttttgttaagatcctatttttggtgaagagccacaaaaaaaccttaatcttcaaaggagttctgaacttccaaatttttttctgtgggaaatgcacttgttgtagcttcaaagctttgtagaaagagttcacggttccatccttagttaaattccatcgtagtttgttattgcagttatcttttaattgcacatcaccccaactagtacaaattttgtgccaatctctcaatctccctccactcaggtctctcgtaaacttgatgcaatttatccctttttgtttcagttttgccacagttatatgttttgtcaaagtgatgttgtaaaggttggggaattgttcatttaaaggtttgccccctatccagctgtcctcccagaaaagtgtcttttcaccattgcctatcaccttggagcagaatttcagaaagatgtttttgatctccatgagcccatgccagaaatgggagtctccatttttaaatttcaataaagatatgggtttgcaacccatgtatttactggtcaaaaagctttaccaccaaccttcctcattttccaatctccagatccatttccttaacaaagctttgttcattgtttccaaatctaggatccccaggcccctttgatctttgggtgaacataccaccggccattgtaccagatgataaccttgtatatatgatatgacacattttagtgctatgaatctgggcatgactcgattggtatattttacaaacgaggtagtaaaagcagtaccacatgaaggcaagaaacagcgatgactgttcagatgggcctctcaagctcattcattcaaatccattttctctatgggtttccggaccagtatatttcttccaattgggctcgcagggaaaccactactctcataagagaaaaaaagaaaaaaaagaaggccacagcccacagcaacacatcgtattccttcccccgttacacttacacaggaagaaaattttctgttaggagtaaattgcatcgccggtacacgaacttgttaggtggggcaatctagtgcacgaatttgtaaaacacttgttttggtgcatgaacttatctggtgcgtgcggaggaaggcaaaaaggacattacatggctaatcttattgatttaggggatgattaggatactatgtaaacatatatctgagaaggttactattagatatacacctcttcaataaaaaaaatagaataggatatagtgatagtagaaaaattttaaaaaagcaagcaataatataaatgttagaaatatatgaaattcatcatttccataatgagggataaagtagataccaaatttataaatatggcatgtcttatgcatgcttactacacgtatacacgtcacatcctaatcaacatcaacttcgtaaaattaacatttataagttattttggtccttgtccgcatgaagtagacaagttcatgtaatgaaacgagcgttttacaagtttatgtactaaattgtacccacctaacaagtttgtgtatcaccaatacaatttactctttctgttagtatataaaattaatataagccctccaagtcacaaaagctagcttaatggatacgattttttttcttttctttttgcgaaacatggcaggttatattaaaaagcaaataccttttgttttactaccaggaatgccattgttgagtaagccatattcaattacccgccagcaaaggagagggattgctgaagcgtacagtatcagccaatgaaccaattgggtagtagtatatcaatccatagatacagtagaatatcaaaataagacataggcactgtactcaacaatggcatccctggtgttgaagtccacaaaataggttgtaaaatcaaaggtgtttttgattattattctgtgatgaacaattgggcattggagattattggttttgttatttagaatttattcacgaagtggttttggagatgattggatttcacaggtgaatctataggatactgctgttatttcatgttaccgatcagaccgggcagtgtgtgccggtcagaccggtggtgatcgagcggtcggaccggccagcccgcggtctgaccggccgatgctgtgtcggtttcggtttctggttgtttatttggatatccgtgattatttcatgattatgacttctagatggatactatacgtatgtaatactgttgtttgctactaatgagtcaagttggagatagcttggtctcggaatatggtttctttgtttatttcatgtgtaggtgacttgatgtctcgggagagtatttgcggtgatggaccgggagtcggcttggggataagacgacatccgtggtggtcagagatcatgcgggatacttaggctagagttgatgcacgtggttgatagagattccatatggcatacgatggaggtattgtgtgcgtatgggatgcggagtcgaatttagaaggagtccaaatttggtacgattggttatgtaaagtttctttcttgtactagagggtttcctaaggtgtttaggactcttagtatgagtttggttcgtggctttaggctgcctacctcatgtataaatagagggggagcgtgaggcttcccggtatcgcttttgagagcaattgagttgagttttgagttagggtttcgagtttagttgaaatttttgtaaggagtgttgttggtgcactttgtaaacacagagagaatcaataaagtcatcatctactttaagagttcttcgatttgtgtttcaccgggtttcggcggtctaactggcaactcaccggcggtcagaccggcggcattgcggcggtcagaccggcgggagcacggcggtcagactggcggcggcgacaggcgcagcaggcgatctcggcggtcagaccggagattcaacaccggtcagaccggtggcatccactcggtcagaccggcagaacaacttcggtcaggccgacttccgtcgatttcgagggtaacttttatttccgctaaaagttttcggttttagggtataccaaccattcacccccctctggttggcttagttcttgtgattcgatcctacaagtggtatcagagccttgttttcttctttggatttttatcgatctagagtttttgccatggctactcccgctaggttttcaactaagcctcatgttttcgatggaactgatttttctcattggtgtagtaggatgcaattttatattatggctgaagattatgatatttggagaaaagtttctcatccttatgtgattcctgaagctattaatactgctgctgaaaaaaccgcttttgaacaaaattgcaaagctcgcaatattcttttgagtggtatttctcgttcggattatgatcgtgttgcccatcttcaaactgttcatgagatttggactactttgagtaattttcatcaaggaacaaataatattaaagaacttcgtcgtgatcttttcaaaaaggagtatattaaatttgagatgaaacctggagaagctttggatgactatctttctcagtttaataaaattttgagtaatcttagatccgttgattcttcttgtgatgctaattatccacaatctgagatttctcgccactttttgaatggtcttgacatgtctatttgggagatgaaagttacatctattcaggagtctgttaacatgtctactttgactttgaattcactttatacaaaattgaaaacacatgagatggatgttctttctcgaaaagttgattctaaatcgagtgctttagttttttcttcttcctctttggatgttgatgcttcttcatctaagccttcttttcttgctgtttttaatgccacatccgatgatcaactcgaacagatcgaggaggagaatttggctttggttgctaacagaattgctcgagctatgaataatgccaggaacaggaaaagaggtggtccaaattgttgctttgaatgtggttcaattgatcatctttgttcgcattgtcctaagcttgggagaggcaaaaagaagacaaagatggtgagaagaccaacaacaacaacaagccgaagggttcataccaagggaggaagatggagaatcttaggaaggcttttcaacaagtttgcgccgcgttcgagccactaagtgatgtagatggtgagagtggagatgatgataagggaaagaacatctccgatgtttgcttcatggcgcgtggtgaatctgacacagagtatgaagataatgaggtaagtgcttttgaggaagctattaatattttgagtgaaaaaaaataagaagtgtgagaagatgtatagaaaataggaatttatcattgaatctcttaaatctgaaattgctagattaaaatctcttattcctaatgatgatgattgctcaaattgtgaggttttaatgaatgagatttcaaaaattagagatattaatgctgcacatgatttgaaaaatagatattctcttgcttgtagttttgcgttacacacacgcactttggatgagttgtttttaaccaaaaagttgttgcaaaaatatcgaattgcttttcatgctagtttgatgtttaacatgatttctgctaagaagttaaaacaacctcatgatgttttggattgctcaacatgtaatttgaataagttgaaatcgaaagatgctttaggtcgtgttgagtacatggaagatgttgtgaaaaacaatgaagtgctttcttgccctaaatgtcgtaaaagcaaaggtgtcatggtagattgtgaaaattgtgctaatttggaaaaagaggtttcttatttgaaaaattctttgctaagattttctgatggtaaaaagaacctcaacatgattttggatcaatcaaaggttagcacacataatcgtggttcaggttttaatccttatgctcataattctagacatcctcctgttgtgttatgtgttggtgctagaaggggtgagattttggttaaacctgatactaacaaaactgtttttaaatctgctggtatcatgtctactatgagtgcatcttcttcaaaatccaatgttgtgcatgcaaaatctcatgttgttgcttgtgttgctaaatcttctaattctaccaatgtgtctaatcatcatgaaaaatatacttgttctttttgtggcaaagatggacatattgttggtttttgtttcagattagctcataaacagaaaaaggagagagagattgcttttgcaaaatcaaagtggcaaaaatctggttttccctcgaggaaactggtcagaccgtagtgggtcccgcggtcagaccgacgaccggtcagaccggctgaatagcctcggttagaccaaccaccggtcagaccggcggtgaagcctcagtcagaccggctgcacaccctcggtcagaccggcctcggaggaatttttctgaaaattctaaaattgattttgcatgtggatatatgcctattggatcttctggtcgtgtgtctcagtactggatttctaaaattttattgtcatctaatcccagtactgaggcttcgacttctgcttgtgtgtaggctttggtggcaaggaaggagaacgtgtggatcgtggattctggttgttcgcggcacatgaccggtgataaaaattggttctcctccctaaagaaggcatctaagactgaatcgattatttttggtgatgctgctacgagtgccgt

SEQ ID NO: 26972 - DNA, 37014 bp, Oryza sativa
  unsure (1)..(37014): unsure at all n locations
aaacatggtacaacaatagcatggctatgacaacaggaaacaccccatagaaacattataaaacaatgcaatatttgaaagaaaacaatagagcatttgcaatataggatcaacatgttcaagtgacaagcatgacttgccttgctctgctgctggaggaacctcggcgactatgtcgaaatacaccagagcgtcggaggaaccggaatctagcgacatacaaagcaaacattgcaaacaggctataagactactgaaacagggaacaaaaccatttttaatggattctacacatttttcatgatttactgagacttgaatgggcttaaacggaactcggatgaattagttatgagttttagaagattcactgtgtttattactataaaagaaaaaccttaaatcatttattgtgcaataaatcccagggctgtcgtcggcacggagggggggggggggcggcgccgacatgcggggcccaccggtcagcggctcgggagagggaggaaggggcgccggcacacggggcccaccggtcagcggctcagggggggaggaaggggcggcggcgacccggctcggcttggctcaaggccgaccgaccggccgcggcgacggcgatggcacgcgcacacgcgaacgcgttaccggcgacggcaaccggcggacaggcttcggggtgccctaaggaaggaagagagagagattagagagagggagatgaaccacggcgaccggtattcatggccgaaagcggcggtagcggttgaactcaccggagcgcgaggggatgcgaattccggcgacgaaactcgacggggaaggggcggccggggtggagcttagcctcgcgaacccgacggcggggacggcgcggtgcggcggcaaccctagcggcggctagcggcggctggagtagcggaaacggcggcggcgggtggttgcacggcgcgggagcgatggggagctcgggagagttcggcgaaatggggaaaaagcgagagggggcgacggggaagcctaaataggggaggagagccccggacgtggccggtaggggcgggatttcgccggccaacgtggggagtgggggaggagagagaggcgggattcnaaaatcgaatcccggccatctcgggcgcgggcgcgggcgggagagagaggggagtgggcgcgggagatgcagcgcacgcgcggacgtggctgacgtggccccggaatggcggaggcgtgggcgcggcggcggttgcgggcgcggcagcgccggctggaggaaggtgacgggtccgacaggtggggcccacctatcggcgtcccggggagagagggaggggcggcttggctgggcctcggcctgcggccggcccagcagggaggagggagagaaaaggagagaatgggccagtggcccattcgaaaaagggagggaaaaagaaaaagaaaaaggggaaaaggatttcctggaattaaaatattgcttgctcaattttaattggttaaaattatttctagggctctgaaaattccactaaaaatcctgttagtgaatttcgacatgtagaactcaagaaaaattccacatgccaattccgattattatttgcattgatttaaaagggtttactcttactttgcactggtattttcttagggtcgcttataaattaaatttttggcttgggaggagaacttcggggtgtgacaggtggtgagcatgatgttcgttgccatcaggagcccgatccaggtttggtctgacgagacgtacatgccctgggctcggcccacgggcttggatctcgaattgggccccacagttagtaggtcgtcgaggaccacaaccatcccgaacaaggtatttgacgtgttgtccggcgggttcaccatcgtgaccgccgatggggaagggcagctgaccttctcgtagaagtagaagtgtaggtgtgtcggctcggaccatggcctgaggggctaggcccaggcccaccatgtgtgtggcccttacaactggctcccagcacaaggaagatcataagcattagtgctaatctctttgccatttttgatcttagagtggttgtgctgagtgatataactcgaccatgagctatttatagaggcatggggagctctaagagctagagggttggacgatgatagatggaagttttctagttgacttgtaactattgtagatcgatcgagtgatatttaaatataaacctacaattagattgtatatacatgtggacagtattgaggcacatcgatccatacagtgttgactataggtaaaatactccgatacacttggtttggttacttaagtataggagtaatagtatgccgtctggcttttaatagttaacactattgacttttatacatatatttggagactcgacctattaaaaaaatataattaatcttatctgttacggtttattttattgttattgtactttaggtatgacttatacttttatatttttatatttgtacaaaattttttaaataagacgattaggtagtcaaaagtaagttaaaaaataagcgacgtcaaacattgaaaacagggagtatttgttttcctcgtcaaatattacatggacatggaaagcctctaagcaagttgctaatgagctgttaaccacacccaaagttaaatgcacgctgagccacagagagtctcagagagtataaaagaacttgcatacatcatacatgcatgtattagttagaacacaagattgatgcacaagataaagctagcaattgtcccagtactattaagaaaatcatatactataaaagaaatatttaagcaattacaagaggaattattttatttaccgtgaattaaaatttggagatttgaccgcaagcattaattcagagtctttatctattggcaagttgctagtggctatggccacttataaattcctcataatatctattttttctcagatttgtttcattaatggtttttctttgcatatatatttgaacatgaaaaagaaacaaacacaagggtattacatcagacaccctatactgtcgatctgtcaaagactgagacctaagattgtaacagggtcaacctgtaaactcacttatagactaaatccagggttactacttatttagcctataagtggattcacgagttgacccacttataacctaactattgagatagaagctagtctagtagtacttctgtaccatatatgtggttcaatttgaaacaaaagttgtaccagtccatagaaaaggaaccaaatgtatatcctactatacacatcaaaccttggagaatagcaattaaatccaaccttgcatgaattctcccttattacacaagatatgtggtagaattaaataaagcttctctcttgacaccatcagtaattaactaagacaaacttaagcgtgcatcaagatcaatggaagacatagacgttgtactccacgatggcgtcaagtccatttgagtcaagaaagtaggtgcgggcttgggcatagccacgagcgaagcggaaagcactggtgccaccgacaaccggcatctcacggatactgtcggatatgtggttgctgccgagcacggttatcacgctgccattgtacggcccagcagtgagcacgatgttcatagcctgtaggaagcctatccggacttggtctgatgagaggtacatgccctgggctcgacccacgggcttggaccttgggtcaggcccctcggtcaatgggtcatccatgacatacaccgtcccgaaagaggttggtgatgttttgttcggtgggctgaccacctgcacagcggatggcgaggggccggtaatcttgtcatggaagtagaagtgtatgtgtgtcggcgctgaactattgcataaggagctacacccatgcccatacccgctttgcgtgtcggccttagtagtggcggccagcacaaaaaggagcacactcatcactactatttcctttgccattttttgatcttagagtttgtgttgagtgaataacactcgcatcctatttatagaggcatgggagctctagggctctatatatgagttggaggagggacacgtggcgagcagcgattggaggaattatggctatctattaattgttgctcatgaccaattggaagtacattttagttgacatgtccttgtagatcgactgaaccgaaagactagaataaaagattgtaatgcttacttaatttgcatttagattgtgtatgattaagtgtggttaacattgaggcacatataagaaatatatgtgttactttcagtaaagtaccccgaatctccaaactagttggttaattaatttttagttctccaaaccgaaggacgatgccttgtagtttgctgaaagcaagggcccaaccacgcccaaagtccacggtgcaatatcacttgtgcacaacaatgtgctcctagagaaaactaaattactccctccgatttgataatacttgtcgttttgaacaaggacacggtctctaaaaagtaactttgacaactattttctattataatataaatatatggttttattgaagtactttttaagactaatctacacatatggtttttatatttttaagataaatattttagaaattatttgtagtcaaagattttaaagtttgactttattcttgtccaaaacgactaatattatcaacccggagagagtaaacgaagtcctagaaaaaaatttcgaattgcgtgatgaattaagcttttaagcgccagcatcggacgctagaacagaatgtacatttctgatttctggagcataatatactcaagagcaagcaaaggtaaggagctaagcgcaaaaatatcatactgtaaaaaaaatgaagctcttgacaatcttgatgatatttgccataattagatactccctcctatcactttaatttgatgcggggaaagctaagcttaactctcccaacatgaagtaaaaatgactagagggagtaataacaaattaagatacacatgcattaaaacataccatcgacagtgagacatatgtcatatgactttatcgattttaagatatactaacccagtctttaaatgtgcttacagagatagaatatgtgcatgtgcatttattgaaatgagagtatgtgcgtgttataagcacctacatatatattgtgttaaaagaaaaaagaaatggcacatttgaggagtcttgaaggatctccaatgctctcaatcgatctctttgccagcatttctgaagcagctcagccagcttggagtggatatctttcagcaactcaaccaatttgttctaattcatcttgttttcatgagaaagatggactaactaacttgcacctctaaacaggaaaacaaataattaagttgcacacgaaggaagggaaccaaatatataaaagatgattcggtgaaagaggaaggatggcatcaattttcgaagacactgaaacaaattgtatcaattccctcttcaaataattgttttctaaaaacacattaggcgctcacatacacacacttagccttataaaggcacatacacactctatcccttgaaggacctctgagagatttgactggtatatcttgaggttgatgaagtcgtcgtagacgcatcgctgtcatcgtctatcattcaaatctagaacttgaaaaaaaaccaaaccctcctctactctgatgacccaatgaatgttgctggttgtttttatatctgaaagaattaattaaggggatcctttgcttgtgaatgctctgtttttttaaagaattctgaatgctctattaatgttttcttttggagaatcgatggggatatggtataacgaacgccaatcatccgatttcacaaaacacacgatacgatctgaatagtgaatactggatgctcgtgaatatttcaaatattggagctgaagctgagctaagaaatactcctacacgatagttaagcatatcaattaaccctatttaatacggcaaactcgtaatcacatggatccaattaacccttttaaaaaatatttgttagacttaattcgatagattttttagaggaatctttgcagattctctgctgtcccattcgccacaagattcatgccggggtcttctcctcttactcaagaaattagcgacagcccaaccgatttaggtttagggttcgaagttggggtggaaggggacggggggggggggggacgggggacgggggaagttcacagggcttagcgagacggccgtgggtggcagaacatgtgggtggagctaaagccacgggatcgttagcaggtggttggccaacattggtagcgggggtgtgggttcctgaccagttaggaggtgtggaaaacaatggggtggggcaccttaccaccgcatgatgggaaggagagggagagagggggagatggggtgcatgatggctgacatggcctcactggcaccattggcgccttctgatgagggcaaggccggggaaggcgcaatcggcgagggaggcaacattatcgtcgagattaggcgcgatttgaagcattgtgtaaaggagaacgacagagaagatgataaagtagaagaactgtaatagtacgaatcttaaagcaatccagggcatccaaaagtgactgaaatgaggaagcattttcttgtgaatgttacatagtcagtccctttgcctcaagatcttgcatgtcgattaaagttgggaatttttttcttctaccacttattgaaaccgtatttttcgtcccgccatcaaaattttgcatttctctcttttaccactactccattagtgccccatcctcttttgccattctggtggtcaatgtcagttgaccatcatattgtccacaaaaaccaatatatgcccctgtgtagctaaaagttactataagagaaccaatgaaaatgtgatttatcttttaattttcagaagttgtataaaacaattgtaggaaaaatatttatgctgtaaaaaaattgttggaaaaaaattcaattcgtttggaaggtttatataactttgtaatatatttagagaaaaatcatttttcacagccacatataaataccttatagcttccaatatttcaaaattcctagtatagactattgttgggaaaaatatttttccgatggctgaagagagagaatacagcagtcgagtcccctccgatttgctgagtggcggagagctgccccaggagttgtgattgtgaacgagagcgacaaaagattttacccctccatgccgttatttgttaaaacgatttttccgttgataatttctgctaccgttaacgacttaatggaggtgttagtataataaaagtatctaaccttttcatatagaaaataaattaacggtttggatgaagttttactatcgatagagagcaccataaagaaaataagtttcgccaaataatcttataaatccctttttctaagtatattgcacatgttccttatttagaaaaaatatataaaattataacttaagaaatcaagatcaaatattgtagtttaatgggtttccttggaaacaatttactgtgagctaacttaagaacatgtacaatagcaggctataagccagttacaaacatattttaaagagatataaaagcgaagaaagaagagcagcggactacagatttgtagccagctgcagcgcggactccaagacataatgtgtgtatgacaggtgagactaagtattaatagtatagtaagcaacaattgtataaattggctatagataatttgaagctagtatttggctatactattagccttgctctaagaatataagaagagatgccacagttgcttcgcttgcttactacaatcgattttgctatatctcactcgaaagattttttcttatctctcactcgaaagattttttcttatctctcactcgattttctcactcaaatttacagtgtgttttcttgtaagttacaatgtaatttatgaaatttacactgtaacttttgtaatttacagtgtaatttttgaatcttcgcatataagttttgaaatttatattggatttggtcttttttttctgaagatatggaaatatagtgtccattatggtgtttcttagttgttttttgcattttactgtgtctattggattttaatccaaggattaaaaatctgtgtgatatgattataaaaatctttcgaaagatgcataggtactccctactacaattgctgcagcttggggccggcatggctaacccacatcagatgccacacattttgggctacgcatgcggcccaatcaaatatattccactttggcataagttcacattggcttcctcaaatatatatagttttaatctaattcttatctctcaatcgctcctctaattattaaaatcgatgcaaaatgacccccttgatggttttgagagcggtttttttgctaatgtagctcattgacttagtttgaccggctgattcagtgtgagacccatatgtcagtgcatcctcctcttctttctatttttctctctctcctccctcctcttctcttcttggtcttcttggaggcaggggacgatattgtacatgcatgggtggcagccgagcttagcgcctacggcgaggccgtgtgggtcctcgacgccaagcaagaggtgttgagcctgttggcaccggtgacaccatgtgcgtggtgcgatgtcatcggaagtgaggagccaaggagctcaatcacccgctccacggtggtgaagggaggcgaggagccaaggcgcatgggcggtgcccgagctctgcgtctatggcgaggccgcacgggtcgttctcgacgccaaacaagaggtgttgagctggtcggcgctagccacgccatatgtgcggcgtgatgtcatcggtaactaatataaatgaattaattactaatgatatcaatttttttttcagaacagatatcaattagagtagttaattgatggaaacccacctgagttcgtcgccgcggtatcgcagtgcgcgcgacgacaagcggcggtgtcgcggggctagcattaatttggtcccttttctatagtgtacaattcttgttccaaattaatctatacgctctagaaggatgattaaatttggaaatatattaggatgtaattttttttggcacaaatataccattgatatcgctaaatctttgcacgaatataacgatggcgtgacgagtcgacgaagagcgccacggtctcgtgggacgcgagatgggcggtgtcacagtgcgttggcccgaaatggacaacgttgtcgtagaccaatcttcaaactttgaagattagtaattaaagcaaaccttgcatgaattaagtcttccttattacacggggcacatatgtggtagaaatttagtactcccgacattccatatggcttgcactagtcaacacagtgcatgttaaactgttaagccatatggaatgtcgggactggtactttgataatagaatatttatacctttttttttcataaagatgagtggtccaagtttatacatgaatagtatcttatatcaagtaagagggaacggagggaataatagcatcaacaattaagccaacctagcatgaagatcaatggaagacataaacgttgtactcgacaatggcatcaagtccgtttgggtcgagaaagtaggtgcgggcttgggcatagccacgagcgaagcgaaagtggccggttccgcccaaaatcggcatctcatggataatgtcggatatgtggttgctgccaagcactatgaccacgcttccattatacgacccagcggtgagcacgatattcatggcctgcaagaagcctatccgggcttggtcagacgagacatacatgccctgggcatggcccacgagctttgatgcgggatcgggccgttcggtcaatgggtcatccatgacaaccaccatccccaagaaggtcaacgatgtgttgtttggcgggtttactaccctcaccgctgacggtgacggactggtcaccttgtcatggaagtagaagtgtaggtgtgtcggcactaaactgttgcctaaggcgttgggcctagacctgccttccatgtcagccttagtagtagtggccaacacaaataagagtacactcatcaccgccaatcctcttgccattttgatcttagaattgaatttgtgttaatttgtgttgagtggatgatatactcatgacctatttatggaggcaagggataggacaagtgtgaagcagtgattgagggaatcatggatatctattgtctcctcatgagcaatggatatttcattgacctgtccttgtagaccgagtgaacaaccgaaagagaataagagattgtaatgttttgcatttaaattgtgtatatgtgtggacagtattgaggtacatatatgaaaaatgttactatcactaaaataccccaaactagttggctatttttagttctccaaactgaaggatgcgttaagttaatttggcacattatacgtacaaggaaagactgaaagcaaggtcctaaccagcagcatcatagctagtcaatcaatgcccaaagtccacacggtgcaatatcagttgtgcacaaaaatatgctcctagagggaaaaaatatatgtttgaaccaaatcctagaaaaaaaaaatgaattgcgtgatgcattaagattttcagcgccaacaatgtagtataaatgaacaggaagcaatggtaaagaaattaagcacaaaaaaaacatgctgtaaaaaaatggaaacattgacaattgtgaagatattatttatgtggaatgtactacgttacacttctcacatagtattacctccatcccataataattacatttctagaaattagagatagattaacatcaaacacaatttatcacaataaccatatatatttaataactacactgcatgcgcatattctatatgtctatacttgattaaaaggaaagttgagcaacacattcgatatgtaaacttaattaaaatgaaggttgggggtacacattccatttgttgttgtgtcccatcttaccagaaatacaattttttaagataaaatttgaatggtagaaatacaattattatgggacggagataattcttctataaaaatcaagcaatataattatacttgcgtgtagtagtatgcagaggaaatagttaacatttggcaacaaacatccatgaaattgctgtataaggcccttaacaaacttgttgcctctgtagaaaaaaaaaaacttgtgttttcagactactcgagacaatcacaaaaacttctgtaatatggcatggttggcattatcgttctaaaaaaaacagtttgttcacattcaggtttcataattgtttacatatgcattttgtacccgtttctacaacgaggctttgatgaagtggcttaacaaaagtttgttctaatttatctcgttttcttgagaaagataaattaacttgcacatctaaccggggaaaaaattagcaggatggacataaattaacttgcacatataaaagatgattaaaaaaaatcaaaatctcttatactgtgaaacggaggcagtaccttaacattacaacttaattaaaatccaatggcaacatgatatagtttgaaaggttcgctcaagaaaagaattattgtgagttcacttacgaatttaagcatctattgcagctggttgcagtgactgcggcacatcacatggatctatcgagcttaattcagttggaaaccacctggcccgggtgaccgtctccaagaaactgtgaagcgacaaaagaaaatctcacaagaaaacagttcatcataagatgcaaacaaattttaaagtgtttgcttgcttggatttttttttcttgtattcatgcccccatctccggcggccgccagcgccacagccaccgacactagcatggccctcttccgcacggtctgtcttgctcgtcggtgcagaagaggccgtaaataggcccatcgagatatgggccgtttcatcggtactctctctgtttcacaatgtaagtcattttagcatttcctacattcatattgatgttaatgaatctaaatagatatatatatatgtttagattcattaacatcaatacgaatgtaaaaaatgctagaatgacttacattgtgaaacggaggaagtacgttttatatttgatctttaccttacccatgaattaagactcaaattaatttagagtaaatttcaactaaccccatgtactattatggtctaaattgtacagaaccacgtgggttttgacacgtaacacataaccttgattattatggccatgaagttttacaaaaccacactattgatcattttgaattataagctatttattccttatataagtgttacatacatgtaaacatacaattttgaattttgatataggagtatgtcgatttggttaacgccatgtgttgatggactatggtgcccacctacgatatttgtagagtatgaaaaacgttgagatcatatctagctagcagacaagggacaagtgtttatattggttcggggccttaagatgactaataaccctacttccatttatatgtatatcagggaaaaagtagattacaatcaacgactagggctttggcttcctccgaattgtatctcgatattgctcttgttatggcttgtaattcaatatcctccccttattgggaccctgtatttatagggatgatcatctttttctcaaagtagaaatcagagaacctgaattagatatggtccaagaagaccttattttctctgaatatgactttgacatcttctatccctagaaaacaatttcctttcggatcaccgtattaccttaattgactatatattcctgtatattattaggtatgtggtactttcatatagcacaaacccaaatataagaggtatgtcttatccttaacagttaacactaatagtgtggttttagaaaacttttggaccataattatgtgtcacatgctaaaatctatggttttatgtaaattggctcatgataagtggggttttataaaatttagataattttttacctagcttaatattactgttacaggaagatctgtgatcgagacaagagttgttggctggaatagacacaccacataataatctctatttggcaagcattacaacggcagcttaattttaaaccaaacaaaatcttgatctttttaaaaaaacaaaaaaaaagaagtaacgacagcacgtacgatgcatgagaaggtgagttgttataatcaagcccacagatatatcatatatagcggtatacccctgccgatcaatggaggcacgtgtagaagaggcatcaaaatttaaataactaaagcatgcatttccaccaagtatctccatccatcctaaaatataaggcagaagattttggtgaataaaacatatcctaataccatgaatatgaatagagagttgtccagattcataaggcttgtttgggggagcttaaaattttgagaagcagcaactgagaaactagctagtgagaatctggagaagctgggaaacccagcttctgtcttctagttcattttccagattctacaaccacaaattcttagaatttggataaaaagctggactgttttggtgagcttctggcaagtggtaagtactggagattctaggagaagctacagctgctaaaagctccccaaacagacccatagtagcagaatgtgtctcatcgaatatcatagtcctttttatattttgggatggagaaaataagtgttaaacaagattgaagaaatctaaaccaagccagctgatcttcacctactgcatctactacttctgtcagcttcctcagagtccatatatatcccaacttgcagcgtgtatgccgtaaaagtatctagtatggactatggattacttcattacaaattaacccattacccatcatatgcaagatcagtgtaatcatgtaatgtaaaggcacaatctcgtgctgttttcccttaaaagaattgtaatgtaaagtgaatactaaactgatgaacacacaagatcagctaaaatcaattaactaatcctccattgctagctagatgtattgcatgccgcatgtgcagatgtgctagcttgcagagctagttgtcttcgtcttcgtcttcgtctttgtctagagatttgtctagggagtagagacgacgatgacgacgacgaaatcatcgaactaaacacaaccaccaccacccccttgcctttttatgtagatcaccctatagctacctagctttaattatatcgataaattaactgtggagaatatggatattccatatctacatgacagttataatttaatcggatatacggtaccaaatatagatagaatatctttatgaagactcgggttagttttttacttgtatgtcaaggaaatacccgagatcttagtcggttacaattgtattttatctataatcccatattccgttacgataagagttgtattttgtaaagcggactccttcccctatataaggatggtccgtgtgtctctcggggcgcgattcttttttccaatttatacaatcaataacgtactcggcggaatcatccccggacatgagtagggtattacttcatgaatatgaaggcctgaacctgtataaaattcattgtctccaaaaccatcaactttcctagcttgatagccacccccttttattattgccgaaatcttgtttcgacagttggcgcgccaggtaggggcagcgtcaagtttttgccgactaagtgcgatgggttccgtttctggcatcgacaacttcgccttccctcccgggcaggcgttctggttcggcagcctcaacttcatcaccaacgacttcggcaagatctctctccttgactcggattcgaaccagtcggggagagaccaggtccccgtgccgtttggtattccgaactcggccgaggcctactccaagatcatatcttccgagtcggcttcaaaccactcggacgagatccaatctactcctccgcgaccagatcaagacgacgggtcctatccttcaatcttgatgaaacttcctgatgacttggctgccgtcttcacagccaaaacatctcccactcggagatctaggcgagctccggcatcggccccgatctagtctagatccagggaggttggcgttatactccaacctcttgggacagtctcgacggaagagatggatggctacctcagctcccccggcgtcagttcttgaccaaccaagatcctcgactacgacgacttcggctaccactatgaccacggcgacctcgacaacttcgacgacagctatgaggataactacacgcccctcttcttcggcgtattcatggctgccaacgaaacggaggaacagcgccgagcccgagaagcggaccaagatcgcgcacggcaagaagctgaacgtcgccgactggaggaagagcgacagcgacaggagcgagaacgactacagcgtgagcaacaagatcacgaaaggattgcaaaggaggctgaagatcgacggcaacgcgccttggaatccgggcggcgagcgagatagctcattgggcaacaagacgtcgacggaacagcggtctttcgcatcccccagcagaacgcggttgcagcaatcactctcctcgacaccctcctcaaggaagacgcactcaactaagctgatcatgttgtcaacatcttgaaccagacgaagaccatgatcgctgcctcggttccagccaactctgcaagcacccgcaccccgactagtagccaagtccctcatcttcgatctcaagactatcaccagccaagcctcagcattgccggcgccggatctagtcgcaggagcagaggacatgatgaacggtctgttcgttcgcctcccgaacgatatagggagcgtcgagttgaacgaccacactccccacatcgaaggcgccccatcgatcttcgcgacaccatcaaccagcgccgcgcagcaagaggccaccattcaccagatcgttatgacgatgatgtggacggcgttgctgccttcacaagcgatctgcgtcgagtggattggccagccggctttaagccgactgaaatcgagaaatatgacggcaccaccaaccctgagtcttggctcaccgtctatggtctcgcaatccacgcagcaggaggagatagcaaggccatggcaaactatctgcctgtggctctagcggattccgcccgatcctagctccacggactaccccgtggcatgatcggatcatgggcagaacttcgtgatcacttcatcgccaacttccagggcacctttgaacgccccggcacacagtttgatctctacaacgtcgttcagaagtctcgagaatcccttcgagattacatccggcgcttctccgagcaacgcaacaagatctccgacatcaccgacgacgtcatcattgccgcctttactaaaggcattcgccacgaggacctagtcggcaagttcggacgcaaacctcccaagacggtcaagcagatgtttgaaaaagccaacgagtatgccaaagccgaagatgctattacggcgtccaagcagtcaggcaccacttggaagccaaagaaggacacgccgaccgcaggagggagtggaagtaacaaccgcaaggatcgcaagtgtaagcccgaagaacttgtggcaacaacctctccatcttcccgacaacgtccccgcgtcaacacattcgacaagataatgaactcccaatgtccgcatcatcctaactccaaccacgtggccaaagactgcttcgtctacaaacaatttgcggagcaatacgtcaagaatgcacttaagccttcaaacggagagcaaggcacatcaaagaagaaagacgatgaagacgatgccccgactggttttcaagatcatcgcaaagaactcaatcacatcttcggtggacctctggcttatgaatctaagagaaagcagaagctaacagaacgggagatcaatgtgattcagcccaacatgccccaataccttcggtggtcagaaatagcaatcaagtttgaccgctcggatcatcccgaccgagtggtccacccggggcggtaccccctggtactagacccagtggttcgcaatgtcaagctccgaagaactctcatcgatggtggcagtgcactcaacatccttttcgctaagaccctggacgatatgcagattcctcgcacggaattaaagccgagtaatgcatccttccacggtgttatcccaggattatcagctacaccactcggccagatcactcttccggtcactttcggcactcgggagaattttcgcatagaaaatgtttgtttcgaagtcgctgatttcgagacagcgtaccatgctatacttggatgaccggccctagccaaactcatggccgtcccacactacacctacatgatgatgaagatgcctggtcctcgaggagtcatatcactacgaagcgacatcaagcaagccgtcacatgtgacaaagaacgttgcgagatggcccagacccgcgagattacactcgaccgagaagagatccgactggctacgaccatggcaagcgaaggagaagtgcccgcaaccaagatgctcaaaagcggagaaagcaatgctaagacgaaaaagattcccttagatccctctaatcctgataagactgctgtaataggcgctgagttagattgtaaataggaatgcgcgctcatcacctttcttcaaaataataaagatatctttgcatggaaaccatccgatatgcctggtattcctagagaggtgattgagcactctttacatgttaaggaagacgccaaacccatcaagcaacgactccgccattttgcacaggacaggaaggatgcgatcaaggaggaattaaccaagctgttagcagcgggcttcatcaaggaagtccttcatccagactggctggctaacccagtcctggttcggaaaaagacggggcaatggcgcatgtgtgttgattacaccgacctcaacaagtcttgccccaaagacccttttgggttacctcgcattgactaggtggttgactcaacggcaggctgcgagttactcagtttcttggactgctactcgggatatcatcagattcgactgaaagaatccgactgcttgaagtcctcgtttattacacccttcggggcctactgctacatcaccatgccctttggattgaagaacgcaggagcaacctatcaacgcatgattcagagatatttctcgactcagatcggccgcaatgttgaagcttatgttgatgatgtagtcgtcaagaccaagcagaaggatgacctgatcacagatttagaggaaacttttacaagcattcatgctttcaggatgaaactaaaccctgaaaagtgcatcttcagagtaccgtcagggaagttgctcgaatttatgatatctcaaagaggcatacaggccaacccggagaaaatcaacgccatccttaacatgaaaccgccaagctcccaaaaagacgtccaaaagctgactggttgcatggcggcactcagccggttcgtctcacgactcggcgagcgggggatgccctttttcaagctgctgaagaagactgacaattttcagtggggacccgaagcacaaaaagcctttaaagacttcaagagacttctcaccactccaccagttttggcctcgccgcatccacaagagccgctactgttatatgtgttggcgacctcccaggttgtgagcacgatcctggttgttgagcatgaagaggaaggccatattcaaaaagtccaacgaccaatttattttgtcagcgaggttttagccgactccaagacaaggtatcctcaggttcaaaagttattatatggtgtcttaattaccgtcaggaaattatctcactactttcaaagtcactcggtcacggtggtcacatcgtttccactcggggatatacttcataatcgcgaagcaaacggacggattgcgaagttggccttagaattgatgtctttggacatatcgttcaaaccacgaacttcgaccaagtcacaagctttagctgatttccttgccgagtggaccgagtgccaagaagacatgccagaggaaaagatggaatattggactatgcattttgatgggtcgaagaggcttacaggcactggagctggggttgttttaatctccccgattggagaaagattgagctacgtattgtggatacatttttctgcgtcccataacgtggcggaatacgaggcgctactccatggattaaggattgccatctctctaggcattcgccgattaattgtccgaggggactctcagttggttgttaatcaagtcatgaaagagtggtcctgtctagatgatactatgaccgcttatcgacaagaggtacgcaagttggaagacaaattcgatggactcgagctcacccatgtccttcgacataacaatgaggcagccgacaggctggccaattttggttcaaaacgggaagcagctccttcagatcagatgtgttcgttgaacatctttacgaaccaaccgtgcccagaaaagagacaattgaagccatggatactcaaggcgtgagcatgatcgaagccgactggaaagaaccgttcataaaatttttgagcaaacaagaacttcctcaagacaaaaatgaagccgagcggatttctcggcgcagcagactttacattattcatgaaacttatctgtacaagaaaagtccatcaggaatactgcaacgatgtgtgtctttggaagaagaagacaattgttgaaggatatacattctggtatttgtggtaaccatgccgctgcacggactattgtcggcaaagcttaccggcaaggttttttctggcctatagctgtatctgatgctgacaagattgtgcggacgtgcgagggttgtcaattttttgccagacaaattcacctaccagcccaagagttgcaaaccatcccgttgtcctggccgtttgcggtctgggggcttgacatggtcggcccgtttaaaagggcagtcgggggttacatgcatctctttgtggctattgacaaattctccaaatggattgaggctaaaccggtcatcacgattacggcagataaagctagatattttttcattaacattgtgcatcggtttggggtacctaatcggatcatcactgataatggcactcaattcactggcggagcatttaaagacttttgtgaagacttcggtataaaaatttgctatgccaccgtggcacacaccatgagtaacggacaagtcgagcgtgctaatggcatgatacttcaagggataaaagcacgagttttcgaccgactacgtccctatgctggcaagtgggtcaatcagctgtcgtccgtactttggtctttacgcactactcccagtcgggctaccggccagtcgccgttctttttggtttatggtgcagaagcaatgttgccaagtgaagtggaatttgaatcactacgattttggaacttcaacgaggagcgttatgaagagggccgagtagacgacatcaatcgattagaagaagcccgtgaagcagctttaattcagtcgactcggtatttgcaagggttgcgccgttatcataatcggaatgttcgatcgcgagcctttttagtcggcgacctggttctgaggaaaattcaaaccacacaggatcggcataaattatctcccttatgggaaggaccgtttataattgctgaagttactcggccagtgtcacatcctgattttcgtttcaggatttataaattatttaataaattaataatagaatttatattaaatgttcattaatttacaagtgaagttaaatgtgggaaataaaatttcctaaatataaagcatggttggatttaatttttattaaattctccatggttaattatactctctggaattttctcggattcttcggagctcaattcttaattttaatcatacaaagagcatttcagtaattacccacatattaaattaatcattaaatggtctaattataatttttttaagtactttgagtgtccaagtattttcagaatttttcttgaaattatttgagcattggaagtatttttaacaattgaaagatcatttaagtgattattttaattggaaaaagtttttaaatccttccctaagtcgttgggccgatttcggcccaactctttctctctccgcgcggccgaatcggcccaatcggcccagctgccgccgcccgccccctcctctctctctctgtcaaagtctgttttgcctccctccttcaatcgggccgaggaaaatgaagcccgtcaaaagtctactttgcctccctgctacagtgtcgtccctaaccttcagccggctgcagccaggccgagcccgagccgccaccttgcgccgccttccgcctccaaatccgctccaatccgaccccgtttcttccggatttttgaggggttttgatcctctcatcctcctctatcttttcccccaagaatcggagcaaatcgttgggtattttatccgaatcaaactcgttttcgagtttatctccaaaaccgagttttgattttcccggatcgatttcttgcgggaggagtccgatctcttcaatccaaggctataaataggaccccctagtcctcctctttcgtttgccccctctcccgtcctctcccgtgacccgtagagccgtcgccaccgtgcaagccgagtcgccggccgtcgtcgttcgtcgtttggcacgagggtgagtatcgttgggttcgtctcgtcgtcctctacgtgttcatgtcctccaaatccgcagccggtcgctctatctccggcgaggtcgccatcttggtccggccattgatgatgtcatcatgacgtcatcatcgtttttctttttcctgtttttctaatagattaaatcttcggaaattcataactaaatcatggtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgtcggaagtgatcaagaagattacttgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttacattgattactttattccttgataccttgggttattataacttgactagttgggctttatatattggttcagctagatattagttatgattgcttagccatgcttagaaacattagcacactattgggataacttatgactcactattatttaaggatggcttaatgatagttcacgatggttaatcgtgattggttaattaattacttgccaactaaaacttgataatggtgggttgtgagcatatggttttgatggttgtgctcatgacaattaaggaccggttcgcgagctactgttgtgaaacatttaccgtgccaaccacaagccagcatgggcaacggctttatcttttgtatagcgtgattcattatagtgcgccagactgagaagtggcgagaagtccacgggggtcgctggggagtccatgccttgtttataagggggtgattatgatccaggaaaggtgcgctgtaatgggttatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacgataattatggatgctataactggtaataatttgcttagctcctggtttggagttagatctgtacagccgggtatggttgttcaggatggttgggcctgtgcagcatgggtgtgctgttcagtgttgattaaaatttttaattaattactctactgttttactactcttaactctttgctaaatgctgctttcgcaaatgagcctatattatgccatcctttggaatccttgtgcacttgcatatttgctgtgtggcttgttgagtatgtcatatgctcattcttgcaataatcaatcaacctcagttgaagataaaggatccagaaggagaagacgtttggcttataccccagttgagctgcctgtgggagtggagccggagcttcgctagattttatttttccgctgcagttttcttcatggtgaggactaagtgcctcttaagtaagtatttatcgttttagttaatgtgataaatctatatattaaattgtcagtttgtgtacctcggctgattcctggacgagggtttaatgcacaaataagttcggaaattactagtgaatttccgggcgtgacagccaggttcttatcgactcaagcgcgaagatggtactcccatcaacaattcttagaatattgaacaccttcatcaattttatgcttaggcattacgtttgtatctttcctctttgactgctaacctcaagtttttccttgaagttttcagtcggggggctactatgataataattgagtgtgatttttatcaattcaatttgcttacttgatttatcattgccctgtttggtctttcgacttagtcaatgaggactgaaggtttttaatagcttttgcgggttttaggctcaataaggctagataaaggcttttaagaaatcaaaagctaagtatggaacaccaagcatagcataaattcatcagtattgtacaaattgagcctccatcatcattaattatcaaaatcattgttatatcaatcagtatcagttttttcatcatcagacttatcagatccagtcggccgaaggtcgacttcttggaatctttcaaccacatcagcagcaatcttgtcagcggctttctgtgcatcgttaatgaggtcaagagcagcttcttcgctcgtcccgtctgcaaagccatcaatggcatccatatcaacccttggataaagggatttggtcatcgccaatgccagacttgctcccatacttccagcttctttgatattcttgaaataagtatctggagcgactctcagcttgtcgaagatttcggcagtatcaagtgtactcgaaccggcgttattgaagaacattgcctggatgagtggagtagcggcattagcgactttatccctggctccttcaagcttgttgatcttgtcaactaagacatcaaactgtgcttgagacttgatcttgcggtctgcatcaacagattcacattaatgaatcagcatatagaagataatggcttttgaggtattgattattggtaccttcaacctcctttaaagccgaatcccactgtcttgccagctctgccttgtcattttccagagtttggatctgcttctctagttgagatatcttggcagcttgcactacattaacttcggttaatcaagattacagagataacagcacaaatcagttgggcagagtttgcgcgaacctttggatgagccactcagttcaaaattggattcctggagcttagcaatccgatccctcagatcgtgttcattctttctggcaagttctctggcctcgtgcagttgactcctggtggtttcaagggttccaagatgaggaactagtttctcaagggttgcggttttcgcctcgtttctaagatgaatcctctgcagagcagtttaatcagcgctcgagccagacggcaaacatgatggctgaggtcaggtgtcaaggaacttacatttacaatgcaagtcgcttggttgagtgccttcttcagtaggcagacttcttcatcttctttttgccggtttattacaattccttgaggttgcaagttgtcatcccaccacttgaccagaatgggagagcacgaatcttcggcaaagtgtatccacttgaccacggtgaatttcttcttcatcaccaatcattggtcctaatgtatccactgacaaaggttagacaattgatcagagttatttgggtcaacatggtttcagacaaagtgtttacccgtaatgatttctggacgaggacgagtggattcggatgcccttaaaggagatccagatctccagtcattgctggcgtcttgtccgcgagggttgtctgcttgggtttcaacttctagaatctcttggcttggccctgcgtccgactggtttccagtcgggggctcctgattaactccggcttcggcttcggccgactggtttccagtcgggggttcgtcgctgggttctacattgttgctggcctacagattatcactcgggagatcttttgcagtcggcccggtttcttttgaggaactcgcctccatgttggtcgggtcagagtcttttccagatgggtctatatcagatggtttcctgcaagtttgattgtcagtactattatcgcaatgggtacgcatcaatgcaatgaagatcgtaatatgagttgcacctagaagacttcctgatctttggcacaagacgactggatgttttcttccttggagtagcctgcttcggcagtttattggttgcctctcggtctccaagctttctagcagtgtcgccttcgtcgtcacttagaaccagcttcctcttgcgagaatttggctggccgactggatcaggagcacttggttgagtttcagaccggattcttggtcctccgcttccctgaccagtttggcggtgaggtgattggcgttgagcgattggcggatccgatttcatcagagcaaattcctgggcgtgacatcctttattgttaactgattcaacaaacagataagaccgtattctgtgaaaagttgaagtgttcggttacataccggtggaggaggattaaaggcattgaatggcacgactggcagcaagtgtgaatagctgacaacgatagcattagagaagatcttatacatcctttccttcatgaccttgaagtcaagagaatctggatcttcacgatttgggtcgtgcttgccgtcaaattcgaaggctgtgcgagatctctctttgattggagctaaccgacacttgataaagtgccgtgtgatctgttctccctgaaggccttgttctttcagctttatcatgcgctccatcagttccactgcttgtgcagcttcgtctcccattggcagtgagttccaagtatcccgataaactggaggaagacaggagtactcggggagagcaggctcagggttttgaacataaaaccaatttgcatgccagcctttgtttgaggtcttgaagggcatggagaagtatttttggcttagcgttccccggagttggaaaccagcacccccaacaacacatggtttgcttttgtttggctggggcttgaggaagaagatgcggcagaacaaggcgaaatgaggcctaatgcccagaaaagcttcgcaggcatgaataaaattggcgatatgcactatagagtttggattcagatgatgcaagctaatcctgtagaagttcataattccccggaagaaccttgaggttggaagagaaaatccgccatagaagaaatgagcaaataccacgatttcgtgtgtatcgggggtcgggaatgcttcgccgaatgctggtcgccatccgatgatctcctttgctggaagaacgccgtgcgccaccatctcctttagattatcttccgtcacatcggaggacgcccactggctctcgaagctttctctctcttccgccatgaatgtggactggatggtttgatttggtccgagatacggctggaaagggatggggaattggagcggtggatgcgggtagaaattttgtggagtgtttgaggatggattggagcggattgctgaaccctagcttggccggcgcagtttgtactgtagcaggaaatggggaaaatggtgagagtctcggcggggaagacgaagagacatttttcacttcggtgatattagagtatcgggagcgctagcaggcctgggccggcacagtacttcagcccaattttatttccagcgtggcccattgtgatccttagggacttaggcactttttgctttggcaatttgtgctcacaatgatgtggtccaatgctgttaaaaccctttttaatgcggtttgataattctttggaattaacacgatgcaaacaaaaggtgcccgacagaaaggtgttataccatttttgtaagctttattaggctgcaaaagctgtttgggttgatttgagatgactggtttactaatagttattcttttagcatgttatatgcttattttggttattgtaagggtcacagcctaggctattagactcattaattaccgtgattttttatcatgtttggtgaatcattttaagagtttcttactcggattcctatcaaatatgtctatttttggaccttttgagtgtttatcactcggccctttcatatttttttatccttgatatgttcaaggagtgttgataaaaccactcggttcttgactacgtgtttagtttttcaactaattacatagtcgggggctatacctaattaggtgcatctactcgatgcaccatgttttattttcgcccttcgcagtctttgattttagcactcggcaaactggagcaagttgaattgaagcactcggattgctgttttttgtttcgagaaggttgttttgtcaactgcgaaggtctcgggggctactgtggagaatatggatatcccatttctacatgacagttataatttagtcggatatacggtaccaaatatagatagaatatctttatgaagactcgggttagttttttacttgtatgtcaaggaaatacccgagatcttagtcggttacgattgtattttatctataatcccatattccgttaggatatgggctgtattttgtaaagcggactccttcccctatataaggagggtccgtgtgcctctcggggcgcgattcttttttccaatttatacaatcaataacgtactcggcggaatcatctccggacaggagtaggatattacttgttgaataagaaggcctgaacctatataaaattccttgtctccaaactcatccactttcctagcttgatagccaccccttttattattgccgaaatcttgtttcgacattaatctagctaattaagcaatggcagcctcgtcgtccttcgtgctcgcggcggcggcgctactcctccaggccgtgacggcggcggcggaggcggcggggcagcagaaggagatgcggatgcgtgtgtactggcacgatgtggtgaccgggccgaactcgacggtggcgaaggtggcggaggcgccgacgtcgagggcctccgcgacggtgttcggcactgtgtacgtcatcgacgacccgctcaccgacgggcccagcctgacggcgccgtcgaggctggtcggccatgcgcaggggatgtacgtgagcgccgggaaggagacgatgtcgctgctgatggcgatgagcttcgtgttcgccgccgatgagccgtacaacggcagcagcgttgccatcttcgggcccaacccggcgaggccggtgagtgagatccccgtggtcggcggcaccggcgcgttccgcttcgcccgcggctactgccgcgccaccacgtactggtacaacgccgccggcgacgccaccgtcccgtacgatatccatatccgccacgattaactgattcattattattcctttgtgtcaaaatataagaacctaattaatatcggataggacgtatgaaatatctaatccgatcatagaagtttatattttaaaacggagggagtaattagttagccaggtagcgatacgttgtgtgtcaattactactgtatcatgtactacctctccatcccgtaataaagttcattttaattagcaccttctatttagcataaaataaatttatttttagagtaattattaaattagaatttattataataaaaattattattttaaaataaggtgaaaaatagttacattgcgatttgataaattaagagtaatttagctttcttggttttatattggtatacatgagatggatgaaaaatgaaattattttaggatgagaatagtattaggtacatggggaaaatgattttatctctcgagggatatccctagtttcgtgcataccacctaatagtcataaaaaatatgaaaagaaaattagcaacatagattaatataaaatatatcactccacaaacataagcaagttaaaatttaacttctacaagttataacaaaaataacaaatatagttgcgaatatacgataactatttttagtttaatttgttatttttgttacaacttgtagaagttgaatttggtcttgcatgtttgtggagtgatatattttgtattaatctatattataaatttttttaaaaaattttataaatatttagatggtatataaataacgaaggatgttccgtcgaggaatgaaaatccgtatcctagctacatgttgcatgcgggcatggaacccaaaacaaccatcaacattttaacaaaacaaattaagataatatgttacgttgtaatgagtactccttattaacatagacgtcacgtcagtcatacttcgagcttgatattattttgacattttatttaatgagaaaatatattatagttgactttaccgttgagtatcgtgattaaaactctggcctcaaataagatacgtcaagcgatatgggcggctgttaacagtgaaatttgataatcggtaaagacgccatccgcttagaatcattatcggctgcagcatctcggaatcagccgatgggagttatcaagtcgccaatagtcggattcctgctatattcggttaaggaaatcaatctattaaagggagcttatccctaagtgaccgagtttaaagaggatacggcatggcagtttatctattaattaggaatagtttgttagtttccttttatctttaggaaagtgtgtttagtgtccgataaggactttatattttccttttatatttaggttagtttctttcttatctttaggttagtttctttcttgtccgacaaggacttgtatcaacccctgggtataaatatgtacacccggggtctatgtaatctatctccacgatcaatacaattcggagcatcgccaccctttttatttctacttttgtttttacgtttcggcggaacttggcacccgacgcggggctgcatcgtcttcgatctccggtgaagggataagtccaatattccatcggcccaggcaattgtatcgtttacgtcggcgtcgttgaaggctgcatcagtacattcgacctcttggattgctctggtttggatgatatacttgcctatctatttatcatatatctctgttaatctagtcttagcatatcaatttagttctatcggctgcttctcattttagggtttctgccggtatcggctaaatcgcgttgctagattagattagcttagacatctaccaccctgaaaactcagtcaacggcttgattgtctagatattatatttcttttcatacttagtgctgcatcagttaagtttgatctactaagtcgtgcttagaactataatctctagcctgcttcttgattgccaataagtgtttcatcggggtttcagccggtgagttatctggacgttgcatcggctcataaggattgcatatacatataagttggatttagccgatgacaacaaaggcttcattgtttaagctaatcttgtggatttcatgacatcggacctccagccgatgtgtgctttgaccttcggatcgatgcttatttatcatatcattatttgctgattggtttatacttgattacattgttattttattacatcatcgtcagccgattgcctttatatcattatctacattggacatatagtcgattgcttaaaccctatcgctatcggctggtatcggcatcggctattatcggcatcggctggaactactccatcggcttgtcggccgatcggctgttttaatctactatttgcatatcttgtcagttgcaggatcaaactgactggcacgctcgcatctcaccaatctttggacctgcactggagttaagcagatctcccaggccgatgtgttcgattttttcgtcaacagctttagcagtccctgactccccctctcattttccacacgtatgtttttcaaactataaaacattacgttcttttttaaaaaaaattctatacgaaaattgattaaaaaatcatacttattcatttattttaaaaaatagctagtagtgcttaattaattacgtgctaacgaccgcccgttttcaccaacgaaggcagcccatggtgtctcacgttttatgtgggccaattaggcccatcaagtagccgtcatggtcaaagactcaaagttgaccacagccagccgttagatctaatctgaacggttcgcgttgtctcggaatcatcgcctgcatcacacttgacctgtggacctatggtgcgcgcggcggctagcgaaaccgccatggccgcggcgacgatcgagatcccgcgctcgccggcgttccggctgcttctcgtcaccgcggcgaggaagaatctccttccgggcggcgatcctcgcgctcgccgactcgattgccggccgacgtggggagcaacgcatcgctcgattacacttacacaatccgagtaggaatcgaagtaaacctctctgtatttaatttgcaaggtaaatttgcaaccgacccatcgagcgatcgatctccgaacgaattcgatggcttccacgtcgaggaaacgttcggcgcgtagcctgcaagaagatgagcagacctcatcggcggcagaggcgccggcggcggtgcgagaggacgaggagcgggttgcggtggcgggcatggaggcgtggaggttcgggttctcgagattctcctggtttcccgcgttcaagttcgaccccaccgacgccgacatcgtcgcctcctacctcctcccgcgcgcgctctacggccgcggccacgccgccgttatccaggacgacgtgtcgaggtgcgagccgtggacgctgatgcgggagcacggccacgccaccagcgcgcacgccttcttcgtccacgaccacgagagcgtcggcggcggcggcggcggcggcaggcgcaaggtgcagcgcgcagtcaagaacggcggcggcgtgtggcggatccagaagggcgaggtggcgatcctcaccatcgtccgcggcggcggcggaggcggaggcgagctcgacgtggtgtacaagcggcgcaacctgagcttccaccgccgcggcgagagctcctcctccggatgggtcatgcacgagtacgagatcacctcgccgccgctccccgccaccgtgctctcccggatcagggccacccccagggccaaggacaagaagctgtgcatcaaggaggagccctcctgctccacctccgccgccggcgagcgctctggccctaacccagaccacaccgccgccggcgccggtgacagcgccactgccaaccacaacaatacaacgtcggcggcgacaacaactatggcagcggcggtgtagtctaatattatccagaccagccgggtccgagccaccaatatggttacggcgagcaggtcgccggcaatggctttgtggccggcgacgggtggcggcggcgagccattgcacttgtgtgaggactgtgacggcaataacgtttatggctacggctctttgacagggaagagccgctgccgcgagctgactggacaatgtcgctggcctcgagagcagtcgatccacctccaatggcctcaggagtgacggatccaccgtcggcggcacaggaatggtgacctccatcgcctctccccgtccctcgcttcccacggttgagctttgggtagtggcagcacgcttcaggctcgttggatctggtggagctcgacgtgggggacaatgatgacagcttcatcgcctcttctcatacctcgctttgggcagctacgacgctagccttcaagcttacccgatttgacggtggctaggggtataaattatcttggagattttatggctaaaattcttttgcaggagaacatcttcacatgtccgcttacgaaaataagattttgcatgtggttacggtgccagcccataacaatcagtatttttatacatgtttggcgtctgtttgaaaaagctgaatatatatgatcgtttgagaaaaagctttctgtaggagtgcctttctctttagagtgttgtctgttgtagacattggctttaacgagctgtaaataagtattgtacagttacaatttctgtacgatttaattgccaatacttggactatagacaaaatatttttggactgaactataaactgatttgtttttctgttgacccgacttgacccggaataagcctagcacaaacgaagttaaactagaggccttgtcagcaagaacttctaagcgttcaaaaaaaaatctgttgatttttgaacatacagaagcaacataactttgctataattctgttatcacaatttggatagacacgtacagacgttccaaagaccaaaggtgatgatcggagcatatttaattacatcaatagatttctagaacatatataccgaagaagcttggaaattaattaaaccaagcatgccttcatctcaccaaatacctatatacgcggctacgcgtgctaatttcaccttaaaaaagaaaagaagaagaaaaccccagagatcgatgcgagtagttcatacgtaccaattcacagtcagcacttcacctactgcatctgttgccagcttcttcaaaagtccgatcaccgacccagtccattcctaccctctcacacgccaaaagaatttaaaataaattaacatatccaacttgcatgcatgcacgcaagaatgccataagaatttctacatgtagttaatccaagcatgcaagaattattgaagaatgcaatgtaaattaatcaaagtctaaattgaacacacgatcagctagagctaaccttaagaaggtgtcagaagataatatattttttcatcttttagagaaggtattatgagatatcgtattttttatgtaaaatttggtatatcttcaactactagatattccatgataccaaaatttttatgtgtaaataatttagatatctcaagatgggccaaaagtgatcatttttgcatgcggaactctggcccgtctaccaggaaagttatgaaaaaatctctctttttctatgctagtggagcacccgcatacgaaaattcaacttttgcatgcgggtgcttatatcgtccgcacttaaaaataaaaatctgaaaaaattaaaaatcgcaaaaaaattctagccaccgccgccgggctcctccctctgccagcagatccgggcggtgcccgccgcccgctggatccgcgtgggagccgctttcgccacattcgacgtgtgacggagcctgccgccgtgctccatcgctgccgctcgccgcccgactgttccgtgcaaggaagctgtcgttgcctccttcaacgtgcgggggagcccgccaccgtggtccgttgctaccacccactgcccgctgtcagccacgccatccgccgcccattacgaggccggcggaggcggatccgctcgccgcttgccgtcaaccacacagcccgctgctcgttgtcagccgcgtcgcccgccacaaaaatatatttaagaggcccgcctgcgaaacgggcgtctctttgagaggttcgcctgtaaaaataagcttattttagcgtgcgaatccttaagaggaccacttgtgaaaatcgatttttgcgtgcggtcctattaaggagctgtatgcgaaaatggagtacgattttttacatactggactagttacggtctgtctgcaatctaaagaggatcttgtctagaaaaattatttctgtagtagtgcataccgccatggcaaggaatggctcgctctttcatctactcgctggattggagacgtattgtttggcggcggccggtggcggtggcccgtgcggtggccgggcgcaaggaggccagcagcccacggccgggcggcgacaacagcgactggattttttttattttgtgaatttttgtagtgaatgatgaatggtttgtatattttattggatattttttttgttgatttggggatgatctcacaagatttgtagattgtggatgtgtatgtattgtggatgatttttgttgtgcttgatttgtggaaatttttattgtgcatgattgatgatttgtgtggatttggctgggggaatagatacaagcagcaaaaagaaacaataaataaaagaaaaaaaacagttgggatgtggcccctatccatctttaaagatggatttttaagcccggttatttcacccgagactaaagatacctatctttagtcctggattcgtccttcctgttgtaaaaccgggagtacaggggttccgaagagggagtaaaacccctttctccactagtgttaactaatttatcctccattatatttctaacctgactgtttgcatatatccgaccatttttgcagtcgccttcctcgccgtgtagacgacgatcgaagaaccttcgaatccagcacacaccaaccacgtccccgacctccccctttaaattcacccatgcacacgtcgtcgcaaatcacatcacacagctaaagctagcttaatccgaaccaagcaatggctgcctcctcctcctccttcgtgttcgcggcggcgctcctcgtcctggcggcggcgacggcggcgcaggcgcagagggagacgaagctgcgggtgttctggcacgacgtggtgagcggcgggcccaactccacggtggcgcaggtggcggaggcgccgacgacgaacgcctcggcgacggggttcggcgcggtggtggtgatcgacgacccgctcaccgacgggcccaacctgacggcctcgcggctggtcggccgcgcgcaggggatgtacgtcgccgccggcaaggacgcgctgtcgctgatgatggcgatgaacttcgtgttcgccggcgacggcccgtacaacggcagcagcctcgcgatcctcggcgccaacccggcggagcgcgccgtgcgggagatgccggtggtgggcggcaccggcgtgttccggttcgcgcgcggctactgccaggcgacgacgtggtggttcaacgccaccaccggcgacgccaccgtcgagtacaacatccatctccgcctcgattaattcattcattcattctcattacttgagacgatgatattgaagatgatgatcgtgttgatcagttcattttactgccggtttttgctgtgtgttgaccagttgattactagaatatataagctgggtgtggtgtcatatgctttttttttccctgtaaaaaaacgctagctatgatttttgttgttgttgttgttggtaggggtgtattcttgaggatgattattgtttataagttcttaatgtgttttagaataatgagagcttcattagcttacctttgttacaattttttattttgatggatggta

SEQ ID NO: 26973 - DNA, 5791 bp, Oryza sativa
  unsure (1)..(5791): unsure at all n locations
aattcctgcagccctaatgcgctaatggctcacctcgttttgcgtatcttcccaatcttctcaatcccctatccctcaaactcacccttagagcaagtttaatagtatagcccactactagctccaattcatctacaactaatctaatagccaattcatacaatagttgcttactatactattaatatatggtcccacatgtcatgcacacattgcgtcttggaatccgcgctgcagctggctacagatctgtagcccactgctcttctctctcatcttttatctcattaaaatatgtttacagctagctaatagcctgctattgtacctgctcttaggcttcgttcgttcccaggtgatctgggagattgagagagaaaacatctcgttttccgcgcgcacgcttcccaaactactaaacggtgtgctttttgcaaaaaaattctataggaaagttgctttaaaaaatcatattaatccatttttaaaatttaaaatagttaatactcaactaatcatacgctaatggctcacctcgttttgcgtatcttcccaatctcctcaatccccttcttctcaaacacacccttaggctgcgttcgttcacaggagacaggggagattgcgactccttttccatgcgcacgcttttaaaactactaaacggtgcatttttttttgcaaaaatcttctatagaaaagttgctttaaaaaatcatattaatctatttttgaagtttaaaatagttaatacttaattaatcatatgctaatggctcacctcgttttacgtatcttcccaatcttctcaatcctctcttcctcaaacacagcctatctttaaaaatgtttatgttttgaaatgaggtagtagaaaggtcagcagcagtgcacccggaagaggaagcttccatggcggatgtagtatagtgtgaaaaaacgtaagcatggccacgtgatgggtaagtagaaacgcggcatgcggcagctggtcaatgcattccacgtctttcagggtcaaattcaaataatccatttttttaaaaattaccccctttcgaacatgaacgatcaactccaaattagatccaaattaattaacacataaacgtacgccatcaggtagaagaattaatctcgctccaaattataagcatccgtacgcagttattttccatatctcctgctccatgaaaatcgaccggccaataactttgttcatacgcacatgtcattctggtttctggagtctggacatgcttgcgttcatttttttttaaaaaaaaagattaatgtattggagtatttcatctatctagcacttgtcaaaatgactgggccgcatgcagtttggaccatcgcccttcaggcctccaaagtaaagaagcagccataatctgaaggcccatctgtgaagtgggtcgggcccaacgcggtgcaatttgccgaattgtgaagctgcggcccactacgcagtgcgtacggagtttaattctccgaccctctctttctccttcagtcttcagaggctcagtggcaccacagctgcgcaaagcttattaatttgtgctaatctttcgccatttcaaaccaaacaaaattcgtacgtattgcgcatgtttcttactccctccgttttaaaatatttgacaccgttgactttttagcacatgtttgaccgttcgtcttattcaaaattttttgtaaaatatgtaaactatatgtgtacatgaaagtatatttaataataaatcaaatgatatgaaaagaataaataattatttaaattttttgaataagacaattggtcaaacacgtacttaaaaagtcaacggtgtcaaacattttgaaacggagggagtatatgtgccactgcgcaattataccaactaagaatctccaaaaactctgatctcaactggaacatcatcacaacctctgtaccaccactgaacatcacaaataaactctttgctgaacaaaacgagatggagaaatgggtagagaaaagttatgctctttatcacagaggaatttgttcgatctgtttgctcaaattcgatcggatttggaacctgaaaatcgatcgagaacaaaagctttacaacgatggcaacatggtgggacaaaggtacgcgctggttacctgcaaaattaggtagggtcggccagtcaggggagtattatcttttacgcacaccaccgaacctctacagatgatcatggccagaaaaactactcccaagatcatcaattgtagagtacatagcttgacagacagatcagcactgaaagccttggttggtagtcatacaggtcaatcatgttttcatggctgcaggcaacttctttcctatggctttcaccttggcaaacgagtcactgttaagattagttcttttgagctttttgggctgaccagtgctttgttttctactagcatgcttttttaactgataaacaatatttttaaaagaaattgtttacaagtttctttaaagaattaaatagatatttttttaaaacacttaattaattatatgctaatagctttctcggctttttttttctcaatgagctctaaagaactcagcataatcggtggaaacttctgtcagggaactttcaccgtgccactgagtcactctcatgtctgaaaattctgaatctctctctctctccctgtcttgttcttagcttctcttccttgacacaggaaactaataattcaagtatatatgcatccctctcacacatacacacacactaatgtgccaatgacaaacaaacacatctgtcctctgagacagctctaaatataacttgtttggagtgactttatctgacctgttgtatttggactagtccttataattgcattctgattcttccaatgtgtaagaagagaggaattaattcctacgggtgaagttgataattctgacgcaactaacttactagtactgtgttaatgtatacgcaagcagagattaataatatgaaaaactccgtactgtgttaattacaactccttaattctgcgagtgtaaatttagctgcaagcaagagtccatcatgtgcactctctgaccgtgcatgagtaggtacaggaccgtgcatgagtaattggactaatttatttacgttttgcttaaatctgggagctttcgtaataacaaatctctgaaatagtaaggagagaaaaaaaattgatataattaactggttcaataaaaactctcattataaaaaaaaacaaaattaggaagaacgaatctgtgttggtgaagttggttatctgcaaaaggcagatcaattatttctctccttatcatattactgttgttatacccaccaaacctgaagatgataaaatataggaacacactagaagaaccaagatgcatatcgacaaacagtgactacagatctgcaatgcagtgatgacacgttgacaccacgaccttaattttaatttctcaattattaaaatcttcaggtggcatatctataacttggatgattaattcaatatatctataataatgaaaccagttgatcaaaatgtaattaagcaggccaatcaccactgcatattgttaactccttttctgaaatcctgcatgaataatgttctcttcagtgtcaccaccatccaaccacccccaatgtctgaagaatcttagctagtcgcagtcagtctgccttaacaccgactactcccagttttcaggtacaaacaattcacatgcttaacattcttccctgctactatcagcctgtcactaacaataattaatagttgcttactaaataaatattacagcactataaagtatagcttgcttaattagctaatgagatgtgcacgcgtaatgcaatttactaacctgacgagtccacgctaaaaaagggtaacttcttggtggtagtggcatgaattgtactactgacactactagtgtactattaaggactaatcacctcattagtctatacacattctccgttttctaatgtgtgacgttaattatcgatttctgaacatagaattttactatttatcttgctaaaagaactatataagcattatttcttttgttgcgacttgttttataccacatccatcccaaaatattaggatttttagggttgaacacaattattaacaaaacagatagaattaaatagggaagattgtgattggatgcaagtgaagataagtgaggaaattgatttgtggagtgttgtaattagttgggaagagaacatggataaggatgttgttatatttttaaataaactttgaagactaaacgttactattttaggacgaatgaaatacacggctcaagtatatatgacttatattttctatatatttgtacttattttattttaaataagatgaatgatgaattgttaggtgttgacaatgtctcattaaaaacgaagggagtatatataatagaaaaaaagacagaataattaaacagagaaatgctaactataggctaattaaggagatgctaaatataggttaaatcaaggagatggctacttcacataccaaccccattagaaaagggaaaaagctctaccacgtgcatgctgcttcatcacttcatctcctacaccaaccactcccatcgcattatatccattgcttccctttcatcttaaatacttcatctgtcccacgaaaactcaacctaagaaaaaatatgatctcttttaatataacaaatttggataactaagatgtgccacatctccttctaagttaagttttttttaggacggaaggagtacagcagtagtagctacattaattatatattagcagcactcatcctctcactagctcctccttcagcttgctcgatcagctcaagctccagctgcagccatggcgaaggcggctctccagctgcttctgttactgtgcgtggcggcggtggcgtgggcgatggacgacggcggcggcggcggcgccgggatgacaaagatcaaggtgtactggcacgacgtggtggcggggccgaacccgacggcgatccgggtggcgcaggcggcgtcgacgaacgcgtcgtcgacctacttcggcgcggtggtggccatcgacgacccgctgacgagctcgccggcggcggcggcggcgggggaggtggtggggcgcgcgcaggggacgtacacgttcgccgaccagagggtgatcggcctcctgatggacatgaacttcgtgttcaccgccggcgaccacaacggcagcagcctggcgatcatggggcggaacgaggtgatgtcgccggtgagggagatgagcgtcgtcggcggctccggcaagttccgcatggcgagggggtacgccgaggcccgcaccgtcgactccggcttcaagtccggcgagaccatcgtcgagtacaccctcttcgtcaaggcgtagctagaagatgatgagcgacatacataagcacatttatgtttgttaaacatcgtttgttgttgtaacatgcttgatttatcgattgtttatcaagcttacaataagataagcagctccgacttgctacgacggatcttaacctaaacagttgacttcactgaccaagaaagccccaaaggatcacataggagacagcttaatcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 26974 - DNA, 2867 bp, Oryza sativa
  unsure (1)..(2867): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagacgtgtggcttggctgatgcctctgggcttcccgtttcgcttgtccgaagtgacgatggaataaagagaagaggcgatccacgcaggctcgagacgaagggggtatgatgttaggcaggccggaatcatccgctagagcctcaggctgggcctgtttatggaaggccacatgggccatggcccagcttgaagccacccatctcagcatatttggcagaaaatctaattataacgcattttctagagataaactttaggtttttctttggaagggagtgttgagttgtgatccaaattcatttgcacttaataaaaaccagcttctgctagagcgaagtggaggccctgccggatcgtatcgtaatcccttttaaggtcccacctcatatatatacctcttgtaaatcgtcgtgcggcgttgtaaccttaccctgatatagtgaagatattttgctggctggtacccatggttttttctctccttctttaggagggttttccacgttaaatatcgtgtcatctatgattgatctattgttctttatcgtttgtttgcctatcgtttcctaacatggaggatcttcaaaacgaattcatgggagatgaactctgaaagtcttatgaaattatgtgtttcagaggattttacgtgtcttcgtggccttcaagaggaagatttgggttagcaaaacaaacccttatctacttatggaattggatcccgatgcatttttactctattatacgttatataagaaataggccaaccctaacccgtagggtgattgggtctgtgtctgttctttggccacccatactcatcatataggggtgtaccaatgtatatcttcttgagtgcacatgattctaaatagattgtccttctcgaactgatttatgcctatgttactcagtaattgaatcattagcatgtaatagaaccacacgtaatatttgttttgggtttgtcaccacctgttaactcatgggtaaaaacatccttaaccctagccccaaaaagttcaagtggtctaagcaactagcagtctagcactaaaaatccaaaacctagtatagaaccatcctactcggacatgctcaaccctagatgtattttctactgccacacataccgcacttgtatctagggagacaacaaggagggttcaacgagtcacgctcacgacaaacctctactctccgttgtatcgttgcctctcgtcctatccctatctcattcgaccgtgggtacaggttagggaaaaattttgcatccaagatttagagtggaaagatttagtttgtacaggtgggaatgaggcacgagaatctgacctgttaactcatatctactaatatcttaatatcttgtgtagtctcaccgtgcatgtttatttttttattttgtaaaacttttctttatttttaattaaaaataaataatattagaacttattttaaaatctaaaccttttaggtgcgccaaaaataaacattgtcagtgttatcttagcttgaaaaatgctttaggtttgaaaataagttttaggatgttttacttttaaaaataaaaattgaaaaggtttttaaaaacagaaaacctagacagtttcctgttggaacaagatacccttctatgagaccgtacctgatacatgatacctgttgtggtaccagctgcatggtacccgatatctgtgatacatgttacccggtacctgtgatatctaggatctgatacctgtaatatttgtgcaagagaatagttaatatgtctgttgtaacgggatcccattttataacagccgtctttaaaaaaaattgtaaatcccagaaataccagagtcaaccggtgactgcccatcttattattggggattggtggttttagccaatggccgtctcctctcctcacggagaactgactcgaaaccgctgagaggcaacagagaaaccgcacggactgaacgaggcggcggaaataaaacaactcgaggctggaggctggctggcttccttgccgctgcccggctgaaaaagcccccgaagcagaggcttccggttgaagcaaagcaagagcgcgagggcgccgtcgggcatggggatcgtggagacgtggatgcgggagaagcccatccgcaccttcctcgcccagctctccacccgccgggcggcggcgggggccgcggccctgctcgcttcctcctccgccgccgcggcgtccgccgacggcgagcccggcgaccggagcatcccgcagctctcctccatcgccaactccgtcgtctcccgctgctccaggtacgccgttatccggttccggggcgacgaatctgttgttctctactccactcggggtttggggttgggggatggaggttgatccaatccatttagtgactgttttgcttttgctcatccgcaacgacggcagcgcttagctcggccgatctgggtgctctcgatcggtgtgggttgcattactctaccccgcatgatcacgctgaaatagtactgaactgccagagattgcataggacccaaacttaactcgtatatttgctggtttgctcagcggatgctaaaatcagtgtatgctaatccatcattgcttattaggtaaattgatttggtttaccaatagaagagtagcgtgcttctatagttatattctcaaggccgatagacttgatttcaatgtactggcatactctccataggatcaatattgt

SEQ ID NO: 26975 - DNA, 3531 bp, Oryza sativa
accaaaatatatgtacttaagtgctaagtatcaaagtgtgtgtggttttatgcaacttggactacaaaacgtgtagttttgtgaaatttactctttatttctggacacttggccattgtgagcatgtgatccctatatatatatagggcctgtttggttggtgacctgagtattgtgcctgagaaaattgcatgcctgagtttcacatgagttttgatgattatgcctgacagaaacttatttgattgctgacccgtgcctaagagatctagaaactatgattatctacattatttattcttaaacactaaattaaccatggattatttattcttcaactttgaatcaaccatagattatttactattaaactctgaattaatcttgttcagccaacactctacttatctaaagcaaacaggtctgaaggaggtcaacagaacacaaacaaataaaggcaacaacctgtagcgttgcaggatggttaattaatgcaataatcactgatcaagcactcatgctaacttgttaaggggagtactgagaatcatatgctagccacaattggatcaacttccatagcttactattgtctattgtagttatctttaatttttaaatacactgacatgatcatgtttctgctttgtttgaccactcttatatgatttaagttgtaatttcttgttatgcctgacaaacttctaacaagtttcttctcaaattaacattttcagggttcttgctcttgcaaccgaaaccttgcagcaaaactttgaagttgactatcccgatagttgtaaggagtctaatacatatgcaaaggaatttttagagtactgctgccacaaagctctccatgaagtaactacacgtccagatcatttggctgataagaatcttcgccgtttaatgtttgatatgatgcttgcgtgggaacacccggtgctgttgttgaggatgaattatcagaaaatgtgagaaacatttctttctgtagtttgttgtaatattcttacttcttcgttttatcaaaatgtttatatttcagcaaaagggaaaaatattgccaaatctgcatttttagtgtaaaactttcacaatgtatgagtttactctacgatgttcagcagtcattctaattgtgctatgatggtcagcattctgctttgcgtacaactgtggatattgaagatgatgacgagggatcaattttttatgcaaattccacaagattggcggttcaagttagttctgtttacaaactacattgctttttctaacctggaaataattcttcactgtgcacacacatgatcaattgcggtccattttcaggtcaatgacaagaagacagttggcttaggtgcttttgcacgaatagcaccttcatgccctataatagctgacttggttactgtccacaatctgttcgatgcactcacatgttcatctggtggccgcttgcactttttcgtgtttgacaagtatatcaaaagtttagacaagtaaggaatacaacttattagattattgcgctctcaaaattcattttcacttctgtttgtcaatgtcttctgaatctgtgcatagttatcttgtaatgaccgttgaaaacttgaaagagtgattgtgttgagttgaactatccgtgttctaactctgcatatggagtttcacagcagtaggtcttctgttgtaaaatggatcttctttccggaacataactggtcatttattatagataattgaattgctggttgggcaaaactggtgaatgtttcacatgtatcttggatattagtgacaaaatacgtggggagggggttctagatttttggtagttctttctgcttcaaatctatcgttgtgattgagtcaataaagacactgagaggagtattattgctattcttacgtacagggtattcagatctgtcaaaggtatattgcagtcaccgcttgcttcaagttttcatcttgatgctggggaatgtatcttagctatggatggagacaggcctattcatcctgtttttcaacacattggaatatcagcatggccaggtgaattagttaaatttgcatttgatttctcaatttgcaaccgtgcttcattttggcaagttactgatgttttcattctttttcgcaggaagattgattcttacaactcatgctctttactttcagagtatcaaagtgggttatggtgacaagattgttaaatatgatttagcaacagattctgatcaggttatcaagcgtgattttactgggccattgggtgttcgcctgtttgataaggctgtgatgtacaaatcaagcactttgtaagtattgaaaggggaatgattctccaataggaccaatttctgttttgctaagtattgattatacttctatgggttgccatcagaactaacaatacattatttgcagaacagagccaatttattttgacttccctgaattaggaggtccctcacgaagagactattggttagcaatcgctcgtgaagtattgcaggtgaataaattcatcaggaagttcaatcttgaaaacgttcagagagcggaagcactctcaaaagctatcctgggcatcttgagatactctgctgtgaaagaagcttttcatatttctccttctcactttaagacaacactcacttttagcttagcagaaaaacttccaaaaggagacatggtcttaaaagccttgtatgctaactactttcaactgttggacacttcgttgagtcatttggtgactgagtcacccgttgacaataggctgcagaaccattcattaccattttcattatatgctctctctagaatgggatttatattactgaagagaaaagatgaagctcaaagtgagataagcttttgtgctgtttgctttggtgtaacaaaatctctagaggctgctttggaagagtcaatttgttactctgagagaatagatgcagcacgtgcaactatagatcaagtaaaggtggaaggtgtggatgcaaatcttgccctcatgcaggtactttggtgataaatcaacttaaattgttcttattggtttgggattgaatggtttctagagtgcagcaagaaaagatagcacgtttcactagttatttggtgcaatttcatgaactttagtgtcacccagatgtctactacaatatcatgcacctttgttgtgacttgagttctgatggatcgcgcttatattccaggagttacttttcccattcactcaagtagtcaaactcacttactcattgaccaagtgggaagatcctctgaaatcatttctgttcttagcttttaccctgtatgttattcaaaggtaatttctttgtgacttttggatcttagaaagtatgcttagaaatatctcattgcctaacatattcctttttgttatgtaggggatttattgcttacatgttgccctcattttttttggcatttgctgttgttatgctctggcataagtacaatggaagggagcaattattgggagtg

SEQ ID NO: 26976 - DNA, 3537 bp, Oryza sativa
atgcagacaactgaaatggtcgcagtggcatttcttgctgcatctgcatttcttatctttgtaccttggagacatctgctcctgattgcagtcctggaggtgtacacaagagagatgccgctaaggaaacagaacactgaaaagttccgccggcggattagagagtggtgggcccgcattccagccgctcctgtgcagatgatcaaacccaacgaaagcaagaaaaagagatgacaatgtgctccgtgctgttgcaaagagctcacaattttccctgtttcccattcctatttttcacctgaccagctaacctgtacatatctcaaaccctcttgcctcattgttacagagatattcttactgatcaaagctagccaaactagtaatcaattcaatgcatagtgccattgctatgagtgtacactgtacaaatatatgatcgaaaacaaattaatgctgtattttctttcgttgattgtgtaactttttgctgtgcatgcaagttcctgagttctgtgaacaaatctgggtgataaacatggacataatcagtttaaaaaggaaaaaaaatgaagttaatcttattgtattgatcatgaattaatgatgcgtccttcagtattgatattacaatccaatcttaagtgataaaaaagtggtgctgctttggttcatctggataggggaacactctggatgctaaattgctggtttccaagtgatctccaggtgctctggagaagccattgcacaatgatgttacagaggctgttttgagtcttcacaatgctggcgggtagcaactgtggtaggtagtgggagttcctacctacccctccctgtcttcctactaatttggtggtgcgcatcatgggttcaaggagcaatccggcggtttgacttctccgtccgcacctactctagcctttgttcagtggtacgaggcgccgcgcgagcctgccggaatggccgcggcgtcgtctccggcggcggccatcacctgccgaggtacgtacgagccccccctcggccgagttactccctgctccgttgcgtggttttgtggtggtgattttggtggatgggatatgcctgcgttgcgtgcagcggcggtggcgtgggcgcccggtcaggcgctggtgatggaggaggtggaggtggcgccgccggaggccatggagatccgcgtcaaggtcgtctccacctccatctgccgcagtgacgtcacccagtggcaatccacggtacgccggcctctctagctctgcttccatccagcccgatactcctgatgcgctcatcgattttgctgctgtttccgaaacgcaggctcaaaccgatctgttccccagaattttcgggcacgaagcatccgggtctgtatagtctatatatactgatctagcagtctcttttgctgttgccgccatgtctcgcaagttgctcggaacactgacattggaacgatctgatgtgtagtgtggttgagagtgttggtgaaggtgtgaccgagttcgaagtgggagaccatgtgctcaccgtcttcatcggagagtgcatgagctgcaagcactgcgtttcagggaagagcaacatgtgccagaagctcggcctggagaggaggggtgtcatgcacagcgatcagaagacccgcttctcgctcagggggaaacctgtgtaccattactgtgcagtgtcaagcttcagcgagtacacggttgtgcactccggttgcgcggtgaaggtcggcccaaccgtgccgatggacaggatatgcctgctgagctgtggtgtatctgcaggtgaattttaagggctcagatggcatcagtgtttttactttatcttccacgcctttctgtagcttatacttggtttactgatgctaagaattaggtgtgctatgttgttctgcacttctgcgcattttaaccgtgtctctgatcattcatgtcttcgttcatttctgtatttcactagggcttggtgcagcctggaaggttgctgatatctcgaaggggtcgagtgtggttatatttggccttggaactgtagggctttctgtaagtttctacagaggctatgctattagttaatgaaagcatattaggaaatgtaatatttatactcatatcttcctgacttaggttgctcaaggtgctaagctgcgcggggcttctataattatcggtgttgatactaatcctgaaaagcaagaaaagggtattttgcaaacttgcaatttcaatctaaacttcaattatgactttttcccatatacttacttttgttcatggcacagggaaagcttttggtgtcacagattttattaatccagaagaattgaatgaacctgttcagcaggtacatcatcatgtttgctgagaaaactgaactgctgatcactcgcagtttacaattttatctaaactgcatatttggtgttggtattccttttgcacaaactgttgtgctaaatcatagattgtgaactagaaatggaatcgtgataaataaatcaagaccttagaagtcatttgttcaggccttaaatagtaggattagaatatggcactgtgttgaacagacagattttgaatacatgcttttgccagtacgctcttataattacatgtttcatgacccaatttttgagggaaaataagtcaacagctcctgttgcactggtgtccaattggtagtttctaaaatcttgatcatatccctgatatacacagcataaagacattgttttcatactttcaggtggtgaagcggctgaccaatggaggtgcagattactcttttgagtgcgtgggtgatacaggagtagtgtcgactgcactgcaatcatgttctgatgtaatttttattcctttccattgcactacaattccacctattctgcccagatatattatcttctcatgttttggtcttcttagggttgggggctgactgtaactcttggtgtgccaaaagcaaagccagaggtttctgctcattatgcactacttctgtctggaagaacattgaaggggtctttgtttggaggatggagacctaaatctgatctacctttgttagtggacaagtatgcaaacaaggtacggagacaatgtgttgtagaagcaaacatcctaataaaactgaattctattttcagttaaaaatattaaattaagaagctgaacttcatcatatgtaattgtgtgaatggattatcctttactgtggtgcgaagtggttatcacaatcgaacataatagcatttatgtacaagatgtcatatttgatgtttggtcaatgatcacatagcaatatatttagttaatgtgatacatacaaaaaataccttgtttgtttttccaatatataggtctttcaccttttctgatatcaaatattgtttgggtagaatgttgactgatatcatgttacttcttctcaggaaatccaagtcgatgaccttgttacacatgatttgtcattcgattacatcaacaaggcacttgaactgatgctagaaaacaagtg

SEQ ID NO: 26977 - DNA, 7270 bp, Oryza sativa
tacggccatccgttccgggctccggccgtagcccgcagcccgcacggcaacgcgcgctcgcgtcgatttgacctttaccggtgcctgtctgtccttgcctagccttgatgtgttccacaggggacccggccttctgcattcttgcatgtgccgccgctcttgcagatctgctcaacttcttggaattcttctcctcaatcaagtgccacttgatctcttgatctcgaacggagatgagtttttgttccttgagtgaaaagatgtttggtttgctcctaaagtttaccaaagattaccacatcttaggttagtcaagtttgaccaagttagcctattatttggtttatagccacacttgtggcaagattacttctcatctatttgggtcccacatgtcatcaactcatcaaagtgtggtacaatttaattttactagctaagttgtggctcgcaagcgtggcataaaaagtacggtgaattgtgacaaacttagtatagcatccacttgtgcatgtaatttcaaaatcaattattttttttaaaaaataatacaataatcatattatatgattgttactacctccatccagaatataacaattcaaatattttctatatatagtatttctatacatctaaagtttatacacctaaaattacccgattcaaatttgaatttgaattcaaatttgaatttgaattcaaatttgaatttgaattcaaattttttatacataaatttttctaactttttattcttttaaaaaaaatttggtgtactgtaataggaagagaagaaggggaggaggaagaggagaagggagcgggggcagggggggtggaccgatcgctgggcgatcgccctggcgatcgatcgtccattaggcccccttggcatgctagtcatcaaattccatctctcttcttccttctctaccctactctctctctcccccatgttttttcactggctggcccggcctctcgtgcccagggtttcccaaaccgtcgggggcggggttattgcgctccggcggtaagcacggttaccgcgcggtaaccgcgaaaaaccgtacgaaaccgtacaaaatttatcaaaaattcaaattattttttaaatttatttaaatttaaggaggttaccgtggtatttatattaccgtacccccgcggtaaggctaataaccgtggtacggtaagtcgtaccctgctcgtgcctcttctacgcagcggcggcggtggcatgacagtgaggaggaacgggcccattgcaggcagcgagcacggaggaggcctagcactcggtgcgatcagaagcacaaggagagaggggttcaccgtggcaagcgagagtacagcgagggagaccaccggtgcttggtccacagtggaggaaggtgttcacctcatccacgaagaccctcaccccccaaagctcatcaccatcgatcccacgatgcgcagatccatctcgcgcgcgcgtgctcatcctgcgcgatcaaacgatcgatccaactgtttgcattcgtcgtaggcacaagcaaagccatttctctagctccggttgcaagtcagcaaatggcacggtgtgtatgaatacagcaaccgtctcggaggagggacaataataccgaggcccgagcgtttgtaacgttgctgagaaaaacaaatgcttctcttgtacaacatctgaagactgaacactgaagtgagtacgtgaccctgtagaaagaaagagtaacagcaaagattccactatggcactgtcgtgttggtccctgacctttttcacctgctgtgctgtttggtaggaacacgaagaccatgcacagaatgaagggtctgaacacgccaaattgttcaaaactaccaccgctttaactttttcttaatagaacttctttcagtttaacctagtttataataaaatataacatatttttttaaaaaaaatatactatcgaaatatattaaattttagttatagtaaaactttggtgttatagaagttactaaaattttctataaacttgatcatacttagttcgattagaaaaaaaattaaaacaatttataatatgaaacgtgtagataatatgggtccgggatacttcgtacgggggaaaaaggccgcctcaaacccacgtggcgctttctgacctgagaagggttgcacccggggctggtgtgttggttgtaccccacgaaaggggtcgggccgccccgaccccctccatgcacggccacgcgtgcatggtttgggcgggcgtgtccaacgccaacccactgcatttattagaggagttggcgcgacaggtcgcattaaatgcggcatgtaggcgcactactcgcccgcccaaagtcggaatgattgatgtgatcgcgggcagagcgcctcgcgcgtgcgcctactgctgtcagggagcatggcctgcgccatgctccgtctaaattgccattaatgatgggctttttgtcttaagtttggatccagaccaaatcccctcgtaccggtccattcaaagtggtcatggctgaccggtgggaacggacgggaggaagtcgtcgttagtcaaagaaggaatgatgcgggtgtccgcccgtgtcgttcggtgtggtgggacgtgcccatactgcggtaaggcgcgcatggttctgcacgtccgaagacaagttacgcattaattgtctataaagaatgttttccttactcttaaagctaggttttgggtctttgtggtaaccccttaagatataaaaggagatccatgcccagtggagtgggggacgaatcccaaaaaaacaaaaaactcttgtattccttccaccaagatcaaccacatacagaaacggcccgaatatgtctaaaccatctgcattttccatcactcctgaggggcccgatcctcctgaggggcccgatccccctctcttttcctcattgatcctcgatctttcacccgtgtccccggtccgaaccggaaaggggctccacggtccctcgtttgaggagttcaccctccgacaaaacggaaggaaacggagggagtacgagggatgggctccaagcacgagtatacataacatgccgttctacaatagtaagtatgctagtagacactagtacagtacagtacagacacagtacatacgcaagtttaccatgggagtataagtatggcgtgcatggatcgtgtgaccttaagagcaggtacaatagcagtctataagccagctgcaaatatattttaagaagataaatgagaagagagaagggcagcgggctacagatttgtagctagctgtagcacgaattccaagatacagtgtgtatgacagatgagaccagatattaatagtgtaatatgtaactattgtataaatgagctattagtttagctatactattgaacttgctctaaccgatagcgtcccattttctttacatgccttttctggcgaaggaaaaagaagctcaatcaacgagggccatggcccatggatatgattgatgatgagctgatctactgcactccacagtccacagcttggtaggagtaggaccgttggaatccataggccatggccgaggaggactggacggaggagtcatcggcatgtctggggttggggcgcgggtcgttggatggaagggcgcgctagatctcggggtggatttgggcggtggagccgaagtgcatccaaaacgtctcgtagactagtactagaactctaccctttccgtttaaaaagaaaataactagtctattattactgtccaaaaaattttaaatctacaataaatctaaacacacatgtatctttgttgtctaaatttatttttagagctagatatttttaaagatataactctatctaaaatgaatctaaatagagtccttgtttaaattaaaaaaaaattgactaaaaacgtcacatcaaatagttgaacacatgaataaaatattaaatgtggggaaaaaaaccaattacacaatttatatgtaaattgcgagacgaatcttttgaaccaatgtgatgctacattaaatatttgctaatgacaaattaattaaacttaataaatttgtcttgcagtttacatgtatgatctataatttattttgttattagtctacgtttaatacttcgaatgtatgtccatatatttaaaaaaaactaaacacaccaaattttttttgaaccaacggggttggtcccagagcgctcccccaccctcaccctagcagtagcaggagtgcaggacagccaatgtcaccacctacggccatccgctccgggctccggccgtagcccgcagcccgcacggcaacgcgcgctcgcgtcgatttgacctttaccggtgcctgtctgtccttgcctagccttgatgtgttccacaggggacccggccttctgcattcttgcatgtgccgccgctcttgcagatctgctcaacttcttggaattcttctcctcaatcaagtgccacttgatctcttgatctcgaacggagatgagtttttgttccttgagtgaaaagatgtttggtttgctcctaaagtttaccaaagattaccacatcttaggttagtcaagtttgaccaagttagcctattatttggtttatagccacacttgtggcaagattacttctcatctatttgggtcccacatgtcatcaactcatcaaagtgtggtacaatttaattttactagctaagttgtggctcgcaagcgtggcataaaaagtacggtgaattgtgacaaacttagtatagcatccacttgtgcatgtaatttcaaaatcaattattttttttaaaaaataatacaataatcatattatatgattgttactacctccatccagaatataacaatttttagctatgaatctggacgcacaattatccagattcatagctaaaaatgtttatattttgagacggaagtagtattctagcctcatcgtttgctctatggcttataagccaaagccaaaatttgaattttaaaacataattttgaatttgattctctttcaacatagttttttttaaactttagcttttcaatcactaggaacatatatacaaaagttttactcacttatcatttttttaatcgctaataagccgttatggcttataataagactagaccaaccgacggggtccatataatttcgaattcaagtttgacttatataattagaaaacaaataataaatttaaccctaaattatgagttctattttatttatttttttacaattttatcattttttttacttgtgtaagttaaattttaatttgcatatgtaaagtaacgtatcagatagtgatattatgatatttttttttacttttaagtgacgtaaaaaatgagcggacattcctggagccacgccctttttaatagtctatgttaaactatcttcataattaaattaaactagcacggtggtccgcgcagattgcgctgctagcatcattatattttctcttatataatagcatatatgttttctcattatattattaaaatatattacaataacaatataattttaaattacgaaactactaatgtgtaatattcatattgtattttatataagtgttagttattaattatttttaatatccagtttttgttatttgtaaattatatatattcctatatggactctagaattgtattttaatattttttttaattctgattttttattatttctaattgtatttgtatgtggactttaaactcatctttcaatattctttaattttaaatttaaaatttaaaatttcagttacttctaaattgtattactatattgactttaaacacttcttcccatgtttttcttaatttagaattttagttatttgtaaattgtatttttatacgaactctaaaccctacttttaattttattatgtttattctgaattttagttagttttaaattcatatatggactttatactctacttgtaatatttcttattttttaattctgaatttctatatggactttatactctacttctaatattccttatttttaattccaaatttatattatttccttattgtatttctatatggactctagtctcttcttctaatattccttatttttaattctgaatttcagttatttcctaattgtatttctatgtggactctagtatcctcttctaatattccttattttttaattccgaatttaagctatttctaaattgtatttctatatggactctagtatcctcttctaatattcctaatttattttatttcctaattgtatttctatatggactctagtctcctcttctaatattccttatttttaattccgaatttcagttatttcctaattgtatttctatgtggactctagtatcctcttctaatattccttattttttaattctgaatttaagttatttctaaattgtatttctatatggactctagtatcctcttctaatattacttattttttaattccgaatttaagctatttctaaattgtatttctatatgaactctgcttttttttttctccgattaatatgagaatttctatatggactctagtctcctcttctaatattccttatttttaattccgaatttcagttatttcctaattgtatttctatgtggactctagtatcctcttctaatattccttattttttaattctgaatttaagttatttctaaattgtatttctatatggactttagtatcctcttctaatattacttattttttaattccgaatttaagctatttctaaattgtatttctatatgaactctgttttttttttctccgattaatgtgggaatttctagaccataagagcaaatgtggaggctcttttttctattcctttaataatataataataatagattttgatagtaagttacgtattcatctactactagttaatgttatgcttatgccgtgtctatccatatcttgccctgcttaccaacctagaagtatgactgtttcaagttgcacgggcagcagcatatatatttgttcttggcccttccaagccactcgtttatccattagcgagggacaggaacatgatccttccaccataaaaaaggttcgagtactaaggccgccagggataagatcgtttatcatgtgttctccaaaagcatctcaattgatccgtgcttttttccaaacgatccgatgttaaaagacgggctaaaatcagacaga

SEQ ID NO: 26978 - DNA, 39532 bp, Oryza sativa
gctcttcctgtgatcaagacatatgaacacctcaatctgattggtgaatgcaacacagtagctccccagaaacacaaaagccgcactggggttaattgggcatgcaggcatacgtccaaattaccagcagtaagtaatactccaccattctgtagcaaaactctatgcaaacagacaacactaccactaatttgagtatcttctcacaataatctggcagcaacgccgtacggccggttcaattctttagggcttgtttagattatagccaaaataaagcttactaaaatttggtaatgctaaaattttgataatttgataatattgctaaaattttaacgggatttcttatgtatttaccaaatttagcaacaaactaaacgtagatatttttttaacaactttaaaaaaatgatgcggtaaaaaatgacatcaatataaacatccccttaatcttgctaaaaccaaatttggtacgattcgggcgatctcaaccagtggctgtggagagaacagagaattcaagcagcagtagtacttactgtgagcgggcgaccgtgatctgcgcctcgagcgtcatcaacttcccaatctgctctgctaatcaatacggagtactacactacaccgtcacacaaaagtgcacatgcaaatgcaattcgatttcactgccgcccccggttcttcaatcgtaagctgtccccggctctgccagtcctaggcaattaaggggaagaactgtggcagtactcctccactgggacactactagagctagtgtggcctactcaacctaactagaaaggttatatttttaggttattttttttacggagtgagtgtctttatttaggccatgtttaaatctcatcctaaaatttttcacctcgtcacattgaacatttgaacatatgtatgaagtattaaagataagcttaaaaattaattaattacacatattgcgactagtttgcgagacgaatttgtttttttagataatggaataaatattccggcctttactcattagagctacagccagttattacaaggaatcatacaaacaacgaatgaagttcaaataaaattaaacacacccaacaataaaaaaaccaaactaagaaaatgagcacacatttattcaagtctatttgtgaatctccatccatggttcgcaaatatttgcataaccgtcgtctccagtttacggcatgcaacattcgtaaactctccatcatcttcacgcttttgcagctttacctaaaatcggagccaatatgttgccttcaatattacctgcatatatgagatagatggtgatttgtcaaaaactatatcatttctactcatgctccaacaagtatgagtttactcattttcttgtcaaccccaaaaaccaaccatcaaacatatcttagatatggtaatagggaggtttaaaccaaaagaaaactgtactattctccaaacaaattttgcataatgacagtcaagaaaaagatgttgaatggtctcattttttatacagaaacaacatcttaaactgccattccagttccgtcttgccaaattgtccttagttagcaccacccctttaagtaagtaccacataaagatcttaatcttaagtagcgagatgaatctgttaagcctaattgctccatgatttgacaatgtggtgctacagtaaacatttactaataacgggttaattaggcttgataaattcgtctcatggtttactaacgtattttataattattttatttattagtgcttaaacaccctatacgacaccctatataatatctgatataacacactaaaatcttacaccattcgatctaaacaccagtacaacttctatggcaggaatgcaggatgccactattgctgaggacgacgtaaaaatagcccaggaatccaagccgcagctctctctcggctcggagcccaagaaattctcgccaatccacacccgccactacaccgtcgcagcgcacccacgtgacacgcagccacagtccatcccccgttgtcccgaatccaacgcccggtcccgctgcatgttcctgcgctcagtccagctacaaccgcagctgaagcagcctacactcgccaacaaaagtactaccacctcacgagatcgatgtttgttctcggactctagtagtcgtaggcgtactccactgacgtgaggagtagtacacggagtgctcattctgtcttaaaataaaatcaatttttaaagtttgatttttgtcttaatttgtatcggaattttgactctgaacgatcacaccctagtttagtttgttcagtgtactgtattatcccaggggagtaggagtagattttagaacattcctgtttcttttagtcgcacagtgcaacgccagctcgcactagggcagcgaagttcagcgcttagtacgactgtactactacgagactactactacgacgacgagtacaccatttcctgtcccacggcattaaccgagcgagacacaggcgttgaaaaagcgttgaaaaaaggtaaaggaggcatcgtttttttatatacgctttcccaagctccgcccggccaccatatcctctgcccactctgcctgcccaaacctaccacttcacactgccgccacagcccgcagccacagcgatcgagcccctctccctccgcgagccgtgtgcagcgggcgacgggataactaacaaaaatggcggccgtggtggcggcggtggaggcgggggtggtcgcggtggcgcgcgggcggggcagcggcaggctgctccggggaatctactggaggctccgagccgggatccggcggatgcagtcggagcgcgggaggtggcgcggcggcaggcgtgaccacgcccggttcagcttccactacgacgcgctcagctacgccctcaacttcgacgacggccgcgccgccgcggacttcgtcctagtatgagtccgacgcgacatggccggcgtttagccgcgcagtatgcaggtggtgtgtgtgtttgtctgcgtgttagtgcgtttctgcttagaggcccgtgtaattaacggaagctggcggtgtgtttgggtggttagtgtggccgcgtactctgctcttcttggtttaactaggagctagtactactatttttggtgaatgggaaggcagattctgtactattatttctaacaccacgatttgcaagggggaaagagtgcttctttgccgttttggtgcttgctttcatgttcttcctctcgttggcgttcagcgttgagtggcaaagagtgccgatgcctgtcataagtgcaactcgagtcgagtgtatgcgcagcgaaattagtgaattagtgtgaagtggttagtactgaatcgaaagcttacgagacataagagcaagtttaacagtataagccaactaccagctccaattcatctatagccaatctaatagcttattcatacaatagttatatactactccctccgtctcaaaaaaagacaaaccctgatttccgtgtccaacgtttgaacgtccgtcttatttgaaaaaattatgaaaaaaattaaaaagacaagtcatgcataaaatattaattatgttttatcatctaacaacaataaaaatacgaattataaaaaaatttcatataagacggacagtcaaagttggacacggaaacccagcgtttgcctttttttgacggagggagtacactattaatatttggtcccacctgtcatacacacactgcgtcttagagtccgtactacaactgactataaatctgtagcccgctgctcttctctttccttatttatcttcttaaaatatatttacagctggcttatagcctgctattgtaactgctctaatattcccatcctcttttactccataccacgatgaaaagaaaaccgacaaaagagtatgccgaccagctacagtcgacctagttggcttgatgcactgcaagaattcgagaaactgtaattttttcaggcactggtttatgctgggatggaagttttgaagtcagtatatctgttttctctgcaatcctactccagtggtatcatttttttcttttctttctactgcgttcgagagaacttcaattcttcaaaaaatacacctatcgttcaatcatgaaggaaacacaccaaccgcgctcgaagaaaagatggtaatgcggttaccgggcttggaagaaagttgaagcggagttggtctgaattctgaaaccgagctaaagcatgaaggccctttccacaggggagttgataggggcggcgactgaagtcacaaatcactttgggcgaaaggcaagacaggaagaggacatgaacccacaacccaccgggttgttactgcagagaaagcgaaggaatctgccttcccatcaatccattcctctccgtaagctctgaccttcctgacgtcaaaaatcatgaatgccgatgtgcaacggctgtagtatagtccaatcgttcttggcagggctacgatcgagctgatcagctgagaaagttgacggtactctgctcggactgaaacattactgctaggtcaactctaattctatgccctttttcctaggactaaatatttttgtaaagaattcctaaatggagtcctcctagaaaattttccattccttaccgaaaggctcgaactttgcagaactcgtttttgtcgggcagaaagcaaatcccggcagtaattgcagccatgccactgagaggctgacaggtgatctccatgtaatgtaagaatatgaggcgtgatcctacgtacgttgctcgcatcgcatctcgcacgctgccatcgtcaaccgcgaaagcaacgttgcttgttcggccatgccctgacggcatgaaggctgccatccgaaacgggcccaattgaattggcctatcgttcgcaatgattcacgaatcttgttggggtgcaacggcgacgatctgtcacgctcatgcacgataccagttctggacagtggacactcgtgaacatgcatggagcagcagattcagctcaaacacaaccaaagcgatcatgaaaatggtccgacatcatgaaaatgggccgactggaggagcccaaggagtccagcaagtgtcttctcaaaggtaaggagtgctcctttcagcaaagcccatcgtatctcttagtattatattacggaataataggatgtgtactatccaatcttagattatattttagaataaaaaagtatttaagattcggcttaattaatttatttaggattatatgcaaaataaccatattggttgtccgttggcgttcgcttcatgaacaaataatgtcagtgttcgttcgaccaagtgacgttgttctcgcgtggtcctcgttgccggtggcgcggaggccgagcgcatcctagacgcctggggacgcggcgatggtgttggggctgcatggcagcaggtagccggtccctaagttgcagccgttccgagagtcgcactcatcgatgaccaaggctgccacaatgttgtcgttgttgtagatttggatatacttgtggaagcaccacagtggtcatactccctccccctgagagcgcaaccacgaaacccccgggattgaatctgttgttgcactctctcatgtccacaatatgtacatcgtggcgctaggcggtcaaagtcgtgtagtgtcaccactcgcttggtcctagacagtggcggatccagtatggaggcggcggggtctcgagcccctactatactaagattataagagaccccacgaagacctcactaaaattttttaccatatgtagatgggaggggggactgtaactctatctagtttgctcagacccactgctatttatttctggatccgccactggtcctagaggtcgacctcggcggtgagcagtcgtacgttgggtaggtctggcttattcggcttcagctcctccgtgccacgcgatcggcatgcactcgtcggctgccacagctcgtgcccgcggcgagggttgatcgacgacatgagacaggctagggagggagacaaacatgaggcctacgattgcaagtgcaaaggaggcaattcaaacacacgctacccctccctctcccctatagatggctatatggcctgagtcccgatgacccggcccaaggcacggcaatttggcccgccccaatcacggtcgtgccttaggctactccctcggcacggtgagcctgcacaaccaaagaaaaaaaagttgagggatccatcaaagacttgattcggccatttgaggtacaacccaaagactggaggtatacaaaatagacttattccagtcatataagacacatcccaaagatagagggaataaaaatagacttatttaatagagaagcacaatgggctatcgtgccttcgtgcaggcccggcacaacccgagtcttgttgggccgtgtctgggctgggggcacagcctagcccggcgtgttggtcgggccgtgttagtctgactagcttcggcccacgcccgaacatgccaggccgggcggtccatttggccatctatactcccccccaccccccggcctgcacacacccgcatgcgcgactggacacgtggcatgcgtggaaaggggggctggacggtgcacttttcccttatttctttttttctttccccgtttcttttcgggtttttttctttcccatttattttgtggttttttaatacgtatgaataactttgtatagtaagtttatattcttgatcccgttctctctccttcacataatttaatttatagttagcttatactttatggattagccaactataaattcacgtgaaaagtgccaaatctttttcaaagtgtaacaacaataaccataaagttagctagtctgatgtgaaaagattgcattagtgacgatccaaatgaacaaacggctggtttgagaaggccttaggcccaacagctcgagcaagatatcataagctggatttatttaccttttggtcccttacaaaacttattttataaaataaactcctagaaaaaacttatttagaaatgaatctttttatgacgtcaatgtcatcgatgccgtggtccagcataatggtgtcattccctacccgcggaagccaagtaactaatatgaaggaatatatttatatttttttgaaaaatgacatatttgtaataaaaatatttataggcaggtacttagggtgtgtttggttgagctgtggcttttgaaaaagtagctgttggctgtagctttttgaaaagtagttatggaatatggactgtggcttttgaaaaagctagtttgctttaacacctgtggcttttaaaataactagtcccgctgacaagtgggccccgcatgtcatacatagaaaataaggggatggagatggcaacggcggcgtcgtcggcctcggcggcggcagcggctcggtgaggaggagcggcggcggtttggcgaggaggagcggcgacaacggcggttcggcgaggaggaggacacgcggcggtgacgccgccgctgtcaaccacctcaccaccttcgtctcccgcctccacggccggcgaacgaaggggtggcggcgggcggtgtctggcggcgccggtcggggatgggcaagagcggcgccgttgggttgggtggcggagtcggcctcgagcggcggcggggagcggcagtgcgcgcagcggcggaggagtcctcggcggcagcggctgcggttcggcgaggaggaggacgcgcggcggtgacgccgccgccgtcggccacctcaccaccttcgtctcccacctccacggccggcgaacgaaggggcggcaacaggcagcgtctggcggcgctggctcaggttgggcagcggagtcggcctcggcagcggtggattcggcctcgagcggcggcgaggagcggtagtgaggaaaccaactcaacttactgaatgaatatgtcttaaaatgatagtgagacttgactatagaatctaatggtgcatagcactccccttcttgaatattgtcatcgatcttcaaaacaaggttaggtaaatttatcccaatagcatcaacgttgtacgatccatttggttctcatatttttccatatttaaaggaggattcatatctaaacatatataaacacgatgcaccatataacatcctctattattatatttaccaatgacatgataattgttccaagaataacatggaaaatcataaattttcttctctaaggcatttagatcacaaagaacatcaaattcgatataacccaaagtacataaagaagacaataatttcagctcttcttggtcatcagcaataacaaagacacgtttattttgagtggtaaccaaatattcaaaaatataagtaacgtgttttttcactagttgtggcatgtgtataagtgaagcagtgcgcaactcttcttcattacaagcattatcaatatcaacacaatctgaatttttagcttgtgataaaagcaaattagaaatctgttccactagaggttgctctaatatagcataattagtggacaattgtagcatagcacaatctttcttaccttggtccagttgaccatcacttaaattacctgaaacgctctcttgacataatttaggtgcttcattgttcttctcttcaaaattgtttttaccttcctgcatgatattagataaaatagaaggagcaagaaaattctcatgtatcataggcatttttgtttctttctcaatctgactttcaatatcgcaagcatgcaaaagtaattgaaaaagatggctatgtgttttattctcaagcctatgctgaatttttaaattaagcccatgtaaaaatcttttaattgtatctcctctagactactctataacaccgtacaacatacaaattttaaactcccggtggtactctctcacggttctattcccttgtttcaaattttgcattttcttttgtaaatcacgaatataataatcaagtacaaatctagctctcatcattgtttttaagtcattccaagaataaggtttattaccgacaagacaaatatcactccaccaaagagatgcaaaagaagtaaaagaacttattgctgccttaactttttgttcctcagacaattcataatattcaagttcatcttccacttctaactcccaatcaatatagtccctaggattaaacttaccaacaaatgaaggcaacaatatcttattttcataaacctcatcatgtacctgttcttgatgtgaaagccaatgttttatatgctcaatcctgttctctttatacacacctgtcattgtcagtagcaaacaaggaaaataaacagatgcatgtaacttcttattaacaacaaattttgcttgtggggttgcaagtcactcaacactcaagcatataccaaattcttataatgttctcaaagaatgcaaagcaagtcaatcaccgtggctggttcgtggcacaatgacacgcttgatgagtggagcgattgtaaagccggacctgtaaaggttagtagtatgtgtatcttggtaggcttaactatatcacaacgaatagcaaaaatcaaacagatttgcgaaattgaataatagtccaaagtactagtcaaaattgctggcgtagcctagactcaatcctagcttaagcaagcaaatgatcatacttggacaaaacacaactcgctatatcaagcaactctctccaagattcgaaaaaaaattccacactttcttttcctgcatttttttcttttttctgattttttttgtgcggcactctttttttttttgcaccttctgccctttctctatttcttttcttcttcttcttcttttttttaaagtaattaactcaagcacatatacacgattgtgttgcatgcatgcctcggtcagaggagaaaaggatggatacctcctatttttgtggaacaaggaatatgggaatgataatttatatactttctatttgtgcgtggcagctcaaaagaaagaaatactgggaattgctattttttggcacatgcacttcggatagagacataagaactaactacgagataaccaagattaggttcctgatttgacgtgttttttacttggtaacgtaccagaattccacggcatgcatgcactaacacaggatgataaaaaatgatcagatctaatgttttcttctccttcaaccgagctcgaacgcaggggcggagctgggcctagggcaacttgggcccgggccctactcgtgaaaaaaaaaattaatacctataccttgtgatttttccgattttttcatatattcttggcccagccccactcgtatgcaggccggccctacactcggccttccaaaaaaaacgccttctccaccgaacagcccacgaaatagcaaacgccgaagcccattagcccactaaccagtgaaaaccctagcctgcagtgccgagtgccgactgaatccgaatcatgctctctctctctttgcctctctccgtctcttggtctctcttcgatctctccctacaggaggcgcggcgacgctcgatagggcggcggatggcggggaggcgcgaggcgacgtgcggcggcgggggcgcggctgcgcgaggcggcggcctgcaggctgcagcgtgcgggccgtgtggcggcggcgtgcggcgtggctgcgcgaggtggcggcctgcaggctgcaggcgtacgggtcgtgcggcggcggcggcggcgtgcgggcttgtggtggcggcggcgaacggagggtggcgacgtgcgggcttgtggtggcggcggcgtgcgggcgtgtggtggcggcgaacggcgtgcggcggtggcttgcggtcgtgcgggagtggaaggtcagtggttttttttttgttctctttcttcttcctttctcagttctcgaatctgaaatctcaaacctatagctttactgctttagtacatcacattactcaattagatttggtttgaattcatagatgaagagaagtaggacaataaaatcattctatcaagtccagtcctcaaatgaatccactccggcaactcaggaaacggaagaaaccaatgactccatcccaatgcctaattcagcagaaaccatggctagtaacaataagcaagatcgtattgtgctagaaccaaatgtggttgttgcacatttgtcatggcaagttttagcctttaatttgggccctagtcgtccgaagatcctggttccgccactgctcgaacgcacaggcaatgcacaaccaagatgcaaaactcaaaccaagacgaaactagaactaaaaccagcacttgacacaacagtggaccaaaactcaataaagcaaaattgaataacaattgcaaggctcaaaactaatgtttggtgaaggaaaaagtggtgtggcaatttgtagataatgggtagggaaaataaatatataaaactaaaatcctcaccaggcaaccgatactctgataccatctgataccaactgatgacgctctctcttgtggcccgatcttctggtgaggggataactctcgctttgattgagtgcgacgtttacgacgtggctaccaaccagaacaagtccaggacgccatgcaatcgctacaccacaaacgatgtcgtaccaaccatgacgcgcgggtgatgatccctgcaatgcaaacgagagaacattgcaagaacaagataagatgcaatctaaatattgcgaataggtaattagcacaaagaaatagttgcgattgaagtggtagatctaatcgacccggcaaatcaacacaccaactattgggggctctgaatcaatagtcgccgactaatcgaacgaggactagagacaaggtgaatggcacttggtaaaattcaactaaacaaaacccaaatgtttttgaggatgtacaaagctatttatagaggaaaataaagctagggttaagtgctaattcgtggaggtggagggagacacttccgagatgggcctagtctattacaaggcccaaggcccaagttcggtttcggtaataacactgtcttgttttggcgattcccgttgactcaagatgaatttggacatgagaccggatgcgtttgaaaggtaacgagataagctttccacgaagtctaagatcacccaaatcggagttggcatgaaggcgctaggtccgtttgaagtcagtgctgtctccgaaggccgaactggattccaaaactcattgaattttgatatcttgtagatcctccattcactcgatgaattctttggtcatgttttatatttctcatgcttggatgcatgcatatgcttgatggtcacatcagcggtggcggagaagtcctcggcggcggcagaggggaggttgacacgggcggtggtgtagtcggcctcaggcggcggcggggacaccggcacctcgtccttcatttcctcctccccttcgtactcctcttcctcctcctcctacacctcctcgtcggcggatctgggccagcgcaggacgagagtagcggcggcggcggcggcgacgtctcgtcgaggaggagcggcggcggcagggcgaggaggagtgacggcgacggcgaagtgaggaggaggaggagctatgccgatgggagaaagaaaaaaaaacaagcgaatcgtttttgtgtaatggcaaaggtgggtaattttttctctcaaaagcagctgaaagcaaggggagggctgcttttgatttgtactacaccaaaagctggctttgggtaaaagcagcagtgacttttggaccctttggttgatttttggcttttgcaaaagcaaaagtttgttgaaaagcccaaccaaacacacccttagtgttagtgtcattggtattgaggatatatttgtagatatttttaattaaaattagatcatttttaatttttttacttataggttcttaccgccaatgtaattttttttacagataggcccttagcgccattgacattggtgccgacctccttcatgttagtgacttagcttctggtcttgtgcggtctgcaggggtgcgagggggataacgccaacatcattagcactgttaggttggactatgacaccaatgacgctggcatcatgaaaatgtttcattcatggaatatgttttttcaagagtttgcttgtaaataaatttttaaaaaagacctcaaaggtaaaaaaaaaataatccagtaatcttaaggctgaaatgtgtggacaccctagtgcacggtggtgcttctcggaagtccatggtagggctctttttgtagcaatgcccatgtcctttattaaacgttgtaatatttattcctttcggatgtgaccgtactcgttattaagactttaatccacccgagtacgctacacgatctcttcgtcgatgatatgatgaaaaagtttggatttggaacagtatcacggaccggtcgatctcatgcgtccgaccaagtgatatcgtactcgccgacgtcttcgccggtgatgcggagcgcgtcccacacggcctgcgacgcgtcgacgacgttggggcggcacggcggctggtaggcgtgctccttgtcgcagccgtgcagggagtcgcactcgtcgacgaccttggcgagcacggacctgccgttggcgttgatccggatgttcttgttgcagcgcctgccgttggcgtaccaccccgtggacagcgccaccacgcgctccgtgttcttgtggaacttgccgtcgcactccgacgggtcgccgccgtcgccgccggcttcgaagtcgttcagcgtcatcaccgccttggtgctcccggtggtcgccggggagcaagcgtacgtcgggtaggaccggccggccttgcagcagtcctggcacgagtggctcctgctcgggcggagcgtgccgctcgggttgcacccgcccgccagctcgcggccgcggcgagcgtcgacgtcgccgcgcgagagtcctgggagggagacaagcacgaggcccgcgattgcgagcgcgaggaggcaattcgtcgtcgccatcgatcttgcgatatgttgttgtgtgtaagccagcggagagacgtcgtgtatttatagacccgtatttttgctgactactgtttgatccttgttgccgtggcatggaaagtcgtgcaagcatagtcaccttgtccttgtgaacgcaaagaagcggcatatcttaacttacgagaagaagtcaaggaatgaagagggacgtacgtgttgtactgcacattcacatggtgacattgtgtgataactgattgatcattagtttaggcgattcgtgagagagatgtcagtgttatgacaagataagcgtacagtacagatggaccgcgaggattagcgattagagcgggtgcaccgtgcacgcagggcgtcgatgacgataacagtatttttcaggggcgagcgatgtgatccacgtgatccgggtcacaatgtttgacgaagatttctgcctgttggaacgcggcaatccctaattcaggctcaaactattcatgccttagcacaggtacaacaatctttattagtggtctctctattaccatataagtaaatttgatgatataaaagaaagataaaggagtatggttgttatgcatgacaacagctcagagtcgactcttagcatttattagaacaaattttgttgcatggtggtgaaagaaaggaaagaagagtaagaaaaaatatttagatacattaatgattagagaccatattatctctaactattgtaggatactagtgtctacatgatatagagcttctatttgactctacctttgtacatgcccttattgaaacgggaaagtagtgaaagtacagccatcaactgttcatggcatattaaaacgggaaagcacagataataagagataaaaacagatgcgaaagggaaaaagaaaaactgaattggagatgcgggggatcgaaccccgtgcctctcgcatgcaaagcgagcgctctaccatttgagctacatccccacttgaactttatccaaaaatcatatgatctttacaaaattgtccagtacctgtggtcggatcagatgagcctttacgtaaagaacgtgtaccattttctgtagactctgaagtttgatccagttgcaaatgctttgcttggtttcatcgacataacgaaactgacgtcacaattcacctagtcacctctccgtcggtccaggctgtgcaaccaacgacccgcggcgttacacgcccacgcccgcggcgtcggggagtgacgcactggtcgttccttgcggcctcgaagcagccggatgcgactcctaggtcctcgcggccgcaacgaacttggcggccggtccatgattttaattggaataagttcaccaaccgttaatccactttacatacatcgagtctgtatgatatccctaatctctaatattagaaatctatatccctaaactatataaaatcatataaaaataagatcctataacagtatagatgtctaattttactgacgtggcattctagtcaacatatcttctagattatgggactcacatgtaagcgagtaacgtggggtctacatatcttctttcttctattttcttctcttctcttctcattttcaatgagctgggaggacaggggcggcgggggagaggcggccggcgagcgagagagggggaggcgtccagcgagcccgcctcgagaggccccatcgccgcctcaagcctgtgtaggccaacatcatctccggtgcgctcgtggagatcctggcttcgcgcgtgagcgccgccgtcgtgctccacgagcttgcctcctccggcgactgccatgccctagaggccatcctgaaatcccacagcatgtgcggtgcgctcgtcggcctcgtcagagcctcatctcctcgcaaagccaccaaggcctccctgttcacggcctactacctcgtccgccgagcttggcaccaagggagaggcggccgcccatgttcaccgctgccgccacacccgacgacgcacatgtgctaaagcccaggctcgccggcctcctttttctcctctcccaccagtacggccagccgcctctccctcccaggttcacggcgacgtcgactcggatctgagtctggatcgacgcaggtagcagccttgacagcggacgccagtggactagtggaggcggggctggggaagagtgcactggtggcctagggaggagcgcagcggatgagcccggtggtggggcgccgtgtcggcgaagttgagacccctggtggcgggatggtgccgatggacgatggtgtagagcaaaggatggcaccggcggacgtcgatgacagtcagagaggagctgaaggtggctgacgttgtgggggcgaccggtggcggacggtgcgtcgggccttgaggtcgtcgggcggcgtgggcctcatccccctgacggtagcaatggcggatggggatgccccaggatccagggggaggcccactggaggagacggtgctaggcaggcggttggggttcggaccggtcggcggcgggatccaatcggagaagagaagagagaagaaagatatgcgaaccccacattactcacttacatgtggatcccatattttttttattttgctgactagtatgccacgtcagtaaaaccagatatctatattcctataggatctcatttgtatggttttatatagtttaggggtggagatttatggtattggggattaggcatgtcatacatactcagatgcaaagttgagggatgctcgatgaacttattccattttaattcgacgtggggattgatggtggctgggcctactggaggcggagaatcactgagcctactgtccgccacttctggcccagtagaaccaacggtggcgattcgatcgacgggatcgggaacaatcctacgtggctacgctaagatcgtactccttctagaacctggttcaaacaccaccccgagtcacgtcagtttcgttatgtcgaaccacatcaccactgaaacaccatgcagcccccgcggtcgaacaaaaccagcgatcatgcgaatggcaaacatctggcactgatacctggacgtcgtgcacgcaaagcaggttaaattcggttcttcttcgtgcaggtcaaggcaggaacctgcactccaattctggacggcaaaaatcccaggtgtcacaacgcgaggcaacgcacacctaaacaccgcaagatccagaatcgccagcccgaacaattgggggagcacagtctagttgggagcttttccaaccgaacttggctgcctgatctgatttgttccctagcctgctggtgcactcggtgtatttctgctgtacgatgtcaccaaacacccttgagagccggtacaatagtagactataagccagctataaacatattttaaagagataaaagaagagagagaagaagagcgggctatagatctatagccagctgtagcacggactttaagacgtaatgtgtgtatgacaggtgggaccatatattaataatgtagtaagcaactattgtatgaattaactattacgttgactatagaaaatttggagctagtagttggctatactattaaacttacttgctctgacagaactagcacacaagttatctgctgattcctgcgacttttcgtgcactccaaactccgaaatacgaggaaggccgtgctagaattttgctactgcaacgtatacgagtcattttcaacccaagacagcgttaaaccaatagttttggccatttgttatgtcgaacactaccaacctcagttttagttttggacccttttcatgtcccggccagtagatggtagtctgtcttcatccgacagtaacgcgatgtctaagtatatatgattgatacagaaaagatatgtagatatgttttcgttgagtggttggccaagatcggaggtttggggccatactagattcgcaacctattcagagttgcaaaacccctactggattggcctatgccctgagtccctgatttgtatatggcgcccagtcagagctctcacactgaaaaggccaagactgcaggaactgccggtcgccgtctcaccccccgacataatcacgcagtttgcttagcagcggcagagcgatctagacactggacctgctagagcgtgcgctgcatgtggacgagtcatgagcgagcgaacgatcagcaaaggctagatcacacataaagcaaaaaataactaaactaaactaaaaatgcacagctcagttttgtagctgaatcagcagtgacacaaacggcaacgggggagttcagccgggaccagagcccaccatgacctgtcggcaatttgcaataatcttttgcactgtctcgatgctaattggcagcagggagcagccatgcacgcacatcctttccactggaacgcacaaacctacccaaaaagcttgcgtttttgttaatcacagacaccattatgctacaccaatgtacagaaatccatccttatctggagcaggggtggagcccgttctacttaaaatctatataagtgatcgtatctctcctgctttctgccgtgctttgagccgctttacaacaagcacaagccccttttgccatcagactgcaaccgtggaagtcagtggaggtcaatttcaaaagcttcttctttagatcgatcacctgcacgtacacgagcatttggatgcagggaattgaaaagcatccagccaggccgaccggtttaggggtttgatgccaccaatggctttgtatggatcacttgcacctcctgattaaggaaagaacagtgcaaaaggatggtcagtgttcctaggggttcccatgggtcattgtgtttcctagattacttactactactggttgctgattgataagttggtcactttatcttgaaagtgccaatctctagctagtagtagtatatagctttatatgagttattgggaattatatacttggttacatattagaatattgccccaaaaaatgattgcttagctctgaactgaaattgagccaccagtttctgaataaaaggcttcttcagtgaactggtagtggggatcgaaccctgatcttggccaatggatggattgttcacgaccgtgaccatgtgttgattctgtgtaagcttcttgcgtagttgacttgtattcctttaaagttcaacctgatgatttagactttcagatgtcttcaaattcctacatgtacctttaatcgtagtgcataccgtcacggcttcgttggttaatctttctgcccattggtatgtgattccttggttgaaagatgcagcaaggaactattgagtgtgcctcaagcttccatgctctgcattcctcgattcttttcccatttctttcagcttacggccaacatggtacagcaacaaaacaagttcacgttgaccctttcaagtttcaaccgccaaagatgtgtagctctacattcttcctacgcaacacgcaatagccaataagccaataaatataataagttcgtaactctagagtataccagtaaacagcaaataaaaaaaaaagatccgatcaagcactctagaacatcatgttatttttggcattctcccaattagtaaaccaaatccaaaagtcacgcacatttcattcacggcaagttgcattgttaccttagttataccctgaaactttaaaaatatataatgcaactatgcaagtacatccaccaataaacatcgagcttttatacaagaacaaaaaagcatcctttgagagaaggacaataaaagagattaaagtaaaaaaaaacaaacaaaagaagcaaggcaagttggttgagccaaccagagcaacgtacgcagcgctgtcaatagaaaaccttccaaatgggcgggtgactcggacgcgacgctgactagagctagtggcggtggcctccgtggccatagagcaaaggggctcggagaggaacgagcgaccgaaccggtgacggtgtcccttccaaatgttcgtgccaggtaggctccgctgcctcgtcaggggcacgtgtcgtcgtctccggcccgtggctttctgacggcggggacgacatggattgggagccaagattttgattcgatgccgatctcgctgtggccagtcgatcgaccggtttatttggaggaatgcaaaaggagtacttcctccgttctaaaatgaagtcatttttaaggttggcacggatattaagaaagtagatgagaatgattagaggaagtgtgtgattggttgaaaagagaaagtatgtgagaagaatggttgtgattggttgagaggaggaggtaggtgaagaaatagccttattttaggacaagacactgtgctaaaaatagctacattttgggacggagagagtacttattagtctgtgtttgcaagtcaagtttccaacctcctcattcactcgcttttcacgcgcacgaataccaaaatattaaatgagatgttttttttaaaaaaaacaatttataggaaatgtgctgaaaaaaatcatattaacgtatttttaagtttattaagttaaaacttaattattcagtgctaacaagtaatatgttttccatgcacaagaggttaccaccctctactcctaaacacagggtatgtacgtcctcataggcggataggcctagtttgattgtcccagatattatgctttgtgatgatatttgagattacaaacgaatgaactaactatattaaaagtcaaaacattgatttataaaagatattctactcaatctatataaacatggctttaataatagccccatcgtttgacctaaacagccaaagaataagccaaaatttgaatttttgaatttgatttggaagttgattttgaaatgcttttaacgtaatttttgttaatgttggcttttaagtcgctacaaacaaatctacaaaagttttacttataaattaattttaattttttaataagccaaataagccattttgaccaaatgggcaaccgatgggagcctaagtcgtattgtttataagcttgggaattttgtccatgacaatcagtccaaatgtaaggttgtgttggcactcccggcacggaaaacgaagcagcgattagcacgtgattaattaagtatttgatttttttttcaaaaatagattaatatgatttttaagcaacttttatatagaaactatttgaaaaaaaacacaccgtttagcagtttaaaaagcgtgcgcgcggataacgagtgtggggagttgggaaccccccgctaaagaacgcaaccagtataattagtcgtccctttgtttcagattatttatcattctatcattcatttttttaaaaaaataaaatatttatcattctcacgtcccatattattttttctagagatgatcttccatctcaacctttaattaatgcgggtatgcacatttgttaattagagttaatgctacttccggtaatagttgagatgtagttagtgaggaactaaggataataatgttgtcagagtataaaatatgtcatatcacttctgtcatggttatggataccacatatatttaatagtaatcgaataagttcggcggaacccaccatataccaagtcttacacgaaatcatacctcgtatatagaaggagttccggataagaaaggataagtagagttctatatggaaactataagtactactcggattgtatccatattggtctccctagttctacttggataatgggacttttatatatacaagaccccataagaggaggggggatagacagatcaacacacaagacagaatagacaccaacacacgccgccaaacattgacatcagagataagcctagacaaacccaatatggtgcctacggaggccgacaagagagatctagcaccatctctaatcttgatgagttcgtactcgaggaggaagactaccatgtcgtcgactacgtgttagttatctatgccgcaaagtcgacgacagctagatatgttatcccaaatattttacttgtgcaatttagatgaataaaggggggtgctaatgcgcgtgtacgcgccagcaatttagttggcgcacgcttttgttttttatttcgccgtttcttttcaattctttttcaatttttcacacacctctttataaatgtagaattgaaagttttaaattttgacgtgaaagatttcaaatcttgacttgaaagttttcaaattttgtgttgaaaatttttaaatctgggttgaatgttttcaaatctgggctgaaagttttcaaatttaggttaaattttttcaaatcagggttgaaagtttttcaaatttaggttaaaagttttcaattcagggttgagagtttttaaatctaggttgaaaattttcaaatttaggttaaatgttttcaaatctgggttgattgttttcaaatccggattgaaagttttaaatttgagttgaaattttttcaaatttgagatgaaaagtttaatgttttcaaaatttgacttcaaaaaattcaaattttgagttgaaagttttcaaattttgatttcacgtatagatttcttttcaatttgctacttaaaaaaatcttaaaaaaaagacaaatctacaaatcttaccttaattatggttattatcgaaaactaattggattaggtacgcatcaccgaaaaaaatccaaaaagaaaaaagaaacagcaccaaaaaaatcccaaaaaaattaatccctccgtgtgcgcgccgcctacgcgcgcgcgagttagctttctcgtgaataaagagcaacaccggcttcagccaacaggagtagagctattacctgtttgataagggatccaaacctgtataaaaatacttgtctccatctctttttctttaatctcgcatataccctggtaccgacgatcttcatatcatgcaaataccgtagttgaaacctcaaacgtcgacaacttcgatattggaaaatgttaaacgatcgtataaaacacttaggctgcgttctagaggatcccggcacgtaaaataaagcacgtattattgcatgattaattaagtattaacatttttttaagaaaatggattaatatgattttttaaaacaattttcgtatagaatttttttttcaaaaagaacacagcctttaacgtccattggaagattattccaagttaggaatcatatttcgatccgataagaagatctatacctaatttgaaaaacctacgctgctacggaacatctagactattactcctactaaactggagactaccaataatgtctctatgagtactcgaatacaacgagacataaggtataaatatactccctccgtcccaaaataattgtagttttacactattcatgtttaacgtttgaccgtccgtcttatttgaaaattttttatgattagtatttttattgctattagatgataaaacatgaatagtactttatatgtgactaaatgtttttaattttttcacaaaattttcaaataagacggacggtcaaacgttgaacgtgaatagtgtaaaactgcacttattttggaacggaggtagtactactttcagagggagcttaatagagacaacaaataaaaagagataacaacaccgaaccttcatcaaaccctaccaggattaattcctagatccgtacagtgcctaaggtgtttgactcccaatcatccgaccaccgtctcactgtaatttctaaagagaccaaaagataggtataggacaatgtcgaaggccgtgtaataaaattgtatatctaatatttcaggactaagggaaagagtatagaagtccatggagattttttggttataaaagtggcctgaattttgatctaactatactactagcattttggtcttaggccttagccataaagtaccttcgaccaacaattcggcttccacgttccaaatggcttgcaggcaacaaagcagagctgtaccagcccttgcacattttcttcctgctcatgcggtcaagccgttctgttatggtaccatctcatgatcgaatttcgccggacaccgaaaacctaatccgtctctgcatgcagagcacaaaataaatatgcacttgcgctaaacaagctcgataaatacagcgactttcacaaaaggctccacacacaaatacaaaaaagcatgacacacgaaaagctatgcgagggacccacgccctcgcgaaaattaggtagccaccagagcttttttttaacgcaaagcactctatcatgatgagaagatgagggctgttccatccattccaaattccaaagtgcggaattagagatagccaccgagacgccttggatctttctgggtgaaaagatgggcaccaaccctataaaagaagctttccctcttggcatttggaacctgagcctaccagggacagacaaccaccgcaaattggagggaacggagcagaaggtagcgaagcgaaccaagaagtcttcagtattccttccttgcaagcatcgttaatggaggggtcaacgagtcaagaccatgtgattgggatcccggtgagcaacaccgcctatggcatagaggagccggacttcgcagcggaggagacgaccacccctgatcatgccggtttcgttgttggttccttccaattcaacaacggtaagagttcgtttctgcttcatctgttcaagtgaaacttgatacgaatacagaacatgtttttgatgatcctatcgtttctgtgttatttcagatgcgaatagcccgacgacgacgacgacgacaaccgatcgggcgagcaaatatggcaggaagggggacaagattgcacagggcatcaaagaacatggtaagagcaatcatctttgattttttcaacacggaagaatataaattttgacgtgtttggaaaagtaagactgatgaactcgtcgttgttccaatggcttacagtgaccctcgggccgaagctatcggaaacggtcaaggggaagctcacgctgggcgcccggatcctccaggccggcggcgtggagaaggtgttccggcagtggttctccgtggacaagaacgagaagctgctcagggcgtcgcagtgctacctgtcgacgacggccgggccgatcgccggcatgctgttcgtgtcgacggagcgggtcgcgttccgcagcgaccggccgctggcggtgtccgccccgggcggcgacaaggtgcgcgtcccgtacaaggtgaccatcccgctgcggaaggtgaaggccgccaagccgagcgagaacaagcacaagcccgagcagaagtacatcgaggtcgtcaccaacgacggcttcgagttctggttcatgggcttcgtcagctaccaccgctcgctgcaccacctggagcaggccgtcgcgcaggcgcggcgatgacacgcacgaagcgcgcaagcgcgcgcacccatgtcgtggcggagctcgctctcgatcggatcggtctcttcgtgtcgtacgcttgtgtgtgtgcgtgcgtgcatctgtgtcactctagcttggtgatgcttagatgggttaggatttgtgtatgcgtagggttgatcgatcacaacatgtcgttgtgtgttgggtcgccatggctggcctgctggtggattgatcgatcggcatgcagttttgcaattgcatccagcaggttagatataggcggcttgattagggcatgcgatggcatgtgatgttttgtggggcgtgtgcggaattgaaattcatgaagaagttggatgagaaatggtttcggctgcaaatcggcaaatggcaaaagccccatcataagtgcatcgcgaatttctgataagatatgccaaaaatggaagtttcgcgataatcttcgtgttcttgttcatgttccctgttctggtgatgatggtgatgacatacatatgcaattcatctgcttaattccaaattcacaccgtgcagtgaggtgctggcaagattcagatatcttttgacatcaacatgcatttcatatactgtactcatgtaaggctaggatttcatcattacatagtttctgacataaactggaatatccaggacgatatcgaggtgatttcttaagattatttattgatttgatttgatgtccggccaattccgacattcttttggtaggacgaactgttcaattctgaccgaaagaatcaggtgtgttcatgacatttactgttgaagtagcacttatacaccatctctacagttggtacatatctgactgaaagagattgaattcaattctccgctttctttgcaaacctagcctgactcaggtcattaaattgctgtacacaatatacagtccagcctgcaaaattggagaaattcaattatctgctttctttgaaaacctagcctgagtcaggtcattaaattgttgtagacaacattcagaaaaataggagaacattcttccaggtaggacaatctcatgtcagacatacaaacaaatcatcagacacatcgccgacctgcacaatatattactaacttgcaaactaagttttcatcatcagtaccaaatctccttctcgattttttttaaacttttgtgacgagattctcctccacttagatacattaattcatatttcagggctttctgaacaagaaataaactacgggcagctgaatccgtcaagttggagcactgactttggctaagccggcaatgccaatacatccgcagcagcgttcaaatacttgaaggcttagcaacgaagcgcccaatggcagtgtcttgtttcggggccaagcagggggatatgcactttggcttttacagatgcatttgatccgtcccttttctttcagttatctcaacgttccatctttagctgaaccatttcctttgccctgtcggattggaccatcgggcgatcctcttttggaatcttcgcactgctaccgcttatcggatcagatgggctttcgatcagctcacaccctttcatggttttcaccccactatgaggcaaaagctacgacgaatcagtttatctcttgcctccgaagttatcggctcggctaccactacagtgaggaccggaggagcaccagcgccagtgggataggatataggaacactcacttcacaacttcagaagaacagactgaaaattcagagataaatatacaggctttggatattcaggacacagaaaattcaggcaacaaaaaaagagcagggaaaaaaatatggaaattcagctctgattcatcaaaaatgaatgattggaacaacttgtgtcttgtggtgccatcagagtactactgacagtctggaagagaaggccatggcacttgattttaacacctttttgttgaaaggacggccatttatgtatcgaaatggttccactccggatattccgaacatgtactgcactgaattgtatcacaaggactgaaaaaaaaatgcactactcctgctacttctcgaaaccgatcgaaacgcagaaaaagaaaaataagaggaggaacgcaactgatggaccgcggacaaggacggcagtgcgtccgtgccactcactcgatcacttgccctgtcagtctatcacacaccgtatcgcacgcgtgcatccatccgagagcgagatgcacgggcgcgcagtcgcgcacgcagccaagcggagcggagcggacgggcgagcgagagcgagagcgagcggccgtgctgactcggtgccgcgcgggcctcgacgcggatgcgcgcgcgcgcggtgactagcgcgcgacggttgggcggaatggtaggcgatcgatgggagtggatggagacttcgattgggagggaaaactggatggaaaaggagaccatatgcaccggtctacgatgactgttgcgcacttggggttgcgcgcgtccctggaaaaatctgagatgagattgtccagtttttttttttttgggctagctggaaaggtcgttgttttacacgttggatcatcttgcgtccacatcacccgcggggcctcactgtgtgatccgcagcaggccaggggagaaatctaaaatctgtgtgatcgatctgaacatgatctctttgacagacgcagttgatatttggactatcataattcataaatcatcgtatacgcgcttgtccagtagatttgtgtaggcgagacatctaaatcatatactagacgattttgatatctaataaatcgtataggataacacgccttcaattacacttggatactgaagctagtttttatttccagggaaaaaaaacgaacgttacgtaaaaaataaaaagaaaaaaagagaaccgtccattcatctattgatcattgtatcattccgtatgtaacccgttgccatgttcatataagaacactaccaactacttcagttttctgagacccaaaaaagggttcctggaaaagcctactggcaggtactctacagactacagaaaaaataaaaaggactaacgaccgatcaatcgatccaaaactcaatatgtttaagatccctgggcctggatccctggcgcccccacctccttttttcccataacccggagcaacaagattgtgcgagcacatgggctgccccttccaaagtggcaatgccaagccatccaccaccaccaccatgcatcaccacgtagacaaattcaatcaaccggctaccctcccggctgccgaaagagagaatatcctgcgcctcgctcgcggttcggttctccggttgggcgccggtcgatcggtcgcgcgcacgatcgggaagcggaagacacagccccacgcacgtaaagcagagcaagctctctcaagctcgggcacttttggcgaacgtggaccgcttgcttttccgggcgccgatcagcaggtgctgactccgcgcggggacgaatccgctgccctttccgctaaagatttcgtcacctcgccggctataaaacccgctcgctgcgcctccgctatccctccccccttctcctccttccgctctctctctctcgcccgcgttacagcttacgggctaaggaagcgagcttagctgtaagcgcggtgccgcggagagagagctagccatgacgaagtcgagctgcgcccatgtggtcggagtgcccgtcacctccaaggcgtacgccatcgaggaggcgacgacggcgagggacggtggcaagaaggtcgacggcgaccgcctcgccgtctcgttgacgcacccgagcccgtacacgtctttcggctacaagcacagtacgttattacctcctttgatctctcaagattatagtttaccgtcatgactgcacgtatgtactatatgtttgctaacgatcgggtttcaaattttgtgtttcgcaggcagtaagctccaggtgatccactgggtgaacaagctgggcagacgggctcagggtttcagggatcatggtgagttatcatgcatgcatgcaacctgaatgtttaaatttcaggctttgagcgatcaaaaacatgtgcgtgagcacgttgctaacctatgctctgtttcgccatgcgtgtgtgcagtgaccttggggccgaagctgtcggagacggtgagggggaagctgagcctgggcgcgaggatcctgcaggccggcggcgtggagcgcgtgttccggcaggccttctcggcggagaagggagagcggctggtgaaggccctccagtgctacctctacaccaccggcggccccatcgccgggatgctcttcgtctccaaccgcaagatcgccttccgcagcgaccggtcactcgccgtcacctccccggctggcgacgtcgtcgcccgggtgccctacaaggtggtggtgcccctgaggaggatcaagagggtgcggccgagcgagaacgccgacaagccggagcagaagtacatacacgtggccaccgtcgacgggttcgagttctggttcatgggattcgtgagctaccagagatgctgcaagtacatgcagcaggtgatctcagagctgtaatatgcttatatatgtagtacggtgcacgcatgtggtatttggctggccggcctcctaccttgtgggtggcactatatagtactaaaagcaaagtgtatgggctactgcacggcaacctcttgttggaacgtacgtacgtagacctgaactgctctaccaatttttgatgagagcgcgttccttcctcttgcgatttggcagatcgacgtgtggcctttgcaagtacaagtactctatgtttgtaacattgatgaaccaaggaacttggttttactgaatgaaaaatatcttaattcttctctcgacgagcatcgacaacgaattgaaacattgcattttcggccttgaaaaataacttacctaattcaagtcactgtcttgctcatcgagattagttgatataggctagctagaatagctagcttgctccccatttatactcgatgtgagagaaccctagatcaaacatataagctggagtacgactattaccaaccttaaggtccgaactattataaaatcgctttcttatgttctcttatttggtgttcatgtatacatttgtatcagtcgtcataccctgcattccttaaatatcattagtgcatttcatgtgtgagctatggtcacggaaggaggagtactgggtggaagggatcgcatggcagataatagagagagttcgtcggggcgagtgtgttcgggtgtggctctagctggaggacgatgctagagggggagaggagatcgtgggaacataacacgatttttggggacgtgaatccgatgcgattcgagggagcatctgaccatgtgtgtgcgaggaggggccgggggaggggtgaatggtcatgatgaatgatgttgctgcattaattatagggtacattacttaaaaaaattatattatgttaaccctcataagtggacatatcgatttcatattaattgtttgttcttaagttttttcatttattacatgtcaaaaagtttttctcatttattatgcgccaaatggatttttcatttatgtaccacaaacatatatgccttttaaatgttcctacatgcaagaataaggttccattgcatttatgtggagaacacataataaatgttagcaactatatcattgtccatataaacccatgccattgaggcctttgcaacaactccttcgaaaacatatcgtttgatccatgggtctagccatgaaacatcttttcctcctccttctgccgcttatcatgatcttcctcccatgcatcgcttgcgatgcaccccaactggtgtatgatgctggaggcgaggagctaagtagcgaacacaaatactacatcttcctggtaaataataggtctggtgggggtgccctctccatcatctatgctggcaatacacattgtgagcattttgtgttccataggaccgatgaggctctctagggcgcaaaagtgagattcacatcattgcacaattcaacagtcagtgatgcagtccgcttgtcgaccgatgtccagattgactttgtggacatcatctggttgtgcaaccgcccctcgacatggtacatctctaatttccaactgaaattgttaccaatgccaccatcatcgtcaacatctaagttgcaatatgtcgtggccaacacaaatatagagcctaactacccatcatcggctaaagtgttccgcattgagaggtacagtgatgatgacaatatgacgtacaagctattgacgtgcattacccatgggaagccttgcaaatatctagggtttcaggtcttcggggataataaattcctagtggcaacggacgagccattagcagttcaaatcgtcaaggaatacacatgatttatgcaagtgcttatgcttatgttatattctagcatgtacttgtagtttatataatgtgcgccatataatctatttgtgatggatcaatcttaagctgttatttcttttgatgtgcgaaatgttgaaactttgtgactcttaagctgttattctatcaatgaataagggagaatagctactttagtccctaaagtttctctataggatcagtttagtccctaaccttttaaatggtccaaaaaaatccttaacctttgtcataaggcctagaatagtccttgggtccaccaaaatcatcatatggatatgccatgtcatcattcatgcaaaatctatgatgaattgtccaatttacccttacgtatatcatagaaaaataaatataagggtgaattagacataaccataggaaaaaaatacttctttttttcacccttttgaggtatatttttgctcttacaaataccatatattttttaaactttttccttttgttttttatttttctgtgcgtaagggtaaattggacaaatcatatagattttgcataggaaggtgacatggcatgtccatgtggcattttggtgggaccaaggactatattagcccacatgacaaatttaaaggacttgtttggacaatataaaagattactgactagaatgacccatgagcgaaactttagggaccatattagctattctcccaatgaataatatctttagaagttctaatttcaattactaatcatgaaaaatatatacaagtatgtcaatgcttttggctgtgaaaaaaatatattaatatattttaaattttggcaagcaaattcatcttttcaaatccaacaacaaacatttgaaagcaatcaaaaggagttaaaggcagcagcggccaagtacaatccactcttcaggtcaggcataatgccaactggtgtgaatgatacaactattgtgcttataccaaagattgatcagccgatggagctccgagacgaggtctgtgtaatgtaatctataaagtggtatcaaaatgcttggtaaatagattgagaccctttctagatgagctggtgtctggtaatcagagtgcttttgtcccaggacgcctgattaccgataatgctttattagcttttgaatgcttccactttattcagaagaacaagaatcagggaaaggctgcctgtgcttacaaactggatttgtcgaaggcttacgaccgcgtggactggcgatttttggagcaggctatgtataaattgggatttgctcaccgatgggttagttggattatgacttgcataacctcggtgagatactcggtcaaatttaatggatcccttttgaatacatttgctcagtcgcgtggtttgcgtcagggcgacccgctttcaccgttcctattcttgtttgttgcggatggcatgtccctacttctagaggagaaagttgctcagggtgagctatcaccggtgtatgtgtgccgccgagctccttgtatttcgcatttgctgtttgcagatgatacattgcttttcttcaaagcaaacagattacaagcccgggtgattcacggcattttgggtgattatgctgcagccactggacagttgattaatccggcaaaatgttcgatcatgtttggagatgtctctccgacagagatcaaggatgacatcaggaatatcctgcaaatcggtagtaatgcttttgaggacagatatctgggtttcccaactccggaaggtcgaatgaataaaggtaaattccagccgttgcatgacaaattgtggaagagactaatccaatggggggagaattatttgtcggtgggaggtaaggaaattcttattaaagcggtcattcaagctattcctatttacgtgatgggtttgtttaagcttcccgactctgtctgcgacgacttgacaaatcttacccgcaatttctggtggggagctgggaaaggagaaagaaagacccattggaaagcttgggatcatctaacccgacctaaactttgtggtggcctgggtttcagagactatcggttgttcaatcaagccctcttagctagacaagcctggcgtttaattcagtcaccggagagtttgtgtgcacgggtgctaaaagcgaaatattatccaaatggctctttggtggatacatgttttgcgagcagtgcctcccccggatggaggggaattgaatatggccttaaattgttgaagaaaggaattatttggagaattggaaatggtcgatctatccgtgtctggagagacccatgggtgcctcgcaattttaccagaaggccaatcactgggaaacgtaattgcagaattaagtgggtttctgaacttttgacagaaaatggcgcttgggatgctataaaggtgaaccaaaatttcctccccattgatgctgaggtaatcttacagatgctgatttcttctagagatgaggaggatttcattgcttggcattctgataaattcggaaggttttctgttagaagcgcatacaagttagcacagtcgttggagcaaatggaggagagagctagttcaagtgctgcatccacaactatcccttgtaacctaatttggaaatgtaatatccctcagaaggttaaaatctttgcatggaaggcagctactaactgtttagcaactatggagaataaaaagaaaaggaagatgtaatcttcagatatctgtgttatatgtggcagggagaaggaggatacaagacatgcgctcaccaggtgcccacttgctcgtgctcttttgcaggctttgtaggaggatcactgtttcatttccgacaatttagctcctactgattatggccattggttgtttgattgcctggagaacctggcggattcagggcgttctctgctcctgatggtgctgtggcggaactggtttagtcgtaatgaaatcatgcatgggaagtctgcacccacgattgaagcgtctaagaatttcctgctgagttatgtcaatactcttggaaatcaaacagcatccccaggttaatcagatgaagggcaaacatgtgatcaattactggggtttgaagaaggatagtcagcaaagactgtacaatggaagcactaccgactgggagaagccgcagcaaggttggatgaaggttaatgttgatgggtcatatgatgcacaaacggggactggaggtatcgaagtggtgcttagggactcggaagtagggatggcaatcgggcgcgacgggcacgggtagtgcctacccatacccatgcccgtgagattatttgtgcccgtgggtatacccattactacatgacgggtaagaatggttgcccatgcccattgcccgcgggcgccttatgcccgcgggcgtgcccgtttacccgccacaacaaaagcagtggaacaaaaagtctacaagctactaagttcgaatcgaacttaaaacatcaaatattctccgcctcggtgtcgtgtctctcctctggcggcgatagagtaagaggagagaaataataagggaaataaaagggaaaccgtagaaaacaaagaacgtggcttatgtattctagtggattttgctcctagcctacatgtaagttagatttcgcgggtaaacgggcaaagcgggcatgtgtagtgattacccatacccatgcccattacccatcgggcatagcttttgacccaataagatatccatgggtataaaatagagaacaaacccaaccctaatagggtttttacccgcgggtaaatgggcaaacgggcacaattgccatccctactcggaaggaaatgtgattgctgcttcctgtaagcagctggccagttgccggaacgcacttgaggcggaactccttgcttgcaaagaaggagctgtccttgcgttacaatggactttcctgccgtttgtgctcgaaacggattgtttggtggcaatacaaatgatccagtccaaggagaaggatatctctgaattagcgtatcttataagagaggtgaaagagcttcttggcagtaatagaaagtcaagatctgtaaggctctgcgtagccaaaaccgggttggccatagtttagcgaataaagtccggtgtgattctttgtccggtctgtggactgggaatggctgtaatttcatttcacggttggtctgtgaagacgccgtgtctaagtaatatatgccttttccccgaaaaaaaaaatccactcctcacacttcctcagtcacgcggcctcatcctgcttctgctcacgaaaagagaaaaatcggaggaggagagagagagaagaggggaggggcagaggagagggaggctctctactcctagcactgcccatgtcggcggcatcgtcgagcggcgccggcggcgccctcatcaacgacgtgctcaccgacgacgtgctccgcgcggtgctggcgcggctggtgcccgaggcggagcgggacgcgttcgggctcgtgtgccgccgctggctccggatccagagctccgatcggcggcgcctgcgcgcgcgcgccggcccggccatgctgcgccgcctcgctgcgcgcttccccgggatcctcgagctggacctctcccagtcgccgtcccgctcgttctaccccggcgtcatcgacgacgacctggacgtcgtcgccgggggcttccgcaatctgcgcgtcctcgctctgcagaattgcaaaggtgcgaccttaatctctgtacgactgtagccgtctgtcaacgctgcttgtccgtctcgattaacaaacagcaattgggaattcggatcagaaaaagggtactgaatagtaggatttatggcttaccggttctttccatctgctagatggcagaaaggtaaaacttttttttgttccttttttttcttgtctctgctaagcttgttggaatcgagatcgactgttcttctttcttctcaaccttcatgcttttcattcttttccaacatggcattgtgctgatgtcttgcttgtatcatttcagttttgtgaattcagaactgtttgcatacatgggaaaaaaaactctgcaacgttgtaaaccacatctgatgcatagctgcatatggttcgctcccggaccagatgtagatagtaatgaactaatgatccttggttttgttcgccgaagaacatgccgcccattgtgaagaggaacgccacctttaactaccttacagcctccgttggttcatttctggaaaaaaatagcctgaacttttgaaaaaggttaaaagcagcactgatgatcatctctagttttgctagttttcattctatttgaatagagactagggaaagctgagagctatataattccccactaggtgtgtttttgtataacaatattattcatctaagaatgtgatcctttctaatgttccctgagaggctgagatagtacttaatatatgctagttttctatgacttgaatgtacgattgctgcatgaagctgctgtcctaggttttgatgcataatgcaatgatactcagaagcgaaatcaacatcttctcaatgttcttttggctttaggcatataatttagagaatggactgaagcctttggtgtttatcttttctcgaatctagatggatgttcgaaattacatgtaatgcatagttaagatttgagattttggtactatgtttgataaattacccatctattagtcataccagtggctttgttttgtactccaattaaaaacaagcaaactctgcttaggtctgaaactactgtttttattatcccttgatatgatgataaatccactgatatttggaccgctcttgtgtctcgtaggtgtaactgatgttggaatggcaaaaataggagatagactgccctctctgcaatccatagatgtttcccactgcagaaagcttagtgacaaaggtctaaaggcagttttactggggtgtcaaaacttgaggcagctggtcattgctggttgcagattaataactgataatttgttgattgctctatcaaaaagttgcatacatttggaagatcttgtggctgcaggatgtaacaacataacagatgcagggatctcaggtctagctgatggttgtcacaagatgaagtcactagacatgagcaaatgcaataaagtcggggatcctggagtctgtaaatttgctgaggtctcttcatcgtcattggtatcattaaaactgttggattgcaacaaagtgggtgataagtccatacatgcactagctaagttctgccataacctggagacactcgtcattggtggatgtcgtgatgttactgatgcgtccatagaagcactggcttttgcctgctatagcagactaaagtgcttaagaatggattggtgcttgaagataacagactcctcactgagaagtctattgtctaactgtaaacttcttgtggctattgatgtggggtgctgtgaccaaattacagatgcagcatttcaggatatggatgcaaatggatttcaatctgcactgagacttctgaagatcagcagctgtgttaggatcacagttgcaggagtcaggaatgtgatcgaatcctgtatggcccttgagcacctagatgttcggtcatgccctcaggtcacaaggcagagctgtgagcaagctgggctgcaatttcctggtagctgcaaggtaaactttgaaggcagcttatctgagtctgatccatctgttgctatattcttttaggacgatcaatagcgtcccataattcttttctagatttcgccgaagaacttgagaactcatcatgtcaaaatgtacctgatattgtggttggttttgggcgtgtgttgcacaatttgaggtagaactggatgatgccgtggatgaaaaaatgtgcaggtgtgcactgttcaattctcatgtgctgtacctgtagtcctgtactatgtagaaagtagcacactacagattcttggaatctgttggttagtacttagtagttagcttttgagaatatagagaaactggcttctagttcatgattctacaactacattttcttagaatttaggcgacaatctggatttctttgggtgagccgaatattccatgagaaactgcagaagcttctcaaactagacctataagttgtgcgctgtacatgcacgttatagggaaatgctgcttgaggttgatatatactctgatttatttattcgtacacattgtggatttgtggtgccatggctttttcggctgtcaacactctgttagatcagagtaaatttgcaaaaaaacggagaaccatcgaggttttttttttcagcctttatcgtcttcttgcaaggctgacgcctgacggtcgccatcgacgcgctccgacgaccggcgccgcctctcctccgtgctttgtcgccggcgctgctccaccgccgccacacagtccgcttcggttccccgtttccgcctgtgccgtggccaccgagaagaatttcagctgctaaggaacagaacaatatgctaccaaccacgtaaacaaatgtgaaaaaagttagttttgagatgcaacgtcgtatttgaggtttgaaacctcgggaa

SEQ ID NO: 26979 - DNA, 1013 bp, Oryza sativa
tagagtgtactctagaactagaagtgagtcaactcgattgatgccatgcgaccacagacagacttcttgtgtctttctttgtttaactatgcatgttggaaattctacagtttatatgatccagttgtttgattctttgcacagccaagagcatcccctcgggaatttgtgatattagttggaaggaaggatatttggctgtggtaaaactggtattgataaatagagcacagatgcggctaactgttggccaagtgcatcgacatgtacttgcattggcatcttctcggtcatgcttcgtccttggtgatcaccttccattcagaatgctttcacttccacgagtggtaagatttcaccaaaccgcttggcatgatattcaaactgtggaagataagagtggtccgctaactctagctagtcttgaagtgcaaaacaaagttgaatatgttaagaaagaaagagcaacacgtactggaggcataaagccatcttcaagggcttcagctcttaatatgaaaccaaaagtttcttcattcaatgccaaaccagtaaagagtgccttgccgaaatcagcagtactgaagaagactctgaagatagatgaatctcttttttctgcaaaatcatttgaagaactcggtttgccacctttgcttatagataggttgaacaaggaaggtcttactgctccaactgaggtccagtctgctgctattcctatcatttcacaaaagcacgatgcagttatccaatcatatactggctcagggaagacacttgcttatcttctccctattctttctgaaataggccctctgaagaggcctacagaacaagacagttctgataagagatcaggtgtagaggcagttattgttgctccttctagagaattaggaatgcaaatagtgcgagaagtggagaagatattgggccctaatgataagagacttgtccaacaacttgttggtggtgctaatcgttcgaggcaagaagaagcattgaagaag

SEQ ID NO: 26980 - DNA, 934 bp, Oryza sativa
tggaactccaagatcttcctgaacgtgacggcggcggcgtgggggttccgctccgtgacgagccagcacgggtcgccccccgcctcgccgtcgtcgtcgtcgtcggcggcggcggcggcggcggcgacggcggcttggccgatctggatgcctgcgttgcggggcctcttgggcctactcggcttgacgcccttgtccttgtcgacgtcgtgggcgggctggctgatctggaggaggtcggcggcgcgtggctttacggtcctgatcggcttgacggcgtcggctgcgaacgtgttagcggcggcggcggcggcgcgtttgcgcttccacgacgacgggccgggacctgcacccgggtcctccgcaaactccggcggcgggcccttcgggaggaactcggcggagcagcggagcaggtctcggcgtgccggaccaaacactttctcgagctgtgcgtacacctgatgagcgtccatccatctcttcttgtgcaagtcggaaagcttgacgacgaccctgtcgtaaagcttctcgtcctccgccttcacccgctccaagaatcgcttggcctcgagcggcgacacgtctcccttgccttggggctttgccgttgccgcagcgggaaggtgatcggcggggagctcgatcttgtactccggacggacgaaggtgttgaactccgcgatgaggtcggggtggtcgccgaggagcaccgccgcgccgtccaccaccagggaggtggacgcgttcgcgtacttgccgtactcggtgaggatggtctcgagccccttgtagacgcacggcttcaaccagaagcggcttctcaccttcctcaggaaggcgagagccgcgcgggtcagctcttctcggttcgccggcgccggcggcgacgccatggccggctttctcggaacagagaagctaggcgcgcggt

SEQ ID NO: 26981 - DNA, 934 bp, Oryza sativa
tttgtgggggcattccagatcttcacttgcctacatgttctcttaagatttccaagagaaggcatagagttccagggttggcgattgttgttccccttgttgctacaacaatatgtatcctttcattgctccttttcttccatgcttggtataagaacagattaacaaaaagtccttcaacaatgtccatgcgagcccatcaacttgtctcctaccagcagttggtacatgcaacagatggcttctcgacgaccaatttgttgggtactgggagctatggatcagtctatagaggtaaattgttcgatgaaactggtgagaatgaaaatcttatcgctgtaaaagtattgaaacttcagacacctggggctcttaagagtttcacggcggaatgtgaagcgatgaagaacttaagacaccggaaccttgttaagatagttacagcatgctcaagcatggacttcaatggaaacgacttcaaagcaattgtgttcgacttcatgcccaatggttgcctagaagagtggctccatcctcagatagataaccaattggaagagaggcacttgaatcttgtccacagagtaggtatactctttgatgtggcttgtgcattggattatcttcatttccatggcactacacctgttgtgcactgcgatcttaaaccaagtaatgtgcttcttgatgctgatatggtagcacatgttggagattttgggctagccaagatactgtcttctcaaccctcaacgagctcgatgggatttagagggacaattggttatgctccacctggttagtttatcattctttttatttgcatctatcgatttatttaacacaagaaaatttacttgaaaacattacgacctttcaatcgtcaaatctctttcaccatagacatagcattatcatttacccagtttactta

SEQ ID NO: 26982 - DNA, 1121 bp, Oryza sativa
gcggccttaattttcctttttttagatggttgattttttgttcaccattttttacttctatataatacatggacaaaaaatcgtatctaatctaatattctgatctgacaaaaaaaaacaaaaaaaaaaggggaagaactcaagtcggtttctccaattaggccgacaccaagctgtcggttcggcccaaaacctcgcagccacaggagagagaagaatcgcgaaggaagaaggccggagaagcggaagcgagagcgcacggcggaggcgaggagggtttcatggagcccgagaaatccaaagaggcggcgagccagccgatggaagcggacgccggcggccccgtcgatccccgagaactaggtagctctcccaatcccccccttgctttagatggctaaaatctttcatgcgaaccccttttgcttcctcctccaagaaccggaagtatatataaatcgtgcaggaaatgggagatgcctgacgtgtcctgactgatgcacctgatttcccctcttttggttttgtgttacctctgaatttgttagtgtccagcgacgatgagatagattactccgtggagcccgagttctacgatcccgacctggatgatgtcgatgagcggtgggtgagcaagcagaggaaagggaggacttctgacgccgtgctcagctgccccgcgtgcttcactaccttgtgcctggattgccagaggttgtctttccttactgcttcgaactctgtgaggaggcttctggattccaatatgcatgtttattaagcagtcactagttctttttagattagtcgatttactatttttagttcttggattggcacgatgcttttcctgatgatgaagaaactatcaggattgtggtgctgctgcctgtatagggtagatgctatcaataattttgtttggagaagttggtgtatgttagaccatgaggagtatatctatacatgtgagcaaatcttttgcatacaatcgacatccatgctcacaatgatcaaattggttgatttaagtggctggaagaaataatggaacttcttaataaatggtttatgctaggattagttgttcctgaatttttagtttgattttgcggggtgca

SEQ ID NO: 26983 - DNA, 11487 bp, Oryza sativa
tttggtttgaaactaaaataaaacctgcttggaacttgtgttggtaaccatatattgtgcttgatcattttcctctccagaatatgcaattatatcacttgattgtactgagcatgtccaattttttaatacaaaattgagaaatctagatttgtgggaaaaaaaatctggaggcaagtttatgtgacctatttgcaattctttcagtaatcattttatatcgtgaaacattatgctgttgttttcatttgcacaatgttcagaaactcctgaagttcttactttgaatgcttcaaatcttcagacaattattaactgtagtggctttctttgatgttcaggcatgagacgtatgtaaatcagtaccgtgcaatgttcgttcgcaactgcaaggtcaagactgatcagattctacgggaggggaaaggcaaacggaaaaaccgcaagggaaaggctgctgattcttctactacatcagaaggtgaaaagaagggtgcagtttatcaccctgtttgttgtgaggtttgctcaactgaggttggagtgtttgatgaagatgaagtttaccacttctttaatgtcattcctagcaactcctgaaacttgttcttctgaatgtgtagtttgttgatccgtagccactgatgagatctgtacttgctttggcgttctactgttaaatcaatctacattcaattcagtcaggtgcatttgccatacttttttttttcatttctgttgctaggagttcttcagtctaaaattataatttatagctgtattctggtatggggcctgatgaatttcaccaagaatgttggcaagttcctggaatattggaattgcaacattaattacttcaatgtgtgtttttttgtgctgtgcagaattgctgaataaattaatgattcgtgagaattattcgagggtacaaatgaacgaatgaattattataaagataaaaatggatttaagacagtattataagaaatcatagcatttaggaattcgggaaagtgtgcccatttatccattcattcgttaagcagagatgtcctagtatggtagtggaccagaacgacaatgggttgtgaatagctacagtcctgtttggaccagaacacaggaaattttgctgggggtagaatcgaattgtttctcgtgaaattcacagctcatatcctgtgcaagaacatcaaaactgagaggagcagaagaggttgtagcttcagtgtaaagatacgaacagtgcacagtgtttcacttccgcggtgagaatagagagagagaaaagattgcgttaaaatcaggtggcgggagaggtcgccgacatgctctttttgagccaacgaagccatgaagcctttgccgggtggggctccaattatacgctgaaagcgagtaggcgaccaacgccatatgcatatccaaaactaggaaggctggtagccggtccattcgccttccctttcaacacaggtcatcatcatcgcttcatcgcccctgtaccccccctcgcttctctgccctctcctccctctctcgacgtctttctccagtcatcttttgttgaaaaaaacgctctcacaacctcccgcaaagtcaactaatcaacgcagtttttggcatcttcatgtgcgtattgcgattgctacttggttgtacgggctaactatagtattaaaaatcacggatggctaagtggtgctggtgtgtacctagttcatcagagttcaagttttagatttagtttagctgtccaatgtttttaggagtgcttatgcatgtatgctaggttaatacgtggtgtcctcgctacagggggtgggtgtttgatgcctccaacattaacttaaaacatgtgtacaggacttacaaatgtttgtgcgtgcaagtggtggtatgcaaacacacaacccaaattattgggaagtggcaaatcctctaaagaaaaaaaataaaaacatgaataaaatgatttactcttattgtggtgggattagctcatcggaattcaagtttctagacttaccgcagatgctcgtatttacgattaattattcttagtggtatatgacatccgttgacagcgagatgtttatagttacgtcgttaatctcaatatatgtcatccagtttttgaaggtgtttattatagagttaatgcgtgcacatgtgagcgcgttatagggatgattgtgtacgtgtgttttgtgcctgtttttgtaaggtgtctttcaaaaaatgatattatactacttttttttcgaggaaacgatattaggctcttgtctcgtacaacatccagtggaacacatggttttgcatgatctcacaacaataatcagttcaatctccatagatatcctcgaaaattcctgcttttgcaaacaaccaaccctaaacgccaagccatggatcgcatccccctcatccatctcattctcaccgtacgtttccttcgtcccgggtgatgatcgatcgatcgatccagctgccgccgtccatccaagctttgggcccccagagcagcagcacccacgcccccacagctcatggctgcaaaaactgtacgctacagcgttgtacaatgtacatgtccacgtccatacagtcgcagcttggacgacggaaacctgtacacagtctcgtgcatgaccacatgataacgattttttagtaggccaaagaccaaagttttttttttctttttcctgcacatccccagcagtagcccccatcatccagtgtccaccgaatcgtcaccgagcttttggttcgaaaacgatcgatttcctcgcgcgaaacccccacgaatccgtccgtttttgttgctgctgctgctgccgccgccgcgaaattccgagatctccctgtctcggcagccagcgtctctcaggtcgctgtgcctgcacagtttgggttctttcacacgtccagttcagcacccacggggataagatattgtaatgagctcgagccgtcgactattaaactaatcctcgccgtgatgtgatacggtggtagattaggcttaagctatgtagcgtttgctgctgctactatttgtaaaagaccctgcagattccagcaaagtgtgagagctactggacccagattcccatgtgccctgccccccctatggtggtacagtactactgctgcgaccacactgcctcttgccctcttctgctcctcccatttctcctcctctccttccctcctgatcaaggtcaggtctctctggtgacccagataattagcgctcgcatttactacgttgcacacacgagtaaaataccttgaatagtatattccgtattgccatttcgctacgaacatgtagcgtgtagtgcatggctgcatgcattagaatccagacaaaaatgtgctggtattgttgtatagtagtaataatgttgattactgtttcctcaatcatgaaataagtttatttaagccatcatttgcattagaggctgtgaaaatataagataaatacattaacaatagataaagagggagataataattgcattaggatttgatcaagtattggatattctagttttttcgattgtattggtatatgaaatgaattacaattaatttattttgagacgaaagtagcaacatgtactactactagtacttcatgagaagaaattttgtagaaaaaagtaagtggggggggggaagtgaagtactatggtaaaatacgcagaaaaaggccctgtatagatgggactaaaacttttaagtccctatcacatcggatgtttgaaaattaattataaatattaaatatagactattaataaaacccatccataatcttggactaatttgcaagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatctaaacaccacctaaagacgagcaagtctacatcaagtccattataaatctatccggcgtgtccctctccccatcacctcaaaacctctcaaaccccacaggcaccggaccaccaccaccattggcaccacctcgcatcacactctctcgctcgccatgagctcccgcgacgccgccgccacgttccatgtctaccagcccgtgcagatcccgacggccacggtggcgcccgctgcggcagtgtcggcggcgccggcagaggccgtcgcccagctggtcccggcgccgagcaagaaggcggccggcgcggcgggtgggaaggaccggcacagcaaggtgaacgggcgcgggcggcgcgtgcggatgccgatcgtgtgcgcggcgcgggtgttccagctcacgcgggagctggggctcaagtccgacggccagaccatcgagtggctgctccgccaggccgagccgtccatcctcgccgccacggggaccggcaccaccccggccgccttcgtctcctcctccgcgccgtccacctcctcctcgcaccagcacaccctcctcggcaagcgccagcgccaggagtccgccgccgccgacgccgtctccgtcgccggcgccgcgtccgcgttctgggcggcgctgcccgcaccaggccggcccgacgcctggggcttctccccgctggacgcgcagccgacgtacgtgccgatggcgcaggcgcaccaccaccacctcaacctcctcgccgcgctctccggcgccgccaggcgcgccgaggaggagtcccggtgaatcacgcacagcagcatgcatcttccgagctctgacacgtctttcgctcaattcaccgacgcgtactgcactggcgtccgtacgccttgttcttgggacagttcttgattggagtgtgcttcttctctctaccccgtggatcgatcgttttgccttcttcctgtgcggttcatcaattgctcaagatgaaattaattgttgctgtggtgtttaagctcaaaactgtaaatacgagtccttagatctcatcttactcctacaaattccagcgccgcatgtgtttgtgtgtttgccacttgtttccagctcttgtgctatgattccatggaacttgtttcagtttagcttcatctacatcgttgtcagaccaaatcatttgacagttacagaaacatgttgcattgagctgctattccttgtgtgcatttcctatctcagcagtctatccaggattatagcgtgcacatcaatcacaatcttccattgcttcttttttgaaaaagaggaaaaaacaatgtttcattctttttttgttaaacgaatcggcgcttatagcgtgctaactttattgaatatagcaggagaaaaacaatctttgattgctcatggaaatgttcttgagctcatttcgatcgtaagtaggaggagggatgtaaaacaaagcaattgttgttcaactaggcgtaggagaaggcattcgagcaagtctgagaatttcctcggttaccccatccatggctgcagattacaccaatgataacgctggctgggaagatgcccgttctcctgtatactcctctggtttcttttctctcaaaaaattcgcctttttttcccctgctcttcttctgcaagtgcaagctatagctccgagcggggggaaggaaaaggaggaaaggctgcggcgctgcagcggcatgcagtgctgcacagtgcgcgctgctgctgcggccgctgccgctgcctgaagcttttgcccatggtgaaaggttgaggccgttgtgcatgtatagggctcgtcgttgcgtgtcaaagctggacgcaacctctcggcctctgaactgtaaagatgccctacctttcgtacaacgtcctgcatgctgccatgtcccgtgctagctactactctctcttgcaattgcaacacagcggactactcctaccggctagaggttgacttggcatggcaggccggttactctcttgttgcactgtacatatattgcacattgctatatatactgcccctctagggaatgtaattaaggaggcatggttgaacgtatcaggtaaaacaaatggagggtcacagggcatgttactacatgatactcctagtacttgacaatcttatttttggatgatctatagtttgactgtgttagtatagtgtgagaacaagaatttcctgctagcagtactctacgcagtattagaagcgccgggcggaaggatgcaaatttggggtcgctgtaaattcctggtcaaaatggtcaggagatcccaataagagagacgctagtacaatgtcggttggtagtctgacctgtcaccacgtactccgccatgcagcgtgtcagtagtataaacttggacaaggtagtaggagtagtacgtgcgtgcgtaccatagctatcccagtacgtacgcgcgtactagtaccacacatccctactgctttgcttttgcagcgatgcaatactggtgttccgagttctctttgctctcaacattttggaccgctcattcagtgattcagactttcactgtagctagataggagtatactagtagtactaatgatcttgttatgcatgtaagcgaacaaaagtgtgtgtcaaggccggcttgaccgagaaaaattgtccgtccaagccgtcctggctcatggctgttcgcatgcacggatctctcagaggcacggggagcctgatgtttctgatcggccgcagactgggacggtccgtccctttgccgcctggttttggttggtggcggccagctgctgctgctgccgctgccgctgctgcagctctgcatattcctcctttgcgattggccggtacaaagcacatgtcgcggcccgcgggcgtggctgcgcgcgactgtgttcgtgacagtgtgactacgtactgtgtcgtagtcgtcgtcgtctactctgccgcgcgctacgtactcttactccgagaggcgagagagtgaggagaggtgtggtcgccgacggcgagacactggcatgcaccaccgaggccggtggaagctccccggcagatttggctgaaaatgtgacaccatacctatgaccggatgatacatcttgtttctatgaatttctatctagatttatcttatccagtcttacactcttcatcaaaaagaaaaagctaaaatcctaattgcacattttcatattcataatcaggatttaattttcttttaaaatatataaaaatatgttgctacattgtgagatggagagactacttttaagcaataccgtacctgtggtcctgactctttgtcctctttgtcttgcctcaagagcaacacgtagagaggtggcagcaggtaatactgatagagtacttgtaagggcatcagcaatcaaagatactctatgggtgtcctcactaaccgaagctactctatgggacacccatctcacaatggaggatactcgtagctggattctttaaaatcttaggcaactttatagggctactgcagcccacaacgggtgtcccgactcaaagtagcccagtaagaaatgaggatttttacggtactctatactgcaagtatatacttatagtataaacaatccaacggtgtagatttatctgatcttcctctaaattaatttgcagtataaatttaaaagggtatatttgtctttccatcttttttacgtggggatatttttgtattttcgcgttttctttttgtccgatctggctcgagagaaatccactccagagaattatgtttgctttccttcgtcccatgctctatcgacgccgccgacaaccaaaactctgcaagcgcctgagccaaactcggtgccatcggcgacggcgcgccccagcctctcgttcgcccagtcaccagccctagcaccattgagaaattgcactgatagccaatcgttgttttcattttgcataactgtctcctggtgccgcctccatgcagggattgatagatctggcaaatcatcccgtcataaactaattgaacaagaaatatactgagaacttgatatgtctggcaaaaaaaaaaatgaactagtcatctatcaatttcatggatcatgcatggctatgcatgtcaaaacttaacagtgctgatatatatttttagatgcaagtgcaaccaaaaaagtgtctactaccgatggaaaattactcccgatgacaaatctcaatttcaaatgactaaacagccatttttagattttttaacaaataccaaacctacccttctatatactgtaagtatatacttgcagtagaatgtaccgtaaaaatcctctaaaaaattccacccatacccctcccaccagcccagtaaaccgtctaaacttctcatctcttcctctcctttctcgtctcctctgctcgcgcccttctttcttctcgcctccgccacctccctacgccgccactagatctggtggccaccaccagctcctccaccacctctccgagtccgattcctccccaacgccggccaagggtgaaaggggaaatttctggtgggggaaccgtgtccacaagagacgacatcgtccaacgcgaaacctcaagcgagtggctcaggaaaaagggagttgaggaggctgggggtgcgttcccctcgtgggggtcgcacctccctgttgagacacggctcatggacggggggcgaacggcgtgagcgaggctacggtccaggggcacccattgctgatgctctaagagcaggtataatagctggctataagccagctataaagatgttttaaagagataaaggaagagagagaagagcagcgggctatagatctgtagccagctgcagtacggactccaagacgtaatatgtgtatgacatgtcggatcagatattaatggtatagtaagcaattattgtatgaattgactattatattggctataaatgatttagtacgttggatatataatattaaacttgctctaataaggtggttgctgggtcaaaacttgacttcgatcggcgcacgaacgctttgaacggcccccgtgcttcgcttcgtgagcggccagtgcgcatatacagcggggtttcggggcttctggctggcgctgatcaactagctcctttctggcgcgccgtgccgtgtggccggcgcatcgccgcctgcgcctgcgcggccctgcgtgcagcagtggataagtcttggccattccgtgaggttctctccgtgtgacaaaacaggtcgcccccgagaaacacaacggcacacgtacggcaaataactgtgatccatactgtgtagtacacctgtagagcctgaattttatcttgtctgacgaatggccgagttgctgcaattttatcgtctggcaggacgtgattttcttgtaatctgtggaacgggttttgcttcgggcactcccagactcccagtagtagtaggagagatccgagtcttgcatgggatccagcttcaacgcgaaacctaaccagaaagactccaccgtttaaaaataaatttactccctccatctaaaaatatttgacgcggttgactttttaaaaaatgtttgaccgttcgtcttattcaaaaaatttaagtaattattaattctttttctatcatttgatttattgttaaatatacttttatgtatatatatagttttacacattttacaaaattttttgtataagacgaacggtcaaacatatttaaaaaaaatcaacggtgtcaaacatttagaaaaggagggagtatatccttaccttctatcttcaacttaaccaatcataccatccttcatttaatttttaacctactttctcttcctaactactccctttagcttgataattctcgttgttttggacaagataatggacaaacttcaaaggctttgattataaataacatctaaaataattatcttacaaatatgaaaaccatgtgtatagataagtcttgaaaagtactttaataaaatcatatatttaataatatttatatacatattataataaaaaaaatagtgaacaaagttgtttttttaaagactgtccttattcaaaataacaagtattatcaatatagagggagtactttttaacgctcatgctcaactaaggaatccttacgttttaggacggagagagtaccatttaagtattcatatagtttcttaacattaattgattaaaatgggatttaggtaaaataatttgaaattgattagatagatccaaacacaaacactgggcatttggttctttctaggtgttttagttggatataatatgaaccacttagttcacttactataatactccctccgtcccataatataagggattttaagtttttgtttgcactgtttgaccactcgtcttattaaaaaaaatttagaattatttttttttgacttactttattatccaaagtactttaagcacaacttttcgttttttatatttgcataaattttctaaataagacgattggtcaaataatgcaaataaaaactcaaaatcccttatattatgggacggaggacggagggagtagtatctacttcactgtcccaaaataaatcaattcctaaagtttaaactttatcctaaaataaatcaatttcgactttcttatcttttatcgatccaagaattgaaaagtttttttcccttcaatacccttactgatccacctatcaatactacattctattgatgagggacaatgtagtcttttttttccttagtactaattttgtctgggaatgcgagggtgcaatttggcttattttgaaacgaatggagtacttcaagtatctaaaattagaataggcacgggaaatggagtattatttaattaatggcattctcttatccaatgtttgcaattttggttcgaaattcctaaaatcatttcacttgaaaattcccatatcattttttaatttagcaaaaaaaattcaagtcggtcaaaactgttcaaattaaattacaagaaaaaaaatcatgccgaatatcctaaatgcgcagaacgtaattaccaaccctgctctacctcggtcagcaaaaagaaataatgggattcatgtactaattaaaaaaacactgtacaacaagctgaataaggaaaacgaaccacacgaacgtgcacttgagcgctgatctgtgactgatcatggcagatcgatcaatcgtcggcatgaatgaatgaataaccgaagctcctccgatcggcacggcgcacgcagcagcgggtgatcgtattcgatcgtacgtacgtgcacggtgcacccacgtcggaataacttcgaacaatcaactgagcagttgccacatactcctacaatttttgttcatgcgcgtactctgcccatcaagcttcacgccattttgcacggacgccgcgcgtactacgg

SEQ ID NO: 26984 - DNA, 2352 bp, Oryza sativa
  unsure (1)..(2352): unsure at all n locations
gacgatcaaggtcagttgaaatcgagccattttcatgctcccgtgcgcgttcctggttctttatttttgtctcttggactcttggtggatgaggtaactcgaagttgtttcggacgcggcaatcatcatgtgtaacagtgtaagtatgttgaaattctgtaaccacccagttgagagagaaattggcgagggatgaaatattaaattttgtaatatcccagcggggatagctcagttgggagagcgtcagactgaagatctgaaggtcgcgtgttcgatccacgctcaccgcatgttttcatttttaatgtatacgagttatttttttttttgctcatcgcatgttttcatttttactatatatacgagttatttttctcctcactagcatattttcatttttaatatactagttatttttctccttactcgcatattttcatttttaatatactacaaaaatgcatgatttgacaaaaaaaaactatgtcaatttaaatgataaaaaacaaaataaaggtcaaaaatcatatatagcattgaacctggttacacgagttatttttctccttactcgcatattttcatttttaataaactagaatttgattaaaaaaacaatgtcaatttaaacgacaaaattaataacaaaaaaagtaaaaaaaaacatatatagcatttaacctgattacacacgtgacgccgagtagagatgcatggaatggtgttggttgtctgggttgggctgggttgggatagggaggggttgcgttggtataatcggatagaagtgtatgatactccctccgtcccataatataaaagattttgagtttttgcttgtaacatttgacccctcgtcttattcaaaatattttaaaattattatttattttatttgtgacttactttattatctatggtactttaagcacaacttttcgttttttatatttgcaaaaaaaatttaaataagangagtggtcaaacgttgcaagcaaaaactcaaaattccttatattatgggacggagggagtagttattagtcatgttgaattggatacagacaacatataacaaacttaaacataaataacgtatcaaaattctggttgaaacatcttcaatttttataatagtgatacgagttattttttttctcattttattatttttacaattttagtatatgagagatttcttggttgctttccttctcttcaggtttttctccgcccctagagcgagtacaatagcagggtacaagtcaactgtatgcacgcatgttgagaagagaagagaagagagagaagaaaagcgggctacagatttatagccaactgcagcacagactcccatacgttgtttgtgtatgagagatggaaccatatattaatggtgtagtatatattatagataactattatatgaatgagttataagattgactatagatgaattagagctagcagttagctacactattaaacttgctcttggccgccgccgctctataacgttaaggtacatacgtacaccggcgaaaacgttaaggtacatacgtacatgttttccctgttcacaatcgcattccgtttagatacaccagcgaaaacgttaagatacaacggcgcgtgagaggagctaagtttatggcagccgcagaacttccccttccctttttccgcacttgtaactttgtaagcttctggtcagaatgtcagatcctcttggttaagatatttgaatcgagccttttccagatttacttgcgccttctgtaacctataaagctatctaatttcaccatctttgcaatcaaattctcgattttgtcactggcgcctcgcctacaagggttcgggatggtcccttgcaagatatttattttagaggaataggggaggaaccccctaacatggtataataattgatgaccagaaatgaaaatagatcaaaggtttccacgctccttcaaagcgatatttgggcttgtaaagtctgaactcggttgtgcttgcttatgaaggtaagaaagatgacgcttgcttgaccaaacagggcatccgctgacataatcacattgcatttcatgctgctttcaactaattccatatggatgtggatttcctaggtcaataaaagatagctgcatttgttttctcagtaactcatgaattgaatccatagtttcatactagttcagatattagaatttgcacaacatcatgttttatggaccactaaagttttaggtatagttaaggccacttcactattttcttttatgttatgcaatcatggcctttggtgttggttcatgatcccacaggaagtgatttcagtatagg

SEQ ID NO: 26985 - DNA, 20041 bp, Oryza sativa
atattgttctttgttcaccataatagccccttgtgcttgcaccatctcggcgagctctacttcactaggcgggttttctcttgtttcttctcttgttggaccggcagtctttctgcctggcattgctttctccactccggtttgtgctgattgtccagtcatctcttcccactctctttcaagtgctgctgctgcgcttgcaaaagtgtcggtgtagcggattggcactgacttttgcctttgggaacgtttcatttactattcaagcccactccaaggatactacacgtccccacggacggcgccactgtcgtgaccttgacccaaggtcacggacaagattagggatagacgggaaaacccccttttcccgcctatcctaagaaatgagcccaaataccaaataaacacatactaagtgacaagacttttagtattccaagatatcctgcctgctacaggctttttgtctgctttatatagttcacagctttacatgtgagattacacttgcaccctttgttgggcccacatgaaattacaattatgcccttgctatatcagctaaccctaagggcattttggtatattatggaggtcattatagtcttttggtgccagctagatgaagtggttgagtggtcctcgggaatattctcttggcatctttgttgtctaagtcgccttcttcatgatcaagagtcttttccaccaccatgggtcttctcctcgaccgatggtcttttccaccaccatgggtcttttccatggcaaatagtcttttccagttcgactacccttttcgacttatccggtagctgacctgttactgacttaggaaacattcaaaacggataataagacttagtgacaagaatttactcgaacggtattttccgactcgaatagtgttttatcgtttccttgttcgaatggtcatttccactcggatacttacaataatgactcaatctcacccaatctctctctacagtgttttgggccgaatatggagggacggtggtcaccccctgctacaacaaacatatctttaagaaatgctgataagaaaagtaaatttcatcctataccatacgtatcaaattatagtatcaaaattgtacaatagaccttgattcctattttccctcaattatatatgcttctctttgtctaatcaaatgagggcgtgagcaacgacaactagagatacgccgaggagatgaataaccaggagtgcacacacagcagctaccacaaaccgcagaatcgtcgatggccgcacccgaagctcaaatactagcttctgattctctgtcactgtcatcttcaggtaaccatcgtcgtcgtctgcggcagcgtcctcctcgtcgtcgtcgtcagtttgggcatcatcatcgtcgtcagcttgggcaggaacagcttcggacgcaggcggctcttgcaccggacgctccaaccctaaaacgaataacacccagtgagaaactacacaagcacacgatggatcgatcgatacaggctagctcaggacgacgatccgtggcgcaaaattgctcagatcagaaacaggatcagaagcagaagtaattgatcagaagcagacgatagatgatagatcgatacagggtcaggattactacctgaaggtgagggtttggcgtggatgatcctcctgaagcagaagttggagcaggcgtggtaggggttggaggcgttgatgcagtggggatggacgcgcgaccaccgatgattatcttccctggacttcacgatctgccggaggcagtagtcggagcactcgtggtacgggttcgacgagttgacgcaatccggccgcgacttccccggcggcggcggcgacggcttctccatcggacccacgattagctccgccttgccctagatgacgattagctccgcctcgccctcgtcggagaccgcaacgcgtgtgaattggggtttggattgagcgaggtggtgggtttctctatttgacttcattattagtattattctcctcctcgtttgcgagtaagattctaactgggccgagcaggtgatgggcttgcgggcgaggcccatttatttttctcgagccgttgggccaaggcccactcatcgccgcgaccgcgatatgtgcgtcgtcttcgcggccggcgagactgcgcgaggaggagacggcggcggcggcggcgtacgtacgatgccggagttgaagacggcgagatgcggagccacaggtagtcgtacaatgctcctcgacggagagtcgaagagctcctcctcgtctcgtcagcgtggcccggattgatctccagttctccaccgccgatgagatcgacaagcacaagagattctcccttcgccgccgccggcgaacgcaacgacagcggcggtgattggccggaggtgcgattctgaagtgcgccctgcacaatacgggattacgggtcctttctgcgtcgacgacgcgcggtcgtcgacgacatcgacggtcacctatctgattggaaaatggaaatggtggttctagagaagttcttgtctgcttccagtcagcactcagcactcagcagttcggagatgcttgtgcttcaattggtctattgaaatatactcctatgtaataaccaaattaacccgaaagcttaagttgatgagtagagacgggtaattcactaatgttgcaacactcattctctcacgcgaaacgctctaaatcttaagcgtggaataggattaggctgcaaacttttatttgataattgcgtgttagtcaggatttgaactcaagatgcttaaactcatgaaaaaaggaggacggcttacttctattttaaagcgttcaacaattcaactcaaaaagtttcaaacaagacaactcatcaaccaacctcctgaagaattctaccaagttggcaagttccgctccacaatcttgcatatttacgtcaaattctgtatgagtagaatttcatcacctgtctcccggatcccaattctcttggaacagacacatgaacttgcaattgttctgtttttgtttcccaggttctttgattggtcgtatggttcggtgcagtttttcacttctgacgcctactttcttcacgaaggttttgagtagcgacctcattttcgtccttttgtcgcctacgtgtgaaccataaatataatcagaacgtgcaaccacccgttttgttgaatgtcgatcacatcatcacgcacatcagctatgctgcaaacactggaaaattctccttttttttcaggtcaaaagacattttcaggcacgaattggacgtctcaaaccaaacaactgacgagtctgaaaattccaagccccccaggcattcctcatctataagtaacatgacgtgtacagtagtactgaatactgatgatgctgtattattctgaccaaatggctccatctccattctagaagattcacaaccagaccctgccaaccagaaagagcagccatacttgtcaaagagttgatatcaatgatgggtttcccttgttcattgatgataaaacaaaagggaaattaatggccacatatcttggttcagaagaacctccctgctataacaaacatcgatccgcctatatctttttatataacaaatatggacagtgatggaaagaaaatgaatgaaaaaactggtttgtggaccacttggttggtgacaaaattataacttatataagcaggcaattatcttacaaaaagaagggggaaaaaaagaaacaacacgcttctatttttacaatcttcacggaataaattatactactagatctagaatatgggactcttttataggagtgaatggcggtaagaaagtgtgtagaaagtacatgataatacagcaaagattgtgatgctgcagccacaataaaaagcggagccgatggaaacacagcttctattgaaacctacaggactattgtcgggatatactttttttttcaccatcatcatctggagaggaaaccttgtatcgccagcctaggaccacaaaaggagatactgtcaactaaaataataaaaaaagaaatcacttgtatgattaaagaaaatctgctgcttatgttcatcaagttaatttttttgtatccaactaatatctttttttcccctcaaaatcattgcagatctacaacacactggattagctggctaggggaaagaaaaacatatgttgaccagatgcttacagctcataagatttttcaaagcttgaccaaagaaaactaatacgaaaaactttttttccgtcatatgtcttgccttacatgtttgtaatcagcacctaaaaaatacatataagtagttacagagcttcaatggttttcttgggatcatgtaagttgatgtgcccatagctaggtcatgacagctgagttactagttgtgcacaatgaaatctagaaacttgttgaaagatgacagatttttactagatgatgcatgtgactcaagaaaaacgaatctgactagttgacaatatataactactaaatgacaatgttattgaactagtatctttcatgaagggttacttggtccaaaaagtttagctagatgaactttacaagtaccaaatcatggcttgataacatgccacccatgttaagtgaaatatgttcagttaatatacacatcaaaccaatgaagtacagataacttcaatgcgcaaggataaccgaacataaaagagaattttcattaccttatctacctgtcaccctttctcttacaatgttccccacacttgtggtagggattggacgcattcacacaatcaggattgatttctcctgtttgctctgctttcacaacagctttgcccttccttgagtctgtaaacagagagatagtaggcattaaaatgtctgccaaagctctcgtatatatacacatgccatgataactcattgggttaactagatgtacctggtttgcttgtatctttctgacccgtttcattcaaatgatcaaagcagtattgggcgcatatatggaatgggttggacgcatttgggcacctcggatccaccttccagttctgcacaacagagatctcctttccccctgtaggcgtaaacaaaaccaattaagaatggcagttgaaggtacaaaatataatctgaattgagcatattcaggataagcaagttggtagcatcattatcataatgccaccattccattcgaaattcacaagattaagacatgggcccttttatggtaccaacaattgtttgtaggtgatccaattctttcaaagtagtggaacaaatcatttaagattttcttataattttgcatttaatatagggaggaacataataattattacaataatgtaataaagcaaaagggtgttgctgcttctttcccaccaacaagcactacatgaactgcgaaacattatggtgaacagatcttcccatgatcatggttggtcccttcaattttcctttcccgtaaaccagcaaaactcagtcacatttcttttttccaatttgcttccatgataccaatcactacatttacagtgcatatcaatttgtttgtaccattagaggcatttaagggatatgtttagttaggtttagggttaaaacaactaaccatttatcccctaatctacactaacatcaaaattggggaagctaagaaaccataaacaatcagcagtggaaggccactagtatatgctacctttcttgcgtgaggacgacttcttaacagtcttattctgctgacccacctccttcatcttggcagcacaatgctcagtgcattcatggaatggattgccagcatttgggcacttaggatccaccttcttgctgctccccgatctcacgctgccatctgcgcaaccatccaacaattgttatgacagataatacaaagaacaacaaatcccaaatatgatgttaccaatcagtagcaagtaacgaatcgagcaaagaaagacagaaaccttcagaggaggaggagcggcgcgagtggcgggagaagagggacatgggggacttcccgccctccgacgagcggctgacctcggccatcttggcggcgcagtgctcggtgcagacgtggaacgggttgggcgcgttggggcatcgcgggtccaccttcttgccgtcgccgtcggctccctcgcgcactacagcaccaaaacccaaatcgaatcgaattctcatactttcttctgaaagttgctgcgaagagatggggggcaaaggaagggaggtgctcacggaagacgtagaaggggaggcccccggatccgccggccctgtcgcggcggcgcggcttcgcctgcagctcgccgtcgctgtgcgtgctcccgttctgctccgcgattccgttctgcgccgcggccgtcccgttctgcggcgccgcggtcccgttctgcgccggtcgggaagacggcggcggtgggggcggcttggcggtggcggcggcgggagcagggacggggcagtagtcggcgcagcggtggaaggggttggcggcgttggggcaggccgggttgaccgcctgccgttcctccatcaccggcggctctgctgctgctgctacccccaccaacccaacccctcctcctcctcctcttccaagatcaaaatcaaccgcagcagcagcagcagcaaggcaagaaaaccagaataaataaggatggtttgacttgcgagatgctggtgctgcagcgcagagaattccgaggacgaagggtgtgatttgaaaggaggaggaggagaagctggggttgggtcgttggctggggtgggaactcgatcgggaggttgacgacgacgaggaggaggaattaacaagggagggaggagggcgttggaaatggaggaggaagggaagaggtcaagtcgcaacaactgctgtggatggtggtactggtacagccgcggcgccaaacggtcaggccggtccaatctgctcgcctcgtgtagtcgtcttcattctgttttttttttactatataaatttcatgcgtaatcatttttttttcctaaaagtatataggaaaaatattattggtacctaattcagatttcagttgggatgatggacttcaaagtttctgccgagccatatatatagttttcttatggctcggcagaaactttgaagcaattagaagtccgactctcatctgaaatgagcatgagtttttttaaatgattttttatactatgccttatatttttaaaagcgaatgaaattataaaccgactgaaattactaaaatattagtaaaaacatatttaatttttataattgcaggggaagagatttggtgcattcatgtttatactcgtcaagacgtatcaatacgaaatcaggtttaagagaaccgtaaagacgcacaccttccacctgttcttaattgtatatttatgaggatcattaacagcatgacagctctgcgcagtagagctggttgcggctatattacgtaccagtactacttaccaacgatttagcagtgttgcggctgtgcagtcgtaactcgtaataccattgattttccttgattttatcagcaaattatacaagaaacgtagtatgatgatattttttaaatgcgaatttaacgatacaacatacacaacatcaaacaaacataatactcccccgtcccacaatataagggattttgagtttttatttgtaaagtttgatcactcgttttattcaaattttttttgtaaatataaaaaacgaaaagttgtgcttaaagtactatgaataataaagtaagtcacaaataaaataaataataatttcaaaaaaatttaaataagacgagtgatcaaactttacaagcaaaaactcaaaatcccttatattatggaacggagggagtatatattctagtttaatagttaatgaaaagtgaattactaattttttaaaaaaatttaatgttgttttatatttgcacacgtgaaggccaaaataaagttattggtctgatatgtgaacagtattttggtcaatcactgatctaaaccaacaaagtacagccatgtactctacgaaacccggaacaactgtttttttgtttaaagacgactagagcaacgagtacgtgtgcgcgtgcgtgcggctagtaaggaacttttgtttttttctactttcaatgtctgcaagactggaagcttccaggagaaaaggaaggaggagttgaggaaggaaccaaatagcggaggagcaccactgttttggaccgctcttctactcgatccatccgtggctgcttcgtttccactgaatttccaagctctccccagtgtcaactgatcgttttctcctccaaaaaccatcgagatacagaaaagtagtccctcaggttaataattcgtagccctaaaatttaaatttttaaacttgattttaaagttgattttaagatacttcaacataatttattttcaacattggctttaaatcactacgaacaaatgtataaaaaaaattgtctataaattgtttttattccctaacaagccgtattgaacaaaagctcacgttttgaacaaaagctaacatcaaattttatttttttaactataattaaattctaaaatattaaccatacatattttagtattaaaaaagtactttaataaaataatatatttgatgatatttctatatgtattataataaaaatgatagtacaaacaataagtattatcaatgacaggaactttttttttctctacctaacgcgttgttgttgtactatagtactatatggtacctgtaaaaaaaatgtgaatgaagcaacacaactgtcacgttttccgtttgcactttgcagccagcacagccgacggcgatctcttgtgtttccagcgtgacgaaacggatggatggctacggatagagtggtgctttggtgtgcttttgttttaattgttgtctcttctcttctctcgtgcaaggccggcagtgtaccgtgtgctgataagagttcaaccactaaagttccgagtaataaaagacccagacagtacagaggagccactttgcatgcataaaactcctactctactgtactcacagttgcacggctcagaatttatagcatactggagtatgtggttgtttatgcaggaccagatgatcaaaagttggtactagtacaaaaattgagtgattctttcacaactcatcattattgagtagtggggttgtgtatacttggctagtgtttgtctcatcattattgccttcccaactgatcgtaagcccgtataggaagttccggcccagaaggccatagttgcatttccatctggacccgaacaaataatcgggccagaagctgaacaggccatattggactattcttttgacgaagtgacggagtttttatagcatgtgtaggcagaaggattaagttcacctgccgtccctcaactttacaccgaatttgtttgacatcacttatcctcagtattaaaaatcttcacccctaaaatatataaaaccgtgcaatttaggttccatagatatctggtttcgttgacgtggcatcatagtcagcaaaataaaattaaaaaaaatgagtcctacatgtaagtgaaatgaggagaaaaaatgtgagacccacttatcagccccatcatcttatatagagggggaggccagccggagaggggggagaggatgccgacaaggggagggggggtgccagcaggatagtggggagaggatgccggccgcgtcggtgggagagggggagagaggcgaccggcgtgacatcgttggcggtgagaaagcgcagggaatgagccataaggaggtggcaacagcggcggtggctggagggggcaaggcagcgggtgcggagggatcttcatctgcaggcgacagcggcggagctccgccgccgcaagcaccctgtcgaggccgacggttacccacaaccatcctccgatctgctccgtcttcatcgtcgatgccgcccccacgcgccaccctggatctgcctcgcccggtccgcccaaggaccttcaccacttcctccgtcgcttccgtcttggactcctcccgatgcgccggccttggctctccaccgatggctgctccgcccctcagccctcctctttctcctctcccgtcggcgcggtcggccgcctctcccctcgctagctactccgcacgccgccgctaccacaacccaggagtacaaaaccatggtggatgtccgcgcggggcggcggcgggcgagcgtggtagcgggcagtgggaaagggggcagagagatggccgcagtggcatgtgcgcgttggtgcggcgacagagctcgaccggctgcctcgccccaatttgccactgacaacctccttgaagaggagaaaataagaaaaaagaaagagatgtgggccccatatctttcttctcacttcacttacatgtgggacccacattgtttttagttttatttgccacatcagtgaaaccaagcatttgtactgctatgtgacttaaattgtatggttgggtgaaaattcctggtattaaagataagaaatgtcaatcaaactcggtgtaaagttgaagggacggtaggggtgaagttattccgcaggcagaatcatcgatcatgcgaattcgaaccccatggaatcagtacaacacaccccatcttgccataaaaccgacccgtcacgtactaaaaactccttccaacgatctaattccatggatggtggatcgcctacaggatcatttaccatactaccactactctctgtcccaaaatatgtaatctaggattggataaacgaatttgaacgaattcatacatattcgttgcagtagaatgtccattcagttcttagggacggagggaatactagcatttatactgccatattttgtcatattgacagcatttataaccattaatcatcctctgatcttcccaaatctccatcagcctgccgctggcggtgaccataaaagccccgaccagtcgaccccctttcgcggccgccggagcagcggccggccaccgccggtgttaacagcggcagccttttcatgcggccacaacggtcaaaagcgcagagcatccgaggctggcccaccaccacgcgcccgacgtgacgaaactgccccccatctctctctctctctttcccctcccacgcaacgacaaatccggctcgaaccactgaccatcccgtccacactgcaccgcgctagctcactccctcacttgcgtccccccttcccgtggctgatctcgccgtcgtgcggccgcgggctccggcgaccggtcatggcgtactccggcggtggcgggaagctgtccgccgtcgatgcgatcctcgccgaggcggccgacctcgtcgcgctggagcagatcgccaagctcaacacagcccacctcgccgccgacggcgactccgcgctcccttccagcctcgagtcccgcttccgcaagctcaagtccctccccgccgcgccgttgcctccgccgccgcccgccaagtccctgggccgcagcgccaccgcgccgccccaccacaccgacccgccgccatcggagacgccggaccctgctccgcctgcgccccctgcaccggcggcacaagaacgccgaccagaagacgccgccaaggaagcccaggagaaggagaactcctcgccgccgccgtcgcaggctcatcctccaccggccgtgaccgttccgacggcggcggcggcggacgacaacgaggaggacctggagaagctgttcaggccagggcgcggccggccgacgctgagggagaggaacagggggagggacgacggctcaccgtcgccgccgcgccaggcgtgctgcttcggcttctcccccaagaagacgctgcagaggactccgaccgggagcggcaggaagagccgccgcgccggcgtcgccgccgccgccgacgacgacgtccttggcatcggcgacgccggcgagtggggcgacgagaacaggaggatcgtcaccgagctcaagcagcagcagcgcaagctcaagaaggcgctcgaggagcaggtcaaggtcagcagggagacggccaagatggcgcagtgggtgaagcaggcgtccgcgcggatgacgcacaccgctgccattgacgacttgctcagcgactgcgacgatgaagacgagctcaagtgaacaaaagatttcatcactgctgcttctgctttatctatgttccaaaatgttttaggttacaacatagaagagtcatatgaatcaaacttcagggaaaaggatataaatcctgctgttttctagtattttgcatgagatagacgaagaaagatatatgaatgggatatgtaatgtggtcaggagatgtagaaatgaagtacagacttcttgccaaaatttcgtcttttgcccctcccatatgtctcctaaaccatttactgatttacacagcctttcctgatgccattatgaattcagtaatagtatcctgacaattttctaaatagaagaactcaagaacagcgttaaggtccagtatgtgaaaatcatgatttcagtaacaacactagggcaattttttctagtatctaaattcacaagccactgctcacgccattacgagttcatacttgggcaattttctcagagagcatttgcagtacatgaacgtatacagaaacggacacacttatttgatttaattggttcattctattttattttgagttatggtctattggtacaaaataaaaaggatcaacgcaaagaaaaaacgaacactttatcacaaaagaattgccctgtcatacagtatatcacaagatgattgattacatatttacatgtcattttatacttcactgaatcttgtaacacacaagtcaatatcagaccatctgatactatcaacatctccttatgactttatcgtgcaaagctactcatgtatgattcagcaagaaagcaacatgaggaaattctaaatgtttcgtgtatatcactatctccaaatataatctttttcatctgaaacatacggaaatatgtggggtagaaaattatgtatcataaacagaaagtgaacatttctgattcctccttatcatgatgcctgtaagtgttacctacttgttgccttaactacaaaaattgcatgctcaagtacaaacacacaagtgtaccaattgatcctatgatgtaaaatgaatgaagtcctaattcattcatttgtgtttgactgatcctacatactgaaatgaatgtagtagggcctgactgttttagtgcgtaccagcattgtggaaccaggcttatgaaagcatcaacggatgaccatttccaatgttctgtccaacctcaaaattccaaagttcagcaattcaagagaattgctgccattgtgtcagtccaacaagcttcaattgcagacacagcatttgtcaacagcaggtgatccaatggtagaataacacagagggcctctctggagtcttgattcgttgaatatcccacaaattgcaccctgtggattcctttgtgaaccctgaatgtagttcgatattcttcctctgtgaaagagtgcaagagtatcaacaatcatatgttgaggaggaaccaagtaagatggatttctaactagaaatagagatagacatggaaatatgagaaccttatttctatgcttaagataaattgagggcttgatgcctcattgttttctcccatgaaatttagtaataggtaaatctgaagcgaatagaggagccgagctattgcaatgtttaaagcaagaggtcatcttacagttgtaggataaactatacaagatttcaaacgttgatatgttccataaagttgtgacctaactttctctctctctttttcttgaaaggagcctaaccttctctttctaaataatgttgctttctgtcttttttggcacactctgcagtaaacaaattaaaaagataattggaggcttggagaaattttattgagtgacatcttacaatactgagggagaaaaagaactgcagaagtgtctatatattcctgagcaagccaaaactcacctgtgtttactatatatcgtatctgtttcagacattcagcatggcaagcaaaaaagggatatggtattcttcaagttatagaaattgaagcttgagccacttcagaattgtaggtattccaatttcgataacccgccaaagcatccatccctggaattcaaaagggtggctacaaatgtaacattcccctttgttccagtacaatagaggcgtcattcagcatttctctagcttttctatcaggagtacaaccagcaccctccatctccttatatacttctgacacctatgcaggaaaataatcagaattacttcaatctcctaaaaccttagattaataagccatgtttcataaagctttgttacaatattttgtatcatcaagatgatctaatagcataatataatgtgagatagttgcatacatgaggaaaaacttattttaacagttatggtgaagagcaaaacaaataagtattcagaatttcaacagaaatttaggatgaggatttgctacaatccatgatatttaagttactaaatgctaaggagtagaaaaatagtggacatgccttttcaaatttctttgctctcatgaaagccttcataagtgttgtgtaagtcacaacatctgggctcataccctgaaaaaatgaaatcaacaataggtagaaattgctcaaactaagttaaatcatggaacccaaaaaagaaacattaaaaaaaacacttttcttctctcatttctggagaaagaacgtacgctatccttgatatgctggagtacagcaagtgcctccaaatgccttccagcagtaccaaaagcatttattagcaaattcagcataacaagatttggctcaattccttctgcctccatcaattgaagaacatttacagtttgttcacacaaaccctgaaaagagagagttgaaatggtgcacaagccacacaaactgaaaggtatgcacagtgacatgtagatattgatgtttttagaccaattaagccttcgtccaaaagaaaacaaaactgtgaaggcagaatgataattgaagattccagagcgttttgaaactacagtagagactaccgagtaatgccaccacatttttgactctcttgatacccttgccatgccttgctagagtgtgcaagaacacatgtgccttagggcccatgtgtgacacatgggtgggatataatcattgccaccccctttaactagaactaaacagaatgggtggcaaatgaacaatgagcacggcattgaacagataaacaaaatggtcaggattcactgaattattcatggatattttaatccagagatagaactgtgatttaatactaaaatgactgcaaattgttgttttccaaagttatattatcactttgacactctatgttagtctgcatcagatgttaataacaactatcatgccattagacgaagttgattccatctatatccagtaactagactaacctgttgagcatatgcattggccaagacacaaaagatgctaggtgaaagctgcagattctcagctttgagagcagctacacagtcatgggcatcacgaaaatggccgtattgtccataaatgtcaaccaaaactgcatacactgcaccactctccttgagccctcgattcctcatgccatgaaacagcttcttaatttcgtcccacttcccctgttcccccaacctgctgatgattgtaacaaagattttaggatccggatacattccttcctcctgcattgcagcgaagaatcgcagagcacgtttcgtattccccacacgacaatgccaccgaatcaaagaattccatgtagtaatatcaggcttgaccccttctgcgcacattttgtcgaacaccttgcgtgcatccgctaactgcccatacttgccgaatgtatcgatcaacccgttgtaaatcttgacatcgagctccaccccgagctcctgcatctccatgatgaggtcggtggccttcttccacatgccattgtccctgtacagccgcaccagcgtgctgtacccggcggtgtcaagccgaataccccggcgcttcatctcgccgagaacccaccacgagtcctcgaggcggccggcccgggcgtacgcgttcagcagcagcatgtacgtgcgccggttccgcgcgacgccgtcgtcggccatctggaggaggaggcggtcggcgaggcggaggtgcgccgtggagaggagcccctcgaggagggcgttgtagtgcgcggcgtccgggcggagcccgaggcggcgcatctcgaggaggagcgcctcggcctcgagcgtccggccggcgcgggcgagcgcccggatgaggcgcgcgtacgccgcgccgctggggcgcagcccggcggcctgcatgtcggcgagcaggcggagggaggaggcgaggtcggagcctgcgtggtgctgaatgccgcggtcgtaggactcccacggccgctcttggctgcccactgggccggcggtggcgcggcacgcgacggcgccaccgacgcggcggtcatggcggcctcgaggtagaggcagggtgggtggaagctggagtggtggagggagatggaggcggacgaggtagtatgcatccatggcggcgcgcgcggagacaggagcgagttggggaagaagagtggaaccgataactaactaagaaaatacgcgttccattaaagaatacgtatttcaggtaatccgctaactaatcgggttagcggtcccccgagaagtgctgaaggcggaaacccggagagatcctgacatcctgtctagagtctaagatccggagagaagctaagagccatgttcattctagtctagagtctagaccatgattttcatcaacattcgatagaaaaggaaacagaaaataaaattcgtctattatcatgtgcttgttagcttatactaaatcacagcctaaatttaaatttcaaaacttgaagttgatttttgtcttaggctattttctagcattatttttttatgtagctaataacacatatatttaaccgtaatatttttttatttcatttaggtttcaagttgtagctaaaatgatcaaagcatctcatatttttaacttaaaattactccacccgttctaaaatataatgtttttagattgtttagcaaatactagttaaaatattttttttaagttacttcagttattaatttttgaattttgatttttttagattccttttcaagcatgtgattagctttggaatcatttaaatcatgagaatcaatgcgtgaatattaaaattgtggcataaaatttaagagaaaatctactccccggtatcccgtggtgtcgagatagctcttcaaccttatccatccgacccgcatcctcatccacccgacgcaatccccatctcactctcgcctcactccactcctctctctctctctctctctgtgtgaagaaggccgagcggagacgaagccggccgggaggaaggggtcgtcgtcgtcgtcttcagcggcagaggaggacgacgacggcactgcgttggcgaggtcgaccaaccctcaacagggtcgccctcgagctcgcctccccttgctgcgccgctctagctcgccgccctcgtcagtcgggtgtgcgccagggagtcgtcgccccggggagggcagaagcgggagctccccttgtcctcgccctcggcctcggcgtcaccgtcgtccccgctgcagcctattgctttgcgcctccgggatggacgccggcagcctgtgtcgacttgcaacaggtatggccgtcaacctcctcttcggcttctcctcgagacttctcacgctctctggcttgggcctcgaccctcaactcgccgtgcgtcctcgacgccatcctccgccgttgcggccctccctcccccacgtctcctcctctttttgatggtaccctctgatgccccacaagtattaggctgataccgagataccacccggtaccttggcaccgggtattaggtatcagtcgatacctagtcggtaccaaaggtatcaggtaccaggtaaggtaccaggtatcaggcatcggtcgatacctagtcagtaccaaaggtaccaggtaccaggtaccaaccggtacctaaggtaccatgtatcaggtaccagggagcacgcgtggacataccaggtatcaggtaccagggagcacacgtggatagaggaaaggaaaagggagagtcacttaaaatatcccgttgtgtagctgccctcaaaatttaaatactataaaatacttttattttagtagaagtttaacacgggataatcaagaagacgaggtatagtaaccttgatctgtctgcacaaactcttcaacgtctgaaactctgaaccttgattagggaaccccatctcttttcagcaacttcactgaacacctttttggtgagatgaaaatatattacgtgcaagctttgagataacacggctgctaactgcaagacactgagttgcattgctcatcgcgtctgcgatgatgcgaggccgacgccatatcatagcaaccatataatatttaaaattcagatgacttcggtcaggttggacccaagggtcaaattgtcatcacatttctgccaaaccggccaatcaatcattccctggatttgttagttagacgatacaacttttttagctagatgataactacatgaaaacaacccatcggtaatcttttttttctagctcgatggattatgatgccgtgcacgcgtaataaatcggtcatcgcgatgggttgattatttaattgggctatgttgtactaataattcagatgctttgtatctctgaagctactatatatgcttacttgcgccacaaaaaaggagtaatttaaatgcaaaaaaattgactatctgtgttggtacggccccatgtgtctaaaatagccccacatcataggggttggtgcaccagcctagtccctaattgttcatacgtggattagctgaagaaatataatgtcagcacatctgtacatgcttggagagatgaaacataacgtcaaaggaactgtaggttattaatccatgaatcaacttaattatcagcatgagcttgcaagagggaatccattcatgaacaggtaaccaattaaaatattcatgaacaaatctggattcattgtttgctctgacagtgctgataagtgctaatcccactgatgacattatcctgtaaaaacaccattgacagactgataaaggtaagcatgagacatttggagtaatcttatcagttatcccatgcaggtgaaagtagtgatgacttgtagaatttctacgtgcgatttgattaggcacagcaccggctaataatgtatacttgccagctggtagaagtctccattcatttaggtcatatcaaagcaaccctactctgactgaattcctttgttcttcaggtcaaaaagattcagatttgcacgccactggtttctgaacctgatccaagaatccgtggccggtaaaaaatggccaccaaaccccactagaaaaggacacaatctttgctcgatcgactgtgtgtagtgggtacgcagtgacgcgaatttaattgttcttgagatctttcacaatgggaccaaaatgattaataagttcagtgtagatgaataaggtacgtgatgtgagaacagcctgaataataaaaaaaatgtgctacaatttatatatagcggcttgattactactgttttggtagtttaattagtttatacattgctctcttgactattgtccctgcaacttgattagtacacagtaaaaaaaggtgtggtgtcttttcttacgtacatgctgcctcgaggagcttgggaggtatcacacttggtggtagaataaatgctaaccgtttatatttttcag

SEQ ID NO: 26986 - DNA, 2953 bp, Oryza sativa
tacgggttagctttagttaaacaaaaaaaaaatggtccacacaagtgttgtcgttgcatttttcgcatctaacgtactactccgttaggtttggtctaaatcaaacatcattatattttgatcgagtctaaaagaatataataacatttatataaaaataaaatatataataaaaatatattcaatgatgaatttagtgacctaatttgatattgtagatgttaccgtgcttttttctataaatttgatcaaatcttagaaagtttgactcgagacaatcccaaaatatcttctaatgttatggaacagtcagcagagggagtatattggtagtatccgatacttcctactctctccgtttcatattataacccgttttatttttttttcatagttaaatatttttagttttgatcaagtttatagaaaaatcatttttaatataaaataaacatattattaaaatatatattcaaggctacatttaataaaactgactggtgttgtacatattgctatatttttagtcctgatcaaacataattttgattagaaaagattaaaataatctactatattattaaaggaatagaaaaagaagcctccatgtttgctctcatggtatagaaattctcacattaatcagaaaaaagaaaaaacagagtccatatagaaatacaattaggaaatagctgaaatttgaaattaaaaacaaggaatattagaagaggagactagagtccatatagaaatataattagaaaataactgaaattcgaaattaaaaacaaggaatattagaagaggagactagagcccatatagaaatataattagaaaataactgaaattcggaattaaaaacaaggaatattagaagaggagactagaatccatatagaaatacaattaggaaataactgaaattcggaatcaaaaacaaggaatattagaagaggagactagagtccatatagaaatacaattaagaaataactgaaattcggaattaaaaacaaggaatattagaagaggagtatagagtccatatagaaatacaattagaaaataactgaaattcggaatcaaaaacaaggaatattagaagaggagactagagtccatatagaaatacaattaggaaataactgaaattcagaattaaaaacaaggaatattagaagaggagtatagagtccatatagaaatacaattatggaataactgaaattcggaattaaaaataaggaatattagaagtagagtatagagtccatatagaaatacaattaagaaaaaaatataaattcggaattaaaaaataaggaatattagaagtagagtatagagtccatatagaaatacaattaagaaaaaaaaaagaaattcggaattagaaaataaggaatattagaagtagagtatagagtccatataagaatttaaaactaactaaaatttggaataaacataataaaattaaaagtagattttagagtccgtataaaaatataatttacaaataactaaaattcgaaattaagaaaaacatgggaagaagtgtttaaagatcaatataggaatacaatttagaactgaaattcgaaatttaaaattaaagaatattaaaagatgagtttagagtccacacagaaatacaattataaataataaaaattaagaaataaaaataaataatattggaagaagagcataaagtctatatagaaatacaatttacagaaaattcggaattaaaaaaataaatattaaaagacgagtctagagtccatataggaatatatataatttataatttactaaaatttgatattaaaaataattaataactaacacgtatataaaatataatatgaaaattcaaaaataaaaataaataatattggaaaaaaagcatagagtctatatataaaaatacaatttacggaaaattcggaattaaaaaaagaaatattaaaagacgagtctagagtacatataggaatatatataatttacaaataactaaaatttgatattaaaaataattaataaataacacgtatataaaatataatatgaatattacacattagtagctttgtaaagttattgtaaaatttaaaattacgttgtcattttaatatatttgaataatataattagaaaacatatatgttattatatgagagaaaatataatgattctagtcgcgcagattgcgcgggccattatgctagtttataatatgaaacggtgggagtaatatatatttgtacagagtgcgtgaaacttatttggtgtgtgtaaaaggaatgcgaacacgtgtgttcgtgtacgtggggtggatgggtgtacccgctagacttgggtgaccaccaatagcacccggccaccaacccccgtcttcgtttcccgcgctatataaacgcgccaaaacttcgcccactccacgaacacactactacgaccacctttcatcccaacgcacatacgcacctacgcatcactcaatcgatcaacaatggcgtcgtctccactgccggcgttcacggtgcggcgaggcgagccggtgctggtgacaccggcggcgccgacgccgcgggaggtgaaggcgctgtccgacatcgacgacggcgagggcatgcggttctacagctcgggcatccacctgtaccgcaacaacccggccaagaaggggcaggacccggccatggtgatccgggaggcgctggccagggcgctcgtcccgtactaccccctcgccggccgcctccgcgaggaggccggccggaagctcgtcgtcgagtgcgccggccagggcgtcatgttcgccgaggccgatgccgacctcaccgccgacgacttcggcgacgtgcagagcccgccgttcccttgcttcgagcggttcatcctcgagagcaccaccgtcgccggcgtcgagccggtggtc

SEQ ID NO: 26987 - DNA, 2550 bp, Oryza sativa
tcggcggtgacgtacgagtacctgcagtcggtggcggacctgatggtggtcgccgggcggccgctgttcgcgctgtcgcggacgtacatcgtctccgacgtgagccacgccgggttcaagagcgtcgacttcgggtggggggaggccgtctacggcggtccggcgaagggcggcgaagggccgctcctcggcgtcaccaactacttctcgaggtccaagaatggcaagggcgagcagagcgtcgtcgtgcccatctgcttgcccaaggacgccatggacaagttccagctcgaggtccaagctctcaccgccgagctcagctagaccattgaaacgcagcatgtgtgttctactgttacttttttttttttttgcccaagtgtgttctactgctcttgttttttcttggttcagaatgtacttatacctgtcggtgtctgataaaaattgcactgactatgtactactaatgacgatgtcctatcgtgttcaaaaaatatactctgtctgtcccaaaatataaatatttttagtataatgataaattaaatatttttaactttaactattaatataaaaaattaattatataaaattgatgttactaaatttatcattaaataaactattataatatataactctttttatttaaaatatttttcttttatagatattgttggttaaaataatatctcggagattgtgttagagtcaaaatgtttatatttttagaacggatcgtatctctctacatttctccagtccggtcatcgtacagcggagagttcctgtggaacgtgatccgagtctgctacagtaactaagcacaatttatggctacagcctacagtatcagtgtgatctggatcgttagactgtgatcgtgtggtttggtatcattgttcatccactgcgttagtacctctaatgcagaggatctaagttgatattttttttcagttctgtgaaagtgtgtggtactaaattatctgaatcagaactggtgatctctcgattgaatgcattagtctagttgtctctcattgctttgcttattggcttatcaacaataatcagcatttataaattttgaaaattttaattttagaagagacttacctttgtggtttgtttcgttctagtctatttctagcttggctgcaccgtagataatacggatataaaaagttgacctataaattatttttattcgttttttttccgtggcttatccgcacgactgctcctctttttaagcagaggcgaacatcaactttgttacaatcctaagataatttatattttttaatagaacttcaaacagatttttacttgctcttaggacccttttaaatagtaggaattaaaaaaaatagagaaaatagagaagtgtaaaagacaacaaaacatagaaatgaccgtttgtttagaccgtaaaacaaaataatacaagaatcggataagagagatagactccggattgtctattcctattccgcatgaatttcaaaggatagaatataatagaatcatttgtttctaatatgatagaatatatttttttctacaattcaagagggccttcgcagttagcaatcataaaaatagaattgaacaacaaatgtgacaaagcaacagttgggtcctttgaatcgtagaaatgaaaaaacagatgaatagagaaaacacaggattctgacaggaatacaattgtaaaacagaggaatgtaaaatacaggaaaaacacaggaatggccatttgattagaccacaggaaaaacgcagaaatcagatgagagagatagattcagaggaaatgttccaagaggttagacctcttgctaactttcctccaaaatgtgtataggattacccattccatataaattttaaaggattggataggatccaatcctttatttcaaaaacctttataggattttttttccataggattgaaatcctctaaaattcctacatttttcctacacatcaatggagccctaaaattaattcaaaaaaattaaaaaaattgtaatcacctccaaattaccactactactataatataaaccgtgtcaagcaggcaagatcctcgttccgtgtaccgaggatgcaagtgcaacaagatggatttaaagtacagatcccgtggaactttccgaggtgctctctggtgaatctatatcttctcatttctccttcatggtttcccgtttagttgcccaaattttttttcccaaaaacatcatatcgaatctttagatacatacatgaagtattaaatatagataaataaaaaaaactaattgcacagttagagaggaaattgcgagacgaatcttttgagttttttgagtttaattagtccatgattaaccataagtgctacagtaacccatatatgctaatgacgggttaattaggctcaaaagattcgtctcgcggtttccagacaagttctgaacttagtttttttattcgtgtccgaaaaatccttccgatattcgatcaaacattcgatgtaacacacagggctgcaggaat

SEQ ID NO: 26988 - DNA, 4671 bp, Oryza sativa
ttttttaaaagctcctcgtttaagcatttgcatgaatctgcacaacagcacaaccatgagaagttactgaagaaataatacaaggagtactctacttcacaatactctgacaacaaccttcttgattgctttctttagagatagtttagaacacttatataaaagttctttttcatcgtagtttatttttcagcctttgcttttagatactacctccgtcccaaaataagtgcagccataaatatccgtgtttagcgtttcgactatccgtcttatttgaaaaatttatggaaaatatttaaaaaaatagtcacacgtaaagtactattcatattttatcatccagtaataataaaaatactaatcataatcttttttcaaataagacgaacagtcaaacgttggacatgaacagtgctaaaactacacttattttagaacggagggagtagtttagaacacgcaaataaaaattttacttacaaattattttttatacacaaatataccgtttggattatttcaccaaacatccaaacgatggggctgaatgaccgtaatgatctttggtctaaaatttatatcacaattggccgtttagagaagagaaaatgacctcaatgatctttggtttaaaaattatattgtgtcactggttccttctagcctcgtcaccttcccacacctaacactatcaatgtgttactcctaacactaggaatgaaatattaccgtattaaatattcaaaagcatgtattttatgagatggggttttgtgattcttcatatggaatcccatattcttgatgtcctcgtgtttgaatcgcttccttgaagtttctattctatcctagaacaatggaaagcagcaggaatatagacaaagcacgcaattctgactgaacaccacaatattagtagtagaggaaactgttccaaattctcgagagaggatattctctcgttgtttgcatgttatctaaataattatatattttttttaaaaaaaatcaacaagatagattaatatgtgatgaattactttacaaacaatgtatactcaaaattaacaactgcaaaagttacaacaaaaaataaatttgattgcgaatatatattaactagatatattttaatttgtttttaacttgcgtgattgtgaactgatctatcacatattaattaatctagttgattgtttataactatttggatgatatgtaatccataaggggatgtctcattcagagtttagaatcaactcccataatagtagtgaaaaccgagagattgtttgttcgcgctgccctaatggtggtcgtcgggcggtcgctgtccacgctgtcgtggatgtacatcgtctccgacatgagccacgccgggtttaagagcatcaacttcgggtggggggaggccatctatggcggtctggcgaagggccgctccttggcgtgacaaactacttctccaggtccaagaatggcaagggcgagcagagcatcgtcgtgcccaaacttctataccttcgtgcgaaacataccatttaacaatttaaaaaacgagctaacgaaaactgagatagaatcatatattacacacctggtgcacatacaccggtacattgcactagaatttttattattttttagactttttaattttaaaatagattgtccccaaaacttattttcaaatacgaaccttttaattacacttgcgtggtgaacactgccacatcacccaaaaacttataatgagagtgttagtattattttgccacaccaatctaattgacgtgttgaaagtcgaaaccaaagtggccacgctaaaaaaattcagattgtaaattagttttgcgagcccttatttttaaaatttttaattttaaataagttcagaaaacagaaaaaaaagggtacactggacatatttgaacgaggactggttgtagacccccgtttttataacaggaatcattcgtgtaaacagtaccattttcctggatcaaatagtctggtacatacgagttcatagctgaaataccaaatgcttatacacgagagtctagtgctaattattacatcataagcccgcaggtattgtcttaaatcatcggaccaagcggtccggaatacattccaaaagcagagttaggtaaggcagcggaattaaggcagcggcacgccattgccacaggcaacgaccgtaactaagacctactgggcgccatcgtcttcgtcatcctcctggtagtaagcgtaaggatcctccgaagcttcatctccgacctctgattaagtttgtatattgcaagggtgagtaccaaccgtactcagcaagccaccacagcaataatgcacatgacaggggaatccaaaggatggctatggttcttttgcgcaaagcaagttttataattcttttcacaagcctaagacctagcgtagactgatcaagttttaataccagtgttcacattaaacaacgatggttctgtccaccatccattgtaatcccaaggatagcttcccgccattgagtcgtcatgattttctgaggacgtccatattcccgcctctcaggaagtggctccatcagcataaaaatcatcatgcaatatcccatcccacacaagttaagaatttaaagtctagccaagtgtaatacatgttccggtactcattaaccgcgagcacggctattcgaatagatttggtttactcacactgcagtggatgtacactttacccgcactccgcgactgtccaacacgcctcgtcccaacacatgagacgcgtcacggcaaagcttttcgataacctcgcattggcagtacccgctccatgaacttaaatccttatgcactctaggcgtccatgtttctagcagtgagaggagttctgacgctcccgggaaagagaagtctcacacatattaaattatggttcaagttaagttctctctcacacactcatggcagtcctaccaatggcgacaccgatatagggcacgcctctcggccctacctcaacggttgtcccatcgtagcgcacctgcctcactcaggggtgaaccatctatgcagggatactgcctccgctcggctatctaatccgctaggtctatacccattcgagaagtacggttgtacgggggtcgtttcatgcttaacttcatggctcggtccttaattgaccggggacggtactagcctttcccagataccacccaaatcctccgtccgccccagtcgaaaacaattgtttaattttatttctcctctcacaaatcatatcatcaacgtcatggcaatgtggcactcatgtctccacatgccgcatctcaattaccttcccaaaggtaattgcccaagcatatagcatttgataaatatgagtatgcatgattctagaatggcatttctaagcaattgtcataattgactagggactcatacgtaatcatggttacaaggattttaagggtaaacaataatcaaggcatggcataatcacaagtaagatgttcatcattgcatgcaattttatttataaacaaaataatttcgcaattgggatcaatatattcaaagaatagtgatgacttgccttgctcaaagtcttgcggttcttggtcctcgcttggatccgcaactccctcggactctaaaattacgtgcgaagaaacgatttgaattcggttaaaattcaaataaagatccaaataaatccaaatggaagtcgaatgcgaaagttgattcttttatattaactttactattcgcgaactagggcaaatctaatttcgatttatacatcctaaactatttttcgggtataaatattttgttatcataagtttttaatttaatctacccgagcattatatccatataataggttagaaattttctatcgcgagctaaatatcggacggaatcaaaaaattatcttataatattatacgatttaatttaccctatgactaaccgattaaatataatatacgtctaaaattcctagtgattaaatccgaacttctaccgtgaatcgattacttatagagattatccaaaactaatctataatagtctataacaattcatctaattgtttagtcgttaattacatctaaactactaccacgaattgattttttttagaaattaccaagaataatctataatttatattaaattttgcaattctatgaccataattaatctataattaaattctaattattttagattttcttaaactattaacctccttaatttcttcctaattttctatttatttttccttttctttttctccattctctcttctctttttctttctttttctttcttttcgctctttctctttttctttcttttctctctttctctctttttctctctgccggcctctcttttcctctctctctctctcggctctctcccacccaagcagcggcggcggtggacgcgagggggaaggagggcggctcaccggcggcggcagcggcgacgacggcggcggcgatggtggtgcacggcggcgcgggagtggcagcacggcggcacgggaacggcggcgcggcggcacgggagcggcggcgcagtggagagggaagaggggaggaagggtgagatggggtgggggaaaatggagagaggggggggg

SEQ ID NO: 26989 - DNA, 20815 bp, Oryza sativa
cggcggctcgaggcgcgaggccgacggcgacgcgacggtgacggcgcggcaacggcaacggcgcgcgcgacgggcgggcgacgcggcgcacgcggcaggggagggggcggggctagggggaccacgatcgaacacctatgccgcaatgaacagtaacttttcctatttatcccgatttttgcccattttctatttaaatatagccctataaattctaatttttgcataaatgaagtttgctccatatttgtgttatcctaattaaaaattcaccctactttaatatcactcatattttgtttatataatttatttgaatttttaattagggttaattctcattccatcgtactaaaatttaattattgctaatatggtcgcgataaaattttatttatttccaatcccacctaatctttattttaatttatattttaattatttatttagccaacttgatttttagggtttattcctagttagttattcattattcgcgattaataaattccgagattaaaatctaatgaaataggcgaataaaatcggcatgatgcaatatttttggtgttttgatttcgttggtcgaattttcagggtgttacactggtgattcattgaatgcatcaacatatcaattgatcctacggtctattttggaagaatcattcaggtgagcatcaactaatctttggtaagctaattaatttcgaattttgttttctaagactaagtttagatacatctacatgttttataaaagtaattgtgaaaagagaattgggcaacgaaatgacgaagacgcgattaaaattaattctaaaagttaaggacagttaaggacgcgattaaaataaagccgtgcctagcaggcaagaatcctcgtgcagtgtaccgagataaatcattatcgaataaaagagtactaaatctcaaaaaaagaataaaagagtactccatttgagaatttatatcttgtcatttctaccatgaatagagaacaatgcatcaatttgctccaatggaatatatattctgaagaacagaatcttgttacttacattatttgactttatgtcactgacatatagatacatactgagatgcagtcacatgacttaacaccagagaatccgcatccatatttcgatgggtactctctacaactccccggtactataaaagaaagaatctctgtttttttatcgcaaaacattaaaaaaaaaggaaccgttgaaacgtgatcttgagtgatctattttcaattgcaccaacgaattaaactgaataaattgaccaagggttagtgaacatctccagtcattttttaagagctcactgtcgaagcacttgcatcaatcttcacaaccaaaaatagctactagcaccaaagaaataagataggtagaatctgataaaacctgctcccgaataaacatttttttcattaacctacgaattaaactcactaaaattgacgaaattaagcaagccaataggtcctcgacttttaaagctcattgttgaaggcagaagcacttgcataaatctgcacaactaaaagtatgttcaaatcccagacttttatgtgtgcttgtatttacggacgattattttttctgacagacgatgtacccgttgataccggggtgtttgtggattgtgataattttatcaatttcaatatattggcctggactttggagatgcttataagtgtacaatatgcatatgtgtacttatgatgagagtgcttgcgtatatatgagagcctatgtttgcagtgtttctataaaaaaaagggttacagagagaactggtactgcatttagcacctactctgtatcaactgctatcttgattataaaagcatggccataatgatccatgctcttaaagttatatcaactggctggcaacttagtactactaattttcagtaaagtgttgttcctttcaagaacggcaagggcgatcagagcgtcgtcttgccgatctgcttgccctcatgggcaggttccagctcgatgtccaaaccctcatcgcagagctcatcttctgtctaaatgcaattgcaacgcatgtgttctactgttcttgtttcttcttggttcagattgtacttaaatttgttggtgtcagataacatgctggccctctagttcatcccacgacgcagagtagggactattcctattgtgttccaaaaaaaaaaaaattacatacgtgctattcgttctctacattttttcagttctgtgacagagtgaaacttcctgtgagcgagtaaagcttattgtacaatggtagagtactaaattacttctctttctacctagagacaaacatcaactttctttttataaacacattagaaatggagacgctcacacacacacacacgtgcacagtcatctctacgaacagaccttatccctatgagcacatcagaaagattaaaccaacatatctttatattaataaagttattacaaacgcataattgttgataggtacgtcgactaccactgagacattaactgatcttggtaagaccttgttatggtccaaatagtataattttgatttttaagaataactttaaatttttacttactgtcttagcaatcataaaaaagaactgaacaacaaatatgacaaaatgagacctttaaaattaattccaaataaaagttaaagttcaaaaccacctctgaagtatataatataaagccgcatgctaagccggccgatcctcgttctgtgtaccgaggatgcaacaagatggatttaaaggacaggccccatggaactttccgatatgttctcttgtgaatctatcttctcatttctccttcatgtaacatgaacgtggaacaggtgcgtcaaccagccagcttttgaatgtaacatattcagacatgaacattaaaacagagaagaatctgcgaaaaattcatccaattcatccatgaaaattaaaacagagaagaatctgcgaaaaatatggtattggtcctattggataagctgtttgtatttgaaaccatgaaccatactgaataaaactgatcagaacaggtcaacagatcctatacttttttaaaagctccttgttgaagcattttgcataaatatgcacaaccatgagatgttactgaagaaataagacaagtagtactgttcttcacaatactctgaaaacaaccttcttggttactttttttagacaatgaccgtaatgatctttggtctaatatttatatcacaattggccagcaactgttagagaaaatgacctcaatgatctttggtctaaaaattatattgtgtcactggtgtcttgtagcctcatcaccttcccatacctaacactatcccttttaaaatggtctcaactcttctaaaactagcaatgtggtactcctaacactaggcatggagtattaccgaattaatattcacaagcatgtcttttatgagatggggctttgtgattctccatatgggctcccatatataattccaacatcctctccattccttgacttcgtcatgtttgaatctcctccttgaagtttctatttcaggcccaaacaatggaaaagcaacaggaatgcagaccaagcacgcgattctgaacaccacagcagtagtagtgaaaccgagagatccctgtcgctggtatagtttgctgtgctgccttcaactaagcaaggccacagaggcctagtttacttccaaacttttttttcaaaaaacttttctatcacatcaacactttcctatacacataaatttctaactttttcgtcacattattttaatttcaacaaaattttcaattttgacgtgaactaaacatacccagagtgatcagctgctgggcaaaaccgtaaatcgaaacgattctgaatttctggttcacgggtcggctggaatcatcgtggtgtcgtattaatatagtagtatttaactgcactgcactgtatcagtttagtgtgaactttacagagagctatactagactacgatacagagagaatgacagattggcccgatcgatttgttctccggcatgggcgaccctacacaaaatgcttcgttacagatagccaggtcgatgtgccgtctcctttgttgcttttcaccttttctttttactcaggctcacccagacacagacagtctcacatcacaagtcagtatgcatatgcctccaatctctgcagttcccagttggataggaggattcctagataatctcgcagagttcagtcgcacggctacagaatcggacattcagatcacagttgcaagcaacagatcacatgaacaagctccaactaatacagtttcagttcaaccagtccaatgcatacaggaacaaatcaagaaagttccagctcaccagccagtctttagtgtcttgctaccttcttcaagttccaacacgtacaaacagaaagggcaatccagatctccctgaagatgtgtgctttgtgatgaattttttataatcttttttgaagaataagctttgtgatgatttattaatacctgaaactcaattaggttctaaagcaagcattgcaagtagaggctctagagtagcatgacatgaagaggtagttacaccgtgtttagttccaaactttttttttcaaactttcaacttttctatcacttcaaaattttcctacacacataaactttcaacttttctgtcacatcgttctaatttcaatcaaactttcaattttgacgtgaactaaacacaaccttagtaccttgagcattcaaactccaaaaaggaagctgcttgagagagcaaagaagataccaaaccctcttctttccctatccccttccctcctatgatcctatcctatcctagcttccattccccctcaaccttgcacatcaccatcctccccttaatgccactcctcgcctcgctgctgccgccgcctcatcgcattctagagcattgctcatggcggaccaccaccaccagccgccgaccccaccacggcgccatcggcgtccccatgagctgtccatggcggcggaggaacgacaccatgggacgcagacggcgatggcgtcggatgacgatcgccaccatgatcgtggcggctggatcaggccggaggagaagcaccggagctccggcgtggcgtgggcgctggtgatcctgtgcacgctgctggcggtcggcgtgatcgtcgccggcgcgacggtgttcgccgtgtacctcatctacaagccccggatgccgtacctggtggtgtccgacgcgcagctggtgcggctggactacgaccagggcggcaccatcgactacctggaggcgctcgtcaccgtcatggcgaggaacaccaactccagggcggacgcctccttcgcccgcgtcgacctcgcgctccgcttccacggcgccgacgtcgcgcgcctccgcgccgcgccgttcgtggtggcgagcgcctccgcggcgccgctccggtacgacgtcgtgtcgaaggggcgcgcgctggacgccggcgggatgcgcgccatggacgcgtcgctcaagtccggcgtcgtgccgctcgacctcctcggccgcgcgcgcacgcggtggaaggtcgggatcttcgcgtcgctcaagttctggacgcgcatctcctgccgcctccacttcttctaccccggcaatggcaccgtcatggcctccgatcgcaacacctgcacctccaggtcgccatagccgatcgccattgattccaattcctccatttgattcgttcgttgcatctcgacgccatccgagacacgtacattactattacatcgcaccattacagatcatgtttcacttgtcatacttgtacagccaaataatgctggtacagtagaatctctgaatctacaagaagagtttattcaaatttagcgcgaaaacaaacacatttatatttgtaattctttattttttctcgatcagtcccctgtttgtactctgtaccaccaaattacgaagtcgatcctaattcctaaacagtgtgtatgaactacttcaagtgtcttttcgcttcgtgtcattgtcaggaatcagaatcgataacatcatcaactaatctcttcagtgttactactgcaaatccgatgaacattctctgacaaaatcagacgctgtctgtctactgaaaactgataatacttcaccattgggctgggcctgaattaccagattggactttctggcccaatatgtaaatccgatgaacattctctgacaaaaggaaaaagtacatcgaaggtccctccctgccgccgcgccaccgtgcggcccacgatgggccggcccgcacaaggagaaaagtgagaaagagagaggaagaagggacagaagaggggagagagatggtgatggcgtagtcaccctgccgtatgggttccacgctaactcagctaccacgtcggataaaatcagggtcaaaatcgtccaagtatccaaagtgacctggttttgtaagttgagggatggtatacaattttataatccgatgacaagatgagattggaccttatggcccaatatagaaggcccacctattcttgggccgaagtctaagcccaacaaccggtcagcgagtcgcgacggggagggagtggctgggaatcgccggagaagaggaggatgacgccgtgacacgggagcacagcaaggtcatcgtcgtcggcttccgtacgagactaggaggagaagtggggattggattgccgcggaattatctccgtcgctgtcgccaccggccgtggggaagcagcgcgcggcgcggcgcgggggggagagtctcctccgccaccgccagcgtgggcagtgggactacctccttgccccgctacgcgacgcggcgacgtcgccgtcggcgtcgtcacccctccgcacggtgcactgaacgtggcgcctccacttggcgcgcgacgcgacgcgacgcggcccgccttcttcttctctactgctacttaaccaccagccgcgcgcgaagtgcggcgagcgcgcaatcgaggtcgaacacttggccggcatgaagcccaggcctaccggattcggggccgcggcggcggcggcggcggaagttttggtggggggcggatgcggtggatgggcgtggaggccgaggccgaggccggcgacggtggcctccaccgcggcgatgtcggtgagggggcctggtactacccaggcggccgcggcggcaagcgccgtgcactcggagcgccaccgcggcggggtgcacgggctgcagctccctccgctgcggctgcagttcaccgccgacctggaggcgcggatcgagaaggtgatctacgcctgccgcttcatgaccttcctcgccatcgccggctcgctcatcggctccgtcccctgcttcctcaaggtcgatttttatctcctctcttcaggttcgatctactcctagcaatttgttgactgtccaactctgcagggctgcgtctatgtgatggatgccttcatcgagtactacctgcacggtggcggcaaggtcaccctgatgctagttgaagccattggtaactaactaactaatctccctaaacttgatgctgttctacacacttcagccatgagcaattaaccactttgtatcttcagcaacacagattagcagttgataacacgggagcacaagcaccaaaccacaaattgcatcgttgctacatgcatcctagtggagttatatgtagtaatttctgataactgaccagtgtgcatttcttgatttacctcagatatgtttctggttggaacggtcatgtttgtcttcgggacagggctatacgagctgttcatcagtaacatggacattgcaaagtcatcatcctatggctctaacctctttggcttgttcaggctcccggttggttcacgcacttagcatccctctaaatggtgcggtaactggggaatttccagtatcctgatacctctgtttctatctgcaggaacggcctgagtggctcgaaatccagtcagtgaatgatctcaagactaagctggggcatgtcatcgtcatggttctactggttggcatctttgagaagagcaagagggtgaccatcacatcatgtactgacctcttctgctttgcagcatcgattttcctctcttcagcttgcctctacctgctctccaggctcagtagcaagtagaaaaataggaggtagcgacacctgaatggctggagcacaaacaggtcttgtacatatgacataggcctgttgtgtttcctatgccgtgcaacacctcatgttatgtttacataatgtaaaattagaggggagtttgcacatctcacgtactctttgtatggaatggaaactactttgtatagtggagccataagacattattgtcaccatcactgtgtaccacctggtactgcaactcactgcttcgatgataaatataaatagttactgctatggcatgttatgaattgattagcaatgctgccttttctgtctgtgattcttttgaagtttttagagcaggattactttgttgatttcttttatacccccaaaagtataaccaagtgctagttaattagtttagaccaggaggagttgcacctatttcttattcttatgatgtcttttatgaacacttctgaatgatatgtatgttatgctattatatgccaaacatactacttgccttcaaaatcattggtgtgatacaggaatgctctgacctccctctttgatattagtagttcctatttgatcacaaggccctggtgaagcttgccaacatagtgtttccatattatcgcttattttcttacacacagagtatatttgatgaatggagtgttgtttggtgtgactactggcttgtgaatgaattgaaacctgcagaatctaattacgtgttatgtatccatgtccttctttctaaaaaaaaatataagtgaagctcatgatgtactctttgccgtatgttgaagcttatctgcgtagctatcgcccttatgagtaagaatactgaacacgatcattaatttgtgaggttataattctgagcaaaaacttgcttgatgttgcagttttatgtataactactaaagctgatgtttcagttctgtgacctacgtccggccaactgtccttcccacacataagatttggatgccagattatctttgaggtatgtttctgaccttcagtatttgcaactgttagcatcatgccatgatctgttgatttctgaattggatgcgccaatgtatggttgttgccttgagatttgtttctgagttctcacctagtatttgtaattcttaagaccattcaatgatttccgagttgaatgcatgggtgctttcctttgaggtatgtttctgctatcaagtattttttaaactgttgcaacattcagtgattcccaattgggtgcaccaatgcatgtttgatgcctatactaacagcaattgacctattcctaaaagtatttcgtagagaggcaaaactgctctggcaagaacgatgaaaattcctatgctttatgaactttggttaagtatgacaccttttctcttaggtgatcaaattaaaggagaggaataataagaagagcagcttgtattgtgccacaaacgatgacagaacctgaaataaattattcaggagttccaagccaaccaacgggaagcaaaggttcccaatcgaaaaaagacttcaaagtggcctttccaaacataaataaaagttccaggaatttgagaaaataaggatcccacaggggaggaataatttttggtggcgcagcaccttgaacgtatatacaatataattactttgaacatttgctgccgtatgatctcttttctatatgcagccgtgagcaacaaaattagaagctccaacttgctgttgtttcatatacataatagattggcagtctctgataggtcagtcatggttgcttgaacttgatgggaacacacaaagtgttgcacttgatgttttaagtatgcaacttgcatgcttaattaagacttgaaagatatatttagcccattataactttgttgctgccaaagtgtgggttgtcgagtattatctgttagatttattacaagtggatcaacttgtctattaaacttacattatttagcacacattttgctgggataactgatcatggtaatgagcagatgttttcatgactggatcctcagtccttggtaacatttggtaaaaaaagaaatgatagttcgctttcctggcaaaataagttgaggatgatcatggtggtaagaaggatgattttacataaaagcattatcctgatacatgtcaggttggcacagatttctcttagacctacatattcccatggtatcaattttttattactaatctcactctatacagtgtctattaggcagaagaagcttagatgtttctaagaatcaaactgaactgggaaaaggtgttccctttggctaggattaataaagtactaagattttgagacatccaaatcctaaacaattggctggggattgctgttatcaccacccgggtcctcccatcacttaactcctccaaaagtacctttcttgaactaaattaatgaaacaatctgcatatataaagaagggagctgctcaggtggtgaaccatcttacctgtgacttagtgagtaacctctgagttcttctcttccaatctccagctctattttgcttgttagcttcatggccatttcgtcgaaaaatgttgctgtgttcaagttgcttctgagtgtcatctttttcatgcagcactctgtgccagttcatgcaaggaagctggtagtgagggcacctatgatctgcatgcatcctccatgcacacggaggaatgccctggaggtgccagctgaacaagttgattcaaccactccaggccatagccctagcattggccataacactcctcccaactgagatgatctgatgctgctactgtgtcccagcctgaaatttgtaactcgggtctgtgaaaactcgggtctatgaaactcatatggtgtttcctggagcttctatgcatttgttcagaaaaggcgtaaagcatgcgactgaagaagctcgcgaagattttgttttccttttttcttttgttccccaagacttgtgcatgcctgcctgcatgctttcttttgttacctgtgtgaaaaacttttcctcaccttgtcttagaggagatctacagatctgtagcctgtaacagtgtgtctgttgaaaattttaactctccatatgttatgaacttgagaatggatgttgtaaggcgaggttaatcggctattttcttcaaaattttactagtacaatattgtaaactttaaagaggtacaccatgagtggtcctttggttttctacatatcctttgttgagcatgtaatttcgtccatatatacatcaagtttgtgtaaattgatcaggatttttaaagtcaaaattaatttaattaccttcaaatgagactgaacaggaccatgtttttcttcagaatggtgtaggacagcggtaacattttttcttaccctttgttgaaagataaattaacgcttggggtgtacaattgtataatgctgatactattacttgacaagtttatggcacccctggagctctaatctaacatgtcatctcattgttgtgtctgttttcttctggcaaagtgtggtatttttcttacaaagtttgatatgtgtagaacagttttgttatactgggtactaaaaagaaaataattttcctttgttcttcacttgtttgctacataatactactaagcaacactggccccttaatttttttgatcatttagtatgaggcaaaagaatgcagtggcagtagaactagcactgtgatgttagtaaaatattaagccaacaaatggtgcacaaatcactttctggtccagttcataaacaaatcacagtgtcctaggtagtactccatgctaatgcatctccttttgaaaaaaaaaagaagcatcattgttgcaaagaatgaccaacaacaggtagtgactgagaaagatatttccgaattaaggcatgtgtgggaactgagaactgataggttatttttaacacatcttctttattttattttttttttttcttgattgatagagaatctgcatcagccatcttcagcaaacataatgcagtttgttggtatggaaatagtgtgagatatcctatgcaagttataaaccagtttctttctcttgccattggagagaaatttcatcttgagctgtcacttcaatttatggctcccctcagacactgattctcaatctattacattatcaaaacagagggaaaacaagcgtttaccttttgctttcatgccctataaatttccatgtgaataaaagaaaagaaataattccgaattattgattgtagtgcgggtccatattataactgtctagattagaaaaagaatccacatcaaatacagttcaaatgataattgaaatttggaatagaatgaaggaacttcagaatataaaatgaaataaaaaacaaccgatataaaagaaacttcacaataaatactaaatagtacttcttccatttttaaatatataacgttgttgaaatctggacatttgatcattagtctcaaaaaaataagtatatttattttattttactatgacctttatcatttaatgcactttaagcatgtcctatattttttatatttgcatatatttttttaaatagtacgaacaatcaaacgtatgtccaaaactcaacagcgtcacgtattaaaaacggagctagtaataaaataatctatctactttagaaattcccaaaaactgatggttcgtgcaattgccaagtgtcagactccagtgacgccgttcagaagaacaaagagtaatctttcagtaacccatagttaattgaaacactttatccggccgaggtatgagcattttcacagcgttgtcgatgtctctctggctgctggtgaatcaatgatgaatcatggtcaaaccgacgacaatacaagagctgggcatctgcaggtacagattagtgcatctcctttacaacaaagaaaacctcagtgtttttccttaacttgaccagcagcagctagtgcctgacaaagctgtttcctaacttgggtatgtgactaagcagtgataagatatctgaaaaaaataataagtagggtgattatattaattattcttaacaccttcactactaaccttttgttttttggtggtgatcaggtcactgcaattaagcaagtgatcaattgatcaaatcatcactagctaccctgcattctccaagataatcaatacagcttcagtgtggcaacaaattaaagctgctttgttctcttttgcagatcaatatctgtgcgcatgcttagttcatcacgaataaatataaaaaccatcacgcataaatataaaatcattcatctgttggtattgggctacgtggttgaatcgagtgcttattattttctgctaagttgtatttctgtgattgtggatacttagtgcaattgtgcagctatctgatcaaacttttctctctttttttaaacttggagtctttgagaattcagatatttgcctcccatctcaattgataagtacgaggtgtatacagcttgattgcctcaccggctgtcaggtggtttaattatctgtgggctttccactttgtgttggaaaagtcgtgatatattatccatcatttgtatatatagatggatgaatacttgcaggttagcatgactagtttaatgacaccatcagtgttggacagtggatctcatgttcttgctatcctctatgtgcatcatgccatcatgcttcagaattttatctcatttgttgtgagaaaagataattaagtttcaggtcaggcatctcgctcaacgaaatttaatgcaaattcagatggaactgtcttaaatcttaactaatgtatcccaaaaccatttatgaaaatgaaataaacctcctatttggctgagccgctaatcagtttggaatttcagaatgcttactaagtagctcatcagttccatgcctgttttgccttctcttcaacgaattgcagagccgggacagtaaatagcttgcaaattgcaccaaacatgcaaattttgaagcatattaaacatattaatttacataaattgtacccttcttcatgaaatacagcgatgattccttgttgattgagctctgaatgatagataattcactcaattccctcatggctacgcaacagaaggcatcaaaagtaacgctgattgcatcatctatcaccaagtagcagtagtactctgctttgctgacaccatgtacagatgtactcgctccctcacctacatcatcttcagagtttaatgtagttgacagaaaaaaaaaggcttaagtcatccaggcatcacagaaacgccattcacattttttttttgaaaggaaattaagcaccagggtgataaatttccaacctgaacgtcattttttgttgttctttcagatatttcaaccgtttacatatcatcttagttatttgctgtatctgttctgtcaaacttatctctagtttggaattcaggatgctaattatcccagttcatgatttcaagtagatggtgataccatgggtgttctaagaaaaaatgagtttgttctgggacatttgacgtttgaaagttgcagtggttactgccaaaatgagttacttccaatcttgaatgctgacgctactccctccagccaaaacagaagtgccgtcatatagcttgaatatatcaacagtatcatatgaataatcatattagccatagaaaaccatacaaatatgattaatttacagttcgagattgtgtcttgaagaccatatgtagatgtgaagaacagcactcccattatctaaaaaaaaaatgtgaagaacagcactcgttttgctagtatttgcaatttcagggttcaacaagtaagcaatatataccaacattttacagagaactttctacctcttcttggatgaaaaacgcaaaatatcaaatgatcattgaagaaaaactagtaacgtggagcatttggtcaagtagcaagatgatcattgacaaatctctgttccgaaacactagcctccgatcaagaacacatgacgagtgtgcatatatctatcttaatttctcaacccgtggctgctacctactccattgatacatttgatcactcgcataagatgaattgaattctttgcatgacatcaaatcatcaattcgatggctccagtgggcagatcagctttttgagctttgaccatggtgctcattgccggcgaggtcgtaagcctccttcgccgagcgaatgcaagaatccaagaacgaatttattgcagctagaggctcgcggcaatctccctttttaaggggctcatcagctgcggattcttgcacaacacatcgaatttgcattcgcattagcattcgcatcatcgcttgttgcctcagagagaagagagaaagaaagctcgagctctcggctcccatggcggcggcggcgtcatacgcgcacctcgtcctcgctgccaccctcgcgttcctggtgctgagctcgccgccgcagtcagcggcgagccgcgtcgacgtcttgaaggaagtagtagcaggcgagccaccagctgcggccatcgaaccagttgtcaacgatccgtcgtcgtcgccgccgccggcggtggcggcggtggtccacacgtcggagccatggccgccggtgcctccgtcggccccgtcaaacaagttcaactagctcaccagccgctaccaccaggatgtccggtcgctgtgattcggcggacgtcgccggagacgatggccggacagtcaccgtcatttcttgattcagataaaatcataaaaagcttgcatttgagcaagccgtataggtgtttgtgcgaggagtgcttctatgctctactggagagaaaaatcttcagattttagggggcgtctaggcttctagctggttgtgattaaactctgagttcgtcgagaaatctgtaaatcagtttcattttcagttgataatggaagcattttcttgctctctgattctgccttttcttcagttcttaccaaaatttgatactttgattcatctctgtgaagtacttgcattgttgataattgatgtggaagatttttgaaacctcatgtgctcttggagaggagatgaacaagtacatccataattttcagatacagccatctagtttaggtgcaaacattaattacagatacattcatggcgcacgtcaaacgtagcaaaggaaataagaacaaaaaaaataaaaatacagatcttgataaaattaaccggacagattgatggacaacggcatggtataattgggtatcaagagaaaatatcacggttgatgaagtatatatggctatggcgtgcaagtggaggaaggggcatccaatcctgcttccagacacccataaaaatacaatcaacaatatgtagggtgccatcctttggcatattggtgaaataagccaaacggcatatttgcaaacgaaaaataattcgtgaataaaacttttatatgtgtgttcttagcaatctaaaagcaaatgctggaaaataaacttcgatgaaaaaaccccaaaattagctttaaatttaacgttgaaaattcaaattttggctgataagcatatgaataatcgtgacatgtacccacaacccctttgtcccctagcagtccacccctcctccctctcgtttttctttttattttcttttgtaatctcctagccttgggttattgtacagttttttcccctactttaatacaaatacatcccacggggttaaaaaaaatgaaaatatcacggtaagtgatgctttggtaagacaacagcattcagatatgcatatactatgaactcttaatgaaaatataggttagtttaacattcaagaatgtttaccctgacccagccaacggttgggaaacaactacaaacaaaagactgcctaaaatgtcaaaacctaaaaggtacaaaactatatagcataaatatattataaaccgttagggttcgaccagctagaacaccatagccataaataagaagctacgccatgtcatgtgtcaatgtttgatgtctcgactacggtatttggacagtatggggatcgtcggtgctaggatatacgcgagactgaggaaaaagagatggagacagggatttttatacaggttcgggcccctgagctatcaggtaatagccctacatcctgttggctggagccgatgttgctttttattcaccataatcacaccagtacaatatgtggggtagcctatctaactgttgtcgacatggcggtctgaaggtctgactcatagtcgacaacagggtagccttcctcctcgagctcacgcccgacggaatcagagacagtgctagatccctacggccagcctctaaaggtaccggatagggtcgatccaggcgtatctctgatgtcgatattcggcggcttgtcttggcgtatgtaggcttgtatgttgtggcttctggtgggtgttgattgtctcttcatggtgagtgtcgatcgtgttgatcgtcttatatcatgggtgtcttccatggtggttctccctggtgggtgtcgatcccccatggtgggtgtgtccccctgtcctcctaggggggcttgtatttatacccataggtgtccccttgtccaagtagaactagggaaaccaatatggatacaatccgagtagtccttgtcgtttccatgtagaactctggttgtctttccttatccggaactccctccatatccgaaggttgtttccgtataggacatggtatgtggtgggtcctgccgagatttagtcaactactattaggtatgtggtatccataaccatgacagtagcccctgacttcgatgcaaatgaacgaattcatattctcaaccacgcgcagacattggagtaactgttatcgagctcatgtgatcgttctcggtaagtttagagataatgttggacttcctttgtcagcctcgtgcgggcaccgaaagggtttgtctaagtcaatctctaatgtcgaccgagaaagtacagagcgtacgactaagtctcccgtcttgctgtaatcgagaatttggattgaagtcaagaaactttatctcggcgggtacaccatctcttcattccgtattccttgtcaagatccagcaaccgttctcgagcgatcgagaaggcgtagagtctgcgaaggagctttgtcaacatttgtcgtactcgccttagtcgatcttggtgtagaaccatagagacatggagtcttcgtcaatgtcgaatagaattttcctgaaatcaatactcagaaaagaatatcaaatagaaatagcccccgagcgaatgcccaaagggtgacatgttataatatgtatggtaaattgaaaatgaattaaatttatcgaccaatgttttgtgtatgagcgtcttctctcttaccgacttcgatcagttagtttgtagagtcatacactctccctagcccccagccttatcgtcggagaatcgttctcagaggataatgctcttggacccttgacctgccttggttgaataagcactgatcctagcccccagccgtgaagttggaaagctcagtttctgattacacggcttggttaatacgcacggcgagaactcttacacgaccagatcttacatggtcttttgtctctacaggatccgacaaggccttatcggctctgggcgtccccagccaaagttcccttaggttcctcggaggtcttgtcaagacggcgtaaagggacagtaggataggtttcaacgctaggtgtcgtcgtggtaagggatctctgggtaaaacacttggcgatattgtgtacctgctatcaactttgttgaaatagaggtagtaggagagtcgctacaccgctggtcgaggaccaggtagtagtcgtaactcgaccacttaaagtggaaatagtgggagaaacactacatcgctggtcgaggaccaggcagtagtcgtaactcgaccacttaaagtggaagtaatgggagagatgctacatcgctggtcgaggaccagacagtagttgtaactcgaccacttgaagtggaaatagtgggagaaatgctacatcgctggtcgaggaccaggcagtagtcgtgactcgaccactcaaagtagaagtagtgagagaaatgctacatcgctggtcgaggaccagacagtagtcgtaactcgaccacttaaagcaaatgtacgagagatcactacgatcaactggttgagaaccggtgagtaggtgtccctcgatcatttggagtcgtggtacgaggaccgctacgctgccggtcgaagaccagttgtagctgttcctcaaccatctgaagtcatggtgcgaggaccgctacgctgccgtagtcgtacctcgaccatctgaagttaaggtgcgagagattgctacgtattggtgcgagaaccagtgagcgagcagaattatctctcgaacactaatggaagttgcggtgcgagagattgctacgtactggtgcaagaaccagtgagcgagcagaattatctctcgaacaccaatggaagttgcggtgctagagttggtttattgcaatttgtatctcatgtggccagtatgactcacgtacccaacttatagcatatccggatgtccgttcgcaatcatgtcgagtgatcaagccaacgacgttcacgagagattatccgttaacaaccttttctcgagtagtccagccatggccggtgctatgagataggtcgtcggtctttattggtaggttgggtgcgataattccgcatttgtcgagaatgttctcgataatggagtgtactcgaccataacctactcgagtgctcaattgttcctgaaaaatattttctagaaggcaagacatatagcagagaatatcgagtatgtactcaaaaactgcgtggatcttctagtattatcaggatataacgagcagatgtaaatagcaagcattatgtaaaccgtaaacaagcatgatttatacagaagaaaatagagcgagcccccagcgttagaccgtagttggcctaacatcggaagcactcgcacaacagatattgtataaaaaatatgctctaggtaaacataataaattatagatctgacaatgatgtatgatctgaataggtatgataaattgcagataaaatattgcgtacctttgtagatacatgccggatgtatctatgaaattagtagaacaatttgaaaaaccaatctaccaattaccttattgcgtactcattcgacatcatatgatctgacatcttttggtacgccgcgtatcttgaggcttggatgatctcgatagaccgagttgtcgatgacgatgatggttccgatctggtcggaagatgtacttcagtcgggttagatcttctcacagccgaagtcgtcgagtagcttgttgttggagaatccatctcttgaacccatctcgtcgaaatactgaagcaccaaaatccccctacctggcgtgccactgtcgacgtttgatgtctcgactacggtatttggacagtatgaggatcgtcggtgctaggatatacgcgagactgaggaaaaagagatggagacagggatttttat

SEQ ID NO: 26990 - DNA, 3083 bp, Oryza sativa
ttctcctttaggtggagagaccatagatttggacactcaatgtctatctacaatgttgcatgacattgaagacgcagaggacaacgacagagattatgagaagtttagtaagttggtggaagattgccagatgccgttgtatgatggatgcaagtcgaagcacagcaagttgtcatgcgtgttggaactgatgaagcttaaggctagtaatggctggtcggacaagagttttacagaactccttgagctgttaaaggatctgttgccagaggggaacaatttacctcagacgacatatgaagcgaagcaagtattatgtccgttgggcctggaggtcagaagaattcatgcatgtccgaacgactgcattttgtattacaaggaatacgctgacttggatgtctgccctatctgtgggggatcaagatacaaacgagcaaagagtgaaggtgaaggaagtaagtcaaagaggggaggcccagcaaaggtggtgtggtatctcccaattgcggagcgcatgaagagaatgtttgcgaacaaggaacaagctaagcttgtgcgctggcatgccgaagaacggaaagtcgatactatgctgaggcacccagcagattcagtgcagtggaggacaatcaataggatttaccaggaattctcaaatgacccaagaaacatgcgtttcgcaatgtgtacggacggcattaatccttttggtgatttgagcagtcgtcacagtacatggccagttctgcttgttaactataaccttcctccctggttgtgtttcaaaagaaagtacattatgcttgccatgctcattcaaggaccgagacaacctggcaacgatatcgatgtgttccttgaaccgataatcgatgacttcgaaaggctatgaatgagggcacacgaacatgggacgcatatgcacaagagtatttcaacctccatgcgatgctgttttgtaccatcaacgattatccggcccttggcaacctttctggccaaactgtgaaagggaaatgggcgtgttcggagtgtatggaggaaacaagaagcaaatggttgaagcattcacacaagacggtctacatgggtcacaggagatttctcccaaggtatcacccgtataggaatatgagaaagaatttcaatggacatagagatacagccggacccccgacagagctaacagggacagaggtgcacaacttagtgatgggaataaccaacgagtttggaaaaaagaggaaagttggaaagcgaaaagagaagagcacatcgaaggaaaaaacagagagcatgtggaaaaacaaaagacaaaagagaggagcatgtggaaaaagaagtcaatattctggagagtaccatactggaaggatcttgaagttcgccactgcatagatttgatgcatgtcgagaagaatgtatgcgagagtttaatgggattactgcttaacccaggtactacaaaggatggtctcaacgcccgacgagatctggaagatatgggtgttcggtcggagctacatcccataagcacggaatccggcagggtttaccttcctccagcctgctacactctttcgaaagaagagaagattgatttgctaacatgtttgagtggtataaaggttccatctggttactcatcaagaatcagtaggctcgtttcactgcaagatcttaagttggttggaatgaagtcgcatgattgccacgttcttatcacacagctgttgcccgttgcaataaggaatattttgcctcctaaggtgcgacacacgatccagcggttgtgttccttcttccatgcaatcggccagaagatcattaatcccgagggactagatgaactacaggcagaacttgtgagaaccctatgtcatcttgagatgtactttcctccaactttctttgacataatggaacatcttccggtgcaccttgtgaggcaaacaaagtgctgtggtccagcattcatgacgcagatgtatccttgcgaaaggtacctggggattcttaagggttatgtacggaaccgttcacaccccgaggggagtatcatcgagagttacaccaccgaagaggccatcgaattttgtgtggactacatgtcagaaacatcttcaattggattaccacgatctcatcacgaagggaggcttgacggtgttggtactgttggaagaaagactattaggttggatcggaaggtgtacgataaaggtcatttcacggtactacagcatatgactgaggtggtgccgtacgttgacgaacaccttgcagttatccgacaagagaacccaggccgatcagagagttgggtcaggaataagcacatgtcttctttcaacgagtggctgaagaaccgaattgccaggttgcagaacttgtctagtgaaacacttcagtggttgtcacagggtcctgaatggagtgccaccacctggcaaggatatgacataaatggatacacctttcacacggtaaagcaagacagcaaatgcacagtgcagaacagtgggttacgcatcgaggctgctagtgacggtggtcgtcgtgatcaatactatggtagagttgagcaaatattggagctagattacttgaagttcaaagtcccgttgtttcgttgtcgatgggtcgatcttcgcaatgtaaaagttgacaatgaaggtttcaccactatcaacttggctaacaacgcgtacaaggatgaaccgttcgttctcgccaaacaagttgttcaagtgttctacatagttgacccgtgtaacaagaaactacatgttgttcgtgaagggaaaaggagaattgttggattggacaatattgcagacgaggatgattacaaccagcacgtccacggcataggtcaagaaatacctctagaagaggaggaggaagaagatgaagttcaatatgcacgtgtcaaccatgaggaaggattatttttgtaatttatgtacgtagtttatgtctacatgtctgttatctgtatgactctaatatgttcgcaatgatcaatagtatattgcttatgaaatagtcaaataaaataattaagtgaagcacccact

SEQ ID NO: 26991 - DNA, 10342 bp, Oryza sativa
cctcgccgccggtcgtcctctccgccgtccgtccatcgacttccccgacctccccgatcctgaccttcccgacgccgggatccccgaccaccgccgactgcctcgacctattcgccactgcctctccgccgccgccaccaggatccaggacgactacggcctgcgccgccgtctccaagtacgccgcttctccaagtatgccgccaccctcccccattcctccttttttccgatggatgaattgcattgtttagatgaatgaaatgtgatttgttgtttcgattattggtgctgctgtatagatgaattaaatgtgatttgttgtctgtggatgttttggatgaatgtaggggctagattttatatacatgattttggtgcagtgaatcttagcatcaatagaggatcttagcatgaattttgctgcagtagatgttcttttctttatggataagttattgatttatatacccttgttgtctatgaatagttgaattgttgtttatatacatgatttatatacccctgctgctgctgccacataaattattgtgggctgttttattatctacacttgccccttgctgtctatgtttgcccatgctgctgcctatggttgcaactgttagttaaaacttgaatgtgtagctagtttgcaacttggatgtggatttaagagccatttggacatataaccattcatggagtgtgtactgctatatatgttgttttgttcccttttgctagacctattgaattttgtggatcatgtttacatttagctgaaaaaggatggattgagggttattaagctagctagaaatagtttattaagcattttgtttgaaatctttgataattaaggacctttattaggtgtagggtttgaaatctagttacaagggaagaattgatagattggccgcagatttaatgtagttccgaggttatcaaaccatcacagaatacaaaatgcatggggaattttggtggataggccagtgtagtccatggacggaaccgacctagacaccaaaattctccatgcattttgttttctgtcataatttgatgattaaggaggctttgcagattatctaaacttgttgatttatataccctttttgtctatgaataggtcaattgtatgaattgttgtttatatacatgatttatatacccttgctgctgctgccacaatgattgtgggctgttttattatctagacttgcttgaattgaatggatgatatctagacatgttgaatggagtatatctagacatgttgttttagttaatttgcccctgctgttgctacccctgtggcatatatactcctcctgctgctgttttatgtcaatcatgcaaattctgtacccttgctgctgctgttttttaaatttgcatgattgattcagtggttatatacctctacacttgttctttttttatgcataagaacagattttgtgcacttgctctttttttatgcataagaacagattttctgcacttgttcatttttttatctacaataatatatgcatgatttatataccactgctgtcgttgcccctgtacttcttgttaaatggtcaaggatgaattgcttaataacattctatctatacctgttcttttctttatggataagaacagattatctacacttgttgatttatatacccttgctgtctatgtgaatttccctctgctgttgctgtttatgtgaatctccccctgctgttgctgcccctgtggcatatatacccctactgctgttatatggccctgctactgctcttattgctgctattatatggccatgctgttgctactactctaatttcctgcacttgctcttttccttatggataagaacagatgaactacacttgttctattttatggataagaacagatgaactacacttgttctattttctttcggttgcttttttctcctagtagctgatttcctctttttatcccttcatgcaaatgattgtaattgatgcatatttctcagcaaaactgaggccatatctttcatagtataccccgtattacattggatctaattctatttagtctaatggtaggaaatttataatctttttcgcgaaagttaaaccatgtcaacgcccggcgcaaacccgccctccccaacacctgcgaggatccaggaagaagcaaacccagccacagaggcagttgccgaaggtcatcccgcgacaacggcggtccaacaacccgaaattcatggtaatttataggataaattttcaccacatgaccacataaattttagctagcaccccttagcaaatattgccttctgtttgtgctgcagaattgccgcaggaacaacatacgtcgatgtcgggcgagacaagtgcaagtaggtctagtagaaatccgcggtcacaaaatatatggccgaccacagtgcaagttataagagaggttgacgctagtggtaggcccacggcgcccaggactgtcattggaagatggtctaactgctgcgggctagcggcacgtgagaacttcgggatcctccataaagatatcgggaaggtcacagaagccgagaaagagcgagcttggacggcaatggagaaatggttcacatttccagccgaagaaaaggataggctcaagtggaaggcattccaaaagatgggcaaagcttggaagaattggaagtcgaagctcttcaccgagtatgtcaacccgcccggcaatcatacgccgttcgatgaataccctcaaataaccgaagcggtgtgggaggaattctgttctctcaagaccacccaagagtttagggaatccagcgaggcacatcgcgtactgcaacagcggaatgagcacccgcatcggctgggcaccgcagggtacatcggcaaggaggcaatatgggcccaagaagatgcagccgctgtagcagcgaatgtccctgccccgttttcagacatccctgaacaaagagctcgcaactgggcgcgggcaaggggtaaggtcaacccggacggctctgtcacatttgagaacaaaagtgatgccgtcgtctatcaggaactggtgagttcactacataacctaactaatttccgttcgtataaagtacaagttcgtataaacgactatcttcttttctagttgggcttggttgctgaacaagcttcacaaagcgaggttgagtccgcgccgaagaggcgcgaagatgacatcctcacaaaggcgctcggaaccaaagaacatcctggccgatctcggggaattggtagcgatgtgccctggaagcatggactccctcagtacagctcccaatacaggaaacggaaagtctccaaggaagagagggacactcgtttgaaggccgaacttaaggttgaggtcattcaagaactagaagctagcatgaatgcaagggtggaagaaagggttaacaaggtgctcgccgacatgaatataccccgagtcacaacacctgctgtgcaaccaactcctcgtgtacaacacgacgcgagtccgtcacagcataggagtagttgtgcatccacagaggtgccggcccctggtctcccgatcgcaccactagctgtagtggaccacatcgaggtaattgttgttatccgatccatttctaataaaagacatttacacattccaatattaaattcaaactttcaccttatgcagggcgcagcacagtgtgtcctactagcgagagtccacccaactttcgctcctgaagtcgctgagggcatggctttcaagccctcggttacagacaaggtccacggcgcagacctgctagctgggtatgccaaggtgtccatcgatacagtaaaggacacctggtcaggctatccgctgcccgtgcccccaaatgatgaaatcatgactttgggcgatgcgcgcaagacgttcatacaatggcccaaagaagacatagttgtgaagatgactcctcatccaagtcgaccgacggagcttacacctcccaagtgtaagctatcaattgaggctccccgtggaccggcattgtcagtacctcattctcccggtggagctgatatggacttggcagatatagctcaaagcttggctccaataaagaccacaagaaaggccgatagctccccaccacttgtcaagggccagaagcgtgaacgcggcaaggggaaggtcggggagttggcgccggagccaaaaaggggcaaggctgcgacgtcgatgccggtgagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagttggacatcacaaccaccagccgttcctatcgtcgcctgcctatataactataggctttgatgacctcttcgaccttttcaggatccggaagttggacactggtcttctaaaatgctactccttgtaagtgcataccttctatacttgtgatatgactggactatatctcctaattaaattagttctaatacgtaaatattttaaggttgtgttggatcgagagtcgtcgccatggtaatcaggttgggttccttgatccatccatggtgaatgaggttaatttacgacagagcttcactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacgctacataaccactgcgcaggcgacattggattctcctagtcatcgtacctaagtggagtagggttacctaccttaactccaataagtccaaagattatgatttcagtgaaatcaccaaggccttaaatatggcttggggtccatatgtggaaaagggtggtaggcacaaggagggcaagaatgaactttatcatgacaccaagtttgcatgcgcacaacagatcggagaccaatgtggtttccacgtgtgccacaacatgtcaacacttctaagagaggtgaaagatttcgaccctgaggttgttgctaatggcgaataagctcatttcaatatctacattgctattcaaaacgtgctaattaacctcttatttattaaacagaaaggtagagctggcttcaagatctcacccatcaaccccccccccgctatcagaggcgaattgtgcgcctttattcttgcagaaataatgaacaagaaaggacgttttcatgccaaatagattcatgaaattggctagataatttattgtgatgtaaaaaagatgtttttataatttctggcgatgtaaaaaattatgtttttatagagtgcaatgtaattaactttcatatgtgcaatatttatggtactttactaaattgtcatcacatttgatcaactacgatttatgttgtactattcatctgttttctcctttttttttccttattgacaggttgtgcaggtcgatgacattatggctttaatccatttggtaagtatatatgcggttctatgagcaacgaccgaaattgtggctttcaaggggtgtgaatttgctgtgcaaaattatggcatttgaactgcatatatgtgttgttggggatctgtgatgttatattgggggggtaatgtatctgtgatggatctgtcactggaatatatctgtgatgtttctatttttcagagggcatggctagcaaatcctgaggctagccaatatttagcatttattttttttttggaattaactcatcagtgacgggtcggaacaaaaatccgtcaaaggtaacataacctgtgacggactagcaaataaaggcccgtcagaggtgacctacctgtgacgggcctttacttttggggccgtcacaggtagatcacctgtgacagcttctaattacggagacctcaacctctgacggcctttatttaaagggccgtcagagatgagtcacctgtgacgggtcctaactcgctcaaggctagcggagaccaacacctctgacggccttctagtaacttgcccgtcagaggtgggtgtcacctgtgacggccggccacccgtcaaaggtgactggactcaccagtgaccactgatcactgaccatgcgcgaagccgtcaaagatgagggtttgggcccgtcacaggtgaccttggccagtgtagtgtatgtggtatccataaccatgacatcatgaactaacggttatcaataataaagctatgaatgcctaattctcaattttacggcatctacctaaagagtttgagagcaatgtattaataggtctataaatgaatcatttaggggatttcaataacccatacttccagtgagcgaatgacgacatgtcgtcaaatcatctcaagcagcttaccgatacattgctaccaaataccaattgttgaatcttcagcaaatttgagtcccaataaaagtaggttgctacattccatatcggtgataaactgataagatttacataaaaaatatccatcgtgaataattatttcctcgcgtcctgtaattacaccctttaagttacacttgcaactaactttttttctcaatctgttcaatttgcatataaacatgtataaatatatttcaataccaacaagtatcaccgcaatcgttttgcaaagaaaaaaaaaaccaaccatcaataagagtttttctttgtgctgtgtatgcccacttgtaaatatagaggctgatgtttattcattatccaaaaaaaatcaatactaagggcctgttcactttgatgaaaaaaaactttaccaaattttggcaggatttcttatatagttaccaaaatttgacagcaaactaaatgtagccactttttttggcaactttaccaaaatttggtaaggttgaaaatggcatcaaagtgaacaggcctaagactctttttttctcttataaaaaaggacgattttgctatatatttgtcgacaaattttctcccaaaaatttagcagatgtaattacagtacaatcatagtgtaattacactgtaacttgcatgtaatacactgtaactatagtgtaacgtgtatgtaactttcaaaaatctctctgtaatatgttatttcagtaaaatggaggttgtaggaacaaatccttacacatatgtgtgtgctgtgatttttttttcttcctcaccaaaacaaatcttgtaatagatttaacgattaaaaattacgtgaaacttaaatacaagttacactgtagttatatgcaagttacagtgtaattacatataagttatagtgtacactacgattatactataattatatctgtcaaatttttaggagaaaatttatcgacaaatgtataggtggtcccaggatctacctaccatcccaagctagcaggccggacatgagcccacccaacgtgggcttgtgcctcactggctatggcccacttacgcagaacatgggcccaccctgcgaggcccaatcccttctctctctctttgcgcgatttcttcttcttcctctcgaacgaatccccttccccttccgctcgactccaactccggcgctgctccattctcggcggcgcgagctgcggggcgtgggcggaatggaggggcatcgccgcggcgaagcggacgacgaggaggaggagctggggctgcgtctcggcctcgctagcgccggcgcttccgcggcggcggcggcggcaggcgagccgccgtcggtggggatggagttcccgacgtcggaggcggccagggagttctactgcgcctacgccgaccgcgccgggttcgccgtgcgcaccgacaagtcccgccgctcccgccgcgacgactccgtcatcatgcgccgcttcgtctgcacccgcgaggggttccaccccaccaggcacgacgacctcacggagtcggaggccgccgccgggaagaggcggcggaagcgcctcatcatccgggaggggtgcatggccatgtgcgaggtcaccaagaaggagccccccttgcgctgggtcgtcaccaagttcgtcgcccaccacgtccaccccgtctcgctcccgctctgcccccgccctcctcccgccggtgagtccgatggtctcgccggagagcacgccgcagcattggatgaacctacccaagccgccaccgaaccctcggacgaacccaccggagctcctgctgcagtgggcaatggggcgcccaatggagggccatccttctgcaataggctcgtcagagcgaatccagctggggtgcgtgccgaggtgcaagatttgctcgattacctcaggaagatgcaggccgagagcccgggattcttctacgcgatgcaggtagatagcggcaattgcgtgaccaatgtgttctgggctgatgcaaaggcaaggatggcatacaagagctttggagatgcagtgacatttgataccacatacaggaagaccaagtacatgatgccgttcgcggtgttccggggaatcaaccatcatttgcaggggatcatattcgggtgctgtctgctgatggatgagacaaagagttcatacacctggttgtttgatacatggcttgctgcaatgggtggccgccaacctgatctgctggtgacagaccagtgtaaggcgatggaagcaggaattgcgagggtgttgcccaacacccgccatcgtttctgccagcggaacattttgagcctatgtaagcagaagttgtctgctgtgtatatacagcacatcaacctgaaagctgatctgagggaatgtgtctttgaggctgagacaattgaggagtttcaggctcggtgggactatgtcatccataagtataatctcgaggagaacacttggcttcagtcgttgtatgacactcggcagcaatgggcttgggtgtatcagaagggatccttctttccagagttactcaagtcgcaaagatctgagaggctgaacaagttttttaagacgcatttcaacatgaagactccactgcttgttcttatctctaggtttgatcaagtgatggcgttgagtttcgagaaggaagctcaagcaaactttgtgacagcatattcaaagcctaccctgaaaactccttctgtaattgaaaggcaggctgcggccatctatacaagggcagtgtttgacatatttcaggaggaatttatcgaatcgctaggctatcatgctgataaaattgaggatggagttatcctcaagtacaatgtggccagtgaggaagaaaatggccggggctatatagtctctttcaaccagctggacaggaaagcagagtgtacatgttgcaagtttgagtacgctggtatattatgcaggcatgcgctaagaatcttcttcatggtcggggttcggaatctaccggaggaatacatcatgaagaggtggacaatggatgctgtgagtagtgttgtaccagacgagcgatcgttggagactggagttagctttcctgagcgcctagttgcttggtacaacgatctctctctcgacggtttgacatacggaatgagaggagccatgtcaccagaagtttacaaggttgcaaaggctgcacttcagaaagcatttgatgatgtcttggctgcgaaatatcagcaaatgagtgagcatcaggacatgcctttgccaaagtcgcaagctaaaaggacacatacaagagcatagttcagcatgatctggtacatgaaagggaaacaccagatgaccggccgtgtggaagtttgtagcatgagtagcttgattctcactaacctagcaagattagcatggtttctgcatggcagataggagagtattgtgcatcatctccagcagagtattcagagataagctggcatttgttagatgtgtacaactatcatcataggatatgctcattttgtgcttgtgcaaatggaagattgaaccccacccatcaatcttgttgactgttcttccgggcttcagttgcaccgaggcactcaattcaagaatttttttcgtttttagatttttttttatatttacagaaataatctatcgaccgaaaaaattgcagaaatagcccctgctgccctaatggtgggcggcaagctgacgtggcagacggtgggtcgaccgcgccgtctgccgccgtcggccaaaattgcgattaggcccttgccgcccatacagagggcggcaaggggctaattgcaattttggccgcccataaagagcttgcggccgt

SEQ ID NO: 26992 - DNA, 17856 bp, Oryza sativa
  unsure (1)..(17856): unsure at all n locations
gcagtctgggtcgtagaaacattatatggacttaacaaggagaattatgtaacatgaagaaatagtagtacaatttgaacatgatacgactatttgcattgcggttacatagatgatattagattcgaactaggagggaggtagtgcaatagttgaacacaacgacgatgtagtaatgggacaaggaagcatgacaatagaaatttcaatatgccaagttgtccgataatagctaacccctatgtgaggatccctttcctctctcaaaccgcgctttagtaaccctgtattgctctggtagttcaagctgcacaacacggctaggtggagttagaacccttctggtgtctatccattctctgtattgacatctccttggtggttccggggaggaaagaatagatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggatttatggaaagaagaacctgacaacgatcaccacacctgcatcttggacgggcttcccatggagggagtgccgtagttagcacccgccagtcgctctgttgttcacgacattgtcgttcataagccgcttttctctgtaagtattgctcagtactttcggatgcgaaataccagcgaccttcttgtaaacaagtggttaggtcgagaacgggattttctgtatcgacccactcgatgtatgcgcaagccgtagtgcgggtctgccgaatagagtagtattacaaagaataaagcgattgcccatacggaatgaataagcatatgcaaataataaaatacctcatggtcatagttagggcacctaaaaaagcgccttcctcgaatatcaggattcctcgaagccattagttggcatcgatcaccgcataggcagagaggacgctggcaccaaggtggtagtaggtatacacaaggatcgctacgccagtttggatcctcaacaccccggcgtctagccattgacgaaagccggtcggatttgtaatgaagcaagtggggaagagagtactgaatgtgactgagttctgaaagattgtgaggcctcactcattaaggcgacttatataggcgcaaaaaatcgagtgatacccctgacatgtgaacgtggtggggtatggtgggtatgcctgattggcgccgaaagatacatgcatgatcggcgccgaaagttacattggtcgtatgcgccaaatggcgggcaaatactcgtatcacacgcgaataaaggaggctgcatcggtgcggcagaaagtagtcgtgcatgcgccaaaaggtatcgtgcatgcgccgaaaggtatcgtgcacatataacaacaacgtagtcattacacaagcatacagtactggaaagtgaagcaagtaaacaaagagaagactgctctactggccctgccccgcgccgcgaccacgcttggtcctccgggcctgtgctcgcacgtggtcctgggagtaggtgaaacgatccggtggcacagcacgggtagcacgagtgtcctgcggaggagtggcctgcgcctggtcctgcgtctgcaccggcggtgcgcctcccagctgtgaggggccaatgacgtcctctgtcgagcctgaagcgaagtcgaagtcagtgatgtcgaagagcaaggtggaaggcagcaagcggtccgacgaggtcccagcatggtccagtggtggaccctgactcgacgtgccggctgcctgtgacgaagtcccggtgtactgccagaactgcgctgagtgcgaggtcgacacagctgcctgagacgctgaccctgcagcctgggaaaagtgggcggcctgcgtcatagcgaactgggcgaaacctacacatcgacacgggacccttgtaagctaagacataaaatgtatgtaaattgattgtcgaagtaatgttgtttttttaagtacctgtggggggcacaacagaaggcctagccgaggaaggcggggtgctgaacggtgcacgaaaccctgaagcaatcagcaagtgaaacggctcacttatatgtgcgaggcatgtacagaaatagtaataaaaatacttacctccgtgcggagggggagtcggcctaggaacgtgcgcagctggacggggaccagtcggtacgggtggccgctgtacagctgcgtctgcccgagcaacgtcgtctgcacgacaggtgagcactcggagaatcgagcgcatcgactccaccatccgcgtgtacgtcgtcaggtgctcctctacgggtaccggaatccccgcgcctaaacgttggatcgtcgttgaaccgtcaatgacgacccggttgatgtcgtcgacctgcatggttaatttgttcgtaaatattcgtaaaatttgacgaagagaaagacatgaaaacataaaggaatggtgcaatgcagggtactcacagcacgagcgaagtcctggtcgcggtgcctggcatagaggtctctagtgctcgcaacatggggctgctgctccaagggagcgaaggtgaccctagtacgggtgcgtggctggtaccagcataggtaggcctggtacgactcctcagtgtgtggctctccctcgtggtccacgacctcctcggttgcgagcaaccagtcctcaacaaaagtcgccaacttggcgggccagtcgctagctgagtgctgacccttgcgcgagtacctgcgaattaatgtgtaatattagtgtgaaacgacagatgttacaaattattgtgaacaggcagattttaatgcaacaacggaaagcgtagtgcaagatcttaccggtgaacagcagctgggacggtggtcggaaacggtactggaaagggctgacggaagccgaactgccgcatcacgcggaaaggggcgtgaggcttaacgcagatgtcgaagaccatcggaaccgtagtcatccagtacgcctggtccctggtgcagagtgtggacagacccaacggcgcacgagcctgggtagccgctgcactgtagggctcccacacgacgtcagtcggcagaaggcggtcgaactccataacaaactcaggatacgaccgcctaacctggacgtgagcccatcggcgctgcaatacgagacgatcgatgtgatgtacaatgaacttagcaattaacttaacaatacgataagatcgatgcaacgtacctgacgacggcaccacagagtacccatcgtagggtagtcgacctctggtcgctcctcgtacagtgactcctcgtacgcgtgctggtccacctcagggcggccgatcgcaatcctctcagctgcccagatagaaagaaagagagggcacccaccaaaggtcgcgctgggatccgtcttcgtgcaagactcacaaagtgcacggtacagagccgccaacaacgcggaaccccagctccactgaggcacctcgcctaccgcggcgtcggcgatgctcctggcgtagtgcacgagtcccttgtcgacggcgtgcccgtgacgccacagaacatcacccagccaaaaagccagagcaagtacgcctccaaacatcggctgtaggagtactcgtcggcctcctcctgtagctgctcaacctgcaagccgtcgataaaatgttaggcaccttaactgcggactaaatatgtaatacgattgtcatttcggtacaaaaacactcacggtgaactgaagcagccacctcttcgtaggtccggtgttgcggtggtgtgccaacggctcgagcgggaggtgcggtgcacgctgtactagtgcgaaacgtgccgtcagatcgtcctgccagtccacagccgtggtcactggcccaacagcgtctcaagcgagcggtagccccaacaagtacgatacgtcctgtagggtaggggctacctcaccgcacggcaagtgaaaagtgtgcatctctggcctccatcgatcgaccaaagctgctaggagggacctgtccacagtccatcgtctggccgggtccgcgtcgccggccgcagcctccaccagccgacacatcggtaggaggccggcctcacgtagcctgcaataacaaattaatatgtcattataaaaaatattacagtgcaactaacttatagtaaaacactgttcgtacctctcgacaaaggagtcgtgaaccgtgagtagctcaccgcacgtccgtgcccggaacgtcccaagctgagccccctgcaccgcagtaaggtgagaccggtgtcggtgatctatcgccgggtccaacaactgaggtgtatcctgacgtgccatctctgaaaaatatagtgtttcgtgttagaacaattcaaaaaatagtaatgtaaaacaaaagataacttgcaaaattatgaaatagtaataaaatcatgagattaattatgtacaacaagagtacaggctatttaaatatagcaaacgttactaatggtacataacgatgacgtgcaatttaacatatatgtagagttcaataatataacataacattacgtgtcgaagtccgacatacatcagcatacctaaagacgttaggcgccttagtccgacgttacatcacgagacctaaagacatgacatgccgaagtctgacattacacgacgaaacataaacacatcgataagttcgaaacgaattacaagcaaatccacatgccgacatagaacataagaactacaccacgtagccagacgtggcacgacgacgcctaggacgtggtcgagtggaggtagtgccttcacccgtaaggcgagctccatctgctgctgattctgatagtcctgcctccgccgcacttggtttctccttgtctttaggacaatgcttgtaggtgtgcccatgttcatcgcatttgctgcaacgcttcaccctgccagcctccgactcgtccatatcgttgcggatgcgacgagtcctcctccttccagccttgcctcggagcttcgatgggtcaggaatattgagtacttcatcgttagtctctgtgaactccccagctatgccgaacccataaatctcgccgctccatgtatgatatattacttgcttactgaagtactgtgacacatatactgcatctggtatgccacactccgctgcggcagcaatgacatgggtgcatggcctgtggagcagcttcggctttgcacaagagcaatgacatgtgccgtcggctttgagaacacactcctgcttcactctcttgcggtagatacccctgcctgccttatcttgacatagtatctcaaacctgtgctgttgggtaccttgcactacagctcgatgtttcatggcctttttacgcaactcctctagctttttctgcatgaaagctccaaacaaaatgctgttgttcggcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcataattccatatctagcaccacctgtgtcatacgccttggcccatttctcttttggttcatgcagaatccactgagaaaatttccgaatctccaatccagtttttctaaccaatgttggactatccgttgggagaggtccaagagcttgaggagggtcagcaacggcggtcgatggagccgctgcacgctgatcactgcatttggctgtcaattcatctaatctcttccaaagctcattgaatttttttctcctggttctgattgcacagcctcttgaacttgttcatgagctctttgttcttgaattgcttgaagaaattagctcccatatgacgcatgcaccacctactctgtacatcttcccaaacaccggggtatcctcgttccatactcccaaactgcaactcttctatcgctcgcagaatgccagcgtgcctatcatgtatcaggcacacatttggcctcataccaacaacttttgttttaaccaatttcaggaaccagtaccagctgtcggtattctcactctcaacaaaagcaaatgccaaaggcaatacctgattgttcccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgctaggatgttcaattgagggaaatttcttcacttcgtaagagctcccagggtttctttcctcgataacaccaagcaggcgtggcaaattgtcatacgaggcttcgtaagttccaaatctcatctctattattttctgtttggccctccaggccttggcatagctaatagtatacttgtatgtctcttcgatgtgtcggattattgaccttggttcatatgtgagattatcgatgacatgcgcatacatctcagatgcaacaaatgcacaagtaatgtttctgtggtatttctgaacaccaggtagaaaacatgtatgcttggtaacaactgacactgtccaataatccttccatttccccttatacgcgtgcactctctagggacaaccatctttttccttaacacaccgaacttcatattgcgaccggttggacttggcaacccaaaactctctatgaagtgacactgcaaaatgttttaccgcctccttcatatcttctgctctactataaatcgctccctgaataacctcattttctttgtactcccatctcacactatcctcttcagagacgatcagcccagaaaaaatcctcactagcccattctgctggattaatatccgtctcatcatctgacgaatcaccttcctctacacgctcattgtcagaatcctccctctccatttcatccacaatggcaccgacagtctccccctcgtcggccactccacctggttgaatgccaactggagctactacgcccccgtcctctcgtgcgttgacctcctccacagaagtctcgtttacttcagcacttggtccctcgccatcatccatgttcatttgcacacctggatccttcgggtgaacaaacggaaccaaagctagaggccacccgcgttgcaatgcattttccaaataccatctccacactcgagagttttgaactggcattagttcccaataaaaaccctcagttgcccaacttactataacattgattgttatgtcacttgtctgtggatcaactctcaagcccttcattaaccatccttttatagaaggtacactcctctcagccgatctatcaattcccctttctgatacaataaaatctgacagatctaccccagttggcccgtaacggacgtttcctggtccatggtaaacttgaaatatttgtttgttcgacatatctgtcaacgaaataactagatcatattactctttcatgcaataaacatctacaacgtaatatcttcttgtataagccaatgcaacggtaatgtattgattccaaactagcagatctacgtagttaccgatatctacaatacgcacttctagattagtacaactaaaaccctaaaaatataatgcatttattcaaacaaatttttaaagaatacacactatttaactcaataatcacatataggatctatgaatattacctgaaattggcgtctgaatccggcagggcttcgccccttcttctcttctcctcccctctcttcttttttttcactggaattgaggagagaagaatgagggctgggggctgggcagcagcccttttataggcagcgaggcctgccgcccggccagagggccgcaaggggccgcctgcaaaatagccggccccgactggcttttttgtattcgggcncntnccgccccaccagagggcggaagggttttcctgcaaaaaaccctccctccgtcaccgcccgttcctcccccgtttgccacgtcagcttgccgccccagaggtgggcggcagggtctatttttgtaatttttttggccgatagattatttctgtaaatatttttttaaaaaaatctaaaaccgaaaaaaattcctcaattcaaccaaggcatcttcgacatctatctagtttcaccgcaagaattaattacagccattagcattttcttacatggttgatgaaccacacagatcggggtggtgattcttgtaatactggtgtcgaccagcaatcaggtaatatgatgatctcacaaaacagaacacaaaggcgcacgctcattacacgcacaaaacagagcacagaaacatacacatgggttcattactgaaacactaaaaacttgatgctttgcaagctggacatcaattagaacataacgatacaaatacagcgcaaaaacaaatacagtgagcattacagaaggtttcttttattactagcatgcaccttgtaatttaggaagattacaacaatatacagcttcctcaactgatcaaaacagatcagaattttagccgtctcatatttgtgcgtgagttgtacacataggaacataccagaaacctaaactaggtaaaaaaaaaaaaaacatagcaccaagccttctgaccataatttcccttgcaaaccaaaaacttggtttcatgttgccagtatgattaggcaatcccaattatcagcaaaacctcaaggcatattcaagttccttctcatcagcacagctgtaacccaactgatatgcgcgtgctgttcagaatcagagcacaagtcagtaattcaatgtaatgaaacaaacgacttatgcattctaaacacagcctacaatcaccgattggtacagtggcaccacacactactattggaatccaataatataaaagtacaaacaaaacggaagatgtgcatacaaaaggctatttgctctgtaggttaaatatgatacaaaggctgtgtttagttccacgccaaaattggaagtttgaagaaattggaacgatgtgatggaaaagttggaagtttgtgtgtgtaggaaagttcgatgtgacggaaaaattggaagtttgaagaaaaaagttgaaatctaaacagggccatgctgttgtgcaaggacgatttttttatattattattgaacaatgcctagtagttccaccacctttcccaacatggcctaaagttcaaatcgtgataccaaaagcctaatttcttcataatttcagatatggtggaagaagaaattttcacagtagaaaagttcaaagatattaccaaatcgtccagaacccataaatggctctgcttcatcggtcataccagcttgttgtagatcctacaaattgtgaagtagaaagggttatgaacaagtacataacctgacccccaataacacacataaaattttagcaatgttggaggaagtggttgcagatatggagaacaatatgccagtcaagataaaacaagttgacagccaaattatttgaaggatacaaaaagaaggctatgtgtaatagacttacagtatcatcatcagcatcccactcatcatcaggacacaaccacctttcaaagcagtgcccagatattgtacaaagcagcagcccactagactggtccaagacaaattcacgacaagcgtcatcgcaaactgaaaaatagaagaaaccaaccatttcacatgtatacaaatctacatttacatgcgcacatgtgactagacactgagaaaaacaaacataccatgaacacggcctgtcttctcacaaatataagcatcaccaatctgggtgtaagagcatgtattcccagaacaagaatgccccttgaccgcatcatcagtgaggcctctgctgcttttccagctagacacctgatcggctattgttttatcaagaataaccttgtcatcgttgaccttcaaaattcacaatagtcacatttaagtcttgtcaatataatacgattccatagctatgtgggaaactataatggagataagaattagtgattacttcagagggaaggggagcttgactcctttttgaagcctgcatctggatataatactccttgaattctgtaggtgtatttctcacaaactcaaccatatcctctctatcttgctggaatttacgaataatgaaaataacatcaacaaactgatgcagacaactagcagcaagcgaaaatgattgagttgcaacatgtaactgaacttctgttcagtgagtgcaacaaggtcacaaggaaaacaaatatcaacttttagtttgtacattgaactgtttgggtttattcttgaattggtactgaaattgcgtagccattcttagtttcaccataaaactgcagcactacaacatctgaactgtagcttgaaaaggtaggtttcggatggattacctggatgtagagtttcttccaagcgcactccctgagtttggtattgcatgacaggccccaccgcatacaataccttgaaattattggacatggatcaaacatgtgagtgaattctttttattacaacaaatgcaaaattggagcaaatgaagtttcaggtaaagcttacaggcggcgccagagggtctcgtcggacgcaaccacgttcatgaagcggcagacgagggcgcaggagatgagatcctccgatgagaggaacttgaatatctgcaagaacaactccggcgggatattgcagaacatgccgctatcgatctgaggcgccaccgacgccacgtccttctctttcccctttgctctcctcaccctcttgttctgctcctccccgctgccgctatccccatcagattcagactcctgcttcctcttattgttcttcgcatcatctcctaactgcttctccttctcatccccttcctcccgctgcaaccaattacccccaaatcacaaccagattcgcacaagccaatcacgcgagagatcgatcgagaacaacttacaccggtagggtcgtcgccgctagatccagagaggatctccgattcgaggaagctggcgaggccgtcgacgtcgtcctcctcctcttcctcgccgccgccgccgccgccgtcttcgccctcttctcgacctcgcagctcatcctcgagaacaaggtcatcgtccagacccgcggcgtcctcctgaccgtcggccatgctcctccgccaccgcctcgacctcgacgtcgtcgtcgccgacgagatcgccgctcctccccttaccctaatgggagagatattggtgcggttggttggaggatacgtgtcgctccagaccacgacgtcatgggccgaatctcaccgacggcccagctacctcatcctgtcggccactttacgcgatcacttcgattaattaggcccaacgcgattaggccccctatacaacccactttctttattactccattcatcatttcagaatcaaacaaattcgtattcaaatcgacgaaatttcgcaaaattaagataaaaatgtatagattcgacccgcgatgtaatacaagtattttattgtatggagtatttagcatggagtttgaatgaacagggtagtaaattgaagcgaggaaaggtgaaaaggaagccaaatttgcgatttgatgttcatagtggggagcaacttctgaatcttgcaaatgacccgagaagggaccatggccacgacttcacaggagatcgacgtcagagttagcgtgacaccacgatcaccgatttactccgattgctcctcctcgttgtcgctgtcaagatcgccatcgattggtgcgtcatccggcggcgacccggctgcggcggcggagacggagtccaacggcggcgagccctcgaagagctgccgccggagcacgtcgtggaggccgtcgaagagcctcttcttgacggaatccatggcccattcgaggcggttgaggagctcggtggagttgttgttgtacatgaagaggccattgtagaggtcgaagctgtcgctgcaggtgttgtcgacgaggcggagcagcgtctcgtaccccttggtgttgatcggagttgtttggagctccagcatggcgagtgttcgtccgacggtgtgggtgaggaactgcgtctcggcggcgtgcgcgtcgtgctcggcgcagctcatctccaccatgcggcagccctcgcgcgcgaagatgtcgaggaaggcctcggcgcgggcgcggcgcgccgggcagtcgccgacgcggaccttgtcgaacacgaaggggaggccgccccacccgtcgcccgcggactccgggccgaacatagggtgggtgcagatgatgtcgaactcctccgggagcgtgccgaggaggaggttcctggggaactccttgacggagagcacgtcggcgaagagggtgtcgcggcggaggcggtggacggggagcgagcggaggacggcctcggcggagaggatggaggtgacgaggagcaccacatccgggtggcactcgacgagatcgtgcgcgtcggtgaagtacgtcgcgccgagctcggccgccacggcggagtagtctgagcgcgagtgcgccaggacggtgtgcccctgccgcaccagcgtcctggtcaggaactgcccatagttcccaaaccccacgacggcgatcttgagacccctccgcctccgccgctcctcgtcctcctccatctcaccaacctcctcaacgccgcgaggcacatggtcgaacggttgccgtgcatcacctcccgtggcgcgggcggcacgaagccggattgaagccgccgccactcccacgcgccggagcacctggaggttggcgggagcggcgattcggcggcgggagggcgctagattcaatcggaggcgcacggaggaggaggaggaagagcacgacatcgccatctcggcgtcgaggtgagcggcgcgccaacgcggcggtgtctcgcgccgccagcctacaaatggggagagagtgaaccagtcaactcaactggtagtgttctagccttctaggtctcgcggaaatgaagcgggcctcttaaatgggccgacccataccgccgaatcggcccatcaaacgaagcccatgaaacccatctcctcggctgggaggagaatcagaatccgctttgcgagcagcgaggagggtggaatcgagttcgagcggcggcgaatcgggagcggcgagattgggggaggcggccggagatggaggaggaggtgacggggagtcgaggggggttggggggagggaagaagatggcggcgggggaggtggagctgaaggagaaggcggggacggcgtggagccactcgtacctgaaccagaagccatggcacccgctctcctacccgaaccagcggcggaagtggatcgccgagcagatccacgccaaccgcgcgcgccgccaggaggaggtgcagcgtgagttcgcgcaggagcaggagttcttccgccagaccgccctcttctccaagaaggacaaggagaaggtataatggaaccggaaccctatgtatatgctaattaccttcttagctaactatgttgctgtatatgtgtctcctaaatcatctgctttgatcatagcttaatctgcttgtgcttttgatccgatatggccattgacaagtagtgttagcaacttagcattgcttatagacattacctaaatgtttgacatgggtttctgtaggatttctttctattcattgtcatatttgctccatggatgatgataatacgtgccagtgactgtgcagccccacttttgtgccctcaaagtcaaatatatgtttgttacatgtatcagcatgggacataagtcagtaagttacagtagaaatgaggaaagatttatctgcacttggaccatggacctcaaacctatttaatactgagaaatctagttatgatgattgctagttgcatacaagaggtttatatgtttgttgcatatatcctttataggagcttttatgttaagctgtgatgaacaagtatgcttttatctaagtcttcatgcttcttttgtcacccatgaaaaattcacggttgtcgatatccaatctgtttctcaagttcagatggagataatgaaagctgtgagtttcatgtatgtccgcccacctggctacaacgcagagagtgcaaaagcagctgaaattgaagatgagaagaggaggtctggtgaaggtgatgcaacccaaagtgctgctgctgcaagcacctcttcaatgtaatgtagcatttttttccctgccgtgattcatgaattatttcacatttatcaagcttctaccaaccctattacttctgctcatatcacttctctatattttctttaactttttttttaaaaaaaaaatacaggcctgataaggaacttgacaagacccacgcaggtccagataagaaaaacaggccaaaagatgtttttggccggccattgccaacagaacaagaatttgaagtgctgaaaaatgctccaaggtactttacttccttcaccttgttttgtgttaaaatcttgaaacaatcactacatgacagtatgacatacagagtttctttttccaaacccaaacaattacccttttcactttattttcattttcacctttttccaatctcaaatgatcaaacatgacattcattttcattacatttttgtgagttatgggagtctaagtcacagggaacgtggaacttagctaagttcctcgctccggatcgaggaactggaactaggcggaacttcgttccgaaaatgggtgggttgtcgttccagtacacggtaggaacaatggaggaacttagcaggatgatatgagggaggaacgagctacgatgagcaaaatatgggaaaggcaatccaaaatttccgaacagaattcatcgctccatgggacgaccgctgcttttgctctttgcagctcgctgccatcgcgcctaggtgcatatatgagcgtgcgctgcactgctgccgccatcgtgaaggggaggatggagaaattgaggcgcgctgcgtgtcgcacccgcttttctcctccatcgctgtccgcggcagcgcagtgccaagccatcgcgctgatcttgccgtcgcttcgagccatctgccatcgcgctatcgactttgtatgaaaaaagaagagcacaatccagggagtcaaactaggaacaccgaacatgttccttaaattgggtacaccgttccggattatcgttccggaaaaactaggaacatgttccatctatcgttccatagttttagaagaggtatacccctcttgttccatcttttttaaagatgacgtcccacgttctcgatccatcgatctgggaacttttgtgacttagatgggagtaggcttagagcatcattgtgctgccttgagataactcttaagtagcattttatgatttaatatgtttttgttgtactctcaggttggagacaggtgctcctgcgagggttaaaccatttggagttgaagttcgtaacgttagatgtttaaggtgtggaaactatggtcatcagagtggtgaccgagaatgcccactgaaggatgtgatcatgcctaacgaggagagccgactgaaaagggatgatcctcttacagctataatggcacagactgattcaagtgaggttaggttttttttgtcaaaatgttttccctgttgcaatttacattcaaataagcttcctgtaacaagacttgcaagtagtagatctctgtcaaccatttgtattgcttgtctcccttttaataactgcatataatttgattgctgatagcaacttatctacagttgcttttttttcctgaagcttgggtaattaatatctgaagatagctcttgaaattgtcatcaagtggaatactatggatagagtactgaatattgaatcagcagttttaaagatatatatttctttatttgagcgtgtcaacaattaagatgcacatttttgccattgccaccttttctcactgtacttcggttaaacttcaaaatgttttaacacaaggaattctttgccagcctttgaagtgggaacttaggcaaaagccaggcatgagccctccacgtggtggatacaacccagatgatcctaatcagcagattgtagccgaggacatctttgatgaatatggaggtagatcatgtagaatatggatagcatgcagctgtgcattgacaaactttcatcatatttctgagtttaatttatggctagtatattggctgattatactggtttcttatatttcaggatttcttggtggatgtgatattccagctcttctttccaacttttctgctagcaaatcaaagaaacgctccaagagtaaaagcaagcataggcaggctgagcctgctgctcatgaggaatcttcacactctgaagctgagaagagcaacaggacatcaaggagcaagagaaagaaagaatattgttctgattcgtcattttctggtgctgaggtggaagctagaaaaagcaagcaaaaatcaaagcacaagaagaaacacctgccagagtctttgtctgattcaaaagttgaagttggtagagatacaagaagacatcaaaagagagagcataggaagaagaaaagaaatatcactgagtcagagtcttcatctgattcagaagttgatatagatacaaggaaacatccgaagagggagcacaggaagaagaaaagagatgtcactgagtcatattcttcatctgattcagaagttgaagttgatagagatacaaggaggcatccgaagagagagcataggaaggagaaaagaaatatgactgaaaatgggcattcaagccgatcgagggagaagcaccactacagtgacactagtacttcggacaatgagaagcactcaatgggacataaggatgagcaatactacagcgattcaagttcttctaggagcaatcggcattcaagaaggtcaagggaaaagaggtactacagtgactcaagttctcctgagcacaataggcattcagggagatcaaaggagaagagggcctatactgacttgagcacgcatgacagggataggcattcaaagagatcgagggataagcgggagtacactgaatcaaggccttatgagagcaataagcattcaaggacattgaaggtgaactggcactactctgattcaagtgcttctgattattcaaactccgaacggcactatagtcatcgccatcgtagaagaaaatgagcagtgttgtataatctgcatgatgtctccacagaagatcgctctgccgtttatatgatgtcattagctacatatgcttggtcattttcttaaggccaccagggtccacgggttgctggtgtttggtgactgcagctgctaatcgacttgtgatgcgatagtaatgtatgtgactgaattttgtcttctgtagaagaattgttgtgccttttgttgtaggcttgtacccgagggacttttattaatttaaaaaatatcttgtttggcatcatggtatcttttgaattcactgaataaaggccctcatttgtaatggaggtccttacgaatttgttgctcttttatgcctggataaatataatgctcaactgagcatgatttgtaatggaggtccttacgaatttgttactcttttatgcctagtatctgtaccaattaccaaatagacatatccaagacattgagtttcaggtttttgccctttttttgctaacatcgttgatgttttccaagagctaaaagagcctttcagcaaaataaattcaactctgtgtttcattttccaaaattgcagtcgactgaaaaacaaaaaagaaactctgc

SEQ ID NO: 26993 - DNA, 383 bp, Oryza sativa
ttttttaccttgaattttagcaaaaaatcgccccccttgccctcccaatggtcgggatggaaagcagttggcagtttgggggtatttatagacccaacacacctcaaacgggttagataaaaaaagcccgtcaaaggtattgctcatacctttgacgggcttctattcaacggcccgtcactggtatccgctcacctgtgacgggccagaaatgaaagccgtcacaggtggcggcccatcacctctgacggcttctaatgtatcggcccgtcacaggtgaggggataccagtgacgggttggaagaaaaaactcgtcactggtatacctctaacgggttttcctttcggcccgtcacaggtgaggggatacctgtgacgggcc

SEQ ID NO: 26994 - DNA, 12910 bp, Oryza sativa
  unsure (1)..(12910): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaattttttatggaacttagttcatgagctgcttttacacgttgctttattgacacttgttcacaaaacaagaggcacttgctgttttatagcatcgaattttatttcttaaaaagatcaggaatagtaattgcattagtttgtcatgggcacatcatgccactgtaattaaacacttccctatttcgtgttctactgccaatgggtttggtttctttgtgtgcttgtgttggcgtgtctagcaaggcctatttgcgatgcaaatgcaaaatgtcagctatgctaactaatttattttttttcaggtatgccatcacaaaagccttttgtgttgcttttctgatgacattcttctctgtattcgacgttcctgtcttctggccaatacttctctgctattgggttgtgctttttgtcctgacaatgaagcggcaaattgtgcatatgataaagtacaagtatgtcccattcagcataggaaagcaggtgagatcattatgatatgtatgcatagttgatagtgttttcttctgccatttggaagttcagtagttcatactgcaccatatgttaatcttccaagtggccattactttgtgtatttggtcctagtcatgatagctgtcttgggggcagtaaaaattagaaaggccctttatttgcaattgcattgggggcttgtcagagttacatccctagtaccttctgattaagtttgtacttactgcactaagattcaagagtaaatcatatgttatgagtaggagctactggccttgtcttgatatgttttctcatagtgtgatatactcccctctgttcatcaatatcggtgtcaaatattagtgatcagaggtagtatcatagccaagcacatgtaagatgatgacagtaggtgtgtcaccatgagaagacatcgctaaccaatttagatcactgacttgttgcgctacacattttcctttttcctgaaggagttgcactatacaattttttaaatgtacaatatattagcttactgaactacattaattccaatgcagaaatatggtggaaagaaaggcccgggagccagtacgtctaaagactgagacctggattgcagatccctgtgttgctcttgaggcaacatgctggcatggtggttttttggtaccagctactgacagtggatgtacacctccattcgctagtcgagaggagcttaaagagactttgcatcggttgatgaccatttgtgttgtatatcagattcttctgtgcaatgactcgttcatttatagttcttgtgctgtgcggctcttgtgtggacgagtaatgaacctattgagtcaggtgcaatgcaaatcaaaactattggggcttgacatggatttgtactggaattcaacatgctcgtttccagacggggcccttaattactcgcatgttagtaacacatttgttattctatttagagtcctatgaaggttgtctgttttgtgtatgcgcatgagccattcggtaattgttactcccttcatcctacattgagcatccaataatgtctgctataatgtttgtgcaccaagaacaagaataatttaaatcacatcgatcaagacgtcatgtataatatgcacacattctctcctaatgcatgagttggttaaaacacaatgcacaattccactctgcctttagcatgcacacattcttacatgatgtattaattgtgctctaataaaatccttatacatgtgatcaatttgaaaaattaattttagtttttattatatgataatcaatttaaaaagaagggagtactatcttaactgcactaatgattggtggccaagtgatttacaacctctgatgcccatcgtaaaatcccaagctgttttagcctgtgctaagtcaaaactgtcagcctaccaggcagtttgtaactaactgcaaatatggtaaccaacccgctggctgataggcggggccgaccgttcgctccggccccacctgtcagccagcgcatgatctctactcttttttatttattaggaggttgctgcgctgcggaggctgcatgcattagcgcggaaattctcaggctcgccgtcgacgaggaggaggaggaatcgggaggagatccgagatggcggcgagggagacgtcgcgccacgcgtcgctctgcctgtggctcgcgctcgtcgccgccaccctctctctcgcccaggtactcgattgatgatgcttgctcattctgtttatatcattcacattgcccggatttttccccttcaattcttagttgccaccctatcattagtttgccactctccctgatctgatctgattactcgtacgtcactcttctccaatgtgttcgattttctatttgttttagaacttttgctctctctgttttctcttttcaggcggtagaatcagaagccgaattgaccaaggtcaccaccaaggtcttcttcgacatcacaatcaatggcaagccggcaggtttgtgcatcctgactccctgatttcttgagttcaccaaaattttgttattgcctgcttctctggtaataatgccatttatgtatgttgaagattgttcattgtttaatgaaatcttccattatctaaaataatgcgtgtttgattgatgatatgctcattgacgtttagattgtttctacttggttgttataggtcggattgtcatggggctttttggaaacactgttcctaaaacagcaggtataacatcaacctaattacttattgttttcaacttaattgtttttgtctgagacacaaattggtaatggtctctgcatctgctctttgcagagaacttccgagcaatttgcacaggtatttcttcccaaccgtcatactacatttcttcaatgtaatgctaccgatttcatacaaattatttgaaattatacaatttggtcagctatcccaattcccaaacgtgaaaggctatatgtccttttagttttcttctctaaaagtgtcaaatgaaaaggcatattgctcgcatcctttttatgttatactatagggttaatacttattggcatattcggtgttacataagttatttcctttatcactctggggcctgttggtacttactgagcatgccccaagtcatgtactccagttgatttggctactatagttcacgagatttggagagagagatgtccctccaaacattttttttaaagaaaaaattgcaagcgtgttggcgattgaacacgggatatcaggattgaaaccacacaccccttgccactgcactatcaagtgcatctcttggctactatagtttcatgtagcaatctcaacttcacatttatacaggtgagaaaggacttggcaagagtggcaaacctctctcctacaaaggaacgccattccacaggatcatcccaggcttcatgatccaaggaggcgacaccgtgagcggcaatggaaccggctgtgattcgatctatggtggaatgttccctgatgagaacttcaagatcaaccactctgcaccaggtgaactgcttttcttgatatcccagttgtatactactatattactgcacagaaatttcattcttttgagcagcaagtcctcatgtttgatttgctggctggtcattggttcagggttgctgtccatggccaactatgcgaaagatacaaacggatcccagttcttcatcaccaccgtaaagctaacccggtaaacttcatcagctcctgagagctgagaattagttttcgtgcaaattttctttttgtttgctagaaatcttccgatcaaattgtaattttgatcatgacctactctttttgtgttgtttgctactgcaggttggatgggaagcatgttgtgtttggcaaggtgctttctggaatggacgtcgtctacaagattgaagctgaaggcagtcagagtggtactccacggtccaaagtcctcatatcagacagcggcgaactgaagtgatcttccattaacagaagcttaataacgagctgtacttacttaccgtgaattcctatcattggagtatgtgtgcacgtcattagtgccatgcattgtttggagcctgtttctgctgattataatgtgacctgctttgtgtaattgttgtaaaatgagagtgttctctcaatattttcccatggcaattcagattggatatgcaatgcaagcttatatacatgcgaacacaatgtcatattcctctttgatttagattattgagcggattattccatgaattatcaatttgattatgactataaattaaataatttataaaaataaacttaataaatagtttaaaacacgcatttttaagccttgtacaagaaaattctttttataaaaaaaatttaaagcgttgagcaaataatccgtttctataattagaataaggtttagtttgattgtgaagtttggatttttaatggcacgtaaaataagactagactaattaagtattaattatttaaaaattatttgttttttaaataaacttctaaacaaaaagtatttggaaaaaaataaacctttaacagtttagaaagctaaactatgctcacagtaaataacacccaaactaactttcaaactaagcctaagttgaaaagaacaactcgatagaatctaaaatttttatgctctcttgatcgatttatctgcatcaccactccctcatttacacaaaacaacccgcaatcgaaagttacaaaaaaaaaaagcacctcaatgagtgtgattaatgtggagttaaacacgaagatctttgcttgagacagaacccgacactgacatgtagggcccacctgtcaggcagcgcatcgctttcaccctcttggctactatttcttcgtggactcttgggcagagtgcggagaccgcagtgtggagcaacagatctatccatccatcccatcctcgatccttcattcctgcccggcggcgagcgagagagaggcggaggagatccgagatggcggggagcgggtggaggaggatcccggcggtgaggaggccgcccatgtcgcgcccggcctcggtctgcctctggatcgtgctcgtcgccgccaccctggcgctcgcccaggtgctcatccacctcgtccgtctccactctccaccacgcctcgctcctcctcctgcttccccgtatctgcgtgtgatgtgatgcgtgtgctctccgatctgattcgattgtttgtgctcgtgcgctgatttcttgatctgtttgatctgtggatccaattggccctggtgtgctgatttgttagaattttgagtggtgcctctatgtgcatctatgcgtactcacctttttttttttgttgctgtttaggcgaagaaatcgaaggcggatttgactgaggtcacccacaaggtctacttcgacgtcgagattgatggcaagcccgcaggtttgtgttggccccctatgtttagctctactaccatatcagcataatatataagtcttcaggcagaaagaagaaaagatatgcatagtttgatgtgtctagcattagcaaatacggagcagtaacaatttaatttgcattaattgtgtcccaccgttgtgtataagtgacttgtgatgggctgatgtcatatgcagtgattattacagttagagttatcagcatttgagattgacctgaagctaactctattatgatgagaatttagcttcttctattgttgtttatgtttaaggagaaacgttgatgtgatatttgtgtatgtactatttataatgtctttcctgttaatgattgccttactgacatttattattttttcttgtattgccataggacgggttgtcatgggacttttcgggaagactgttcctaaaacggcaggtaccatttgcttatcatttagttaggtaacaggaaattcattgtcatatcacaaatgctaatgattcactatatcttttttttttcctacagagaacttccgagcactttgcacaggtatgctccctgatgatttatactgtttttattacattagatgtgttcattcatcttctgctagagtttccagatggttaatcccatggcaagcttggtagtggcagcatgtagaatttccagcattgaataacactttctttgccactttaacctgaaattatttttgaatgcacaacttttgtgtcattatcaagtttggccaatcaaatatactgttacagttgactagttaaaaattgatgcaaaaatacatcagctcagctgttgtcattattcatacgcaagtgtagaatattatgaaaacccataaaagtatttacttcatataatgagagagatcccattctggacagcgaatagcactacaatctgtgtggtagcattccctgatgcctacttgtggttattatacgtaatctaagtttgggtttgatgtagcgctttcaactttgttgttatacaggagagaaaggaactggaaagagtggcaaagcactccacttcaagggaagtgcattccacagaattatacccagctttatgatccaaggaggtgacttcacacttggtgatggaaggggtggtgaatctatctatgggacgaagttcgccgatgaaaacttcaagatcaagcacaccggaccaggtaattttcgttatttcctgaaccatttttttactacactatagacgcattatttgtgtggtagaccatcaaatcatccttgtttgatttgatctcatgtttatgcaggcctcctgtccatggccaatgctgggagagacacaaacgggtcccagtttttcatcaccactgtaaccaccagctggtaatcgtcgtttcctcactagcctttgtaatcatagcagcactatttctaatttgtactgaagacacttcaatctgttgaaactatttatttgattaggttggacgggaagcacgtcgtgttcggtaaggtgctgtctggaatggatgtggtttacaagattgaagctgagggccagcagagtgggtcaccgaagagcaaagttgtcatcgcggacagcggcgaactgccgatgtaatgagctgaaatgatgtttcactgaagctactgctactgcttctcgttgtagaactgttattagctgctctgttttgctatgcttctaccccgaatctggttggagtaaatttctgttagactataacagcgtgcttatatcgcctcttagttgtgggcgatttggagtgaactagcataaaaaggtcgaaactttacttaagtcgtcttcttgttctaagtcgaattatactttgaagtgacttgcttactgttgagcgcttgatctgcgtctagttcagacgaagatattctagattcattgaactgcaacagactaaaaaaaaaaaacctagatcacgatcgattagatttgagtggattaatttacacaaaccaaccacctcgggtagataaataaaatctgtatgtttcatagattctcactgacacatgaaaccgaggtaattagagagagaattaaggccgatgcaaactggagtaatcctcaaaacagcgtgattccgtgtgccaaaagaggacaaggagagagtcctgggagttagaaccagacacacccacagaccgcatctagaccgcgaatctccgatcgggcggtggatagcacagcatccaggggaaagccgtgtcagacacgcatctggaccgcgaatctcagatcggacggtggatagcaccgcatccggggggaatccgtgccagagacgcatctgggccgcgaatctcagatcggacggtggatagcagctggaggaaagccgtgtgctgctccaacgagcctaataattggcggccgagtcagtcagcctcccgacccatcaaacacaaatagggttagcgagaatcggcggcggcggcggcggcggcgagagcggagagagacaggagggggcaaccgcggcggcggcggcgggggggcgcggagatgacggggaaggcgaagccgaagaagcacacggcgaaggagatcgcggcgaagatcgacgcggcgacgacgaacaggggcggcgggaaggccgggcagaaggaccggctggggcaggacaagggcggccacgccaagctcgagtgccctctctgcaagaccaccgcccccgacatcaagtccatgcagatccaccacgaggcgcgccaccccaagctccccttcgagcccgacaagctcaacaacctccacggcggcggcgccggcgccgccgccgccgccggtgaggccgccgcctcctcctccaagcccaagcccggcgtccgcggcagcctcaagaagtaaccgcaatcgaatccatcatcacccgaatctgctactactaccgcccgccgccgctcgctccggtgtgcttacttgctgctgcttgctgttttgaattattactactgtgtcatgatgtgccgtgtgatagatgcgttgattcgcgcacatatacatatgtgaccgtgttccgtcgcgtcttcgtcggcatgttttagctatgatgtttagtttatgtgtcactactctatgatgctgtcaatggtgtcaatggatgataatgtttatgtctgtcactgctcaaacaattgctaaatctgagtaaagaaaaaggtgatggctaaatccgtttgctcactcacttccgtttcgtagcaaggatgaattggaaatttgcaattgtgattagctgattattatctttgcggtgtcaagcggcatcttttttaacttggtgatcataggtatcatgtggggcatgttattctgcgctgaacccatgactgatctgcttttagcattggaagcacagtaattaggagattctacctgtttagaaaacatatgttttttttatttcatagttatgcgcctgaaaaacaactgcctcttcacaattagaggtaattgcaacatggaactgatgaaaaatgggcctgttgccctgtataagggagttagttgcgggttgatgaaatcgtggtacagtgttaaaaagaacacttctttcagttctgaattttagatgcacacctcacacggttcagttttctctgtcaaatttcacagttttcctaatgttaggactagtgaactccttaatctccgatatgatctgttaaacatgcagatggctctatgccaagcccttcacagtgagaagttgcatcatttgtttcatgtgatttccactattcgtaggtagttcattgtggttgtcatttagtcatctgagcatggatttaccaatgcagcggtgtgcagatacaaggcattccaggcttctaacttgtcaaaaaaaaaacaagttttgtctatttgattggtacctaaactaaactaccattgaggcttaacaccataaagtgatgttttgcactaatttatagcagtgagatgcctttctaaagctcatggactttagttagtgcagtgcccactggggaggcattgcaatgatgtgatattatggtgcttgaagcatgggggaggcatattatggtgcttcaagcatgggagaggcctttcacttttctttgtatgacatggaatcaggcagtccttagatgaaagtcatgaagctctgatgaagtttttatgtggaaaattttgactactcgaacttctgctctggcaatttggcattagatgaaaatcatgaaactctggtaaattttgtccagattatttggatttgatcagaaccagatgatatgatgtagtgctgcatcccttgaaggttttgaacagtatagtttactgaaatcgagatgccagaaattcattgtgcaatcagagtgttttatataaactacgccgtgagaccaggttgttgcagaacaagaatatgcactagacagtaaggattttgcatacagtgttttcctttatatactttacactaggtaatacaaaaaagtaacagtgtgtactgacaatttacatcacatatataaaacaaatgaagcaacggaatcattactagacagacacaacgaaagcacaatcctggaattctctcttttccttggacagaaactattgtgctctcaagacataaacttgaacaaagcaaagaatacattgggtcccatcatcagagaagaacagctgtcttgccgcaagtaatcaataactcaactctgtttcagattgagttcccaggcctagagaacaacctgctgaagagaaacacaaaaccaagcctaagatcagtcattttggaaaaatctctgcaccaaaataacaaaaaaaaacacgtttccagttcttttgttaattaagtgtggtacaaatatgaattaaatctttgggtagctttaggtgcataacttttcaatattacaaatggaacatcagatggtaacaatatacatacgatctattatgcgataagtagaatcagtaagtaacaagctatttaaggtctacctttaatcactgaagctgttcctactggtgaccaccagtgggctgtaaaaacaactgttgaagctggaggatcactgaccattgttagccaatggcacctccattgatgaaaaaatggctccttgatatgagctcaaaacaatggctattgttcaaacttattttcagcatagagctcagtattctgatattcctgatgatggagatggaacataaaccaactacaaattctaaaagtgatggaaatcttgacgtaggagtataggcgagaactgtatttatacgtgaagtaattctgcagctactgttcaggacagctcatttaaggatcaatggagccagtgaaagaactttcctgtgtcttgggagttggtggatcctcatcctccacaagaagagggtctaaatatccaattgccagtaccctttgcgcctcattgtaacgggcccaggtaacaaggtatagaccagcaatgataaagactcctccaataatgctgaaaagtagaatggaaacatacaacacgtgattatgacattatgtatactttgaagtttcttgaaattctatagtttagaggaccaaaaaggagtttttctaaaatagtatgggagtgaaatgaacaaagcgatattggcaatgttatctgtaaaaaaaacagtttttatcatattttcaccggtattaacaccaatatgaagattatttgtctggagagtatcagaaacaattaataaacacaatgaagagcgactattgtctggaacgagtatcagaagcaactaatgaacgcaatgcagagcgactacagttgaatgaatcccaaatttcagaaaccgtcaaatggcaaagttcaaagaacacatttcgcattattacatgccagaattttccgttataccttccaagatatattggggtaccaagaaatatagttgacaggatggtagaacatgctggttggagtggattgtagagggcaaccagagaaggaccaaggattttgtttgaccaagtcatgattgcgtaattcaagcaagatgcaacaattccctggtgaagcaaaccaataaattcagttagaacatgctagaggaggatcataaacattagcattgcattggtcatacacaagtctatgtaatataagcccaagggaatataaacatgcttacagcatatagaatagcaatgatctcggtcgttgtcaatgcccattcatggagcccattggttgtaactacccctgtcagcaccatgaatacagtggcaaatgaataagagtaagctgttaaggataagctcgcgggatattttatcagcactggagcctgcacataagaaagcaaccctgtcaatagacattctttttccaacaaaaataaagacattttatcaacatatagatattaatcttcaccaaggataagatgttccaaagtttgcatcacctgtatgaccagataagcgcccatcaggaagcagttcccaatgaggcagatgacaccaagattccatgtttctagaccgtattggagcatggccgatgtcaaccattggggcgtgtaagaattgctgctccatgtgccggccaggacattctcacccacaccattggagcctcctcctcctcctcctcccatgccaatcaaggatggacctctatagaacaccatcagcacggctccggagacgcacacagccgtgccaagaaccttgacgatgccgtccttggtgaagatattgatcacctcaacactgcaacacgcgtaatttcactcaattcagttgaaatttgaagccaatgcaacatcaggagtagataattttccaaatcatgaaccaattttacccgacgattgcggctaggaggaatgtgaacaccggtatggctggctggaaggctgcggcgtaggaggcgttggtgaagctgaggcccagcaggaacaggagctggttcccgaagatcctggagaagaagagatcgatcgataagatgagcagaaggagaagaagaagaagaggaggaatcgatgaatacccggtgaagccgaggagagcgaaggaggcgaggaggtgaggggtgagggggcggcgggtgcggcgctcgcggaagaaggcggcgggggccaggagggcgagggc

SEQ ID NO: 26995 - DNA, 6077 bp, Oryza sativa
ccatggcggcgtgcgcgcgccacgccttgtccgcccacagcagccgcccgctcccgctcacgctccacaccgacgacgaccaccgctgcagcatcgtcatcccctcgccgccaccccgttccctccccatctccggcgaccccgccgccgcgattcctgcctcctcgccgccggttggtgtctcttgcttttgcttgagcttgtcttggaaggcgtctactgactactgctgctgcttttgatccgtttgtttatttatttatttattttgttgattgatgcgtctgagttttcgcttgcgtggcaagttatatattagtagaaaatgtgttgagcgccacgcacgctaaaaggccgggaagaagtcatgcatttttttcattttttttctaaaagaaaatatgaaaccgggagaaaagtcatcagcgttgcttgtactcccactatgtaattcatagttatagaatacgttatatcgatatgtctacatctatactgagatatttttatattaggatagagggattatgtattaatcttgtgtacggcttgattctaagtaatacggagcactaatcatatggctggagtaatggtcttattttttttcttatacttatgtttattagctatttttttagaaaatttttattagtttaagtttgaaattttaatcttaaatttagagttaattttatgggtttttcatcgaagtttatttttcaccctttactttcagatcgctaacaacacgtatataaaagttttatttataaattatttttcgtttgcaaattatgaggccgtaagtatcaatatgtcatttttcaggagaaggttgtcacctggatatcgacatatcgtgactggttttttctcgaccagattttgtaagattctcgattgaggaaaagaaaaatctcaccatacacagggtgggtgcgccactgcttatcgtatctacagtactcccctggcaattcactgcttttttcagttagtaaagagactaccctataatcttttcgtcccaaaatataaaatattttaggtgaatggaacactttatagttttctgtctaaagagtgtcatattcatttcaaatctgtttatcttttgagacgaagaaagtaattggcataggctaattataaaaccatatgagtaacctaaaatacttatagatatcggattttatccattatttcaaaaaagaaacgatgtaacacatgattataactcattaacgcaaggtgttctcagactctatggtagtttcgtttgtgatttatttttttatgttcgagttgtacggtatcatttttatttttcgggtctctgattccgtttccaagagagaaaaaacgattgcataaacattttgaatattttttttgatcattttcattcacagttattgccatggaggaacatgtgagtgagatagttgaacatttccttcttatccagaacacaacttccctggtggtggtggcccttcttctttcatttcaaaaaaaaaaaaaaaagaaaaaaaacacccaaatcaacacagatcgtaacttggtggcgggcgggtgagaggacagcaggttaaattttacattaattttttttatacattaagatagtattaaattttacactgaaacatgtgatacctttccaaacatggtaaaattaccctacattatataaaatatgttctttttgattgggtaaaccactctgtttttcaataaagttaaaaagatcaaactgaattttcaatttttgataaaaatttatttggatttcatcagttttatcaatggatttcgtgaaatccgatgataccacccctgagccgattttaatcactgtcgggattgtgaacctagaggatagagcgcgtgaatgctgagatgaggcgtgccgcgtgcgtggctggttgagagcacctacatttcgccgtgtttatctccctgatgtatcgtccctttcgccttgtgactcgtaccactcatcagacggttagggtgtgtttagttcacaccaaaattaaaagtttggttgaagttggaacgatgtgatggaaaagttgaaagttcatgtgtatataaaagttttgatgtggtgaaaaatttaaaagtttgaagaaaaaatttataactaaacacagccttaatgaatcgagagcggcagcggcagtgaccgcgacgagaagagaacgattgattgattgatcagccaagatataaaggtagagagcggtgaccacgctgtaatatgatgtgataatcagatgctagcattatgtcctgcacctgcactgcagattccgtttcttcgctgccagctaactgttcaaatctttttattttctttttgggtgatggagtttaaatcattttttgaatgaacagtgttcagatccgtatcatatgccatgaactgtagcgattgcgatggacaccgacgaccaaacacacgccggggaggtagggattcagtgtttattattattggtcgtggagagaaatctgtacagctgtgtattgaacatttttgtgtcatgtctgatgtgagtgattctgtttaatggttgatcgctaatactatgtttacagttacattcctgggctgggatgaagaggccgtatggtcacattcgtggagtatgcaatttactttacttacgccgtgtttagttccaaaataattcttcaaacttccaacttttccatcacatcgaaactttcctacacacataaacttccaacttttccgtcacatcgttccaatttcaatcaaacttttaattttgatgtaaactaaacacagccttataagttattttatgaaattattagtaaagataaacagtagtcaagatttgcggggtgaagtcaatcgtaccaatttatctaaaagaatatatagggggtgtattaatgtattacgtagtactattattcatgtaatattagggtgtggtatttgacacgcctctttagctttgaagttcagcaagaaaaatatggtgtataagcataccacgtcaaacataggaaagtccaatattcttttaaggggacacacataaactcactccatatttacatcacatcacacgcacacaccggtggagtataagaaacacatattatcactccgtagtggctggggaaaattattaggaggaataagagtttaaaaagtgggaactgttaagtctattatttaatcagagaatgtgagagttttagaaggaattgagaaggagagtaagcgaacttccacctcttcaaaatcttggtaagagtaagtaattgaaatggaactctcttctaagtacagcaagataaatatgtgtcgtacatcatcacttaaaattcaattctcatctataatccttatgattcttatttctaccaccaaacaaaagattaggagtaaaataaaactcgcatgatcaatcctttcactaactctctcctctcaacggatccatgtcgtctacagtgtagtagagaagtttgtgagtctgccacagtaaagcagtacatcaaacactcaaacagtgatcaaatattgtatgcaagtactgtataaacagtaattcttttattatttaaatgattagtgttcacattaagctgctgtagcactttgttttggacgatccaacaaaaaaaacagcataccataatgcactgcattgtaagcagggttcgacttaccgtccgtaaccgcgcggttaccgtggttattggccttaccgcggggtacggtaatagaaaaaccacggtaacctccttaaattcaaataaatttaaaaaataatttgaatttttaaaaattttacacgatttcgtacgatttttcacggttaccgcggttaccgcgcggtaaccgtgcttatcaccggggcacggtaaccccggccctggcggtttgggaaaccctatttgtaactccctctgctgactcttcatcactgcagaggatccgaattgcctctaaactctcaatcctcctctcatctctttgtcaaacgggccgacttaatcgggacctaaacgcatgttatgcgtgtatccttttacccacccggactaaccgaagtcagttccggggaaagcctttccggcagctgcgaatgtcaaggccctccgaaagtcaagaagagaaaatgacggcccacataattcagacggcctgaagctcgcagggaaggagcggcgggctgggcctccgggattgaggaacacttggcccaactcaaatgtcagcgaatgtcaaggcccagccctgagcaagctccatcatgagctaaacgcgtgaattttacaggattttcatatgaatcagtttaattcccgtaaaattattccaaaaatcctagattcggaagaaggccttagaacatatgattcaaccaccataccaccatgattccagtgaaattactgcctgaactctgaacaaactcgtggtagacaaaatatttctgaacgtctctgaataccagcaaacctgttgggactctgaacttggtaagctctaatcaacaaggctccaaatctcaggcagcatatctcaaggcccaaccatgaaacacagttggcaacaaatggagtagctagctagcatacctcgatctcagtttgattcgattgaacatcatggatgaaccaccatgattccagtgaaactgctgccttcaaacaagagttataaatatgacattttctgaatctctgaataccagcaaaccaattggtgagactctgaaaaaatggttcatcacaggatagctctgatcatcagggctccaaatccaaatatccaatcatccaacgagtgatttgcaattccctaatccttacctaccactctgcaggtacattacgtgtgtaattgtgtcaatgcaggagccgcagttaagtcagtgtcaataggttgatccggaccccagataaaaaaaaaaaacggaaatgcagcagaagcagcaacgcagcaaaagttctccacaacaagcaaagaaacagccgttcagacttcagagacgtggcacaacatcaatatgccatgaacccatccttccatagtggagcatatataataaaacctgggcctgacgcagagctgtcaccaccaccacaaagcagagaaaaatttgggactgacgaaaacgactcatgatctaaataatggttaggtggtcatcagtgttggtgtgttaacctgacctcttccttctatcacatgctcacaggtcgattaagcactaacaatttctttttatattgcaggcctctgcccctttggtcagtaaaacataagagctgaagaaactggaattcagatgtgcttcgctaatcaggcgaattcaacaacgaaaatgaagtccttggaaattcattgggaactcgcatgagacaattctgaattgttttttttcctgtcatcagactgaaaggcacaaatatttttgttaagaaacaattggagctaccaggagtttatccatagaatgtctgaagcagtgcagggccccagtagaacagtaaaccccgagtggcaagtactcaccaacacagatccactgattgatttgcaaaatcttcatgcgacttacagatgtcaccatgggaggctcaattcaaagcatgctaatgtaaaacatgtggttttccatgacaaataattagagcacacagatttggaatccctttgctaagtgcctctaataccgctgtcaagaaagctgcataccaaccggatgaacagcacggttgaagagaagatggccacacctaacctcgtcgcaaagaaacaaggtcgctctcacaactaacactctctgccatacttgggacgacaaggactcccaaagttcaaaagccaaggtgatttgggtttgactcttactctacttcaagatcctgagttactaacacacaagccaagttaatttgctcctgaaaaactttcttgtatcacaaatcacaatgccaagcttattcctcaatgttctttttttttttgtatgatgacgagttaatcttcatgacaatgccaaagtttattt

SEQ ID NO: 26996 - DNA, 1111 bp, Oryza sativa
tgcaggtgttgtcgacgaggcggagcagcgtctcgtaccccttggtgttgatcggcgtggaccggagctccagcatggcgagcatccggccgacggtgtgggtgaggaactgcgtctcggcggcgtgcgcgtcgtgctcggcgcaggtcatctccaccatgcggcacccctcccgctcgaagatgttgaggaaggcctcggcgcgggcgcggcgcgcggggcagtcgccgacgcggaccttgtcgaacacaaggggaggccgtcccagccgtcgcgcgccgactccgggccgaacatggggtgggtgcagatgacgtcgaagtccggcgggagcgagccgaggaggaggttcctggggaactccttgacggagagcacgtcgacgaagagggtgttgcggcggaggcggtggacggggagcgagcggaggacggcctcggcggagaggatggaggtggcgaggagcaccacatccgggtggcactcgcagaggtcgtgcgggtcctggaagtaggacgcgccgacggatgcggcgagggaggagtagtcggagcgggagtgggcgagcagcgtgtggccctgccgcgcgaaggtgcgggcgaggaactggccgaagttgccgaacccgacgatggcgatcttgagccgctgccgctcctccaggagccccgccgcgcgggactcgtagtcgaacggctgggctgcgtcgatggcgcggatggtggtgccgcccccgcgctgcggccgcgcgcggaggggcgccgccgccggagacggagggcggcggaacgcggcggccgaccggaattggtggctcgccggcggcggcggcggctggtggaggcagtgggtggaggtggaagacgacagcatctcgccgcctctcgcgttggatgcttcgggggttgggcttggctcactttgctgcctaccttgctctggagttgtgggctttgggggaaatcctaaatcccaattactagtaattaagtgagctaaatgatggtgattagtcagtcaattaattaattttgtgggctaactgatgaggtgattagtaaattgatcaactggaggacagaacggtgttattcgttgggatggatcatgg

SEQ ID NO: 26997 - DNA, 6794 bp, Oryza sativa
  unsure (1)..(6794): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttcctggattgaattttaagttattttagccttttgttgtagaggaatctgatctgtatatgttgtcggaaagttcaggtgaacaattcttctttgttactacctctgctgtttcctgaacagttcttgagctgcaaccatgtagctgaagctgtatacttgtatttcgctttcagagatcacatatttccatcgcacacctctcttacatcttccagagttcagtctatgttttttttttgttctcatgttcttggtttcaatgcaatacacaaaatcctaatgaatctttcccactgagagtttggattgaatcttgttctttccagttcatagctttacacagtgatctgttgctcactgactttgcagagtaacaccgtttaccaagtctgacagagtttcatggagcaggtaattactctgtccctgattcttctccggctccggcgagatcatgtatcttgtgaaggatatcggcggcgccattgcgctgatgggcgtgtcactggtgctcctgggcacatggccggtggtcctcgccgtgctggagcgccgcggccgcctcccgcagcacacctacctggactactccatcaccaacttcctcgccgccctcctcgtcgccttcaccttcggccagatcggcgccgacacgccggagacgcctaatttcctcacacagctcacccaggttagtgcccatggttattcttgtctgaatttagacatgttagtctgaaggaagtgatgctcatttcagacattcagtatgttggtctagtacagttttcagacttttcagacatggggtacaaccttttctgaaaaactgtggtttgtcactaggaagtgaattttgttggttttttacattcatgttggatgtagaggccgggttccaatccattgtctaaaaaaaaagggaagtgaaccttgtttcctgtcggaagaggccaaagatgtaaactgttttcattatctaaaaaaaggaagtgaacccagtgtatcaggcttgtgttaatagaaaactctgaaaatttcagttgatcaatgctggataaccttttttttttcaaataaagatgcaggacaactggccttcaatcttgttcgcgatgtcgggtggcatctttaacggcctagggacactggccacgcagtacgggtgggcgttcgtcgggctttcggtcaccgaggtcatggcgtcaagcctgaaggttgtcataggtacaaaaaaattcagagtgatatgctctcctgataataagaatgatgcctgatgcttgtatagcatttactgttcagaatctgaaaatgacaatatggtgtgactgagaaacttctcttccagggacaacactgaactattttctcgatggccggatcaacaaggcggagattcttttccccggtgtcggatgctttctgattgcagcctgccttggatctcttgttcactcttccaatgctgctgacaaccaggagaagctgtctagtgccatggtgaaccacagcaacaccaatgggtataaactctcttcttccgtttttcactcatgtggtgaatccgtttcatcagttctgcctaaattctacttctgaaatactgaaaattttgaaaaataacacgtatataaggtaatttgcttttacttgaattttatttggttgttgctaattgcgaccaatgtatcatttgtgcatcagtacattattccaatgcagtaaattcatctgaacaaacaatgtaattaacttgaactctcaacagggacactgaaaatgaagaactcaccaagcacctccttgagataggtactaatcagatttagtctgaaaataatagtatatcatagagctatgtgtactaatctttcaattgacagaacaacccaaggattgtgaagaacaagagcctgaagtggcaccggctgcccaggctgtggaaaaactagaggcaggaacagctgatttcctggttgaccttgaggggaagagatctattaaagtacgtacttataatactaaccgtaccaatatattagttaaaatgtcatgactaaactgcagaaattcaggtggagcaattgcaaagcagagttgctagcaaaatttccacaaatgaaaatccatgtatctctaaggaactttttttaaaaatctgacacaaccttccatgtatttccaacatactccctccgtttcatattataagtcgtttgactttttccccagttatacttcattaagtttgatcaagtttatagaaaagtataatagtattttcaataaaaggcaaatgtattatcaaaatatattcaatattagatttaataatctaattcgatattttatatgttactaagttttcctatatatttagtcaaacttaacaaagtttgactgaaaaaaatcgaactgacttatgatataaaacgggggggaagcagtaaaattcacactttcacaacagaaacaccaactcaacaacattaatttgtttcttctccatgacacaaaagaccttctgaaaaaaaaaaaacttcacattcaggtgctcggatcgaacaccttcctgggcctcggcatcgtcaccttcgccggcgtgagctactccctcttctcgccggcgttcaacctcgccaccaacgaccagtggcacacgctcggggagggcgtcccccacatggtggtgtacacggcattcttctacttctccctcgcctgcttcgccatcggcatcgccctcaacatctggttcctctaccaccccatggtcggcgtgccgcggtcgtcgctcacggcctacctgaaggattggaaggggagggatcttgctctcgtcgcaggcatggtgtgtggccttggcaatgcgttccagttcatggctgggcaggctgctgggtatgctgctgctgacgctgtccaggtacaccatctttcttcaatccaggccgtctgcagtactgctgtcgaaactaaatttctgctattctaaaagggtagcaaacaagctagaaaagtagatgggttatgagacggatgatttatataggttcacgtcttataggtatatggtatccataatctccacaactgtagaggatctttctcagctcaatttgcatttcttgggagatattctctctcgttataaatatttgatgattaggataagatttcattaaaattttgggatttgacattcagtaacttctcaatttggctgtatatatccacttgtagatatatagaccggatttctacccattatcttttttaaaaagtattttttaaaaaattattggtttaaaaattagtgtgtgcagattaggataaacttgttctgaaataaaattaatggccaaagttttgatttgaccaaatcttatcctaaacgttaaatatttacgacctggagagaggagtacatgacttgaacattttatcaggcaagcattaatgatcctcaagatgaagattcatatgtgcaaattatgatctgatcatggttttggaatttgacagtatgagaagaagacgatatgggttttctgaaactctgaacatgaatgggccggggcgtgtgtctgaacttttctgaacattatttctgctgcaggcgttgccgctggtgagcacggtgtgggggatcgtgctgttcggcgagtaccggagatcgtcgcggcggacttacactctcctggggagcatgctgttcatgttcgtcgtcgccatggtcatcctcatggcgtcgtcggcgcaccggaggccgctctgatggcggccggccggcggctgccgtcgacctcctcctctcctcatggacatgaccgagaaacatcagaagaagaagaagaagctgcatatgtacagctccattgatctgaccacatcagtgtgtagttcctgaccttctcgacgtaggatctatgcatattgcctcccggtgcttgcgcatcggcgaggctacacatcaattaatttcttctgcaatgagcaaccatgggatgggggagtgaatttggagatgtgattggactagtatatagtgtaatgttgtaatatatgtctcagcttctttgtgtgaagcttctgtgaagggaaccaaaataattttcaaatgtataaattttgatcaatgttatgaggagctacttcctccgtttcacaatgtaagtcattacattcatattaatgctaatgattctagatagatatatatgtctagattcattagcatcaatacgaatgtggaaaatgctagaatgacttacattgtgaaatggagggagtagctattaaggctagctctagtaaaaccagattaataacctttttgtaatcctcaaagtagaaatgttacaactttgacaatgaaagaatcaataatggcattatgacgtcatgagggcttttttcctgaaatcaggttcatattttcttttctatacgtgcagtctaaatattggtcctagaacagtttttccccccctgaattttgcaacgacattaagttgattatcagtgctaaaatgactccaacaaaaatactaaaatgtgtctcccggtgaaaaataattgtgtttttctttgacagataagaatatatactcacataggcatctccttaaagttttgagtaaattttacaaagggtggtgacttggcaagtgatgtcatcagcacataggtgaccggtcccacatcaatcgctgattagtcccttgcatggtccatactccatccataccagttcttgtcatggttgaaaacagagttggggcacacctacaggctactctagatctagtctgtgttggatagtaaaggttgggaaaacttttcccgcacacagaaaacgtgataactcattaatatatgattaattaattatgaatatgattttttttaattaatatttttataaaaaatataaaaacacgatgtttaataattagggaagcatgcgtctgagaaacgaaagagtagagaggcctcggtcccgggccatctacataggtgagatggcatttcaactaaaactctggtttgtctagatcagactaagactaacacgagttattttaactagaggttcgtttgcatgctacagtaagtggcgcgattaaaatatttgcagtgtttgaatcatccaaggatgttgaacacactatatatattttaatttgtagatgcaatgaatgagtgaagatcatttcttattgattttgatttatatgactgagctgatggtgatccagtaagcttgcgtttaaaacagccctattgactaactgactgcttgtgcagttgtgctcgatatataggctgacagaaactatctgtgaaatcttcattttttggttagttcagtgtcactgtccatcaagaggaaacctattaccagtaattaatactgtcacagtataggactgaatgattcgtactccctccgtcaaaaaaaaaacactcaaccaagggacaacgaatctagctagataacgagttttttttttacggagggagtaaaagaaaaatacagtaggaatcatctctgctgtatcacaggtggatgatgacgatgatcatgatgatggtaattgtgacctgtacgtattcctggtgtattttcgaagaatgcatggtgggagtggcgtgctactggtctggaaggaatcacaatggaagagatacaagatcacctaggataactcccatttggttttgccaaaagtagttaatttgttaccagcaaaacccagttaagatctactccctccgtttcaggttataaaattttctagcattgtccacatgtatatagatgttaatatgtctagattcattaatatatatatgaatatgggtaatactagaaagtcttataatatgaaacggaggaagtacttgggtagggacggatctaattctaatagagggggcttatctccttcttcctcctcaagcccctactctttcttctccccctcttcttccccctcctctctccccttctctcaatggtgatgattcagtaaggtaaggggacttgagtccccccatcacccatgctagattcgtctctgttcttgggtttaacccctttccttgtttaagtttcgattgttatatatatatatatatatatatatatatatatatatatatatatatatatatatatatatatatatatatatatatatgtggacacacttgttgtaatatgtaacatcttcatataatcttaataaaattggtcggggctttttctttattgcaaacccaatgaaatcacaagtacgtgtattacataagtatgatttcttttagccatctatatataagtaactaaaatagttttatagctaaattcatcttaccggtcactacctttgttattttttgttaatgttttggatatcaacacattctcccgcgcacatgttttataattacttttcagaagtatatatttatataaattattgaaaaatataactatatgaaatattattttatgacaaatataattatcacattttaaatct

SEQ ID NO: 26998 - DNA, 24126 bp, Oryza sativa
ggcgccaaacatttcgaaacggagggattagtatctatcatacatatggaacctcctcgcgagccacgtttttctaacaaaatgattcacttgctttgaacacttgcgctaaaggctagctgccatgctttatttggtagaaatatttatttttttattaatccatccattagcaagttgccacttttagatgtggtgtttaactattaaccacttatatatgtatcatatgtagatttctatatatctatgacatgtagatagtatggtaaatattaaacatcacatctaaaagtgacaaatcgtacaatatatatctctcgtcatcgaaagatttggaacatggacacaagaaattgtcatgcatattgtcctgccacgtgcaagattagctagaataacataattaaattaagggccactaaaactttcgccacagaattaaggtagcctttttgtaaaattattctttaaaggtccgtatatatatgtcgtcgaaaaaagaaagtgaattttctgccttgaggtcatattttactactacttccgtccaaaaaaaaattgcatttctaactctaaggctttgtcccataaaaattgtatttctagccatatggggcccagcaaattgatttatctagataagtttccttaagttctctcagcttgtaatttaagtatgctaattatatgggttaattctctcaaacttccttttaatgatttgtatatatggaatgtgtgcatgcaatgggttcattaaataaggtcattgtggtcatttttcaatcctattgttatgtcctaaattagctagaaatgtaatttttatgggacggagggagtattgtacatttgatagtgcggcaataaaatttattaaggggtaaagatgaaaccgatatgcatgtcaagagaacatataaaatgcacgaatatctttttttaataagcaaataaatcaaggttatattctaattctataaccatgatacctactataagaaagcacatgttaatagcttccaaactagtggcgcccatagctggatagcaccaagagccaggatgacaccggaaacaaagccaataatgtaaattttctacagaaaaaaaatctcgtgtagaccgatagagtagctctaaagggagcataactttagatccgtacatgaggaagaaaggggtatctttggtgggtgtagtcaaggtggtacgaatggcccacgaaacaaaagggagctcctcaacccagcttgaatggcaggtcatgagcctattgtatacactatcccattggcccactcgacttgcttattgctctgaggatgggaaactaatgcggagcagatttttatgttgagttcgaagcagtaatcctgaaaggtaccgcttgtgaattgggagccgttatctgtcaacatctgatatggaagcccgtatcgatagaatatccctctgatgaacttgatggcgtgttcggctctgatttctcttgttggctccgcttctatccacttaatgaacttgttgatagccatgaataaaaatttgtagtcgccttgtcctcgtgaaaaatattcgaggatgtcaagcccccaacacgaaaacgacataaggatcgtttggagggcttgggctagtaacttggtatattttctgcttccgtatcatcttccggtaacttgtcagcgttgagaaaatcgatgagcggtgtgcgccagtcctaagtggtctcaatgtccgtgatggttttgtcaatctgagtagtagcttttgagctaacgttggtggtgctattaatgttgccgtctggtgaactcttgatggatcgactagttaatacttctaggaatgtgtcaggttcaacctgctctctcctaaaagctcgtcaggcaaggttgttggcatcggcgttatctttgtgatagacatggcacacttcgagcccatcaaacctacgctccaactttctaacttctgctagatacttggacaactcgggatttgagcatttgtgatccttgtgcccttgattagcgactatttctgaatcccctttccaaactagtcgtttgaccacaagtgacgcggttgctctaagtccagcgagaagtccttcgtattccccattgttgttggttgctcagaaatctaactagtcagcatgtcgaaactgatcttcggttggtgatgtgaaaatgaattcagctcttgctcattggctgttaaatgcaccatcaaaggccattgtccaatgtttgttgtccgtacgatcaactttgtcctcctcggggacggtccaatcggcgatgaaatctgtgaatacctgacacttgataatcgttcatgggtgaagtggacatcgaatcgataactttataattagttttcaaagtatatatttatataaattgttaaaaatataattatatgaatttttttttgacaaatctattggtataattttcgcattttcaatgtaggcatagttgcatacatgagtgatttaagattttaagatttgacgacacgtatagtagggcgcctttcttttcagaagagaggtatacatcatagcatgctacctctcactttcaatgtatatttcaatagagatagtcacgtttgtaaaaccgtactcggtccagcaatgaaagcatgcctatttggatgagtaacttcagaaattaatgttatttaattgaatggatatttgaaaatgataactttatatttgtcccaaaggtacttttataaagtatttcggagattttctaatcagaatttttctaacgaaattttgcagtggaagtgaattgtcaattttgcattttgacaattgcgtccatatatatctaaagcgacgtgtttttcatgactggaagatcagtatatatgaccgggggaactgtctgtaataagatgtttaccataattaatgaacataattggtctatgatgacgctctgcagtgaattaggctcacagtttcttcacgttaaaacattggtcgatgtgatcgatacagtaattaggagtagtacactactctatcgttttcatcgtccatataggagagaaagcaacttggtcaattaattgattgttggacgtttggccaaagtccatgtctctgaattaaggctttagaaacgttactcgctttgacctttttttttctaatcaaattttttttaagtttgatcacgtttattggaaaataaagcaatattttcagtgttgattttaataaaactaatttaatattctagatgttgctaataaatttatagatttgatcaagtttgatttagaaaaaaatagaaaacttattatatgagtaatatttaactgatcgcgacgcgagaacacatgagatgccatatcgccatcctcctttaagttaattgaccgtccagttggagtgtaagagtactcaaacacaccattgaaagtataatcatataaactctctcttttgggattaaatgatactccatccgtattttaatgtatgacgccgttgaccttttgaccaatgtttgaccatttgttttatttaattttttatgtaaatatgaaaatatttatgtcatgcttaaagaatatttgataacgaaacaagtcacggtaaaataaatgacaattacataaatattttgaataagatgaatgattaaacgttggataaaaagttaacgacgtcatacattaaatacagagagataggtagtatttgaagtacaagttgaaagcgtacccacactttgatactacaccaacgtgtagacatgtcctagcacatgtcttgacaagattagaggtctaacctcgcgtgagtacggtcacgtgctttaattcggatcctctgtaattatgaagagactacagagggagctacagtgtatgttgttggtccacatccaacggtccaaaataaagtgctacagtataactaaacagtgaatgcgagccgtaattgttgaaatagtaaaagatcgaattattgtttaattagtagtatagccagctactagcttcaaatcatttataaccaatctaatagcttatttatataatagttaactacaaatatatactacgaccgcgttctaaacagctaatgcagcttagctattcctcgtttttcattagcatacttttcaaactactaaacggtttatttcgtgtgaaaattttctatataaaagatgctttaaaaatcaaataagtttattttttatttttttttaaataataatacttaactaattacattgctaatcatgtttctcgttttacgtgtagctaatcatcatcacccaactgctgaaaagaacgcggcctacatcattaataattggtctcactgtctcacttgtcatacacacagcgttttggagtccgtgctgcaactggctataaatctgtagccccacttctcttctctctcctgttttatttcctccacataagcttgtagccgacttatagtctattattgtacaccattaatatatggtcccacctctcatacacacacaacgtattagagtccgcattgcagttggctataagtctgtagcatgttttcttttttttgtttttgatgggaagcctgttttccttctctcttctcttctctccttcatatgcttatagctgacttgtagaactcgatcttatatagtactttaccacagtatttggacactgttttactgcattgactcactgtagcagactcagcatattgtgctgcagtctcactgtagctgcagtgcttctccgctgtaccttgacgacctggatctgtgcatgtactacctcttaggcaccgtttggataacggaaaaggaaatgattttccagctatgaagggataactttaaatcctaaccattcatttttttctaccttattttatcctaggtcttaatttatttcctgtaggatcgaacacaagcaatcaaacctaccagagagggggtgaatggtagggaaaaccaaaaacccaaaaacttttagcggaaataaaagttaccctcaaatcgatggaaatctcgacgtagtcctgtcgccgccggtcggattgctcgtatgccgccagtctaaccgccgtcttgtcaccggttgaaccgtcggtatgtcaccggttagaccgccgaacccgatgaaatacaaatcgaagaactctcaaagtagatgacaactttattgcttctctctgtgtttacaaagtgcaacaacagcactccttacaaaaatctcgactaatctcgaaaccctaactaaactatcaactccacgctctgaaaagcgataccgggaggctacctctccctctctatttataccgaaaacctcctactcaaagtaggagaacaactcctagtcacactaggactctatcctcaattaccaaacctaaattgtaattctctcaaactacagccgcacgcatctcctgtaccggctcggtctcggtctccatcgcacgggacgacaccaacttggcctctctaccttgccacatttcccaatcccaatcctacccctcattttccattatccaaacatagccttaggattaaattctaataatagatacaaatgctcatgctaaggccgtgtttagtttcaaatttttttcttcaaacttacaacttttccatcacatcaaaacttttctacgcacacaaattttcaacttttccaacacatcgttccaatttcaaccaaacttctaattttggtgtgaactaaacacaacctaagtctttgattcgagttgggtaaaaatattttgccgcatgagttaatgatacctcaattcgtaattaaaaatgatattttactaatatgtgacatattaaggttgcgttgttgttgtctatattgtgtattttctttgtgtttattttattctgtaaaaatataaatttataattgatgtcactaatatagattcgatttttctatacggccaaaatcaaattttgcatgtggacgggcggcccgcatgcgcccaaaggtctgcgaaaattggatttttgcatacgaccagcacaacctcatgcgattttcgcatgcgagcacttaagctgaccgcacacgaaaaggaaaatcatgaaaaaaataaaaattctgaaaatagaaaactacaccgtcgctaccatcgccgccgtcctctcgttgcgattgccaccaccgtcctctagtcaccaccgctgtcgtcctcatcctccagccgccgccatcgacatcgtcctcctcccatccccaccccgtcgtcatcgccaccgatggatccttgcaggaggggccgccaccagatcggggttggggagggcaaccaccgattaattaatccgggcggggagggtcactgccactggatctgggtgggggagagtggtggcggccagatcggtgcaggggagatctgccgctgtcggatccgagcgggggaggaccaccgccgtcacccacgcccgtcgccgccatcccactcgttcaccgtcgccgctggagcctgcacctgtcgtcctcgcgctccaccgccatcgcccttgtcctccaccaccaccctcgcccgccactgccgtcagagtgagggaggagagggaagaggaatggggactaggagagtgagggccgccagatccacccgggggcggtggcggccgctgccgctccctcccgcttggtgaggagaggaagacagagaggataggagagaaagagagagaggagaggagaggagaggaagaggtgagaggaagagagagaggagaggaggtgaaaaaatttgaagtgttgagagggaaaagagagaggaggggagaaaatatccgtggaaaagaagagcgtattttcgcatgcgaaaatctatttttgcatgtggccccttaagaggatcgtatgggaaaataagctcattttttcatgcggctctctaagtggcccgcttgcgaaaatagatttttgcacgtgtgcctcttaatgagccatatgcgaaaatggagatcgatttttacacgcatgaccaattacattccaattgtaatatataggggtccttgtaaaaaaattagtagcgtgtgtttgtttacatatcaaattacaattaaataaaaatatgttttctaacttttttttgactgaaatatgttttctaactttgtttaccttaccagctgaattatgctcagttcacaattgttttatatttttagagcatgattatattatagtttgcataattaaatctaaatagaaactatttaccaaataatgaaatattaaaaaccgtcacaaaaaatattgttactaattcactgcaatacgaaatgcagcgtaggacttctacgaatcttcagggccacttgattattcatattcgtacctaccgtaatcttcactcaatgcctgtcactttgataatctaaatttgttgctgggttcgttttttaatagatgatactgttaaccttttatcacacgtttgactatgtatcttattaaaaaaatttacgtaaatataatatattttgttatgagttgttttatcacttaaattattttaagcttgatttatatcttatacatttgcataaaatttttgaataaaacaaatgatcaattgtgtttaaaagtgagtgtcgtcatctattaaaaaactggagggtactaatttatgatatctatcatgcatatggaacctcctcacgaagtcacgagccacgtttttctaacaaaactattcacttgctttgacacttgcgctctaggctagctgccatgctttatttggtagaaatatttatatatttattaatccatccattagcaagttctacttaacctgtcatcaaaagatttcgaacatggacatagaaaattgtcgtgcatagtatcctgccacatgcaagattagctaggataagctaactaattgagggcccctgaaactttcatcacagaattaaggtagccttttgtaaaattactctttaaaggtccatatatgtcgtcgaaaagaaagtgaattttatgcttctaggttgtattttactattgtacatttggtagtgcagcaataaaatttatcaagggataaagatgaaaatgaaatgcatgtcaagaaaatatatatgtatataatgcacgaatatgtttttttcaataaacaaataaatcaaggttatattctaattgtacaaccacgacacctaatgtaagaaagcacatgttaatagcttccaaagtcgtcgcacccaacagccaggctgacaccgaaaacaaagccaatcatgccaattttctcaaaaacaaaaaaaaaaatcttcacacgtagagttgagatcttaggccctgatccagatctcacagccttaaaatttctagtaaaatgttatatctttatctaaaatgaaaataaaataatttatctaaatgttataacgtaatagcagatccagatctgtggttatgtagagttaggaatatccagcttataaaatcttggatttagagttataccaaacaagatctatattagtgccagtacatatgtgcatggttttaataggaatttagggggtgtttagatccaggggtgtaaagttttggtgtgtcacattggatattatatagggtgtctcatggggtgttcgggcactaataaaaaaactaattatagaatctgtcagtaaactgcgagacgaatttattaagccttattaatccgttattagcaaatatttactgtagcaccacattgtcaaatcattgagcaattaggtttaaaatattcgtctcataaattagtcgcaatctatgcaattagttatatttttagtctatatttaatattttatgcaggtgttcaaaagttcgatgtgacagggtgtaaaatttttgtgtaggaagtaaacagggccttaatgaagctagttatttatcgctagaaattagtcacggtctcgtgcgtctcttacaacgtttgttaagagaaattctatgtgtactaaaaaattataggttcagatcatgatgcctacaaatattaatattgaatatatatatatatatatatatatatatatatatatatatatatatatatatatatatatatatatatatatatatatatgaatgtgttttttgcatatgattttcaagacaacatattggctccgattatgggctcttctacaaaaatgtgacgaagacattaagtttataaaagttgcatgttacaaactggagttatgtaacttttcaccaatcttgaagggaggttcacaaataaaattcaataagtttgtgctttatctttttattagtgtttgtgtcagtgtgcgcctctatcagtttggattgtcccttatgtcttaatgtcttcttttgaggtgtgattatgtttggaacattttttaataattggatatagctctgtaaacaaaggccgtgattttatttcattatctaaaatttgaatgtgttttaacatgagtttttttttaatgcctagttattactattagtctagtactttttttttcttttggcgtgtgttaggagaaaccttcccaccgtgtaataaaacaattatgaattattcatccagacgtgttcccgcctaggctggactgatctgtacgttacagcagaaataataatatgtcaaattgtcaaacagctgcatatataattcacctatttccaattttttattaaattaaaaagagattaaatcacctactcttctccaaacaaatcgctcctggcacgcgaaacaacgacaaccacacaaggcggtcaaagcgagggaagatagcaacaaatactgccgaattgcctggggaatcttgaggatctctccagatccggagtcaatggattgaatttttatttctatttttacatttctttttttcccaaaaaaaatattcatttttaggtgccacaagaatcttcttcccttttttttgttggccctcttgagagaagaacaagaatctcttgatggttaattccttcccttcttgcgtgtcagctggaggagtgagtagtagtagagagagtccaacaaaccccagctgcctatctatttaacctgaagaattctatgcagtgacaaaggctgttgagacttgagagttcagttcttgagttctctggaggaggagcagttcatccctttctctccttctgactttaggtaatgtgttcctgtcttttgatctttgatttgtcattaattagcttgtggtgatgaatggtttatgtccggcatgtctgctttgttatctgtttcgttttgtgttctttgtattcgtgagtggaagtcgatgttgattggttgtttgcttcctcttttttttaaaaaaaatgatattttggggagaagatgatgttcttggttgaaaatcatcggcatgggtctctcttttttgttggttttgagttcttggatccatgtcagtttatgaatctcttgttctattgagaaatatttttgtttagtttgttgcttaaaggaggaaaggaaagattcagtagacgcatcattttcttgttggaatcatcaaaaaaaaattctcttttaatgcgcctttttcttagataagacgtcactgaaagaaatggatagttgtttatatgattatatctagctaaagagtacagttctctacttccattatttttcactctttgcattcttggacaaattcagtgcccaaattgcagataatacctagttagatatctgtatccaagaaaaaaaaaagccttgatatgtaattcattagacataatggtgtcaattgccatatgttcataaacttgtggagtctgcaataagtgatatttcagctaaaaatcatttcatttcaaggttattgattggtggaggagagtatccctagatgtcactatcaccccattccattattttcagcaaatgacgagtgtatagttgtctttttctccacctcttttctctccatttctccctcctcctcctccataaagctccaattccattgggtgatctgcgcatgagaagacgccgcgaattcgcaaattgctgcatgagtcaaacttgtgcagatcaagttggactttttgcgtttgaaagataccattagcttttgttttggtaaccagtgcttggcactataagtagtatccatggaccatgtccttggttgtgccacttctttggtttcatgccaaaaggtactctgctctacttgcttgatgttcttcttccccttccttgtgtgtttatgtgtttaattgggagtttggatctcttctcatcctcagcagaatctgatctttgaagaattggggatttagggttccaagaactgggagtctttcatgctgataagtgataaggatagcttatccacaatttgggatcttccctatggctgttggaatgaatttgatttcctgatttcttttccttccttttttttcttgtgtttcttgtaatgatattattgcttgctgtaacaagcaagaatgaagagatggagatttgaggacagtattaaatgcaaaacactttctgattttacaagattttgtggataacaactgcaagatcttgaaacttcttgatgattcaatccaaatgagtagcagctcaaccctcttacatgatgaaaaaatgtgttttattttattttttgtcaggtttttgaaggcccccttgtgaattccctgttgtccatcagacaaggaggcctcaagatgtacatcatagaggacaaagggggtgccattgccctcatgctggcctccctcttcttcctggggacatggcctgcggtcctcaccctcctcgagcgccgaggccggctcccgcagcacacctacctcgactactcgatcacgaacctcctcgctgcggtcctcatcgcgctcaccttcggtcagctcggcgatagcaagcccaacatgcccaatttcttcacccagctcagtcaggttagccaccttctcttaagcatctgaaatagtatatccctgaattaatacatttctgattgttagttagtctgaaattttgctgacagtgatttttttttgtttgcaatgaaggataattggccttcagtgctgtttgcaatggcagggggtgttgtgctcagtatagggaacctctctactcagtatgcatgggcatatgtaggtctctcagtgactgaggtcatcagctcaagtatggttgttgtaataggtaggtaaaacttctcttttacaacactgcaacatatattattgtttgatttttttttaagtaaagaaaattgagggaaaattattgattcttggtgatacatgtgaagtacagctcatcacaacctatctatatttatgttagtcgaagaaactgaataattaggttagtaatagtatgaatacattatagttggtcctactcctgaaaagaacatatattcagatcaatatctccagtttactttattcagtagctacagcaaactaattgctgtatccattattattgtcctaattattcagtagatcagaaaactcacatgttggatcttcaggcacaacactgaattatttcctggacaaccgcatcaacagagcagagattcttttccctggagtggcctgcttccttgttgcagtcattcttggctctgctgtacatgcctccaatgcagctgataatgaagaaaaactaaatggctccacaaatatctataaacttgggtaagatatttcacatttttcaacacatcaagatatttcacatcaagatacataaaacacattacacactggttagcctatctggatacctctgttagaaaatatattatgccttaggttccaatctatttaaagattctgcgtcttttaatttactgacccctatgatcttaataacctgtaatttccagggaaaatggaagtgtggaaccaaacaaagaagtcatagaaaaaggtatgccataaccttttctttaaaaaaaaaactgactttaatgttgtaagtactagtaatgttgatttcttgcagatcagatcctagttcttaactctgccaatttcagatgctcccaaggacttggagaatggagcttctgcaaccaaatatgttgccaaagctgaagcaggaactgcggaatacttgattgagctcgaagaacggcgttcgatcaaggtaattcggtcactgccattctaatcatcctttatcatgcttgttgaatcaataccaaaattatggatgaaaacttgtaccaatgaactagattgatctgatgaacctctccgttgcgcaggtgttcggatcaagcaccttcatagggcttgggatagtgttcttctcaggagtctgcttctcactcttctccccggcattcaacctcgccaccaatgaccaatggcacaccctgaaacaaggtgtaccacacctggtggtgtacaccgccttcttctacttctcgatctcgtgcttcgtcatcggcatcggcctgaacatcctgttcctctaccgtccaatggccggtgtgccgaaatcatccttcaaggcttacctgaatgactgggaaggcaggcagtgggctctcctggctggcttcctatgtggctttggcaatgggtttcagttcatgggtggtcaggctgctggctatgctgctgctgatgctgtccaggttagtccaatctccaaatcttatcatttcttcacatcagaagagaaattcatcgtgttcgcgatggctgtggcgagattctagatctttcagacaaattctcttcaagtttagcaattcagacaatcttcagataactgcaacttattattctagatctttagataaattcagatactgaacatcatactagatcttccaggcaaattcttcaggtttagcagttcacactatcttcagagaagtacaacttttctggactatgattctaactgcttcagcattgctgtttcatcaggcattgccacttgtgagcacattctggggaatactcctgtttggggagtaccggaaatcgtcgcgaaagacgtatatcctgctcgggttcatgctgttcatgttcatcgtcgcggtcgcggtgctcatggcttcatcaggtcacaggagcaccaagtgattgattcaaatcctttcatctcttgccttaatttggtgtttgcaagcgcaaaccactcttgctgtcagaaaacaaagaagttcaggcagcaatgcagggggggacttcagtccaggtctccaggaagcagatcatgccaacatggaatgaaactccattcatgaaatttccatttggatggagctgtacataaggggaaaaaaggaacaaactaagatagtttgtggatttgtgattttaagtttgtgtcagattatataaatgtaatgttatccctttctctgaattctaaaagacccatttgcagatagcatagggaaatttggagttcacctgaatgataagaaagatagtaactgttttggtttcgatgctgatgttcagtgcttaaaatttgaaatggtacatgacatacgagttgttttaataatgtccctgttattggtgaaattccaaagaagctgagcaccagcaacagtaggctcaaacgcgtacaaaatggttcattcttgaacaagacaatgcaccaaaagggagaaaaattacaagatggtgtgtatttcgattgaataataataattagttcttgtcattctgtaccacaaaccaatgaaacaaatccaggaagaaagaaaacggctctactacacatatcaaaattgggctataaaccagatatatggcctttttgtcgatgtgctaatctatcagcatcaactgggacaaacggtaaaagaaaactactttcttgtcctcttcagcgatttttctgtcgtgtcttcagcattgcatgacctgtttcttccaagtgagaaaacaacttgttcctgcaacaagaagtatttgagacaaaccataactgcgtttccaatttcattgtaagatagcaacatatgatgggaaagtgcaaatgaaagggaaggagaggaaaaggaaagctgaacttcaagtacataccttgagtcaaacgttgatccacacgtttcacagtcattactgggtgcctttgaaacctcctggtacaagaaggtagcttcaaagtgttataactacttacagaaatatatatagaattttatgaatctatagacaatgcatagcacaatattatccacacaaaatatatccaaaacatgtcatgggtactcaaggcatggccgaattttggttttaagctcatcgggttgcactaacagtagacagtgaattagtacgtataaaacttttccacatttgcagcttcaagttgtatgttctccaacaaagtattttgcactagacatctacatgatacagaacaaacggaagggctctttgctctaggtggcactaatctactttttaatcaaaacaagataagaaaatcgtgataacagtgaaaccaggggggcttccaagattctttaactctgtttgcaactgtgtacacacccacaaatttagaacaaatacacagaaagctaaactgatacgccaattatagatcaacaagttaaactgttaacagacatcacaggaaaaggcataatatactaattgacatgaaaccaaaaaaaggcttgtctccaacaagtatttcacaaaatcagtgctatcaaatatttcacaaaatgctgtctccagcaagtatttcacaaaaccaagaaaggctgtctccagcaagtatttcacaaaaccaagaaaggctgtctccaacaagtatttcacaaaagcataatattcattatccactatgttaatcagtgctatcaaatatcatttcaacctatgcaaaatcatcctctaggtttctttccaaaatgtgaaaagcaagagcaagatcactgctactgtgctgcacaaagacagatttagggttttgcataaggaaaaaaaatcataaaacaacagcaatccaacatgtgagtgttgatacccgcaaaaatcataagattttcaggacaagtttcttttctcacaaaggaagcaactctaatcatgtattccacaaaattcaaaacattggttatttcctctataaagtagcacagcttttacgtaagcatttctaataagtggcttagttaggtggttcttgaagcacctacacggctaggtatctgcatatgtgattcacatagtactgatgaggctaaaagtttttgctctttgacttaaacagagaaacagaatacatgggttttagtcacaaattcataacaagtttcctgccaactatacatgaaaaagaaatatgaagaagttaacaggagaaaataatgtgaatgtaccttttgcttctttcccttcgatgtacccttttgttcagaagatatagttgtgttcttttctgtgcctttcttgttctttttagtattaccggtttttcctttctgctgatcttctttacttgctgcagcactgtcttcattagaagatggaccttccatcttatcatcagcaccattttcatcattattatgcctggattcctcaggctgattctcactcttcctaccttgcccattatcagcataagtacctcccttctttgctgcccgtctccggcgtcctttctttttgacattattaatctcatagcttgtatcctcatcgtcatcatcatccatggcaccagctggtgaagcttcctcctgaggagcgacaaaaccactcttcctattcttgcgcctagacctcgatagcatttcctctaacacactggtttcatcatatgaaccaaccttttgttccccattacccaagtgcttatcacccttctcttcttcatcacgcacctccaatccctcgctcaactcgtcagccaactcttcagcagcatctgaaaattcactctcctctgattcctgtgcacgctgaaaatcaaaccccacatcaacttcttctggctcctcttcttcagcatccttcaaagcttcttcctcttcttcaaacaccatcctcagctcggacaccttatctctatgcttctttgactgctcatggttcttccactgcttgtcggacttgaacttcttattacacgccacgcagtacagctcctccttcctcttcgccctcgtctcctcctcctcgtcgtcctcaaacaccgccgcctcatcctcgtccaccctcgcccactcgggctcctggtacgccatcgctcgctccttcctcctcctctcctcctccttcttcctcgccgcctcctccgccttcctcttctcctcctccaccttcttcttcagcgccatgtccaccacccgcttgtccctcttcttgcagaacgcggcgagccctctcacggcgtcgttgtactcccgccgcgccttgcgcgtcgccttcttgttgtcctcctccatgagccgcctcacccggcggctctccccccgcgcggcgtcccactcggccgcccacccgaagtccatcgcggtgccgaacccgagccagtagctgtagaacgcggcgacctgcgcgtggggggaatcgaggttcccgatcaccggcggcgtggggacggcgtcggcgggcatgcccatgcggcgggcgtaggcgagctcctgcgcgaagacccggtcgaagacgtcgccgtagaccttgtagaagccgcggccggagtcggagaagccggagaaggcggaggaggagaagaaggcgaagaggtcggggacgggggacgcggaggcggaggcgacgccgccgccgcggccggggccggaggaggggtggtggtcggagaagaggatctgggagcggtgggagtcgtagtaggagcgctcgtgggggtcggagaggacggagtgcgcgtgctggagctcctggaaggcggcggtggcggcggcgacgtcggagccggggggctgcttgtcggggtggagggagagcgcgaggcggcggaaggcgagcttgatgtcggccggggagcagtcgcgggggacgcccaggacctcgtagtagcaccgcttcggcgccgccgcggacgccatggccgccgccgccgccgccggggaggaggaggaggacgacggcgaagcggagctagggtttcaagggggagggggagatgagtgttgtttaatggcgagcctaactctaatctaacctctctgtaataagagggaaaaaaaaagaggtagaaacgggtttgtaataaaatccgtttgtaatttgttttctctttcgtactaatttcgaatattgtttcccttattcgtatgcttattcggatcggttattaaccaataaaaaatatttgtcggtaaatgttttatgcacttctctttagcgactaaataaaaacagatgttgtaaaataaactacgatgaaaaacgaaaaaaaaataaattcaaaatcaagttctaaaatttaaattttagcttataagcataagcatcagccaaacaatgaggcccttcgtatattggcgaaggagaaatttttaccttttaaacaaaatttggcattccataaaatctttaaatccaaacactttacacatatgacatggctactgatacgccagccatcacgttgttgattggcagtaaagctagcactctgacaaaaggcttattcaaaaaatattagagagattatctttttcttgaaaatattcttcaaaatatttcctcttagcaaagaattggttcttgacgaaaaagatcatatccctcaaaggattggtgcttaaacgcaagaattttataggaattttaaaacgaatcagctcaatttctttgaaacaccccatttcaaaggaagtctcaattagttgcatgcaattaaaatgcttaaagcatttgctaaataatggacctacaccaaaatccatattaggactaaataatatcatttttttaatacaaatgtaggatgcacagcgcgctatatatatctacgaatacgccacttttaacacaacaaagagacattagggaaaaatccataaacctcaaaagaaaaaaaaactacctagtttggttacctgaatttgaaccttaacaaattaatttatgcaaccacacctacactccaacatcactcaacaccatgttaacatgaaagaaaaacaaataatatcctcctatattctctctccctctctctctctcagcatttacattagggatagcattagaggagtgcagatcctctgcagtactgctggtgcaggccggcagcaaacattagcactagcagtagcaggcaatccccgttgttagagaagttgcagctgagttaaatgcaaacatttctttttcagttttcacttttaaaatttttttattctccctctatttataaacgtttgatgtttagaagaagattcggtcaacttttgaaaatttgatcatcaattttatattataacaaaattataaaatataataaatttatgctatattatgatagtattttgcctaagcaattccatgcgtaccattcttttttctaaataaaaagctaagcataccagaagttatgaatgatcaaagtttaaaaattttgcttattaaagttttggagtacggtggatgattagagtatactatttacaataacacgtgagagagctatgcttactctgtgggcatggtctgaattactagaatataatacctcaaggagatattcttactcatttgttctcctccttagctgcaacaaaaatactaatagaatttctaaaaattttaacaataagtgatatatattatttcacaaaaaatcaagactgaactccaccacacaaggataaaagagcatatttggttggagatagttcatgtgcatttttttaaaacttaaagatacttcagaaactattcacagccaatctgtcatttttttttgtttcatcatttagagcacctgcaatggtaaagtaaggtgttatctataaaacatgtacatctcagtaatagactagattaatagtaaaccacttcaatgatatacctacatgggtatctatagctctctaatccattgcctcgtttttttctatagactatttccaggttagtagataactttgctctctctctttcttcatttaatctcttccaagtagaaaaatatgctgacatggatctcttgtagagagcctatagataaccattgcgggtgcccttataagtcatgtatacattagaagagtttcctgatgtggtcaagtgtatgtgtggactatatttataaacaattctgcagtaaccaaaaaaaaaatccaagctttgatttatcaacaaatgtaccataacaaatttacattagattcaatggcaatcacttatttgaaatgtcctaggttggtggcgtcgcgttcaagccaacactattatttatggactatttggtctgacaaatcattcctagcctaattggggatttgggatcttgaagttccactgaaccaggaattcttcaaaccaagaaacctcacagcaaccatggcttcgcaattgaagtttaccgccgatcaaaccattggatcatcatgtgtgccttgcaattgatatttgatacacaaaataataggtcgactgttctctaaagaaaaaagaaagagaaaggaggcgtgcaagacctctatactattacagtgatgaggttttccagacgctgtcaaacttccggtgctacaaaataagatgataaactgttattgaagaacacaactaaatggtgtttcttggacagaagcaaacagcatctccatgagagtattacctcagagattggcattttagttcgcacagcctcaacttttgacaagtctacatctgcgacagcaaacccagtggacagccggtctgtagccaaagtttgatgattaattcctcagaacgatatttaacgggcatactgtgacacactcgttccacataatttcagaatattgtatttgaacaaatacaaacacgataaatgcagtatggtaatggcagactacaatattttccaggacaagttcaaacttcagtgctagcaaatattgttgaggagttcaacagaagatcaataaaatcttggtggttgtcaaggtacaaggtgctgataaaattcaagaaaaccttcaaaatatcaacagaagatttctgatagaagacagtaacaaaatgaagagatatacctggaagtcgagctataactgttccccatgggtcaataattatagaatcaccatagctctctcttttctcattgtgttttccagcttgagctgctgcaataacctattgcaaatcttgaaaatttaacaataacaaatatgtaatgcatatatggtggattttatattattgatcacactcccaaccatatgaaacagcctgatgtgtctgcaaaagtgaaagacttataagagttaggatttgcatacatagcattgtgtctcaatggcacgagctcggagaagaatttcccagtgcgcctccccagttacttttgtgaacgcggatggtactagtaagacctaaaaaggtcactggcatattagaagaatactggaaaacaatatgcaattcacctgagctttcctcagagatatgacaggtatgcttaggataaggcaatcaggaaaaacttatgtcagtataatgccataaatcactacctgagcttgatgcttaaagcgcaaacattggtaaagctctggaaatctcaaatcatagcaaacagtaagcccaagtcgtccaaaaggactatccactgcaacgacagtatcacctgataaataaataaatacaccatcacatatagcgttatcaactgcaacccgacgtatgtctcactccatgatatcactattgcagtattagtttcaatcacttttcaatcaagtcagtttatatttggcttcagaagaaaaaaagcttcagttgataatgcctgacccaaggatatgcaatgcatactaaagtttatgtagaagcataagttagtgtcccatcttgcgctcataaaactatcttgtcgagagtcatgtgcactagaaatcagatagttggcttaaataggcttcaatagttcaatgtgaaaaaaatgagttctataacagagtaacttctagaagaacagaaactaataagatagtgcaggatggtgcagaccaaaaacatctcataaaaatttgttctaagactgaatattgaactgatattgtggtagtggtacattgactatgacacttaattgagcatattaaaaagtacatcaagaaactgttgataatttaggtataataaattaattctagaataatttatgtgacaaacacaacattccgcagggggatttgaaatataaaagtacaattggttaagtgatattttagaactaactctaaaaatttacatatcccaatatgacaaaactaaaatatcaggaaatatatcagtacctgctgtcgtaaaacgactttccttgtacaccatattgcctggtacatctacatcaaaccttcagcgtaaaaatgtgaaggtgaatatctgaacaatgagatgttgcagtgtaccataacaagcaagaagaaacgaagaaagatgcaacagttgtcttgcgtacgaccaaaaatttcaccatttagacagtaaagtaatgcagaaatatacttctgggatattgtgacgatttctcataaatctattttatccatggctattgtaagataaatgttctcttgttagaaccaacaatcatatgaaacttctagtacttaactgcatagcatcaaatatcatgcccttactatgtcaacttgaaaaaactactgttaaaattctaagaatgcctaaaataggcatcgcaagtaaactgtttagaaaattcttgaaggcatgtttctcctaagagctgagaaagaataagcacctacagatgtattttccgatatgagctcctaatttctccagaatcatcaattagtacatgagtattgtactggtgtgaatcatcaggacccttttcttgaaaccctccaagagacaaccacatacttgattccctgcaggatgaaattatgttaagtcaaggactcaaagtgctatccgataaccaaataaaatccttaaaaaatacaagagaaatatgtttcaagactcaagacacagctagtctccatttggccttgtgtggaatggattagtcatcatatatcatatatgcatgttttgatatttggctagttcttttttctagattgtgttgtgaaagtggtattattgtgttctgcctccacataacaaaatatatcagagaatcgcatatcaaaggttcatgctagaggaaattagaaggattaaactattacatgacaggagttgttaagctacagtctaatttaccaaacagggcactgggagttatgaaatttacttatttgcggtagctttcaaaataagcacgacaagtgcacactggtccttaaactggaaattacagagcattagatagattttcattctttctataagccaaaacaatttctaagttaacagattgaccaaatgttcatactgaacaaatgatcagaagattcatttgtacaattgtaaggcacagaagtcaagattgagaacacaaaatactaaatacttaaatttaatatgtcatataatgtgaactctaataaataaagtaaattgagaaaaggggttcctatgaagaggcacttatatgtaatggcaaaatggaaattcagcaagtttgttcttactaactttgcaagtgagcaatatctctgcattattgggccatctaatggttcagcaatcttaatagactcgccatccttggagcctatgaatgagaatacctcaggaaagcaaagaaatttgacaccagaggatgctgcttcctgaagaaaatgactctatgttagtccccttggcattacccaacaaaacagaagaacaaaaaaaaaatggaagtacaattcatatttcagaactacctacaga

SEQ ID NO: 26999 - DNA, 4307 bp, Oryza sativa
tcatctataaataatactccctccatttcatattataagtcgcttcgactttttttcctagtcaaacttcttttaagtttgaccaagtttataaaaaaatttagaagcatcgacagcaccaaattggtttcatgaaatctagcattgtatatattttgataacatgtttgttttgtgttgaaaacgttgctatgtttttttataaactcagtcaaacttaaaagaagtttagactaggaaaaaaagtcgaagcgtcatataatatgaaacggatggaatatatttgttttcccctacaataacaacgcatggttgcgtccgcacaatcccattgtagtaacaaaagcatcaccattcaatcacaaatgctctacaaattcacctgcccgttccctgaaacagaagccaatcaatacagttgttacaaaggcagcaaagcttagctcccactcggatccatccattctacaccgatgaaccatcacattgcttaacgtttatccacaaaacaagagcatatggcatatcaattgcagcttcttcttttttttttttttttgcgaggatttccccaccaaaaccccactaacaacagcagcagagcagagcaagcaggctcgccgcagttgaggaaatatacacggcgaccagttgaagaggtgcgcttgccttggcgaggcgggagcaggtggcgtagttggcgtcgaggtcccccacggaggtcatctgcaccacgcccaccctcgccgccgccgatgcccccgcggccgcagatggtgacgacgaggaggccatcccgcggcagcgggcgagcgacacgcgtgacctcgccgcggcggcggggaggagcgatgcggcggcggcgagggaggccaaggccatatgcgaggagaggattgagatcccctcactaccttaattcacatggctttgagtcactgacatgtgggcccactctgctatggacccagatgtcagtgactctgaagcgcgacgagtggggtagacagtagacttgcccgggtgcgcgtagcgcgggcgggaggacacgtggacggatcctggccgtcggaccggcacggccgttgcctctatccaccgttcgattccgcgagcccacgcatccatccggtcactcgccaactagtatccccattcgccgccgccgccgccgccttcgccgccggcgatacggtggtcagcgccgccgcggccgctcgtatctaaaggtgagaccacttgctgttcctttcctcgcagattcgctgcaagactaggatcggggttgggcggatgatttgggtggtagtggtgcctcaagaatgtcgcagaagttttatctgtctgattagagctctgagattacggatgcatctggatccggtttagggaggaactctagattattggttgatctgatagttgggaacaacttcgttggtgaggtgatgatggatgaacatgttgtgcgctgcttttcttatctagccgttttctctgaattttgtgtatcccttaaaaagggtgtagagcagctgaatgcatgtacaatctcatgcattttgttccttgacacaacattattttgttctcggtaatttagtaatgcgtgcttccgtcgcagtaatttgctcattgcatatttgcacttgatttgctgcttgcaggtatatggccaaaatggttagtcagtgtatctctccgcggcagtcctttcgcgttcctcgtttttcatcagctcggcctacgctaagttcacgtttagcaattggctacgccaacccgtcgttttgcggtgttaaacgctcaaatcgtccgagttttatagcagcagcactggatgtaccaaaaagtatgtcctcccctaattcagagagctccctgcctttgaaaggtatcgctggaaacctttagttttgtgtggtcatgctatggtgcctatgcaggcctgagtctcctaacaccgtgcatgcttcttctcttttcaccagaggttatctgggcatggtgcaatgctgacgcggtgtgcttcgatgttgacagcacggtctgcttggacgagggtatcgatgagctcgcggacttctgtggggcaggccaagcggttgctgaatggacggctaagtaaagatgctgacttttaaagctttgccaattaatccatggaaatttccattcaagcgttcaatttttattttattttttgaaaaaaaaaaaacatttccagggcgatgactgggtcagttccgtttgaaaaggcattagctgctcggctatcgttgttcaagccatctttggggcaagttgaggactgcatggagaagcggccaccaaggtaagctcctaagtattaatgattcttaggtgtttcagcctttgggggggctgtagttactactagccagaactagatggtttgctttcttttgttttgtataactttcagtgaaaatacacagatcttctgcatttctcaaaaaataaaatcgctactatgtttccatttttgggatggccatgccataagagaatactaagttgtttttaatccttttctccacacgttttcatgttttattttttttcaaattggatacagaataacagaactacttgataacttcttgtttattctaaataaacaggaatttatatagctcgttgttcaaatattagctgtttctcgtaagaaactgaccctgactttttttataaatttgctacaaactatgatctatctagatatttgtgcgtcaagcagacacaacgttcatgttccttggatgtattgcgttgattgtatctagccttcacatcctactatattttatgcaaatgacattttatcgacagaatatctcctggaattgctgagcttgttaagatgctgaaagctaaaaatgttgatgtgtacctggtttctggaggcttccgacagatgatcaaggtataatgattccattgttggatgctttcccagtgacattccaggaaagtcaccgtacgtgctatactttgattttactccgccaacattctgttgttttcagctccaatctttactttaacttttgaataggtccactgctttagtattatgtgatgttttttgccccctcttgaggaaccgatttcaaaaaaattggaagaacaaaggaaggttgtggcaagaaatatttgatccatatttcttttgatgcatttacactcctggtttatgacaagctttagctattttcaagttgctatttcttcacccagagtcagtctttgacttaccctttgctctttccatcagcctgttgcaatgcagctcggcattcctcctgaaaatatttttgcaaaccagttactgtttggaacttctggagagtatgttggttttgacccttcagagcctacttcacgaagtggaggcaaagctgtagcagttcaaaacataagacaggttctgattttaactctccactctgccatgttgctgcttattaagcacattgcttatgtacctttgtgtgtgcagaagtgtggttacaggacactctttatggttggagatggtgcaactgatcttgaggtactattattgtgtccatagaacaatgatagccctacagtaggcatagcattaccattttcattatatgttaggagtacactgctgccacaaaaaaaaatgggataaatgttagcaagaaaatgcaaaaccacatatactgacacatgtattacactactaccttaggaatacaaagtattttgatacctaaggaagaccatcccaattccaaatcaataagagactgaatggccaatttgaattttaaagttcacataaatcgtgacaaatttgttgatgttcatagtatgtattaacgtgtatatgtaggagaaacattctcatgttaacaaactatttatgctttcatttcatttagcaaaggaaacataaaaggggtcgaactatttttcttcctcagttactttgactaatgagatgcatggttttttccttcatattttgatatgagcttttgcaatgaactttttccttcatattctgattttagcatggtgatgctgtatcgctgtattggctccatgagtagattagttcataattttgtattggttaactgttggtatatcataaaggaacttctgtgtggatggaacttcagaaacatcttaaactatgtttttcatgtgtgcaggctcggcaacctaatggagcagacttgtttatctgctatgctggtgtgcagatgagggaagcggttgcatcaaaagccgattgggggctgcag

SEQ ID NO: 27000 - DNA, 467 bp, Oryza sativa
ctactaaaaaattataggttcagatcatgatgcctacaaatattaatattgaatatatatatatatatatatatatatatatatatatatatatatatatatatatatatatatatatatatatatatgtatatatatatcgctgtgtgtctctgtgtgtgtgtgtgtgtgcgcgcccgcgcgcgcgcgggggggcccacacccccccccgcccccgcgggcgcgcgcgcgcgcgcgcgcgcgcgcgcgcgcgcgcgcgcgcgcgcgcgcgcggcgcgcgcgcgcgcgcgtgcgcgcctccccgcgcgcgcgcgggggcgcgcgcgcgcggggcgggggggggggccgcggccgctgggggggggggggggcggggcgcgccccccccggcggggagagccccccacgtgcgcgtgtgcggcgcgcgggggggcgcgcgcgcgcgcgcgcgcgcgcgcgcgcgcgcg

SEQ ID NO: 27001 - DNA, 4679 bp, Oryza sativa
catcttacaattatcaacccaaaggcggcagcctacacacagtgagtgttttcttacaattatcaactaaaggcatacttaaggtcaaacaaatgcaagctatctctccttttctttttcttttttttttactgcacgactctaaaatggtcgggaaacaacacttcaggacaacacaacaaatcagaaagcagtcatggtaatgactgctgctaacggttgttgattaacaggaaactgataccattgcctttgtcagctgaagagtgactgccccagctccggtgatgtcaggttggctacacactcaaactgcacacgaagtacaattaaatggtcacaaaagatgaacaaatgaccctttttagtctagtacctcaagaagctggtgaagtggtgatcatgtaccttttgttgcctatacttttcacgtatagcattgagagggcaattactggtgttatgctgcagttcccgtagagcacagacacatatttgaatatcagagcttttgtaagaagtgtagtgctcaagagtatgattctgtaaaaagataccaaggttgaagattagaaaaaatgttttggggtgatacagaggtcgatatagtgcatatccttgttatacgaacccatggaatgtcagattggtcaagtgtccatcttgcaagaaagactgcagatgctgccaccactgaaggaagaaatttgaggaaactgtaatcgatcagggtcagctctgcaagataattggccagatatcccaaggtaattgaaggaacctggaaatacagtttgaaaatttggcgttcagggatatacacataaaaggaatgaatgaaaattgtagctgataaaaggtcgggtgccaatcttacattacgagaagcctgtgcggctctaaggaatctcctgataaaatataaagaaaagcaggacggtcatgttagtgatagaaccacaacttagattggacaagaaacaccatatgtatgtggtaaccaaaactacctgagaaatgtttttgttgttggaacagatagatgaaaccccatatcattaagcaccaggccctccattttcagcacctattgaatcagggggatatcatatcagcaatggcagttcaatggctcttctatatacataaattagcaatttcttcagacatcacattaaacaaatacctcagcttttgtgtatgtattgtcagttatgaaacaaaattcttcaacacgaggagcacatatctcttcatatttcctataaaaagaaggtagacttagcaatacttccaatgacatgaagacaacatgcaattccaatgacatgaagacaacttgcagagttgttagcttgtactttacattagctacagactaagctgcatcagcagctaggtaaacctttctatggtacattttgggaaaatcacatatatgtatccaaaacttacgaggcaatcagcatgcttgttattccaagaagttggagtttctgtctttcaatataatgttgagaaagaaatcggtcaataagattaatggttaggtagagtgtgtctggcacaagcttatattcttcagaaacctgaaatgaagacaatatacagaacttcataagctcagaagtcatgaacagttcatattattaaattaaaatgtacaaaggatgatcatggtttattataacaaaaaagaaaaggcagattcttcgaattttgcaagaaatgtataaagcttgcttctgatgcagaagccaactactcatattctcacctcttcagtatctcaggctctccgctaaatgatgagaagagtgattttataatccacaacttattcaattatctcatataaacttttcatcattgaaactatggtactttcaaagggaaatgcaaaggacaaatggaaaaagtataaacaataatgattcaatagaaagaatgttcttgtaggcttttaaccagatgcagcatccagtatgtaacattcacatgtaactatgtatttcatgtttgagttgcacatacatgagtttctatgtgacatgcagcgagatgctaacggcctaacaataaacggcttaaattcgtttgaaaagatagcagggcagtttatgtgcaaattacatcaagagaaatcaacctcaacaagccaatcaatgagaatgcctcgcatgccctttgtgatgtcacgttgcaaagcctccatgtaatttgacctgggtcttctgataagctgggaatggcataagcagaagatggagtttgaattcaaacaagaagaaagcaccaataacacagggatgaaacacaaccatgaaaaactgaaattacttttgtcatactagaatgtttgaaatatgaagaaaccatgagcatgttaagacagtaaacaagattttgtttttcatcaaagaacaaaaacatacctcagaggccatcagatttgtgtatatctctgaagcataggaagcacacatttgaggatttccattatcattgtcaatatctataaaacctaaaccactagagtcacctggaacaaaataaatgactctttagcaatcagcagtgtacagaaaaatttatattcatgtttttcttgattatgactagcaaaatacccgtgcattgcaaggggattacagtaaagcccaaaaagcaaaataaaattattaccactctctaatcatcatatcatatttggtacaattgtatacatgtaagtcgagctacacagttgctctagcgataaacaattggtataaattatccacattgtatttgatttatatagtggacactgacatcataggcccacatgacactggcagaaccaccaccaccactaccaacatctgcagtagtaagtacagattatctacgaatatctcagaagtcagcagtgtacagaaacatttatagtcatggttttgtacagaaacattatagtcatggttatcttgattctaagttctgtgacaacagaaagacaatcaagagtatgttcctgatagaagtgattgacaaccggtagataacatgacacgctaagggatatatgaatcttttttatagaattagctgacttgaaaagaaaaatcagtaagtccagatactcattgctaaaaataagcacgcaacgtatgcaaaataactaaccaggcttggagtcagcgagttcatgtttatccatggcgtttcttgcctcaaagaatgcctcatggcaatcactgtccctgctccgctcaatattctgcaatgacagtaacccctcgttttcaaacaaatgtgcgggttcctctgctttggccaaaagctccaccttttgagtttcttcagaacttttagaatcaatcacaaatgaagttgcagcaacagccggagggggtagcttaggaaccttctttgcacactgctttttgctcgggatttgtttcaccctttgggtgggctttgacttttgctggaacaaaggaataaccttatcactccatcaacaatgttcatggaaaataaaggtctaaaaatcataatagcataatgcgataatgcagcagctcttgatacctgcagcttgctcgtggtggtgcaatttttggatgagttggcacagccgatgttggttacatccttgagcactgtgcgccgtttaggctgaggagctgaagttgcagtacttgcactagtgatttcatccaaagctcccctttttgtctttccttttgctgtctgctttcgttcagttcttgcgggtagtgatacggagggagcaaacccaaaccgtccacgatttgcagcagcttgagctcgtgtgattcgaccactgggtgcttggcaagcagtaagcaccggattttccttccttccagccatgtgagcctgaatgtgttaaaaggaaaaaaaatgacataagaaattgtgcagttttgacgcaaaaaaaagaaagaaagaaattgcacagtgagcaatgaagatatcaaccaaggcaaataactttatggagctgaatgagacggtgtattaagcattaagtatcagtgtgaaaaagaaatcgaacaagtagatgcaatgcagacataaaacagtatcagatcttatttgcaaatctaacaagatcatatttactcacaagtgcacaagttaaaccaaaattattcagtcccttcgtagcataattgagagaaataatagataatcccagggcatacagatcggaattagcagtcagttggcacaaatgtttacagttatgatctataattcaaatctgaaaccagatttatttgtccatttcgttatgtgcaaaaaaggcagcgctttctatagattttatggcgttctttaaacaaaagtcccttctaaaactgccttgcaaaatgccatcttcatattcaggttagatttcctaacacttttgttttctttcatggcgttgaacagatgcaaaattaaccttatgcaccagattgtgccaagaaaccctccaagtcaagctaccatcagatactcaactaaaaactcactttttttttcaaaaaggatgccacccaaccttagccctaaagctgaaatcctcgcaaacgttaccaacatggaccaatctacgcacatcccccatcctcagacgcgcacagatcaagcagatctaccacacagacgacggggcaaga

SEQ ID NO: 27002 - DNA, 683 bp, Oryza sativa
gaatggtggtggtctcctcccctttttgaagtttgaaggcgtaggcgggatgggggaggaggattgaggaagaagccgagagcgagatggggagggggcttggtgggcccggcccgtcagggacccggaaaagggaaagtggggttttgggcctatatatacggataaggcaacttttgtggccctagaaaggaaggtggcttttttagttgagtacgtacggcccatgtaacatgtttgagcccggtccattttactctcttttttttcaatagatgacgttgttgactacacatatttgaccattcgtcttattcacaatgtttatgcaaatacatgagatataaataatgctttaaatatttttagtgataaaacaactcacaacaaaataaatgataattgcataaattttttgaataagacgaatggtcaaacgtatacccaaaaatcaaaagaggtagtaggtagtagtggacttggctagcgaaaaaacttagaggatagcattattcgcaaccttgcaaaagttttagggcttctttaggaacgcgggaatttttttattaaactttttgtaggatttagttcaattactccattccaagggagtcattcgctgaaaacacaatctatgtgcgaagagataaaaaaagggggtagggcttttgggctgcaggaat

SEQ ID NO: 27003 - DNA, 654 bp, Oryza sativa
  unsure (1)..(654): unsure at all n locations
gacaaggatcagcatgtaaaggaactgtacattcaaaaatatattaaaaatgaaaaaaattacaaaaacgtacctctgacaggagcaccatccatcaactcaaactttgcaagagtttcagtctcaacatatgcactagagcctgctcctgttgattccctacgacgtacttctagttccatgtttttatctttattctgacaagaagaaagtagatcttcccaataatcannnnnnnnnnnnnnnnnnnnnnnnnnaataagaatgtttcaatgtaagcaaacgctgtggatgccacattgaggaacatgtcagaacagacagccaactaagcctatcttcttacttgcttttgctgtattcgaactcaatatgtaagcaatcctcaattccaacttccatctgaaaggaacatgcaagatcaagagttacataaccaaatatgtcttcatgtctttcacacacactaaataaagcatcactgtgaccatggcgaatagcatgttagtcaagaaatagaagtgccgaacagtgtatgttagtcaagaaaaaaaatactgttggccacaacggaataaaatattatgcagctaccatctacaggaatatcagaaaaacaatagcagctgataagcacaataaaaaggtacgatc

SEQ ID NO: 27004 - DNA, 982 bp, Oryza sativa
gtttaccatatatttgaacacaatattcttctatggtgacgctctctgcagttaattaggctcgcaatttcttcacgttttaacattggtcgatgtgatcgacactgtaattagtagtacactactctatcgttttcatcgtccagataggagggaattaaagcaacttggtcaattaattgattgctggacgttggccaagtctatgtctctgaattaaggctttagaaactttactcgctttgacttttgacttttttttttctaattaaaccttattctagtttgatcgtgtttattagaaaatatattatttttaatgttagttttaatgaaactaatttaatattttagatgtcgctaactttttttatagttttgatcaagtttgatttaaaatacataaaattaatttataatgtaaaacagatgaagtaatatttaactgatcgtgacaagaacatatgagatgtcatcgccatcctcagttaagttaattaactgtgaagtttggagtgtaagagtcaaacacaccattgaaagtacacacacatttgaaagtataatgatatgaactttctcttttctcttttaggattaaatgatatttgaagtacaagttgaaagcgtacctacactttgatacatacaacatgtaccaacgtgtacacatgtagtcttgacaagattagagacgtaacctcgcgtgagtacggtcatgtgctttaattggtgtcacacccgtgtgcatacatgtagtacctcttgggattaaattctaataaatacaaatgctcatgctaagtctatgattcgagtcgggtaaataggtaccaccacatgaatattgatacctcaatttgcagttaaaaattagactgtattaatagcaggcatgttaaggttgagtttgttgttgtagttctgaaaaaggagttcgttatcgtattgctatattgtgattttttttcttattttatta

SEQ ID NO: 27005 - DNA, 22798 bp, Oryza sativa
  unsure (1)..(22798): unsure at all n locations
gcatcaatgccttgaaaaggttttattttgcaaatggttgacttgagaaaaacgccgttcatcaggaaaactagctagtttgtaagtcctggaaacgaatcctatattttcatagttgagaagcaattgtttgaacattgttatgagtttgttgctacactgttctgaagtaatactacctctatatcaaaatataagcatttttagctatgaatctggacacatagttgccaagattcatagctaaaaaagcttatattttgggacggagggagtacaataataacagtactcaagatttgaatcgaacgctgaaagaaaatgcactctactcatgctttgtactccctttgtcccattgtaagtgtagtgggttttcgtgttcaacgtttgaccgtccgtcttatttgaaaaatttatgataaagttttaaaaattaagtcatgcatgaagtatcattcatgttttatcatctaacaacataaaaacactaatcataaaatcatttcaaataagacgaacggtcaaacgttggacatagaaactcacaactacacttaaaatgagacggatagagtagtttattacggagggtctaatttcgtatgtccttaatttcctcctaactaaatgaaaatcatgatgaatcaaagttaccttgaaagtcacatttcttccgattgtaccatcaactaccatctcactcttatctatacaccatttaatgagatgcaccttattctttctaatcaaatcttcgatatcctaaacaatctagaattacaattattttgacacaaatgtagtaaatcgttagatacgtatataaaattttacctacatattattctttttgttaataagccggcatataattaactctacgccaactgatgaggccgaagatgtggtagatacctatcgaaccctataatcttaataataggagcaccctcacatggcctaggaaaaaccataggacaaaactgcaccacatcctgatttagtatgatttgtgaatattatgacatgggtatatttgcattgaaataatgaaaaaccggttaatcctgcaaaattgagggaaaaataatatcttgaaaaataaattcatgatttggaggaggccaaactagaatccatgatattacaatatctcgtaacagtgctggagtggtgtttgtgagttcagggagagggagattctctgattttttttctatcttttctagaatagctaaactagttctaggaaaagaatttgtaataaaatttgtagtactaataggagatgccccctaacgtttcattttgtccaagtatgtcctttgacctgatacaattcttcgacacataaagtgctacgtgggcatgtgtactatttgtggtaggttctaacttgtaaaatgactttatggcctgtggatgcccaagcaaataaaaaaactcagtgacaccatgttaacttggttcttttggtaaaatatctatacttcttctttaaagatcctaaagacggtggtaagtgggtccccagacatatcccttccccaacctcaagccataaaacaagggaattttctaatggtgacaaataatgacttgaagattttataatgaaaataattttaaccacggcatggttcttttttttttaattgccattgcaacgcacaggcgtccaactagtagtaataacatgaatagtgtaagaattgaggtggcttgtctacttgaattcctatggattaataaaatgtaggaatttttgaaaggggaaattcggttcatagcatgggtgggacttcaaattcgaaaaaatcccatgaaaactttcgcacctatgctatctgcatacttaaaaaaaaagagatagatagataaaaaaaatggttcccatgagggccagcctaatgaaagaaatcgttcaaaattcccatgaactaaacagttccatataaattttgtagactaaacagttccatataaattttgtaggatctcaaatgtccattactttgtttcaaagcagcaccaaggaaaattttccatggatcttacaaaaaaaagtccagttcattttccttttgttcgaaggagtgaacatgcatagatgtgatctaaacttgtgaactccatttccacaacatcatgtgtttttttttatcaggaccatattactacattagcgactttgatcatgcatcactgtaattccggacagtgcggtttgagaaagaacaaaaaaagaactctcactgactgagtgcctaactggtaacttgtctagcgttctgcaagacctgatgaaagggtttgccttgtcatcataggtaactaaataccggctaatcccaaagaacagacttatgtctatactccttccgtcctataatataagggattttgatggtaacttgtctagcgttctacaagacctaatgaaatggtttgccttgtcattacaggtaactaaatgccggctaatcggctatnncaatggacagacttatgtctatactccctccgtcccctaatcccctaatataagggattttgagtttttatgtctatactcccttgagtttttatgtctatactccctccatcccctaatataagggattttgagtttttggttaaactgtttaaccactcgtcttatttaaaaatttgtgcaaatataaaaaacaaaaagttgtgcttaaaatactttagataataaagcaagtaaaaaaaaataaataataattctaaaattttttgaataagacgagtggtcaaacaattcaaacaaacactcaaaatcctttatattaagacggagggaatcctttatattaagacggagggagtaccgtttttaattggagtctattgacaagatagataacacatagcataacacagagaagcagttataaaacgctttgcttcatgtcacatgatatatagagcaaagtcaagatcgaaaacggactaaaatcatggatagtctgggcttgtttcatgccgggtaacggagaagttaccagatgtaaaaaacaaacaaaaataagtcatggatagcgcatccttacgcatgcatagagacatttgagggcaaaataaacagcacgtcaacagttactgtccaacgcaagaagcccagaagcacagcaagcaaaacaaagcagcagcagaagcagcgcatcagcagtttaccttgagtgatttcaaacagagctaatggaataaaaacagacatttaaaacacctccattgtcatctcaacataacataactagaagtagtaccttgagtgatgtttacgttattacaccacatctatgaaaaagaacagaagaaaaagaaaacccagtcattgtgtattgttctggaatttgatgcttgagcaggtgatgaccattcaggtgagccggttcatcactaagagactgcaaactgaggctcgaaggacgtagattaattagccctgcttgttggcatagttgtcaggctcgtcatccttgaagaggtcatccatgagctcatcgttcttgcggcttccaaagctgtcaccaccggcaccggagaaatcaccaccgccagtggaacctccagcatcaccaaagcttccagctgggtttccaccaaaactaccatcaccacctaagttgattccagagaaggcatctgcagatccttctgcaactccataaccacctccaccaccacccctgttgccataccctccattgttgccaccataaccaccgccgcctccttggtagccgccgccgccaccaccaccaccactgtagccaccaccgccatagccaccaccaccactgtagccaccaccaccatagccgccaccgccgccgccatagccaccgcctccatagccaccacccccactacggaagccaccagttctctcattggcagtgttaaccctgatgttacgcccatcgagatcctgaaaccagccaggaagaaaataagctgctggataagattgaacaaaaatgactttggtttaatggaactgttgcatattttttttaactagaaaaccagaggtaaataatcaaagcatcaacaccataatgcatagtaaaataacaaataagaagctcaatcagaacctttgaaatggaacatctccaatttctgtaacaaggaatctagagtaggaatattcatttaagcgatcgtgttgcatacaagctgatcaggcagcatgaaatttgacattctacaaaccatatcttttgcaaaagtatggaaacatggcagtgttgaaaatccacttaaattggtttgcagtggtaaaatccattagagtaatagaaattaagggctccaaaactttagaagcattctaagtgaatttaaccagcataaatcattacaccttaagtttgacagaatacctattaagtctggataaacatatagatgatggggtaaaaaattaaattaaacctaatctgaccctcaccatacagggaccaactcttagaatcctggaacataaacatgatgcccgctaaaattaattccctataagattacctttccatccaaggctgtgattgcagctgaagcctcttcacttgatgcgtaagttatgaagccaaaacctctagacctcccagtttcacggtcattgatgatcttagctggacagaacaaaagtagaccccgttaacaaaacaaaggaccaacaggagtgcagttacaaaaataaggataagataccttcaataacttgaccataattggcaaaagtatctctgaggctctgctcatctgtgccgtacgaaaggcctacaccaataatttgtagccatcagaaaagaacagtacagagagaataattgttttctgaacaaatgatcaaacagataaaatatagtatttgcaaacctccaacaaaaagctttgaggatgacatgcatctgattgattgatagagagctggacttgagctcgtggctctcttgagcagattaccaatcttattagccaacgccattgttccaaactacatgcagtggtgaaacaaaggaagacataaatatagccatctaaataacacaatacagctggagcaagtccttgtagtgtcacaggaagaaacaataacagcaagaagaaacacaaaaacagagtggttgattagaatccgagctcgatgggattgtgcagacaccaatttacagaagaaagcaatgccatacatctaacaactaaatcagacatctcatatagcaattaacttcaatatcattccatctcatatctcaagaacgatggaatggttttaaaaattgcaccacttgcaagtggaaatctcaataggaacatcccaagctggactatctcaacgttactaaaataataacatcagttacatgctgaaatccacatttaaaaaggaaaaagcctaagatattcactattggaggccaaaaaaaaggaagatttaagatagttgactttatggcacatagtgcccagttttacggtttcaaagattcacagaattcatccttgttcaaatcttatatctaataatagaatatctgaaagaatatcaactaacacaaggtttgatattcaatactatttcatggacactttgtaacatgataaatcaagcaaacatgctacaggccatcagaatactaagggttttctgcaacttcaaccataaaacatgtgatttttttttaacaaaacttactcaaagatcaaacctcgcaacatatgagaatctgcaggccctcaaataccgacccaaaaacttccattcatcaccaaccccatggtgacatctactcaccctccaccattccagcccccctccacctccagccaaaaaaaccataaaccccacgaggcgagcaacaacagcgcaacaccaatagatcgtctatcttacgaaccacggagatctccacgaaccctaacgcaccctgcacaccgccaaccaactaaacaaacgcattcatccacccagccaccaaaaagccccccaaaagaatgggggacagattcgcaccaaatcgctggatcacaccgacgcgcgaagaaccccgcaccaccaccaccccacgcgggatatatattaattaatcaaatcaatcgaagaaaatttcaacgaaattagatggggaattcgcgagctagggtttaagcgtctcacctgacgagggtttacgatggagaaggcggcggcgaggggggaaggaaaaagatgcgcccgtggagccgtatatagggctcgaggagcgatctcagccgtccgatcggaacggggcggcggtggtctccgccgttggatctgggcgttgacttgtcaacgacagatatttcttggggactgggaaaagcgtgggccccgcatgtcagtggaagtgagccctagtttataatttagaatagttcgagggggttaattgcaaaaagtgagggtttgtgagatcggcggcgagagatggcggcgccgagggagaagtccgccgcggcgacctcgtcggcggcggcggcggatgcggcgggggcggggggtggaggggatcggtggggcgcggcggtggggaacctgacggagctgggggcgaacgtggcggcgctgcagaggctgctcgcgaagaaggcggtgttcgtcgacgaggacatcttctccaaggcctccctcgccgccgaccaggcccgcaccatcaaggtgattttgctctgctttgctttgctcgttgctggtgctcctgattcgcccccaatcccttcgccggtatcctcggcgatgctgttttgtcagtaagtggaatgtaggatttgcaattgttgttcgtatcccagatgcgtcgtgaatttgatgtggattctactcaacccagctgaattggtgtcgactccactcaaaatgtgactgggttgattagatcattcatcaatcatcatgtagttatcatcagaatgatgtgtagtgtgaactctccaagaactctcccagtgtaaaagaagaatggtttgatctgatcagatcttgagtgattgcactaggtgaaccgctgagatccttgtttgagtaaaataagaacaatttgattcacatcctcattgatatgacatagtcatttgggatggcatatccgagaaaccagttttatacatgagattaagattattcgttatatctcagtagttaggagcattatttgtgctaatgtgtactctccctaacttagcatttgtgatcaaggtacttggcatatattgttctaatctaggtttagatcactggaaagctatcaagagaaccctgtactatctacaagggactaatactacatgcttagtcaaaatcaactatcaagttttcaaagatagaatctagtatcaaccaattaattttcagcatacaagtagttaagtactaagttaatgattgttgacccccttactaagtcttgtctccaaatctccttcgagaacttattgccagtatgatactaatgaaaagctcatataactcagggataattataatgataagatgtcgaattttgattctggaaatattgaaagtttgtttctcccttacgaagtgcacataatgattaatggaaaaacaacctatgaaactatattgaggaccatgagaaaggagtatgatcacgttctttctgaactcccaaatgccgtaaataataacccatatgagatatagtggtataccatagacaatgaagttcagttatgattattttgtcaccctaactacattatctttgtgtggtgctcttgccaaagtatggactaagattagttattcaatcaagtgggagaatgttagaccatttagtgtgatccatgagtgaattgtgtaattaacccattggttgaagggcaaatgggtaattaagcaattagcctgtcacaaatggttaattcgctgatatgctttgatcgtggggctaaatagaatttatagaaaagggtcaggtccctagtcagattttacactataaattgaggagcatcttgttaccacaaatctaagtgcttcttgtgtgtcagcaagtgactgcctcacaacctcattcccgaactaattaggaagtgcaatttggttggctcaaaggctgatccactccagaggaggtttcgtaggacagatcccctcgattcattgtcactcgttcatggatcatcccgatgaacatcctcaggagtggattgggcttcaagacagcaaattatacttccggattggtttgggaataaactttttggagctcacttactgtgacatgagaagtagttaagttcgcagtagtgggacgcccccttaatttatagcgcataacctgacttgggacctaagcctttctgatagcctaattacttaagactcatgttatcttttaggctaatggaccaattgcatatctaatccattgatcaaactaaatgatctaacacacttgtgcagattggtggatctcgtgagtgattggaacctatattttggggtcacaagttctcacgaaaatcagaacactaaaactgatgacctgtagctaatctagtggacaccatgtagatattaggatcattctgatttttgttcttttgtattccgtcctgtgttggcaacattaaatatggtattgacatcatagtactcacatttctgtgttcatataacatgttggttagatgtcacaaattattaacctttcataacctctccatatctgaaaaaaggttgatatgggatctgctcaatctaccttttcaaaatttgatcttgaaaatatgtcaaagtatatttattggctacatgagaaaatattaaaatttggctcttgcaaaatacttttataatagataagttcaatcattttgctagtataaattatgatagtataccataggcccagtcatacattggagactgcaagaagtaaaaaccgacttatatttaagctggagggatgtatttcatctctctccagaaatacttaataattttgcaagtcaatggctgcaaatgtgaagcagtaaattggcattcatggctttacgccagtacattattattacaaaaaattcaccgagacttatttatgttgtagaagtgtgctgtcattgctgtccatatttactttgctaaaatacaattgttaaattgtatgtatgttgataataagccaccatgtaagattcatggttcttaacatttttatcattacaaatataaaaatatgttgtagtcaatggctgcaaatctgaagcagtaaattggcatttatggctttacgctagtatattattattacaaaaatataaaattcgctaaaacttatatttatgttgtagaagagtgctgacatcactctgatgtatgttggcttttaactaaacattgtcccaaaagaagctatgtaagattcatttgcacttcttgttgcatgttagattcttgaccagagggtgcagtcgctggaacgtgaactagatgctgccatttctgctgctgcccgagctcgtacagagaaacgccaagctgaagctgctcaacgagctgcggagttacgtgcgcaggaagtgaccaaggaattggagaacactgcaagtatgttatgtttcgttgtaaaccattggcatttggtaactgagcgtgtcaaaagctgaatgtcttatctggtttcattttatcatcttgcagaagtgttcaagctacacatggaagagttgcgggcaaagcaagaggagattgcaaagaaagaaagtgatatcaaggtgttagaagcaataattcgaaccctgagtaacaaagatgatgggggatccagcgaataatttccattcagtagcattgttttttttttcaatggaatttacatgttcaagtatatcatccatgtattaatataagcccttaggtaacagattattgtaaatgttcgcaacaggacatccaaacagattgaagatgaacattacaactgatatgcttgactgttcatctgccactgcccagccctactacacctaacttgctgctggagggtctaactgactattggaaacaaagtattggttcttattactatgcaacagctagcaatcatcaaggagaagatgcagcatttgattcctagtaaagttggtggtttattcatctcttttttcgagattggatcctttatagtttattcacatcaaagtttgtggtattcttatgcttgtaatttagtttgtttccactgggatcctgtattatgcttaagaggaatacccagcgatattatgcttgagaagaactgacagacgattgcaatttgtatacaagctttgtacaacaaattgatactgtcatttgtgctcccgtatggccatataccagtaaaaaaaaagaatttacaatgaaatttctcagcgcaagaacaccaactccatcaatttaagttgtgctttggatactaattctgaagcactgatgatttgacttatgatgcttgttggtatcacaaccatctcaaaacatacaaggacgtgttggtgacaaggtattatatggacacattctctcttcctagtacaatcatcgaatgaaccttcttcctttttttcccctacatatattaatctatttttagtcatcccctcatactcaaccatgtattatagttggtagaacattacactacatcttaggcagaagatcaccatcataagctgtcatgctgatgatctctaatccaccgcgattgcaatctaccatccccgttcgttttcccaccaaaactcgcacaaacaaatttaccacaactccaggaacctcagcgcaaaacttcctctccactagtatgccaaaactcattagaccgttttcattattgaatgaattattgtcgcaaatattgtaaaaactaaatatcttaaaaaataaacctaacaaataacttaagaaacttagtcttaagtatattgaagtgtaagaaaaattttcaaaaaaatgtactatatttttccaatacataaagaaaataatctgatgcaataatactataattaagttgaaaacatggctataaattttcgcacaatcaggcgtcagcgaaaacactctgttcactataaaaaccgacttacttccttctatagtaggttcaattttaacctttttatttatctcaaaataggttcatttttataatcattgtatcaaaatttgttgtgaaagtaggagataaatatatttagaagtagataaagtgaagaataattatattgaggtttgataaagtaggggtattctagtcatcttaatgttgtattagtatccgtggggtatataaaaataggacatcatgctctggtgttgggctcaaccaactacaaaggtccgaataatgaataatgaataatgcatgtcgtaaacttgagtcaatagtcatgtaactctttgccaagttcagatggagattcacaaataggatctgaaaattgtgttttctttatcctgtgttggttttcattagtgtgtgcttgcttaaggtttggttagagtgtagttctatgaaagcttttgaacgattttttaaataatgggttatagctctttgcgcaaagaccggaatgatattccattatctaaattgtaaaaattaacttgttgtgcgacggaggaagcattagaatttcgcacaaacacagggacctcaccgcaaaaacgcaccttcctaaataatggcggccgccgaccgaatcgcagcagcgagcagcgatcccactcctcctcctcctccccttgttcgtcgtctccgcggaatcgatcgcgccgcgcgcccacgcccttcctccctcccggatccggcgcgtaaggtgcgtgcccttcccgaatccgcgtccccaccccgcgggccgtttcgagccccccgattcggtggagatttcgcggaaatccttgtgaatcttggggattctggtgatgcgatgatgatgatgatgatgttagaggtctaggacggtttgcgggattgagcgaatgcgcggtggattggattggattagggtgttaagaggcttttggccaaattttgtgcccgcctcactgtgatgcaaatcttagctccgtggtttgatggtttttgggtttgatccgtttgatgctttgattttactattttaatgttgtggaatgcagattaggtgcagaaattcgctgtgttcttttttttttcatttctgatgagttgtgtgcagggaagatgctagttatagcaaacggacggaatgatttggattatcggtgcaaatcattgcgcatgtttggatcacgcacggaatctttgttgtgacactatcttgcgctcgctttgttccaaacgcagcgctattattggagaattttatagtgtgatgtttcctaataccatctgtgaccgtgactataatcaaatggttgttgaggtggatacgtcggcaggctgtacctaactaagttgatctgcataattggaatgttcttgatattatcaacacaactacatcgagatacataaaaaagaggaaaatgccatacaagttctgtatagatattcattaatctgtttagataattagttcattttgtaagaaaaaagaaactgagcgtaaggaagtggttgctaaatttacggtttccatttttacacgttaggtatgccatgtattatgacctatgcaatttcccatttatgtttgagatagtgtattgatagtcaaatgctctaaagcctctaacatgtcgtggtgcttgaccacttacacgccacattgttgttatgctgtccaataagatgttcatgcattccaacctgtgagcctaggaaacggacaaattagatgacgacaactgaatttcttcttttctttagggtttgtacaggcaaacaaacttagcaccaattatattcaccttttgtcttaaatgtctgctattttctaaagttttgcagttggccttatgtatgtttgagatttaattagttctttgagaataacactcgttttgtatctgaaactaattttgcagagtaattgacctttgaagttctataagatgggtcgtggtgttagcagcgggggtggtcagagttccctgggctacctgtttggtggtggtgaagctccgaagtcagctgagaagcctgctccagttcaaaagcctgccccttcgtcctctgcagagaagctgaaagagatcccagccggtattcaaagtagtaaggcgaacaattacatgagggctgaaggtcaaaactgtggaaatttccttacggttagtgtccactttccattataaaaacttcaattagggttactatccacttatggttagcatcaataattgaatgctagtggaaatacgaaccttactgcaataatgtcttttgggggggcattttgataagtagtagttgatcaggaattctaggggagttccttaagtagaaactcattatttcaggttggcacttttgccttaactcagtaattttacaaatttctgcatgtgaatattaccatctcatgctgtcttgaagaaatatccattttgtactcatttaactctcagactgtacattgtctggtctgaaacgtgctaagatgccttacgtaacacacaagctcacttcgtaagcattttgcaattgatcttacttgcattgcgtccgatttgaggctttatgctgacatttctttcccttttgtttgcacaggaccgtccgtcaaccaaggtgcaggctgctccaggcggtggttcatcacttgactatctcttcagtggcaacaaggatggcaagtgacggtcactctgctgtccggtttaccatgagctctggatgaaaggtttctgctcaacaaaagcatgttttcccatgagtaactaactatccaatgtatctgctcatggtatgtcacagaaactgttgttatgtatgcatgtgtctgtgcttattctgtgttgatgtatgcgtgtgcttatcagcagctacttgtgcaatgaactgatggtatgttcatcctgttgcatgttagttcatggaaccgggtctttatgctaacattaatgtgcttgcttctttaatgtataataactgtgttctagttgtgtcatacccctcggattggacatggttgtggtttgatgctcattgttgaagcaagaaatgtctctgttctgggtggcatatttgtgatatgttttccacatgacccatgttctgtgtgtttgctgctttaatgtgtaataactgtgttctagttgtgtcgtacactcgtacccattagattggacatggttgttgtttgatgctcattgttgaagcaagaaatgtctgtgttattggaggcatatttgtgatatatttttctacatgcatgacccatgttctttgtggcgttttagttctgttctgtatttgctgaaacggtgaagatcaagtagttatctgaaatctagagctggtgagttacttggctttagtttacccactacaccagtcaaaacaaatttgttatccattgcaaattaagtgtagtttttattttgcgaagaaaattaagtgttacattatgatatttcgaaagctatatttccggaccttaagatcaggattcatatctaacgatggccttgacttgcagtacttcagtgccagccacattttgacaaattccaatgcaatgttggcctaaaaattatcttggaacaaacaggatggtgaatttttctaaaaatatttcacaaactttcaatgcatgattgcataaaagataaaggtatttctggatgataagatggtgaaaaatgaagttattttgaaacaaatctaaagtagttaaaggattaatctttctcaccaccacaatttgccacgtcatcagaataatcagagccgttacatgcagcatacatataaagtagtgaaaggattaatctttctcaccaccacaatttgccacgtcatcagaataataagagccgttagatgcagcatgcattcaatagataacagcggatctagagaggatgggccggtaaaagatgactcatcaggtcggattcaggactcagactcaggagtcttcggaaaggattagagaaagaaagcaaggattagagaaagaaagaagacctatagtcaaatggaaaaggaaggtcacgtattctctccatccatcaaagttatacctatttcacctttgagttttttcaaataagttgttcctatttgtaggctttatgcattcaaaacttaaatgaagagataaattaaatgtttaattagaacccaaggagtcacctaaacacttgttggttgcatgcttgcactcactccttgattttgtaacaaccaggatgattcgatttctccttctcttggtgacaaaagtaataggtagcataacttttatggatggagggagtactaagcaagcttcctggtattagctagatagaccatagctattgggattacgcatgatgtaattagattagcaaggaagttagtcaattttaagtgtttttaaggcattagagacaaagttgacattggttattttatgattgagagtaaaatatttgaaaatatgaaaaatattattgcaaggcaataacatgattaacaaaaatagaataataggatatataaacaaaggtaaaagataggaggatcaaaattattgaataaaagaagaaaaaagtatgtattcaagcaaattatgattcaagtggaaaaacatgattaaatttttaatcttaatgcccatggtaaattacctacggtaagagttgtaattgatatgcgaatttctaaattatgaaagattcacacaattaccactctagaccgattgcttttcttaataccactttcaatcatttaccaaataaaaaatggttttaagatattgaacatgtcaacaaatgtatattaatattatttcttgatcatttacaagcacaaaaaataggcaaaatttgccacaggatatccaaaaatcatgtaattagctagaagacacccaaaaaaggcgacactgccaatggacactataaaatttgtgcaattagctataggacacccgaggcaatattttattattttcagtgaaaaagaggagagagaaatttcaaaaggacggaaatgccctcagcctcagtacctgaaatccccatccaacttcaactgcggcggcggcttcggctggttgcggcgttgggaagcgacggcggtggtgatggctcggccggtcatggtgcaccaggagctcgccgcgctgcaggagctcgccgtgcacgccgcgaactctggtgaaggcgccacgccgccgccgtggtgcgtctcgaagctgagccccacggcgccgtcgccgccgccgcaggccgcggtctgcaggtcctgttctccaccgacccgtcgccatggatccacctcaaacctgcacacacatcaacaagaaaccaatcaacggcaacaaatcgatcgaatgcaatgcacaaatcacaatggcgatggagccgctcgccaccaccacccgctgctgcagccgctctgcaacgctgccgccgccgccacggcgcagagctcggccaagtccgcgccaccgacgccgcagccgcaccagcagttgcccgccgccgccgcgcacctatccgccacgacgcacctgtccgtcgcgccgtgcgtatggtggccgtcgcgcctcgccgtcgctggcggtgagaccctggcggagcgccgccgctttttctgctgcgcgccgagccgtcccggctcgggccgtcgctccattcctccgctccgccacgtgcgtgaggaagaagaggataggagagagatgtggaccccacttatgattagcaaatagtaatcataatgcattcatagcattgtggtacatttcttgcaattgattatgaataaccaatactatgaaaatcatctttcgtggcggccattttgggttttctctggcggaaattgcagccgccacagagcaaaggccagagaaaatatcaatattcgctagcggttatcggccgctagcgataatcaatttttgctgccggttgtgttataccggccgccagcaaaaatcgattttcgctggcggctgtgttataccgaccgtcaacgataatcaattttcactggcggctgtgttataccggccgccagcgataattaattttgagataaaaaaaaccatatgcagttgtcctccagccgccagcaaaagccccatgctgctaagcatcccaaatctacatccccaaatctcaaatccataacaattcaaatccacatcaaatccaaccatccaaccttaaaagaatactacatcaatttctcacttcattcttaacaaacaaacatcaatacatgcatatatgaaacatcaatacaaacataaattggagaaattcattaaaatcgtcgtcgtccgcctgccatcgccgccgcggcggccgccccctccctccggctagatctgggagagggagagggaagggaggaggaggccctccggtcgtcgtcaccagtcgccgtggtcgtcatcgtcgtcgtggcccggcccattgtcgtcgtcgtggtggtggtcgctgtgctcattgttgtcatcgtggcccggcccatcgttgtcgtcatcgtcgtggtacgacggcggcggatccggcctccccgcccgcgcccgagagccatcgcccgccgcgctcgagcgccgccaccccgccacgcccgagagccgccgtcccgcctcacccgagcgctgccgccaggtccgcctgtcgtcgctgccgccaggtccgcctgtcgtcgctgccgcggcggccgccgccccctccctccggctagaactgggagaaggagagggacgggatgggaggggaggggagagaggtgagtggagatgagaaagagataatgaggagagatgaatgcagtgggtgggtgggtgaaattgcttttaaatgcgtgggtgggtgatgctgtgaaggaatcgatctgtgagctgtgcttttcgctggtggatccgttttttcgctggcggatctctttagtacccgccagcgaaaacactgatttatgctagcgaacatttaagaggtccgcctcgaaaaatatagtattttttatggcggacctattaatatggccgccagcgaaaattagttttcgctggcggcccgtgaccccccaccccctcaattttctacgctggcggtttttgcttgtagtcgccatgaaaaatattttccaaacgctatgaaaaatcgtttctctagtagtgaaccttaaacatgtgattcttttgtaaaatttatatacaataagtacaaaattatctataaacaaactcttagctttggggttcgcatcaaggtgagtatagtaaaaatgaatttactataacaaatgcactggtaggttatactaaatgttgtaaaatttatttagcatatgtatgcaaaattgacgataaatatagagggtgtcatggtccttcttcttagtggcatatgccatagtccacctatagaaattgaaaaaaagtcatgatggtcacgcaacgcgtgacgaatgtggctagtaaaatgatgaaaaatgaagctagtttggaatgggggagtgtactaaaatataatataacttgagtttaaattttatcccaaatataataacatagtacttttaaaatgtgacttttacaatttaacaactcgatcatactacctctattaacattttggctttattatattctcaactagtgagggttcatatctcacccatccttaaaaaaaaataaagtagtactaccccatctcaaaataactagtttctccgtcctaaaatgtactcccccattgcataaaaaaccaatctagtactggttgtgacacatccaagctagtataatgaatctggatatacctctgtccagattcattgtactagaatatgtcacatctagtcctaaattcgtttttttgggacggagagaataagtattttttagattgacataggtattaagaaagtaggtagagatgattggagaaggggtataattggtggagaagagaaaatatgtgaagagaatggtcgtgattggttgacagtgaagggtaggtggagaaatggtttcattttgggacaagttattgtgctaaaaatagctattctagaaagataaaatttgaataagatgaattttttttaattgagagagtaattggggtaagacgaagagaaatttgaatgagataggattgaagtgacaagtactagtactctagaattgcatgcactgatttgaaaataaatttagattctgaaattgtgcttactcctttcgtaaaaaaaaactaacctatgattagatgtagcatatccttacaacaaatttgtacatgaacttatccaaattcattgtattaggatatatcacatccaatagtagatttgtttttttttttgacagagggagtatttgagatggaggcagtacatgactaatgacatctctctgttgctttttttttttcaaacaataaaaatttctacaagtgatgttgaatcctgttgtactccctcttttccataaaatcaatctaaaatggatggaatgtaagtatgtgaatgaatctaatataattttgtaccacgttgcgtggtggctgaaaggataacaccagacatggggacagacatacatactactactagtactccctccgtaaaagaaaagaacaaatctaagattggatgtgatattttctagaacaatgaataatagaagcttgtccagatttattatactaggaaatgtctcatcaaatactagattggtttttttttacggaggaaatatttaattattatagattaccatgttcaatcttttcatcaacaacaaaaatgtcaatggagtaatcgacggcaatccccggcagctataggccttgtttagttcccaaattttttttccctaaaaacattatatcgaatctttggacacatgatagcattaaatatagataaaaaactaattgcaaaagtttatatggaaatcgcgagacaaatcttttgagcctaattagtccataattagccataagtgctatacattaaccccatatgtgctaatgatggattaattaggcttaataaattcgtctcgcggtttccaggcgagttatgaaattagttttttccttcgtgtccaaaaacccccttccgacattcggtcaaacgtccgatgtgacacccagaaattttcttttcgcgatttaaacacatatataatagtagagtcaaaatatgccaagttggaatgaaaactttgcatgtcactttattaattattccactctcttgaggatctgaaacatacatagtatttattattataggggtgttcccatgttcaataatcttttcatcaacgagtacaatgtcaatatggatcagtaatcgacggcaagaccggggcaggcagctaggccggggaagaaaggaatctgcgctgcagtagcactctctgacctgtgggccccctacccccctcatctctctccaacgtacccacacagcgtcccacctcgccgccggagccaatgagagatcgacgacgatcgacgtctaccagtccacgaacgagtacaattcgccataaataaatagggcgccacacccctcagctcgatcccctagctctcgatcggctgcaagaagctatagctagcctagctcatctcgccggagaagaagctaaggcagcaggcagagagagagagagagagagagagagagagatgatggggagggggaaggtgcaggtgcggcggatcgagaacgaggtgagccggcaggtgaccttctccaagcggcggccggggctgctcaagaaggcccacgagatcgccgtcctctgcgacgtcgacgtcgccgccatcgtcttctccgccaagggcaacctcttccactacgcctcctcccacaccacgtacgtcactatcactactcctgctgcattttccatacaatacgtacaaaataacaaaagcagtagatatatatagttagctcaattaatatgatggattatttcagaaacatttaacttctctctctctctctctctctctcttccctggcatgcatcgtccatgtatcaaattaaaagatgatcaagaatgcaatgtgaaaaatatataacaacccgtgtacacctgtgagtttacaaatacaagcatttcaagcgttcataatttatccatccataaatataagtgttacaggatatactacttattctatcgtctatcacccttctttcaaacttcctccggatgcatgcatatcgatccctcattcaacaagggatattttagtcgctaaacaaattataaatacctatattaattcatcgatagagggggagttagcaagtactccctctgtcccacaatgctggtcgtccaaggaatgtagagaaaataattgctctggatgaaacttaccaggatgccccaaaacattagttgcagtagtcattttaacacaagtacaccagccacataatggtgccatacacctaatttgaatgctttggcacctagaaatttgacaggagcactagatggtgctagggatgaaaacggagcggatacggacggataatgctcataccatattcgttttcatattttttaccggatacgaaaacgaatacggatagctcgaatacggaaacaaatacggattatctcgaatacgaataagaatcgaatatgatcggacacgaatacggaaacaaatttttctcggaacacgaaaaccaactcaacttctaatggaaacaaatatcaacatatataattagctcattttatataaaatgaggtataatttataaatattttttaaaatttaaataatattaatagtatggactagtgttaagagataaactactattaaaatctataaacgtatattgaaggtcatagagttagaaagaaatggggtatgtctcatgggtcctgcggatatccgaatagcactgttcaccggatatccgaattattatccgtatccgacagaaaccttggtaccatatttgtattcgtatccgggagaaaatatccgtattcgtatccgtatccgaactatccgagaattatctgatccgaaaggtatccgtatccatttttgtccggagcggacggaaactatccgctccgttttcatccctagatggtgccacttttctgcgccattattactgccgatgggcgagtacaacgtcaaccattctaggatatttgttagccagtaaaacgatctcctttgtgggagggaggaagtagacattgtacacttcatagggcctgtttggagaactatctcagggatatttttttgctaaagattatcccaccaaaatagccctcttgctgtttggatccaagggctatttagctattattgtaccatcccaatcatttgtctccactaaaagtatacaacagccggatcttctatagctaatccaatacaggcacatacaagcatacacaattccttacaagcacaaactcataatttgtctcaaatgtataagcaagtccgtaaaataattgcacgccaaccgcggcccccacgtccgcggtcgcggccacagttggttgccatggcgcgttgccgacggcgacccattgcccctgatgagg

SEQ ID NO: 27006 - DNA, 7462 bp, Oryza sativa
cggatgggagggagaccggagcctcggccatggccagctccttcctcgccgccaccctggaggaaggcactgtactcgtggaggtgagggaactcctggcccgacgacgcctgggtgttgaggtccagcgtgtccacgccggtgcggggaacggatccgtgggaagggccggacgccgacggctgcgagggccaaatgttgccggcggcggacgaaatgggatcttgggagaagaaatcgaagccgttggggtccatctccgcgcggattcggtgcacagcgatgcgtcgacgacggatctgatggccggcaacgcgggtggggtgagttgccagtgtggatgcctctcggtggatctgaaggaaggggcagcgcgattcgagggagagggcggcgcgggtgaagggccgggcggcggcgtgggtggggggagggggaggagaagctagggccgggcggcggcgcgggtgtggggagggggaggcgaagctgggccgggcggcggcgagggttctagagagtgagcgggggcgacagcgagcgggggcgaaatgcgatgggttttgccgcaacgggatcggcacaagtgggggaaagtgggaatcggtggggcccacagcaaaatagccccaattagcacccggtgggggtgataattttttggggtgggctatttgcaaatagccctaaaatagccctcctgtttggatccccttgagctattttggggttaaaaggggtgggctaaaaaatatccctaggatccaaacaccgccatagaacgatattatgcatagagattctccttactatcttgtaccaccggtaagtacacggcaataatttgctgagccagctttatttcctcttatgggaactgttatacctgcccaggggtactatttttggtagatgcatgtcggccccattcttctcttgtcctagtatatgcagtattaccttagtcctattgcatatactacattcgtcctattttaagtgcatctatagtttttcgtgcctaacttcgattgttgtcttatttagaaaaaaaaattaaaaatataagtcacacataagatacttatcatgttttatcatcttataacaataaaaatactaattataaaaaaaatttaaataagacggacgattaaaattggacacgaaaactcatgggctacactaaaacgagacggatagagtagtattaatagagtagtattaggaacagccttttgacttgtctacggcaatgcacaaatagtaatcaatataatctaatcatatcttttattgataggaacaattgtttgcacagtactgatatatgtatattttttttcatgttatttcagatcatatacatgaaactcataatcaaccttctattctgttgatttatataattaataatttgaatctgtagacaatccagatcatgctatatggagtataacattattaattgcctctttgtaaataaccattatcagaactatatattcatcttcaaactttgatcactactcgttctttaaaagacaaatacttaaaaatgtattatcaaagtgtgccgcattaatcgtgaaatagttttcgtttatcatagtctaaccatttgcaagatattagatgcatcctcttgttttctctcaatccctccaactcaactcaaattgtactcagtgatgccattccttttacacaattaattgcatgatgttacacttacacaccattgtttacgccctaacgaaactaatgtgtagtgcacgtaaaacgaagcgattcattagcgcataattaattaagtatttagttttttttaaaagggattaatatgattttttttaaaacaactttggtgtagaaattttttttaaaaatgtactgtttaatagtttaggaagcgtgcgcgcggaaaacaagaagaaggaagttaggaaccgaagtaacaaacacaaccttagggcactcccaaccctccacctagtatgatgtctatggcattaactacattgccatgtaggacttttagcttatgtggcactatattaattaagagagagggagtgaagagaggaagaaactgggtctcatgcaagacacagcttcaacacgagaacctatgcactagacactatcaagttttgcattgggagagaatagtgtcttcataatagatgaaaaataaatatgattggtagagaagagatatgatgtatttattaatggtctattattttaagaaaccatggattatatagtgtagtgtgatttcttattgacatggcaccatagacactgcttatggacaatatggattgggactgtctttaatccaatcaaaccaaggccaccccgtgaatgttcactgcatacgcatagcactattcacatgagacagacccatggctgggcctaccaaccgtcacatattgatctggaaggacatgcactattcagcgcgtgtgagatgcccaatcaaagaaataactgaaattgatgtagataatttgtttacttaaacaccgtgggaacgctggaaagttaggggtgccacgtcagatgttacttttgtaaaaaagcccccgcagttctgttaattatgcattggtccccgctgataatttatagtataaattagctaggtttggctatcgttgagcattggccgaaattctattctattaactaaacaaattagctaggtgacttgaagtgaagtgagtgtactcaccatccaattatagttaattagggtctgtttattttgttgccactttcgattcattaatattcatgtgtgagggcgggaatattgtgaacattttaagttagttttttttattagaggaagtatatcctaataattgattctcatattttattgatagtatggagcgaatccttgagaagtatgacagacatgagttattatctgaaggaaataatgtgattgaagagttccctgagctggaggtgtgtacgtaggaaggggaaatgttcatcataacatttgtacattcatcctgtataaatatgcactacattatatatcactatatctgttcaatgtataggtagtaaacaatttttagtttacatcttctgtgttctgcgcagggaagcatgagctatgaccacatcaagctgaggggcaggattgaagctctaaaaaagagccaaaggtaacaaaaaatctagacaaaactaatagctcttcaatttttcccttttctgtatttaacaaatcaactggcctttccaatgtagtatgccgtgttagtttcaatatacagaaaataggaacagtatctgtggatacccaaaatatgctacatatttctgtaaacttttattggtttattaataagtattaattaatcaagaagagggatatttaaaaaaaattaaaccctgcaacatactcttctgggaaatgatcaatcttttttacctggtgggaaaggatgatcatattatttttagctcgattatttgtcgacacatatactttattgaacattgttgatcagctcagcatgctgaatatatatggccttgaatcaatgcattagtctgaaaaaaaataggtgcaaagcatctttctttaataaaaatgtaagtgcaaagtatcttcatcttcttgaatcttggtactagctagacagtggattctttattgatggctcaagtttgtcactgtcaatacaaccggtaaaatattacaatcaataaaaccttttttttaaattaaaaatgtcatatatgtccatctagtttgatcttatatatggatttggctcaaaagctgtctgggaatcagtggacaaatgctaaaacgcagacacctattcttgtcaaatgtatatctcctttgtacttgtgatgccctagttgttggcaggatagggacctcatgctctcatacttgtcatccatggctcaggaatcttatggggcaggaacttgactcgctgacactgcaagatatccagcagcttgagaaccagatagacacttctctgaataacataagatcaagaaaggtacaaacacacacacactgaacttatagaactacaaaaatatgtttacttgagatgatcatattgtgtggtgttgctaatggtttttaatttgtaactaggaaggtaacccgcgcgaggcatgtgttgtacactaagtttgagatatttataagagcaaaatattgaacggagaacatctagcacaatttctccataaattgttatcatcggcatcattgcttttataatgttataacctattagttttatattgtatcatatttaaataatatctattagaaattatttataatcttctttatcatttgaaattaagagacttattttttttaagaaaacatgttaacgaaagtaaaaatatggtgtttttgaaattacatatctatggaccatagttcattaaaggattaattaggtggaagatgaagctccactaaacttttgggtttatatagtctaatatggttgatgtagtttgagaggcaatccatatatgaacatttcatgtagggggggtgagaggctccatgcagcctaacatgaatacgataacgacgaaatataattgcgcagtaatattttaaaaatattatgtaccatgaataaattcttttttttaggtaagatagatttaacgattataactaatagtttaccggtttaaaaggcacatgagtattgcagaatgtagcttaaaattatggttgttttaatattcaatgttattgcgaagtgagcgcacctcaactggttaggtttcttgtggtggaacttgcccactcggattcaagtcctagatttgatatgggtgttggcatttacgactaattattctttcagtggtaggtgacgtatccatcgacagcgagacgacatggtaacttcttcaatcttaaaatatgtcggctcagtctttcggaggtactaaaggggtagggtgcgtagacgctgtgtttctaagagatttccaatattattaattgtttccgctaaaatctatttatttttttcttaaaaatgtatggattagtttttgtcaacaattagtgaacaatagctagtccgtagaatatatatctgatccaaagtaatgaatttttttaataatatagttaacttggttctttagttttaaattttatagtaaataatctaatttatctcctacttatgctacattcgatctcattggttgagcttatgtagggcacacaaaacgatataggccattaacgcatgattaattaagtattaaatattacaaacgtgaaaatagtttttttttttaaaaaaatgtatagaatgtatttgcacaacatgcgcagattagtagtttaaatgaggcataatttttagacaatacattatttatttctgtttttgacaatatgtcctgagtaatttattactcattatttcatcttgaacaatcaagatacgtttttttgatattttatattatattatagatctacttttggctgtgcaagtttgtaaagtaatatatttttcttatactaccaccttcactaaatatatgacgttggtcatcaatatataaaaaacaataaaaaaaatacaaaggaagtacaaagagcgttcttttctttcggtagtttcactaaatatggccgtcataagaaaatacagagaagtgcaaatccacctttaaaaaaagcgatgttttttttaatttccagtagtacgtacgtatacagttttttttttctgtatattatttcttcttttctaggccgtggttgttaatccgtatgtacgtatgccttctcagctttttctagtcaatttttttatggaaagtattgctcggtaaattaggaggggtagattactatttataacagatctaatccaatggtgtaaactaatgggtccaccaacttaaatgaaaatcgagggctagattttttttcttttttattagaatttctaagttttttctattttattattgcgccatgtggcagcttgagagcgtttttagagcaccatgtggcagtatgagagcgtttgtaggaagtttaatggacttttagtatataataatagaagatagatagatagatagatgttttagaacaatctcttgctcaagtcgatcgccgagctccgacagaaggcaaatgctaaaaaccttttgattcttaaacttgtaggtgaaatggttataaatcttcttaatgttagtcttttttgtctctctccaggaaaagttgctgatggagaaaaacactattctggagaaggtattctgttaattttactgatggaatgaaaagcatatcctaattattttcagttaccactgcatgattcatgtagctgtactcagctcaactgaactgaatcactaattttgtgttaatttgtccatgaaaaaaaaaaaagaaaattactgaactggagacactgcatacatgcatcagggcgtcacccactaaagctgctgctcctcctgcctgcaatactgctgatgcatttgttcccaacctcaacatctggtgagccacaccatccaactgccaccatgcaatgcttgccatgttgtttcttcagattcacctcaactgaaactctgatacctggccttcaaatcaaaccgcagctgcggcgattccggcgagccggaaaccgtgacggcgccacttggctggaccagcagcaacaatggcttgccatggtggatgctccagtcatcatcgaacggcaagagctagaagatgttcagatgaaatggtccctgcagccattgcatggttgctgaataatgtcgtcccagatggttaggcaagcaacctagctagaactttcagttagtgagcggtagtagtatctcccccttcttaatccctactatactccgtagattaattctaagcatccttttgtttccattatctacgctgctggtttgatgaaattcctgtgttgtattcagctgcattgggatcattgctcagcctttggtcatgtctctcactggaatcaatgtgtcatgtctgtcttgcaatcacttcgatctggtattctattggtcagtctaatgagtgtaccttctagtactcagttttgtctgaattgtttcacaggcaaacagaaaaggcatacttttctccgttcaaatatagtaatctagtactccctcagttttcgtttcataacgtaagactttctaatattgtccatattcatatgggtgttaataaatctagatacatatgtgtgtctagattcattaatatttatatgaatatgggtaatgctagaaattcttacgttatgaaacggaagaagtactagaaagtcttacgtactctatggtgtgtctaacctagtagtagattgctactccctccgtccctaaatatttgacgccggtgatt

SEQ ID NO: 27007 - DNA, 2488 bp, Oryza sativa
aaaaaaaattaataattatttaaattttttatataagacgaacggtcaaacatatttaaaaaaattaacggcgtcaaatatttaggaacggagggagtatattttaaaacggtgggagtactgttttgtttgcgtgacatgcctcagaaggtgctgggccacactgctgcagaaatgcaggagacaacagctaacagttcatagggagaaaaagtgcagtgtggtagcagaggttgtttcaggcaaccactgatattcctagaaactaattgtgtctatttatctgtatgcactgttaacatcattcagtaatacatatcttgctagatgcatgaatgtgacggatgcaactctgaaataaagatggggcggagatgtttgataaagataatcgagcacaatacataccatatcatatttgtattgaaataggataaataatagaatgtaatcaataaattaagacacaaaaggacattcaacataaaaaaagtagagtacaatttcggagtcgcattgcaaccacagggtagaccggtagaggcatggccctacgcatatcacgacgtcacgcagatacagagttatagcggtgaagaggatgagcggcgagccacaagcaacaaagacaaacaatcaagggttggaatcatgcctagccctgagtgcttctttggtttgatggactacttatgggctaacgggtgatggctaatatgggtgagccaatattagaaggaggttcgggggatgtgggctatacctggacttgttgacgcattgtgtagtttggaggatgctgaaagttcctaaatgtgttaaggagctgatgctacaggattgtaattttcactcacaggtcaccaggacatgaaacaatattcagttccttgtctcgagattgtcccactattttgacattttgaccctttctaagaatttatttgaaaatatatcatgaaaaaaactaacaaaaatacacctcagtcccagcgtcattgttcttagcgctcaagtataaaatctcagcgccatattctttgcgctgataatgtttatatgcttcgtccctcatgacagaggtaatggaatggtggttaggtagccttcaatccaacacaatgttgtgggttcttgactctctctgcccacatgatatttttcttttactcaactatacagtccgagcatacttcaaacatataaatatactttcattctttctcccacattattattttgaaacatatactttacttcaacagtatattcaaagttatatatagtacttccgttgtttttttctcacagtattgtttccaacttttttgtattaaccgcttggggaaaacaaaccgaaatcaaatttgaatatatttcaccgcaagaattcgatttgcttctaaaactgtacttctacctcttgggaaaaaaaagtaaaatcatatatattcaaatgcaaggattcgagttgcttaactgtacttctacctcttgggaaaaaagtgccggaagaaaagaacgaaagatttccttgtaccgctaaaaagtgccaaaagaaaaaaaaaagaagcttaggctgcttgctacctcacgcatgcatgcacgaaggccacaacaccacaccctacaacaacattattactccctccatttctaaatatttaacatcgttggttttttagcacatgtttgatcgttcgtcttattcaaaaacttttgtgaaatatgtaaaactatatgtatacatgtaagtatatttaacaatgaatcaaatgataggaaaaaatttaataattacttcaattttttaaataagataaacggttaaacatattttaaaaagtcaacagcgtcaaaatataaatattttgaaacggagggagtagttaatacgatatatgctagctagccattagttgtgagatcagctaacgagcatcaaattaagatgtggcgctgagatataagtacttcaacgccaaggattatgacgctgagattgagttttatttttattttgtaaaagttttttgtagggtctattctttaaataagtgtttagaaagggtcaaaatgtcacattttgtcgtccctgtcccaagaatgcggggacaatatatcgtcgtctctgccttgttaaaacctttcgaaactagtgctacgcatttctttgatccccttacttgacctattgatccaggaacttctgtgactacttgcatcattttccctgccaaccatcacgacatttgatcaattataagaattaccaagcctatggaacctgatccagggagccataactctggattttactatgcgtacggtgatgaaattatcgatctggagatggtacaacaaaggatagtactcagccacatcggcatacaaagttcagttccaaattccaaggatgcatggttatactatccattgttctgtttgacgcgtatgtttctcaaactatataaacgattcatttttt

SEQ ID NO: 27008 - DNA, 2287 bp, Oryza sativa
tttaaattttaaaaatgtattaatatgattttttaaagcaactttcctatagaaaatttttgcaaaaaacgcaccgtttagtagtttgggaagcgtgcgtacgaaaaacgaggtgctttctccctcagtatcctccaaacgaacgctacctaaatatttaacagtaactagaggaaccaattaatgactgactacatcttgttcaggtacatatatgtacagaaagaaatagctgaagttatccaacaagtgcacagctagaaatagtactgtaagtaatacctactctttgtacatatacatttgtatctgttagctaaaatacaagtgcaattcgtacaaatttgcattggctctaatcaattcatacacagtatagtatactatcttcttttcttatagataacgccattaacttttaacataacattcaaccattcatattattaaaacatttagtgtaaatatttaaaagtataagtcacactgaaagtttctttaatgataacaaagtcatgacaaaataaatgatacctatataatttttaaataagacgaatgataaaatatcatgccaaaaatcaacgatgttatctattaaaaacggaggactacctcctaaaggactgtaaaaaatcacttttgaggaaaacgtgaactgccattgtcagtatttctctgtgaaatgccaactgagagaaagtgtaaaagaaagatttttcccttcatggtcccaaactttttaccttaagacccagtgaacttccatgaaaaattgcatttcggaagctggtgtttttttgtgaagaaaatggtgtagttgttgccgctattgtgtatccgtccagtccaaaatcctgaaatcaattataaacaaaattatgtagccacagcacatgaagcctagtggtgctagcaactttaatactaattcgtctcttgaattctttggatagtgagtgtcatggttgggagtgttaaggatagacgatagagtacttgtgaatattccaaataaaacataaaaaaagaagatgatttggttgagaaagtgcaggcctttcataagaacaaatcccaaggagcacatgagtacattttaaacaacttcaatacaacgattcatggaacatgctaattggacagcttgggtgctaaagctgcatcatgtttgggattggaataaatacatggctaccagtagttaagcatattgcagtggcacatctgattgttctgtgaaaggtggtgccatcatgaatcctagccttttctctgaaattcggaaacatggaacattcaagaagctgtagtaaagcgatttttatagagataatctaactcttactagtaaacaagaaaaattaactaaagcaaaaaaaaaaaatcagctcatgattgcacatctgagagctgtgttggcttgtcggtgatgcaacacaaacatcaccgattcataagcatagaattgtcctttttaaaaaatggtggtgtggatgcttatcaccagctggttcaggatcaagcgagacatttttcaaactatgcctgcattttgtctacaaaatcatgcgcattcccggctttatggccacaatagcagatgggtagatctaggttaagcagagagcagcttctccatgatgattggcactttgacagcagtgcatgccctcatgtcctttggctttgcttgcatatgctcctctttcttggatcactctggtgttcatcagcaaaagtgtaatgatttgtgtgatcttgggattactaccctctccatgacctatatctgtccatataaaagaatagaaaattgaggacaggtagctagcaggtacatgtttgaattttaaacttgaattgtgttatatatactgtcatatactccctccctccgtgtattttaatgtatgacgccgttgactatacgaccaacgtttgatcattcgttttattcaaaattttcgtgcaaatatgaaagtatttatatcatgcttaaagaacatttgatgatgaatcgagtcacaataaaataaatgataattgtataaattttttgaataagacgaatagtcaaacgtcggataaaaagtcaacggcatcatacattaaaatatagaggtagtactattttatttgcttttcatctgccagaaaacactgttgccttcagactaattgagagaattttttttatttataatttttttattaaaagttttacaaaaataattttccattttgaaaattgacggaaatagtcgcctaccgccctctgggaggg

SEQ ID NO: 27009 - DNA, 12117 bp, Oryza sativa
acacaatgtcagtatctgttgtagtgagtcgtgcaatagaaggttatttttgggaactaatgccgatggacagcactgctgcttggagacggtatgtggaaatggcttttgaacggtcatggcccctcgttatatttgtgtcggtacaagagaaagatacaaatgtttcaatgcaaaccgaagatgtggaggttcctagcaatgcaggggatgttgttggaccatcgatgcaaaatgagaaaaatcaaccaagggaggagcaggccatgggcatggcggatgagggggagagagtcggtataattgttgatgaaatggagagggaagattcggataatgagcaagcggaggacgacgcatcatccgatgaggaaggtgatgtaatggctactgattgggcaaatgaggacttctctggtcttgttatatcagagggtgatcatgtaccctgggagtataaggagaacgaggtaattgagggtgcaaggtatgctcataaggatgagatgaaggaggcggtgaagcattgggcagtttcattgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagacgaggtatggcacatttgaagcttcttatgataatttgcctcgtttgttagccaccattgcccagaggaataataatacttactatgacctacatacatttacatcggttgaagatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtgaccgagactacttcgtggcggtacgtccaatttgtattacttccaacaattatgtcatttatcttgcataatataggacaactactgaattttttatttccatcttgcataggctgatgcggcgcgggatatcagtgccgatatcaccgcagtccaggtgaggttgaacagaggtttgcacttgactgacgttgagcagagggcgaccttcgaccggatgcaggagaagatgcgtgcggtcatgcgcgtcttctcctgtcgcagcgccgtggacgtcgtacctccagctggtccggtacacccacggcctcgcgcgcctaccgtcggagcaggacctcgtttgtcttcgagcgcccctagcttcggagcagtgcgacctacagcaccggtttcgcacggtacagttcagcccagatattagttcatttttgtttcagcttttgcacgaatgtgtcactatgttttaactgcacgtttcctcatcgcaggacctcgtctgcattcgagcgcgttcgcaggcacgaccggcgcttccgcgagctccgcaggggcgttcgccacctcttcgggcgcgttcgccagctcttcctcccacggagcgtcgatccctcgcccacacggtactttactttttattaatactgttaaatacctgtacgaaactgatggtccttgtccagcaggatttgcagccgggatcttcggtactggggcctcttcgtctcacgccggtaggactggtcctactagccagttctacgacgacgacttgcacggtgcagaccaccaggacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcatttatatggtgctagaacaacttatgctcacgacaacacactttcggcgcttcacggtagtgccatatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactaccacaccacacacgaaaatggaagcctattaattgctaatacgtaatctagaattgagattatgtacaacattcttcactacaattttacattttggcagcaaaccaaatatgatcaaatgcaattttaccttaccaaatatttggtagtgccaaaacttgcttatattttggcattaacaaaatatttgtacggtaacattccaaatatgccctaaaaataataaaattgtattttaccagtcttggagattttaatcttgtatagttttcaatataaaaagatttgataactattgatatttatataaaaaaaatatagagcacagtacaaaatcgccctagcggagggcggcaagggggccgcctgcaaaattccatgccccctcgccacccatttgcaggcggccccccgcacagtgcaaaatcgccctagcggagggcggcaagggggccgcctgcaaatttcgttgacggccgtcgcccgagagcgaacggccgtctgccacgtcattttcgccgccctctgggagggcgatttttaaaaatcgccctcccagagggcggtaggcgactatttccgtcaattttcaaaatggaaaattatttttgtaaaacttttaataaaaaaaattataaataaaaaaaattcctaattgagagctatgactgacttatatccaacaacattagtcaacaaaagcaaacactcttgtttggggctttatgtccactttctaaccaccttgagaaaaatggatctgaatcatatacatcaaagccatatgctctctctcagtttcacattttttttgtgtatttactagggatatttggatatatcataatatttttctatgtagtcaattgagttgccacatttcttccctaattccttatatctcaagctggcaaggttgatgctcgctgattgattgagatgatgcacaattatacgttgacacgtgtccctctttctctcccccaagaggctaagagtgtggctggacaagtatttagaaaaacaaaatactaaaaatctagagaactcttcccacacaattaactctagtatcttcgagtctggtctcatttcaaatgatttaggagtaaataagacaatattgtagtcaaactaatcgaggaaaaaagtttcaaaaacaacatttatatgggtcgcattcacctgattaaatcaaagaaggagctaacaatcgaaagaagaattgagccaagcaataagatcgaacatgagcaatggtggtggtagtgactgcaatactggatcgaacaagtgatggtgctcgcactaaatggctcttccatgaacaatgcagtgctaccgaagacttgttgatcaattggactttgccattgcagtgaacgacatgcttgtcgggctcacaccacgtaccgccaccctctcgctggtcagacgtgccccgttttcagctatgccggaacttccatgccaccacatttacatggctgacgctggagttcagatagccgtcttcgaatccatcgatcttgcatcttggcacccccggaatcaatgccccaagagtagccatctgatcgagttggtaggagcacaactgccaccagatcagatgtgtcctctgtctctacatccctctttccacatggatctgacatctgccaacacggccaacatcagatcgggcaacctaaggtaccaagtaccataagcctcctggcgagatgggaggggaaggagagggcatcatcgtagccgtcgctggtgaggacagagaaggaaaaaggtgccatcggcgagatgcagaagaaaaagtctgagagagggagaaagaggcgacacggcagactgattgaggcaccaagcgtccgacgagacaacttgaaagtttcactcgattagggcaaacaagcccgcttgaatgtatctcttttagaaatgttacaaaaattatgttactttttaaaaaatatatcttataaaataaatatcttttaaagagcgtacatgtttaaagcagtagatgtaccaactgtcacgtctattttctagttatgcaaaaagggctaagggcaaccacaatatgcatgaaaacccaccttaagaaataaagtagtatttttttacctttatacatagggagatgatttatgaagagaatagtgttatgggtaaccttaagcttaagggtagaccataagaattttaaaaaatatatcatagctttgcaacatgcatgtacacttttaatcttgagtaaatatgtgtttttttccttagtgagtcccaccttaagatcaaaaagagaccatatacttcctccgtctcataaaaaaaacagtacatgatgacatttcatctgtcatcccgggtactaggttggttttttatgggacgaaggtattacattgtattatgtagtatggacaaacacaaggacgtcccgtcttatgactacattgattttaaacattgaggatgctctaatgcctttgtttgatttatattatttggcagattataatcatggatcatctacttagttatagggataaattaaatatttcagaagtaaacttaacaataaaagattaaaaattgatacaaacaatacaataaaagtaattcttttttgcaaaaaatatattcttcaaagcatgaaacaaataatcccttttaattgtccgatgaagtgaaaagaaagcttccgtaagtaagttattgtaccgttccaaacttccgtatggaccgtatggtgccctgcacaagaaaggtgttgaaaaaaatactaaacaaaaaaaaagacagaaattctgaacatagaataagaacatcaaaaagttcctaaacaaaccagaaatatcaacatgaatacattagtgataaaagatcaagtacacaaaagtccctaataatattttttttcaaaaaaagtagagacattatttttactttctaccttaaaaaaaaaagaaaaagaaaaggggcgcgtgcctggccgcgaagatggtcactggtcagcatgggacactgatctccttcccttttctttggggaaagtgaaatcatccctcgaggaaatcccctcgtttcgtacatgtcacctaaataatcataaaaaaatataaaaaaaattggcaacatagattaatatgaaacatatcactctacaaacatgcaagtttaaattcaatttctccaagttgtaacaaaaataacaaatatagttacgaatatgcgataactattttcagtttaatttgttatttttgctgcaatttatagaagttgaatttggtcttgtatgtttgtggagtgatatatttcgtattaatctatgttgtcaattttttttaaattttttaataactatttagatgacatgcaaacaacgaggggatatcccctcgagggatgaaagtccacatccttttctttgctagcttcagtggagccacatgccagcttagccattaaccacacttcactcactccacttctccaagaaacccacacgaacgacgatggcagcaagatcgtcgctgccatccttctgcctccaccagatcaggtcagacagccgccgcggcgcgccgccgtcgatacgcgcctcctccaccggcgctgccaatgatggtggccgcaacgacgacgtcgacggcaaggaggaggaggagaagagcgaggtggggaggaaggtgatggtggtggccgacggcggcagcgacgaggcgcggacggcgctgcagtgggcgctctcgcactccgtccgcccctgcgacaccgtcgtcctcctcgacgtcgtcaagagcggcggcgacggcggcggcaagaacggtgagcattgtagctatggcttaattaatgatcttccttcgtttcatactgtaaatcgtttaactttttctaatcatttttatgtttaataaaatttattgaaaaaattagtagtatctattttattaaatgggagtattaaatatatctaaatatattatcataatatgtttttttagaaatgttactaatatttttctataaatttggttaaacttaaaaaattaattaacttataatatggaacggagacagtagcacatttctaattagatatattcttgttttttaatatgtgttgagaagcttaaggtgcacgtatgcaaagtaattaaatgatattgatagttctatatatcttgcatggttggtgatgaactttgctgattgattaattgattaattgattaggggatgatccaagcagagggtgccaacatctggagacaatgaggagtatttgccaggctaaaagaccagaggtatacaactactaaaaaattgtggtttttctactcttgtagctgcaaaaggaacttaattagaaattgtttttttatcaattaacaataaaatgagggtgatttttactgttttgtattacgtcgtttagatccctctttcttctcccaaatgcaatttgagctgtcataatatttttttggttcctgtaaacagtgaattttccctgcttcaaacagagcactttaaggaactctagaaggcatgccagttttcataaggttttcactgaaaaagttggttctgttatttcatatatcctaatggagcatgggggccatatattatgactatcctcataaaggggttatcatgatggagctatggttcccattatcttaaaaaatgatggagctatggctttagcatatcatatataatacacagagcttgcccattttgatctcattatattctggttttatatgaacaaaaatttgcaatatccagaatatccattcaatctacttacgatcgaaccatatatgtaaattccaatacaacattgatataatccacaaagcattatggaatactctgacttgcaacatcatgattaagattgatcctgcaagctagaacttctacacagttacttattattgttcagtgatagctatgaaacagatgcttctattgataaatagcaccttctgtttggtggtacatattttctttcaagcaacagatcaatctgcattggaacttatactcccattttttacagtctctaaaccaaaccgaaaatatatataaacacaaagcaccctaaccctgtaaaacccatatgttggtagtaacaaatgagagaaatttatcagaaagctggagatgattcttgcaatccatcaattaatatctgcaagcctgtccctttaattaccttctggcatttgaagtgacatcatgtatttcagatcaacctgctaactaatcagtaaatcctctttgccgacaacccagatgatcagtaaataccctgtggcagatcttacccttttgtgatctggaaatatagacagctagtactacatataaaccagttcattggtaaattaattgaatgaatgctttccctgagacaatgcattctatgtcaaacagtgttaataatatagagggtcccattcactgtcaaatcatgaaaatgattggtgaacagcctccacagagatgcatgtgctgagcatcatctcaaggggtgcatatgcagttgcatcccagacaggatcatggattcatggcccttgattatgtttctcatactgcaccttttcaatcctagtttgacattcatgccttttgcacctgccatagcatacgagaattaattaagaagttaatcaatggcatccagaattccatgatctagaaacttctgatctgaagctaagctaggtgcagcaaccgggttttatgagttatagatttactaaaagaattataacatcagaaaattacctctccatattcaaacaattgcagttttgattgtttcaatcttgactacttactatggacaaattaaaaggttttacacttatatttgagatgcagtactagtacacttcaataatatgacatttttttaaagtatttgtagctcctttttttttcacgaaagaccggtgctcagtgtttgaagatcagtggtatatatatatatatatatatatatatatatatcaaatgacagtcaggggcaaagccaggatttatggctagggggtgtaggcagggcgaacaagtcataagtcagggtaagcaataccgacgataaaaaagcttgaatttagctttttagttgtatcattggatgtttgacaatttgagacttgaaacatcatgctcgataacgagacgcaatgggaggacagagagacgtgtgaagccgaagcaatgatgacgaggagttgatttgcgtcgtctctccatctcttccttattaattaattttctataccatgtttattaataatggactaattaacatgctaatgcgctagttagtacaacagggatgggtgtcggataggggggtgttggcccccttcggcaccccctgtagctacgcccctgaattgacagttatatttttaaaacaaaacgggtacatgagtatatgtcacatggcacaagtaatgagatattgattttttttaacaaaaaatgcatggtagtttaggagaaatgaagcatgattgtggaggcaagcctagggcttaacaagttgcccaagttacctggacttgtctccgcccctaattggaacttacagtttttataatatttcacaagctagaattttgtggaaatattgaattgagaaaactcttgcattaataaaaaaaaataacatgtccttactcgcgtcttgattcgatctatatataggtacgcgtcgagctttccttggtggaagggaaggagagggggccggcgattgtggaggcggcgaggaagcaaggcgtgtcgctcctcgtcatgggccagaagaagaggtcgatcacatggcggctgctggtgatgtggatgaccggcggtaaaggcggcggcggaaggggcaccgccgagtactgcgtgcagaacgcggcgtgcatggcgctcgccgtccggcggaagagccggcgagggggagggtatctcatcaccacgaggcgccagagagatttctggctcctggcttgatcgaggtgtcccaagagcttacagtattgcatgtgtgtgacctaactatggcgtgttgtaggtgtctgttaccggagaggttaagttaattatagtggaataggcattcatgatatgagaaataatgcacaagatgagtgatggtgtttggcgttggattggtcgtttctctttcgctcaatttcaactctcttacaattcacacaaaaagattgagaatatatatagcttggtgaccattggaattttgtgctctcggattgtgcaaacacgttaattgattgagaaacatttatattttggacgtgactacacagctaccactccacctataagagactttatccacctatacttcaaataaaattttcttttaaactactcatccgatctacgatccgattacatcactgtgttcgtaacaattaaatctttataacaagatctcacatgattatattttgatgaaaaattataaattacttttataataaatctaaattacttttagatttcactaaattacttcttcgacatataaaagtaaattcaataaagcttaaaagtaatttacatatattatagaagtaacttataacaaaaagaaagtaactttaatgaatttacttctaatgttatgacaaagttacttccgttttgttttaagatacttttataatacatgtaaataccttttagactttattgaatttacttttatatgtttaagaagtaacttagtcaaatctaaaagtaacttatatatatgataaaagtaacttacgtatataataaaagtaatttacaaatataaatattttttcatcgtaatataatcatgcatgtaagatcttattgtgaagatttaattgtaacgaacacaatggtgcaatcggattgtagatcggataaataatttgagagaaaactttataagaaggaagaaaaagacatgcatgtctaagaggaaaaacaagcatgcacgtcagaacttgtagcagtacttcttctcacaattcgttcgtcgctggttaacactaaaccgagaagccttttgccttatattttgtctgcttgactgaacaggctgctgtccagtctccatccaccctgtctttctttcctttttaaaaaaaatgaaaaaaaactcaatcaaaggtaactattttctcacttattatgatcagaatccttgcaaaattcagttatttctcctttgggccattctcccggcccatttcttcgtcatttatttttcaataaatctattttgcttccctcaactcttgctcttgattgaatcgcctcccttaacagctataccaggtataacatcttcatcttcaaaaaccggagcaaatcaagtccctcgtctgttttaatcacggttttgtcctcctacgtaaagctcatggaaccacgtgtcagtgaaaaaaaaatagaaaaatacgcatgtcaggcctttctttttcctcacccctttctcacatctctcttccccattctctcgccaagcggcggtagcggccggagagctcctccctgtgcgccctgcggccggtgactcctcccgttctgtctcgccgccgccgccgcatcgatcgatatgtagccagccggtctgttcctccacgttggcgacggcgcttgttgctttccgccgacgtacggtgttggcatcgttagataatcctgaagctttgttcagcaaattcagttactctgtatcctgtagcgtgtctagctattttcgttcttcagctgttctgttttttcagttagcttattagctggttttttaggatctgagccggcacttccctgcgtggttgcgtgttcgtgcgcgccgtggagtcgtgtgtagcgagagggacgtgttggatggcacacgttgcaaaccgatcatggcgcgctcgttgaggttcatggcgagaagcgcggccgcgtctgttcttatatatttctcagtcgcaaattcagaaaagctgcagcgagttaacgcccgcagcaccagatcctctgctcccactgtgttttcgcgttgagtatttgcaaattccactgtgatcctgtgagctagataacataacggtacgtcgttgctgctcacattgatcgatgtagccggcatacggtacggtacgtctttgctgctatatatccatgttgaagtaggagtatatatctagagaatggagtagagagatctcactgggaaaagaggtcttctatattaattcgtccccgatcgagaggacctgaccgtgtcgccgtcgttgatgacgcctgtaggagaggagagctctcctcacagtttccctcgtggcagccgatcgacagagcagagcacgctcagctaagctatccaaacagccgagggactttgatttgatctggttttcgaagatggaggaggcattatacctaatcaggggcaagagttga

SEQ ID NO: 27010 - DNA, 14947 bp, Oryza sativa
tttgtactgtgcggggggccgcctgcaaatgggcggcgaggggacatggaattttgcaggcggcccccttgccgccctgggggagggcgatttttccccccccccctataaagcccagcccctcctctgtgaaatttcattatattcactaaaaatccaaaaaaaaacgaaagagagaggggagggcagcagaagggaagcggcgaagccctgctggttcgctcacttcatcacaggtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtacttttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgatagccctgcggagagaacatttcagtcaatttatagttggttgttgagaggatttagaatagaccaagaagtctacacaatgtcagtatcagttgtagtgagtcgtgcaacagaaggttatttttgggaactaatgccgatggacagcactgctgcttggagacggtatgtgcaaatggcttttgaacggtcatggcccctcgttatatttgtgtcggtacaagagaaagatatatatgtttcaatgcaaaccgaagatgtagagggtcctatcaatgcaggggatgttgttggaccatcgatgcaaaatgaggaaaatcaaccaaaggaggagcaggccatgggcatggcggatgagggggagagagtcagtataattgttgatgaaatggagagggaagattcggataatgaggaagcggacgacgacgcatcatccgatgaggaaggtgatgtaatggccactgattgggcaaatgaggacttctctggacttgttatatcagagggtgatcatgtaccctgggagtataaggagaacgaggtaattgagggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctagcaaaggcctggagagccaaagaaaaaattattgagatgaggtacggcacatttgaagcttcttatgataatttgcctcgtttgttagccaccattgcccagaggaataataatacgtactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatctcggtatggcataatgacaccaatttggcagaggtgtacaactgggtaatgcgaggagttcgggtacttccattgattgctattggtgaattcatccttcacggcacgcaagcgtactttagggatcgatacaagaaaattggtccgtccatggccgataacaacatagtgtttggcaacgtagtgacaaagtacatggaagataaaatcaaaaaggcacggagacatagagttgttgctcaaggcacacaagtgcatcggtatgaaataatgtgtgttgataggagcaggcgtggtatctatcgcaagcaagccgtgcaggaatgtgtcttgaaggcggatggtagatgtacctgcagttgtatgaagccgaagcttcatcaccttctttgctcacacgtccttgctgctgccggtgattgtggcatatctccaatgtgtacgtctcaaattatttcaggaaagaagcaatctttcatacatggagtgaggagatatatgggttcgggatctcaggatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgtccgaagaatgcagaagttccaagcggcgcagatgctagtccatctggacaggcaagtgatggtaggcgaccacctggtgaaggaacaacaagcaggcgcgcaaggccaaggcgtcgtctcgcagcaggcgattccatggtgtaacaatgctatcgatttaggaaataaaatgctgttgtgatgtgatgagtgttcggactaaatacttctatcgtgtaatttcaattgaatgttgttgtaatgagtacctccgactattgttgtactagtagtattgcgaactattcggtgttgtatcataatgttatcgtgatgagtgttcggactaagtactcatatcgtgtaactgcagttattgttgtaatcagaaatattccgtatggtgacacttttgtttatttgtactcttgtttaatatgtgttagtaattcgcttattaacatttattacttatgttgaactaattatttatatgtttctgatcaatctatttgatgcaggtatggcgtacgacacaccggcgctgttgaaccgtgggattgacaggaacgaccggcgcttccacgagctccgcaggggcgttcgccacctcttcgggcgcgttcgccagctcttcctctcacggagcgtcgatccctcgcccacacggtactttactttttattactactgttaaatacttgtacgaaactgatggtccttgtccagcaggatttgcagccgggatcttcggtactggggcctcttcgtctcacgccggtaggactggtcctactagccagttctacgacgacgacttgcacggtgcacaccaccacgacgtcctaggctcctctcagcttggaggagctccagaggcgcacactcaggagcagccagagatcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacgtagttcttttcattcataaggtgcttgaacaacttatgctcacaacaacacactttcggcgcttcacggtagtgccagatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacaccacacacgaaaatggaatcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacaatccaaatatgccctaaaaaataataaaattgtattttactagtctccagatttgataactattgatatttatacaaaaaataaagagcacagtacaaaatcgccctcccccagggcggcaagggggccgcctgcaaaattccatgccccctcgccgcccatttgcaggcggcccccccacagtagaaaatcgccctagcggagggcggcaagggggccgcctgcaaaattccatgccccccctcgccgcccatttgcaggcggccccccgcacagtataaaatcgccctagcggagggcggcaagggggccgcctgcaaatttcgttgacggccgtcgcccgagagcgaacggccggctgccacgtcattttcgccgccctctgggaaaaatcgccctcccagagggcggtaggcgactaattccgtcaattttcaaaatggaaaattatttttgtaaaacttttaataaaaaaaattataaataaaaaaaattctacgtctggccaccttcccttccggcctaggcccaccagccgcttagcaccttcccttctccccaaatgaaggttgatcgagcacaattcttggatgcccagcatcttaaaattttctcgcaatcctattttactgttagcagcagagacagccgctaccatcttcactgctaagggagtgtttgagacaagtattggcaagggccctcgcgtcgccctcccccgggcggctcgggaggcgacgcgcgcgccgccgctttcctcctccccccgccccctcctccacctcgccgccgcccgagcggctgccggaaagccgcgcagccgcaaggacggcggcggcggggtctcgcctcgccctccccacgctcggcggctgggggagcagtccggggcggcagtggtggcggccagatccacgccgtttccggccggatctgaagggggggtggtcggcggcggggactgacggtgacggtggcgactgaaggcggcggaccacggcaactgagcgacgttggcggcggaccgcggcgactggcgacgtcgacggcggaccgcggcgcgtccaggccgccacggcagggacctccgccgcaccgtcatggtcgtctcgctccagcctagcgctgagtggcgcgctccgtcccccggacccgcgccaccccagccggatctggatgggcggcggctgctggcggcggccggtgatggtggcggctggtgacggtggcgtggagacgaccggtggaccacggcggctgacggccgtggtggtgatggctggcgacggtggcaccgtgcagcagacggcgcgtgacgccagcggcagcatatgaaggcggggaaggagttgggcggtagggaaggagaccgggagcgggcgtggcgtgggcggcggttgcgtgtggcggcgttgcacggctcgggagggctccggcgagctcggcggctgcgcagagtcgagacgggcttcggcagggttgctcgctggtggtgagcctcctgctcgcgatatgtggatgtggatgcgctgacgtgtttggtcacgtcgaggtatgattgctcgtgagacgtcacggactattccatggtcgtcgacgtggggtgcttgtgtgagtgatgtgaagacgctggcgaaagccttgccgtgcctttggccggttcgacgacgacgacgctcttgggcgccattaaccttcttggaggcgtcgtcatggcgttctttcatattccccacaaatctccgggtgaaaaccttgttccgatttcggacgagcggcggcgacgttacgcgtcgtgtcctccttgggggtgtcgcttcggagaagttcctatgcatcaacgaccatggatggtctttttcggttctaaagctttcataccttgacgtttggcgaggccttcgcctccttgggtccgcttcgttcttgtggtgggcgacatgctcttcggttgcttctgctgatgaagtcgaagctgctcgctgatggggtgcggcgatgcttggcaacgatgacaagttgcagtctcttccaaggagttggtgctggccgtgtgaaggaagtgtctctttggtggtttggctgatgtccattgttggatgtcggagctgcttttcgctctggcgactttcgcggattcagtgtcgctgcggttgtgaagtcggcgctgctgggtcgctttggcggctagctcggcaacgataacacctcttctgtgatgttggagctgtttgggccgcttttgtgttttagcttggcaatgatgttctacatttggactccgccgttgttgatagttgtgtagctagatctcttgctttcttctgtgtggtgggttttagccggtttcccgtaattaaccgtgcagttgtatggttttcgggcccagttttccttataaactgggtcaattctcttcttctaaatataaaagtggaacaaagttccgccttaggtttcaaaaaaagggagtgtttgagaggggagaaaaaaaagattaagaagatgatatacaaaacgagataagccaattagcgcattattaattgagtgttaactatttcaaattttaaaaatggattgatataattttttaaaacaactttcctatataatttttttttcaaaaaacgcactgtttctctcccaatcacccaccaacgatagactatctagaaacaacattggccgctcggtctccgacgctgccatcgtcattgcgaattgtcgtcgacgtatgaaaaaaaaaatcgatttatcatctggaaacaacattagccgcgtcgctcgctctaccatcgctgattgtggaatttattaaaacactgctctgaacttaaaacaacgggttttttttttgtttcagtcacgcgctctagcttgtataaattactccattaattatatagaatctcatcaaacatctaatttgaacttcataaactcatatgaacatgtacatgcacagcacataaaaacagacacacacatacaagatacgtgtaatcataatcggaagatgatttttacgactcaaatatgtatatgcaccttacgtcctaagccatttgatgttttgttgagattcatgttatactaaagaagaacactactaacattattatgtcttattaaaatctactccctcaatcccataatataaggtatggtaaaaattacacggtctccaaaactaatctttaatttataatttctcatatgctataaggtttgtaacaacaaaattataatcatatgaaagtaaatttaaatgtcaatctaacgatataatttttatcaaataaaatttatttcatattacgttaaatgttggtcaaatattttaaagattaaatcttgaaatacgtgcacaccttatattatgggatggtgagagtatattatgccatgtacaacgcgtgaccctagcttgtggtctcaaacctccacgtcggacgcgcgcacccatggcagtggggaccgtagcactgcaggctgatcccgcgcttgcagaagaaccgcccaaagcgccgcgccagggcttgggaagggcgaagcccggtccgaggccacgcgttggcagagccggagacccgtgcgtcgcctcgaccggtccccagatccgccgccaccactgctccccggcgccgacggtcgcgaagaagggaggaggagaggaaccaccgccgttgtggcccccgccgccagatccggcgagcccgccaccgacaagctcgccacgccgtcggcgagctcgtccgcgtcgtcgtggggggaggaggacggcggcgtcgagccatccgccgccaccgctgctcaacgccgccgccagatccgccgacactgctactcaatgccaccgctagatccaccgccgccgccactccccgccgccgctaccgctgctccccaccgccgccagagctcgagcgccgctgatggggagctcgcggcggagaggggaagggagaagccgtctcgcgccgcagaggggaggggagaagctggcgagctcgcgccggagaggggagggatctcgccggcggggtggagtaggcgtcagtggaggtggagaaggggatcggaggagcaacgtcggtggcgtatgagaagggggacaggagagagaagggggagagtaaaaaagaaataggttggaagaggctgacaatgggttcttatgatatttaggggtgcatatgtacttattttggttgctatgggattcaaaatataaaattttaggcctcatttctttcagcttgggattattataatctagattattgagtcagattactataatctagattgttataatctgtagtagaataagcggttagttgtctctttcctaaattattagagcctagattattgggtttgcaagtctaaagagggagtggggtggcatggtgggtaattttttacccaataatctagaaaaagctcacctaaatgagcttatcatattataataagttgggctccagattataataagctacttcaataagttgtctgaatctttcagcttactcccaataatctggattataataatcccaaactgaaagaaacagggccttaataggtttgataatatcatacaacacaagggctgacatataaatagataggggctgaaatgcaaaatatgttttggagtggttaccactgtgggttgtgtgacctttatgtggttctattctacgtggcaacttgagaccactgttgcttgtggcttgcattgtacatacccttacatgggcgaatcttgaagcaaatttgatgacataaaagtgcatgggaatttgcacttgcgttgtgactttcctgcataatcatcgatgtatggatacattatcttcatcctaaaataataaaataatatagtagtatatataagaaaaaaatttgttaatatacttatttttttaataatttacatttatatacatacatcggacggattcgtaaaaatatacatgtcccgcacgatagaaacgcgggactgcgatgatcccgcagctccaaaacgcaggatcatcggtcccgcagaatggtcgtggggccacgacggtccgcaggttcaaaatgcgggagcgaggcagcctgtgattttcaacgtggtttagcactgtgtagcactgtttcgatactgtttgaaactatttggcaccgttcacacgcgcggtaccgcaggttcaccgtgcggaaccggcccctaaacaggccgctaccgtgcaaacagtacccgaaacagtgttgaaccagaaacagtgttgaacagtgccgactcagtaaaataaatcgctggccgactcgctcccgcgttttgaccgtcgcgatcccgcggaccgacgtccggcgttttacaactgcgggactatcatggtcccacgtttctatccaacggaacgggtatatttttatgagtccgtcttatacaggtatataaacataaattattgaaaaaataaatattttcgtaattttcattcgtatatatgacgctagttagtatactctcttagttctttaatatataatgccatctattttttaaatacgtttgatcatacgtgttattttcaaaaatatgtaattatcatttgttttgttataatttgatttatcacatgttacatgacttgtaactttattgatcggtaaaaaataaaaattgaataagtcaaattatcaaatgtatgtcaaaatatcaatgacatcgtgtattaaaaaatgcatattaaaaaaggaggtagtacatgaaaagaaactgaggtagcaatatttaattaagcataattaatccagagaggctgcaggggtgagattattcgtcatcttcctcctctttaaacatggcttgtaattttattgatttgtaaaaataaaaattgaataagtcatatgatcgaatgtatatcaaaatataaaaaaaatcttatattaaaaaaaggaatgagtacatgaaaagaaactaaggaagtaataattaattaagcagaattaatctagagatgataaagtaatacttcctccgtttcgtattataagactttctagcattgcgcacatttatatgtgtctagattcattaacagtagaatgtgaacaatgaaagtattataatatgaaacggcgggagcaattaattaagtagaattaatccagaggcgccgcaggtttacctacgcgagcagattaatcgtcatatccctcctcctcttcttcctcctcctcctcctcttcgtcctcgccgccgccgcctttgcctttgcctttcttcttgcgcccaccgccgccgccgccgcggccgttcttctccagcccgatgaccttctcgacgagcctgatgacgaacgtcttcacccgcttcctccggctgccgctcgcgcgcggcgacgacgccgccaccggcgcctggttgtaggacgatgcccgctggtgctgcgtgtaggccaccggcggcgggtggtggtggtgggggcggcggcatccttggcggtggacggtgaagttgcagagcgggcagcggtagccgaggacgccggcgaggtcgcggaggcagacgttgcaggtgcagaagccggcggggacggcggcgaagctgatggcgacggtggcgcggccgcagaagccgcagctgggagggttggaacaatggccgccgccgctgctctgatgatccattggttaattactagacctaatattgattcgatcctaattctccattgttttagtggctgattttatgtaggcttaaaagaagttggttttttacagtcattttcgaggaaattaaacccaacagctagtttgggattgggtggatagctacggtcccttagatataggatcagtttagtttcacatattttaatatgtttatgtctaaaatctaccactttgactcaatattgtttttactggtacacttggctcaacataatcctaggggacacaggaaatgggagagcgctacgcgttggacgtacggcgcgagacaaaaaataccacatgaacgtgccatgttatccacgcatgtaagaacaataataatgatcattatatataatcataataacaaataaaaagaaagaaaagacaaaaccatatatatttaaaaaaaatcaggctggcattctatcatgactttctgggttattattatttttgtttgttcttattactgtaatatggtatatgtaagggtagaaggatttatttttgtccttatatatgaggattacgtggcatgctcatacggtgttttgttcaagggttacattgagtcaatagatttctaggagataaattgaaacgtaagggattgattctgttttcaagatttccccacacaccccccccccttttttagaaaaaaaaaggttttaaagcttttctggtttgctagctcctgtaatgctgtttaattaagtccctgtattcgttagctataaatagatgagagaatccaggagctaagctgaccatttcttcaactcccggcttatttttatgtatacgtactggatggtacctcagacgttactgcggaacattatggaatagcataggattataattttttttttaaaaaaagaagccaatgaactgaaatgtacatgttgatggggatgtaatatgccacataagcaatctaacagagtcacctatgagagcaggtacaataaaagctgaattagcagtgggtagaattgtccacttcagcaaaatctaggtggaagaaagagaagagaggagagagagagcaaagcggacgctcatgcagccgccaggtgatagcacgagaaaaaaggcagtggcacctacatgcagccgatgcaacagcaatgcttaaaggtcatggtgaaaataagataggtcccaccataccctatgtccatagccacaatgttgaaggcaagaatatatgttaagatggttcacacatctatgtaaacaaattctactttaaagtaggtcccaccataccataatctattctcatcctcatcctctttagtgtgcatgtatgctttatctcatcattttattttttaaggttgagccataaaaaacttatggctatttttagtatttaatgtcttatggctagtgcccataatatatatggttagttaaaaggcctatggctcattcttatggcacattgtggaagcctttatatgtgggattgcatgtccttctgattggttgggagaaaaaaaggttgacgggtgagagaaaaggcaagttaatgtggtggggacccaaattaaaaaaattgaatggtatatttttgtaatttgtgtatagcaatctacctaatagtctgttgttatacacctatctttgatgtagataattttatagacaacaaccggctctcttattaaacttgctctaagtagacagggcatctatattttcagagaataaacggcatggcaggaagtaaaaagagaaaattgtacagtttattttaatcacagactaaacaaaaattttgtagacaatacataggtaaagccataataacttgaattgttcttggataaacagataccaatccatactatatgacttcactagtgagcttcatgagaccaaatggtgatgtctatgcagttgctgaactcaagtttacgtaccagtgagatcatgtaagatgaagcccttcaatatttccaccaatgtaagtctgaagagcaagagactggcttccgtttattccttccatccaattgtctggtgatgagctgagacaattcaagttttagtgttttaccatagaaaaacaacagtgcacatagtagtttgtgacgatggaagtttcaagttacaaattatgtcaagtatcaaagacataagaaatttgcttataaaatctctagctatatgagtatataaaataaaataatgatggacagcattgcaattcatacatacatagggatgacgcccccatgttagatatatctccctcccttgagcccaacggctcaagggggccttgactcgcgccctgatcgggggcgcccagcccaatggctgatgggcccccatcatactgtgccatataaagaggggtggaggacgggacgcacatgacacaaggttcgtcgccgccgccactccaccccaaaaaccctaaggccttgttcggttcgggtgtaaaaggccgggataccagccttttccccggccccttcggggaagcccaccacgaggggatagaatccctgagttgtcaaaaaatgcattcggcttagcccgggaaggtggatttcccggcccaataccccacaaaccctagggatattggtccaccaccctgacccgtggaaactcaccacaccgctgcctcttctcgactggagcggcgcccgcgccgccgctgctcgtccagacgcgcgccgcggtgggccacgcccgcgccgccgctgctcatcccatcgcgtgccggcggtgggccgcgcatctactcgcgccggcgcctgccgtcactttggcctcctcctctcgccggaaacgacgccgcctctcgtcagatctgccggagttcaacaacggtgtggccttctccgttcggtctccaccatccaggacctcgtccccaacaagaacctccaggacctcgtcgtcatcttctaccagcttgtctaggtatgccaaattccatccttctcctgaattgattggtttggtggttgggaaggtgaaatcttgggctagatctgatcgattatgttgcggatagttaatcttgggctaggtaatcttgtgctaattttacttgtgaaatctctaggcataatctgtgcagctctgtataagttgtggctctgtgtattaattcctgatgctcgtgtggataaagcttgagcatctctgttgatccatgatatactcttaatttttgccctaacaaacttgatacggtttgtgtattaattagaattcttcatgatcctgtgaagcacccaaacttgctttgtcaattcctggaattaaaatgggtaatttactatgggagatgatagtaacaaattctagatgtctgacataatgttcattcgaaggaaaatattttcttcctttccttttatgttgatcaagatatattgaaaggagagtaatcaggttttgtccctttatttccgaacagatatttttgtggttcattgctatggatttctg

SEQ ID NO: 27011 - DNA, 11793 bp, Oryza sativa
caaagatatgctctgctgtttatcttttttatgctttgtaatctaatctatagaagtacagaatagccattactacctttgacattaactgcaaccttctgttatctgttaattttttgtagtttggtgcttagaagattcttttttttgttaacatttgtttgcttgatatcacacttttatgtgcttagaagtcatctcacacatgtcaacagttcctggaattaaaatggattcaagggctaaacgtcggaagcgggaggaagaggatgatgatatgattcttttccttttccctgctgtgcatcttttggatagtggtggtgggggagagagaaaacacctaggcatgcatcaacccagactggtgcagaaaaagtgacagaggtacttgaagggcatgtcatgaattgccttgtggcgtaccgtatggaaccggaggtcttcaaaagtactgcagaatttctaagaaggaagaacttggtccgtgacactaggggagttagagtggaggaaaagcttgctatgttcatgtatatgctatcccataatgcgagctaccaagatatgcaatatgaattcaagcatagtggggcgacaatccacctacatattagggcatttttcgatatagtccctactctcacccatagattcattaagccgcctcttgcaaaccaaactcattcaaagatcacatcaaatcctcgcttctacccatacttcaaggtgcaatactaacttggcattcatgtataataaaatattttatttctaaaattaaatcttcttatgtgtttatattattcttgcagaattgcttaggagcaattgatggtactcatgttcctatcactataaaccctgagatggcagctccatataggaatagaaagagcacactaagccaaaatgtgatgttagcatgtgattttgacttaaacttcacattcatttcttgtggctgggagggatctgccacggatgcccgggtgcttaggtctgctcaactaaatggttttcgcataccgatgggcaagttttaccttgttgatggtggatatgccaacacgccttcattcctcgcaccttaccgtggcgttcgataccatcttaaggagtttggtcgtggtcaccggcgcccatcaaactacaaataattgttcaatcaaagccatgcattattgcgtaatcacatagaaagggctattggagttttgaagaagcgcttcccgatcttaaaagtaggcacactacaccctattgaaaaccaagttaggataccagcagctgctgccgtatttcacaacctgattaggaggtacaatgggaatgagggatggttggatcttgatcatcagccacatgatccacaccatatatcacctgaagattttgttgatgttccagcgggaggtgatgagtatggcaatgatgtcaactcactgaataatcaaactcatcaaggaaatgttattagggacaatattgcaatggcgatgtggaatgattatgttcatgatcattctaatctagcatgatatgtaatgaaatgtgatgtaataaatgacttgtgtgttttcatgataagttcccgcacatttgtttttcaaaaggacaaattcaagataaagaaaaggagcttaagagagactacaggtgcttgaaagatgcaagaacacaaagtggggcatcttgggacgaaaaactcgggatgattattgctgatgatcctgcagtttgggataatattattcatgtaagtttcttgaactattgaattccgtgcaattgttgaattgtctctcctcatatatatcttgttatgttctgtcatgttcctttactttctatattctccttttgcctcataattaactcagtttctttttcatctctaaaacttaacagtctttccctcgagctaagaagttccgcaacaaaccatttccaatctttgaagctttaggagaactatatgatggtaatttactaattctcagatctatccataaaccattcgaactacttttcacttagttatcggcatgcatttcttttcttgaataggtcaaactgccgagggcctcttgaactttacatcccttcagccaacaaatacactagatcagtcaagaaacacagaagatgatattgttacacaagtaggtgctgatgatttgctgatggagaacaatcaagatgacctaaacaatgatgatccaatcacagcaagtgaacaatcaaaagttgaagtgtcaaatcagttaaatcaaagaagacaaactgtcagtacatcaaggaaacctcctgaggataaaagagagaagaacccaaaaagacataagcaaaatgggaatgtggctgatgcaatggagaaatacatagagctgtgacataaacaagctgaggaggaaatggtacgggaaaaagaggctacaaagcaagttgatgaattttcaatcaagaaatgtatcgatgtcttgagcacaatgaatgaactatcccctgaggaaaatgcccggtcatttagtgtttttaaggatgctcagaacagagaaatctttatcagtgctaatccaaccgctagaattttgtggctgaaacttcagatggtgagtaacatttctgattatgatattttattttcattagtgtcatcttagcatgctgtcttacttggttgacatttctgatcccctacttacctggttttcttgtattggcagggttgatttacatgagattgggtgcttttgtgaggtatgttctgcctaaagtttcatttatgttgatatacatgaatagcatgatgatagtgatcagccttttttcatttctcctgtagtcctgttgagcttgacattgttgtcatcagtccaacttctctatactttttttttatgctttactgtcggcattaagctaccatagtcctgctatgtcatatctttgtaaaataaacttatctgtgggccaacattgttctcctcctaatgtgctgtcattttctggatgctgttctacattggaagttttctgttgttgtgatcacctgtaaaaacttatcagagtcttgtttctggatgctgcaacagctgttctttggctgccgtgtctgtgtcttttttttaatcttttcttggggtcacaatgctcatcattttctcctctcaggtcatggagctaatattattaggtgaagatcaaatggtgtcaaagataggacaacagtgcatgcagttaccatcttcatttcttaaatttgtggacaaatcgattttggaacctgggaacctagtttgtggttgtactcagtgttctaggtgttaatgtcacttgctaatcactagaatttaaatgcgtggggtacattggcaactactatatatgcttgtaatattgtttggagggcacagattgacttaccacatgcgaatgtcaactgctacattgaatagcagtgttaactatcgtttaaaagcttgtcagtattttcattttctttatttaatgaactattttcttaattttggttttcttctgtacatgccattgtagaaattagttatcagctcttttttttttttgaaatttcgtattattttgtgtgattttatagtttgattctattcgtaagttgagatgtgctatctatgctcagtttttattcaaagagatgtgtttgccctgctttccctgcttttcccctgttttccccatccgaatagcatgggggtttaacacccaacgtggaagtggattgggtggtgggaggggatccacccaatcctggactggtggtgtttcccccagggaaatccctccccacgtgccgaacgaggcctaaccgatcgagggggcgcagccagtgacgggaagactccaccgccgcgccacgacctcgccgggatcccctacgaccaccactgccgcgcagcaccgtcgctgtcacgaccaccatcaccgccgccgcccatgtcaagcagagcgacgacaacgacgatggccgggacttcctcttcatccaacgtgtcaaccggtcacatccctaaaccctttcccttattctctattgttgttcaatcatccatcgcaaatagaaccacccgactagatctaaacctaggtgatctaatagacaacactaacaatggtatcagagcaaccctagtgtttagattggttcgggaaagaaatccaaagagaaaagcaaagaaaagcaaacgatccgacggaacgaaaagaaaaaccctaaccctaatcttacctcgtcgccggccgtcgttgacgccggcaacggaggggggaggggcaaagaggcaccacctaggagcaactcgacggccgtgcgcgcacccgcgggtgcacgcgcgtgccggcgaggggggccgcggcggcgccgccatctccttcggccgccgccctctttctctcacttcgcggtgggggctagagacggtggggggagaagagaagagaaaagaaaagatggcgccgccgtgtttccccatccaccgccgtcgccggccgtcgccgaagccggggggagacgagagggcgccgaccacaccgtcacaaggccgctcgacggcggcgcgctctgcctagggtgagcacgcgcgccggcgaggggccccgcgacggcgccgccacctcctccggccgccgccgatggcgccgccgctccggtgtagagagaggagggagagaggagaagtgaaatgtgcggctagggtttggccggttgggaggaagggtttttgtttccccgaactcggcggctgaccgtccgatcctaaccctagcaaatggatggccggatggtgacggtcggctggtggccgcgggccggacgggccagaccggccaaaagtccactttaggtccctcggccgaaagaaagaaggaaaagaagaaaaagaagtttaataaaagtccctcggccgaaggaagcattttcaatatgtttaatgattgtgtttatttctaagcaatttgaaccaacgtgaaaattgtttagagaatagataaatgtgagaaatgtttctgaacaggtattttgtatattttcatgcaaattacaatagaattttgaattgtttttcaagttttacctctgtttaaatttgaaccaacgggcgaatttttacagagagtaaacaacagagttttgttattgtttatatgaattgtatatagatcttccactgcaaatagatgaaattgatgaaaattagtgtttctaaaattaaatttcgaaccaacgggagaatttgattttaggaacattaattatgtgctatgatgttgtaattttctgaccaacgttgataattgcaatgttatagttatggctctatgtgttatgtctattttctgcccaacggtgatgtagacttaatacataataattttaatgttaattttgttctcacaatacatgattatcttaggtggctactccttgatgggttacattaaagatattccgaccctgaaaggagataactacgaagaatggaaaagagaactcgaccttgcttttatcttgggacaggtggactgggtgttgactaccccatgtcctatggaacctgctgaacttttcagaggtgaaaatgagtcaaatgctgaatggcaaaagagagagagggacaatgcttccctcatcatgtcgtatgacattgagcatacgaaatggtccttagccaacaagaactgtttggctacggtaaagaacacgattgagccaaccaaattgggctcaatcccagagtatgacaccgtctctatgtacctcgaaagtataaagagccagtttactggttcttcaaagttttatgcgacacagctgataaagtagcttgtgacagagagataccatggaggtggtgtaaaagactacattcttaggatgggcaacatggcttctaagttgaagcaaaaaagatgtgggcatctgagatgactttctggtccatctggttatgtcctctttgccaaagaactttgacaaccttgttgtcaactacaaaataaatccagaaaaatggaatattgaagagctcatctctaattgtgtccaagaggaggaaagactcaaagagaccaatggtggctcctttaaccttgttaaagataaggaaaagagccacaggtcaccatcctcaaaagaaaaacagcctcaacatctgcctcagaaacaacagttcacagttgagacaggatcagtgtctccactgcaagaagacaagacattccaagaaagatcgtcctgacttcctgacagtgatcatggcaaagaaaggtgagaacattattacatttgtaaatgaatctcattatgattggttattctagatccacatggtggattgattctggagtaactattcatgtgtgtaattgtttaaagggattccgttcaatgaggactacgcaaagaagtgaaagatccattagagttgccaatggagttgaagcaaaagttgaagctgttggagatcttcgcctagaactcacgaatggcttcacacttttacttccagatgtttttatgtcccttctttgcaaagaaacttaataataagtgtatccaaattggattttgatagatatgattgccattttggaaatggcaaatgtgaactatggtataataatgcatgtattggtcttgtgttgcaagatcagctttatttgttatctctttctgagaatgtgaatgttgtgtcctcgttgacaaaagaaaagaaagcgaactcctgatgtctcatcgaaattatggcattgacgtttaggccatatttcgagggggagaattgagagactggttaagaatataattcttcctccattggagttctcagctttagaacaatgcatacaatgcattggtgcccaaaacaccgtatgagctatggatcctccgtgtgtgtgggagtcctgcagaggccaaagtatttaacccaaatcttgggaaattgaatcccaaaacagtaagctgccattttattggctattctgaaagatcaaagggttatcgtttctactgtccaaacagttgtacaaagtttgtagaaacgatacacaccgtcttcttggaagacgaaatgattagggggagctcggtagttcgagaaattgatcttgaggagaggcggatgtctgtacctgctccgtcgactcaggaacctttcttctctctacctactaatgttgtgccagcaatgcatgccattgcggtaccaacacctgttgttatctctcctgtggcaacaatgaatgaaagtggggaacccattttacaggattcaatagaaattattgccacaccagaggaggagctgcaacagcctcaaacagataatgtgccaaatgtggaggcccctagaaggtcttgaagagtcagaagatcggctatccgtgatgactatcatgtttataatatagaagagtcgcatatggaggatgatcccacctcatataaagaggccatgagaagcgctcgctcatctgaatggttggaagccatgaaagatggaatgaaatcaatgaaattaaatgatgtctgggatttaaaagaaattcctaaaggagccaaatcagtagggtgtaaatgggtctacaaaaccaaatatgactctagagggaatgtagaaaagtttaaagcgcgacttgtggcaaaagttttcacgcaaagagaaggcattgattacaatgagacttttctccagtctcttgtaaagattctttcatgattataatggcactagtggcacattatgatttggaattacatcagatggatgtaaaaacggaatttctaaatggtgatttgaagaaaaaagtatacatggcacaaccgaaaggtttcgtcatgaaaggaaacgaaaatataggatgccgtataaagagatccatttatggattaaagcaaagcttcgagacagtgctacttgaagtttgatggaacaataaagaaatttgggtttttcaagagaatatcgaggacaactgtattgattcaaagttaagaatgggagattcattttcctaattctgtatgtagatgacgttctactggctagtagtgatgtcaatctactgcaggaaataaagaaattcttgtcctcaaattttgacatgaaagacctcggtgaggcttcatatgtttgggcatagagattcaccgaaatagaacatagtatgcattgggactttctcaaaaggcatatataaaaaaggtattgaagaaatttaacatgtatagatgcagtgctacacctgctcctatagtcaaaggcgaaaagtatggggcatcgcaatgtcccagaatcagtatgagctcaatgaaatgaaaacaaagccatatgcgtcagctgtaggaagcctacagtacacgcaagtgtgcacacgacctgacttggtatttgttaccgggttacttggcagatttcaaagtaatctaggcctagagcactggaatttggtatagaaagtcttgcgtgattacaaggaacaaaaggcctcatgatgtcttacagaaaatcagaatcgctccagatagtggggtattcggattctgactctgcaaaagataatacaaagtcaacatcgggatacgtgttcaccctggcagtaggagctatttcatggaaaagctcaaaacagaccatcactgcagggtctactatgtatgccgagtttatagcatgctatgaggcaacggggcaggtgaactggctaaagaagttcatacccaggtttaaaggtggttgacagtattgagaaaccactaaagttatactgcgatagcaaacccgcagtaatgtactctcacaacaatcagtcaagtggtgttgccaaacacattgacataaagtactatattgtgaaagacaaagtccgggatcaaacaatcagtctcgagcacataagaacagaaaggatgctcgtggatccgctcataaaaggccaacctcccaacatgttcaaggaacatgtagcatgcatgggtttaagggaagccttatgaatcctggactatagggcccaaaagttaaagtatctgtttctaaatagagatgtgtatagtggctgtcgaatccatcggtaattaaccgtgacgatgaaacatgctctatatgtaaatctgtgatggaatagaaaaagctaaaagaaatagtgagatcaagggggagaatgttagatagatctccctccccttgagccgttaggctcaagggggccttgacccgcgccctgatcgggggcgcccagcccaatggctgatggccccccgtcacactgtgccatataaagaggggtggaggacgggacgcacatgacacgaggttcgtcgccgtcgccactccaccccaaaaaccctaaccgatcgaggggcgcagccaatgacgggaagactccaccgccgcgccacgacctcgccgggatcccctacgaccgccactgccgcgcagcaccgtcgccgtcacgaccaccgtcgccgccgccgcccgcgtcaagcagagcgacgacaacgacgatggccgggacttcctcttcatccaacgtgtcaacctgtcacatccctaaacccttcccttattctctactgttgttcaatcatccatcgcaaatagaaccacctgactagatctaaacctagatgatccaatagacaacactaacaccccaaagtaatggattacttgatcgattgctccagaacagcataatacctttcattgttatgattatttcacctgcaataaaattgggcatcaggatttacctttacctcccccacaaccccacatagatagctgagtcagaatgcacatgcacaggaagaaaaagagagaaaatgttaagaaaattgcacatgtacaggcgtacagcacattgtgaaggaaaccaagattagagaaggatgggagccgcaggaagccaggaagagcaaaggcaggggacgatggggatatggatggtatagacgtatactccaaactccaaaatcgaaacgaaagagacgcacaactaagggcagaatgaaactctctacattactccctcgtggatttcaacattttgcttatactgtttgatcattcgtcttatttaaaaaaatttaaaattattatttatttatttttacttattttattatccaatgtaatttgagcacaacttttcgttttttatatttacacaaattttttgaataagacgagtggtcaaacagtaccagcaaaatgtcaaaatcccttatattatgggacggaaagagtacattagttagacttatttatattacactcatgccaagtaaactgtaaaactggtatcggcttacttaatgaagcatgttatgcatcactgcaaaacttcaatcatcactgcaaaacttcaatcaagtgaattaacaaagatccttgtgagataatacacataaggtcttcggacagattactttcaagaaacagaaataaacagggggaggtaatgcacatatactccacatgaatcaaagggtctaccataagcacacagaggacaagaagatacagaaacaaagaaatgtgatttggagagcagcactagtgaactgccgagctcttctggagtttatatacatgtaagtacgccattgccctaacctcgatgctagcttgtacaaaacctgagaatcgaaaaacatcttgctgctccagtttggaatctaggaagcctggggggtttctagaaggcgatacatggtgatctcttgctgcttgaagtacctcctatcttcctcatcaacaaggaccagattcaggtagtacttgacgctgaacttgttgtttatgttccgatacgaaggggtcagctcgtaaggcgtcaagaatagcctcaccgggatggattctcctggaaaaaaaaaaaacagttacctcaagttcacagcaaagcaatatccttgcaagcagagagatcatgcaagaagctaaataccgaatatcactactcactagaatgagaagctttgaacgttggcggtgctgaacgaaacggaatatgacggttataacttttacctctataaacatcggaaggaaatgttgatattactttatgcaccacacaatttgctttagtattaattaggatccttgcagccagtcctacttcaagtatacatgggatcaagttggaaagttctcaagtgaatgtttagctctactggggctgatatttcctaaatcataattaaagtatataggaattgtttcaagcagggaaagtgcacttccacagtgcatcgtgataattgagaagaaacccctgcaggatcactaaataactaaaatagacttgcatctacagatctaccagagtatcatataggcttgaaattcattaaaattcatgtgttttgctgttttgcaaacgttactaccaagctttgagtttaaggtaatcagcaaattgttgcaactatcataccacaaaaaagattcatgaaaagcatgcaaccatgtggtccacaaataagttatttataactccaaagcatgtcactttaaatatcaagcaacaagacaaggatcagcatgtaaaggaactgtacattcaaaaatatattaaaaatgaaaaaaattacaaaaacgtacctctgacaggagcaccatccatcaactcaaactttgcaagagtttcagtctcaacatatgcactagagcctgctcctgttgattccctacgacgtacttctagttccatgttttttatctttattctgacaagaag

SEQ ID NO: 27012 - DNA, 751 bp, Oryza sativa
  unsure (1)..(751): unsure at all n locations
aactggatgcacacagcccacacgcacactaccatatgcacacgcacgtgtgcgcttcctctacacgctcctgaaatattaccaaatgtatttgcatggatgcgtgaattgtgatctccaggtaaactactagcattacacaatacaaatactaggagctgtattgttttgtgaagacgtgccatagacagacacatctgaaaggtatgaaatgaaaagcatcttacatcatcaatgacaactcaccttgatactgttgttgattgtgggggcaggagagtaatttcttacctgtaaataatataaaaaaattaaaactcctatagaaaaatattatgcagatgatactacaacaccagaaatgcaatgtgttgaatttatttttgaaatatgaaaatactactgaagtttcaggaaaagaatatcaggaatcatgtgacaattcacaacacaataataaataataagcctacataaaatccaatgaaatccatgaaattaccaaatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 27013 - DNA, 755 bp, Oryza sativa
ataagaatgtttcaatgtaagcaaacgctgtggatgccacattgaggaacatgtcagaacagacagccaactaagcctatcttcttacttgcttttgctgtattcgaactcaatatgtaagcaatcctcaattccaacttccatctgaaaggaacatgcaagatcaagagttacataaccaaatatgtcttcatgtctttcacacacactaaataaagcatcactgtgaccatggcgaatagcatgttagtcaagaaatagaagtgccgaacagtgtatgttagtcaagaaaaaaaatactgttggccacaacggaataaaatattatgcagctacaatctacaggaatatcagaaaaaacaatagcagctgataagcacaattaaaaggtacgatcttaacgaagcgatctaatcagcatatttcaggggaatcaactataagaattagtcaattaaccatcaaatgcagacaccatttgcaaagtggtgcctattgttgaatacttgactgatgaaaaatcaaaagtaggaagaaccaccatttgtgagatgcacaaatcacaaatttccagggtccatcctggagggttgtagtgttttaaattttccgctactttaggaaatattatcaaaactcataatatcatgccagacaactttgtttctgagaataaatacaattgtcacttgcccaaaaagaccaaaacaaaaataaacttaaggcatacattaggactgtacaatcctggtaaa

SEQ ID NO: 27014 - DNA, 10170 bp, Oryza sativa
cgagggtctgtgcaaggtgatcaaggaggtgctcggtgacaaggtggagaaggttgttgtctctgaccgtgtggtggactctccctgctgtctagtcactggggagtatggctggactgctaacatggagaggatcatgaaggcccaggctctgagggactccagcatggccggctacatgtctagcaagaagaccatggagatcaacccggagaatgccatcatggacgagctccgcaagcgtgccgatgcggacaagaatgacaagtccgtgaaggacctggtgatgctgctcttcgagactgccctgctgacctccggtttcagcttggaggaccccaacaccttcggcaccaggatccaccgcatgctcaagctcggcctgagcatcgacgaggacgagtccgccgaggctgacgccgacatgccgccgctggaggacgacgccggcgagagcaagatggaggaggtcgactaaacgtcatggacccatggatgccattctgtcccttctagttatccctctcctagttctcttctcatagctatctgactgctgctgttcgctttctttttggtacgttggatgcatcagttttgtctttgtcttagctcttaaacaatgcgtggtaccttgtcatactgtttgcgttgcaatgctactagccgaagtatatgccagcttcttattcatacttataacgtctttttttatcaaattatgttggctgaatcccttggagtgtgccaatttccatcttgaacttgagtattccaagtagctgttgtgagcagcccgaccagtattctggaacttcttcctaataagcctggttgctgcaaattgatggaatgatggaccattgtttgcccgcagtatgctggaacttcttccatctgttattgtatggctagatagtggatggtaagcttagtatgcctggttgctgcaaattgatggaatgatggaccatttttagcctgcagtattcttgaacttcaatttgttagtacaaggctatttagtttgaatgagtgatggaatgtttgttcactgttgatgcctgcaagatagaatgcctcgaatgtcttcttgctttgatcaattaaccatctgcagggaatttcgttgtttcaatcatctttggtcgacctcgagagctttctgtttccgtttcaatcatcttttcgttgtttcaatcatctttggtcgacctcgagtactacttagtagtagtggaccagtaatttctgcccctccgctctagcacaaacccaactgacgaactgatccgccggttgagagatggagcacatatgcgtttttgcgttgtgaggacatcgtgaggtacgtgtcggctgatctgctggctgagctcacgtgcatctgtatcggatcggaggcagaggttagaggtacgtgtcgattgcccgtcgtgagtacttcctctgcttgacacctggtgcactgccatggcgaggtggccatgaaacccgaatccctagctctatccacacacataaaactagtcttggattctactagtagtaggccaaaagcaacatccattataaacagtgttggatactaccaggtcaagtacacattcagagaaacaaggctgcactcttgctgcagatcaagcggaggacttgcaatggaggcaaccaaggagacccagcagcagcagcagcagaggaagccggacgccggcgacacggtgcagctgccgatggacaccagcccgtacgtgcagtacaagaaggacgacggcctggaggactacaagctgcgcgcctacggcgcccgcggccacctccccgtctccgacgtcccccacggcggctgcggcaccgacgcccccaccatccccggcaccgccgtccccgtcgccacacagcgccgccaccaacaaggcgacaccgccgctgccgccgccggcaccggccgcgttgacaccgccaccgacgccatcaatcaccatggcgtgccatagacggtgtaagtgggtagactatgggtgttggtcggtgagccgcgaacccacttattttaatttataagtggatttgcggtttattttagcctacaagtggatttcacgccacttacactcgtaccataaaccaccgtaacatcttttcggttttcactgtgtgagctgctgcctcttgtggtagtatagtgttcactgttcagtgtccagagagtgataaaaaaataattaaataaagcctgaaatgtgctactatcaggcacactgtaatactgttactagcccgaactggtttgcatcaaaaatatttttaacggttttcaacttcttccatgtcactatcgatgatgcttatttattgcagttttttttcactattttttccccatatatatgtcactgtaacaaaacaaaatgatcgattgattcatcatctcggattgtaatcagctgcatcccttggcgccgaagccgatcctctggttggcaacgtcgtacgcgacggcgaacgtcttctgctgcgtgttcccgaggatggcgatggacgagtcgtcggcgttgggcgcgaacgccaggcacgcctgcgacaccttggagacgtagagcacgccggtgaagtcgaggctgacggtggcgccgccggcgaacgccagctccaccgtgggtatctgcgccgtccggtggccggtgaagtcgtagcacgtgtcgaggatggacagcgcgggcgccttcttgtactgcgccatggagcgcgcgaacgccgcgcggagcggcgcgtacgcgcgcggcgggaggcgggtgatcaccgtgccggagtcgatcaccgtgccgccggccgccgcgaacgccgtcgccgggatcctgatcgcgcggccgccgaccttgatgccgacgaggtcgatgtagtagaacgacggcgtcgcgccgtcggccagcgccgtgaactgcgcgttcgccggcggggcgccgccgagggacaggtagcccctgccgctcgacgacgacggtaggcagtaggtgaatccggggccgtagctcggcgcgccctgcgacggcagcgacaccttctccctgccgaggccgaacagcccgtcgacctggccgaacagcccggcgttctggtcgccgcacccgaagacgaagcccgggagcgtgtccgacgccgagagcgtcagcgtgtcgcgcacgaggttgccgtcggtctgcgactggtcgccgtactggacctcgtaccggcacctgctgtccgacgagcagcccgacgcgtcgagctcctggcactccggcgcgccgcacgccacggcggcgtacgtcgacgacagcgacgggtcgaacagcgggtcctgctgctcgtagcagtcggcgcagggcttgcactgcacccacgacaggtcgctgccggtgtcgaagatcacggcgtactgcttcgccggcgtcccgagcccgacggacacgacgtagttgccggtgccgagggagatgcccctctgcgccggcagcgacacgccctgctccgaggcgcgtgccgggtcgaccaccgacggcgcgcccccggcgccggcgaccttgcggtggatggagtcgaccctggcctggtcgcgttccaggatctcggcgtgggtgacagcgccgccgccgccgcgaggacgagcctgcaccggcgagcacggcccgtgccggtgcacgacgccgagagccgacgagttggacgccgctgcaagaaaaacagaatgggaaaatgagaaatgcaatttgtgcaaatgcaactcgaagcaaagaaagggaatgttcagattgtagctaaaataaatcttaccaaattttggcaagatggtaagatggtagtattgctaaaattttagtaggattatttatttatttatcatatttggcaataaactaaacgtatatattttttgacaacttaaaaaaaatggtatggttaaaaatggctttaatctgaaccgccccaaagctttttactgcactgaaaattttgtgtagtgatcagtcatcagcatgccaaaagtttactcgcatcaatcagcaacagattacctgatgtaattctgatcaatactactgtaaaacatattatgtttcccttagaatatcttataaattcgatatatgctgcatatgctatcacggtagctgagtttcagtggtactaaaatttcagaataatgcagatgctacttcagtcacaatacttgtttgcaggatacagactaaccatactccaaattggcctaacagatttcttattgggtttttcaattcctcagtttgatcaaatggacgagatttatataaagcaagttcgatcgagatggttaatggccgaccaggttacattatttttccgcagtaactgcttcagtttcagatacagttgcgaaaggagacaggctgcaaaactgacactacctttcgatgcagtgcaggccgagctcggcagcagcgagctgacgctgaagacgtgccagttggggtcgttcgtcctcgccgccggcccggcggcgccgccattaatccggcgaggagcagccaccagagctacagccacaaccagcgcgaacgctctcccacgaacaagaagcgacgacgaggacgccatggtgatcacctcgtcacagctcgcgatcagttggctgagcctgagttagctagctctcactccctcgcttaatttgtccgtgcagctgaagcgatggccattgctgctgcttatatagcatctcgtcagtagttggcaacgcataaaccaccactgctgttggtgccctggtccacaccacacgcgggcgtcaaagtcgtcctcctcgtcgtcggcggctcgtcgccgtcagccggccgcccgtgcgaaggaaaaagattaggttgttcgccacacacgctgctggctagctactagccggcgtccgatcaaggagcaccatggcattacacacacggcgacgactagcgatcgagctagtgacgaactgtcaactccaactcccaactcgatccaacttgattgcacgagcacgaacacgcgcactacggaggccctgtttagatttcaacttttttttcaaacttctaatttttttatcacatcgaactttcctacgtacgcaaattttcaacttttccatcacatcattcctatttttttaaacttctaattttagtgtggaactaaacacagactgagcgtaaattgccgtttagatcagtcgtacgtcaagtcggagccacttaaattaagtggatccccagcatcgctctaaatgtaaatgttcctatgatgtttagcaaagataaaggataagaaaaaagaattccggtcaaatttcgaattgtctggattcaccgtataagcacctgattgattagaatgcttgaattcttgcccattggaacctgaatgcgaaatgcttatattttaaaacagaaggattacgttgccatatatatatatatatatatatatatatatatatatataatttatttcaaatctagatcaatttggctacgatcgaaatgggcataggaaaatgacacctcttcccgttccgaaaggcaggcagagagaccgacctgtgtcacaaattgtgtaatatattgggtggtgaatgctgatatgttggaggttgctttcctgcctccaccacgccagaaagcaggaaatgcgtatgcatgcagtgctcgatttgctgatgcactgacaaagtgatcacaaacacagctggtgcgttgcaagcgtgtgtcattgctgcgtgagatgaaacgaaacgcgcattgctaattaagcgctgttcttgttgttcagtaatactccgtaattgtttagttggttcagtttagccctggttaggagttagttaaactatgtagttgtagtagtagtacataaacattgattcttgagaagttacagcgttgatacattgagaacatgacagaggatgagacattggcacacaaagggcaccaataagttacacacactcatatgattgatgcattccaatatgctccttagacagcatcagatttgattaattaactttgattagactcatgaacaacacatagcattttctgctagcttccatgcaaaatatttgcaaatggatagtgcagtgcagaagagcagaaacctaacaaggactgtcactttgtgcaacatcctgccgtttgttcaggctcgtaggacaagcaggaaaagcagcgtttgctcgtagttgccatgacaaaatcgagataaaaaaaataacccaaaagaactgtacctaacattatactagcatgctgcatatatacaagagaagatatacataattacatatatcatttgattaaccgggaatggatcgaagacggcctaccaaacgtgtacaagtgcattgcatctggtcagtcagccgcgtgcagaaatgggcgaagaaactgtacaaagtgcatggctagctaacatttactgtcacttcatcgatcgcactgagtacgaaagacgagtagacgacgaccatcattagtgacgtccacgctaattaccctctcgagtcaaacacaggtgcaggacattagtgcggttaatatcttggagtagttaattaaggcgttaaatcatgtgcaaccgcacgatctctcgttccgtccatttgtggtgctgaccacaggatggttgaaggacaattgagcagtactgctcacttacatgtgagcccgagaggctatggggttcacatgtcagtgagcaatattgcatgtacaatattgcagatgacctgcatggctgcatctggttgaagggtagaaacaccacttttccactttttactcccttgtttttcatgcatatttcttcaacaactaaacattgtgtttttcttaaaaaaatttactatagaaaagttgaatttttaaaatcatattaatctatttttattcttttactaatatttaatcatgtgctaatgaactatattgttttctgtacagaaagaagaagagccccatcggttgccttaataagccaaagcaaaagataaaatttgaatttttaaacttaattttgaagttgatttaaagatttttttcaacatagtttttttttcagcatcgacttttaaatcgttaagaacacatgtataaaaagttttaccaataaattagttttttattatctaatgaaccaaaatggcttattagaaaatatgagtaaccgatgaggccggaagtatccaactaatactcttgaacacatagggcctgttcattttgatgccattttcaaccataccattttttttgtcaaagttgccaaaaaatatatacgtttagtttgttaccaaatttggtcaatacataagaaatcctgccaaaatgttggcaatattgccatcttgttaaaattttggtattgccaaaacttggtaaggtttattttggctacaatctgaacatgcctataatagtagaaggggtttatttgcaaatatccatctccaacttcacgtgggactatctgagtggattaaagtggtttagaatctaataatcgaaacccattttgaaaagggttaaattatcaaatctctcctcttgaccctccctttctttccatgggcttcgccggcgactggaccctctactgtcttgaatgcgcttcatagcttgttttcatagacttcattggcgacttgatcctagtttgttttcatgggctttacgggccactggaccctcgcttgtcttcatgggctttatgggcctcattttcttcagaattttatggccttctatacgcccactacacctaatcacgcgcaaaatctcactgccggtccggcctggcccacccgcaacgactagtcaacacgcgctgcggcctcgccggcttctaggcccacgtagaaggttcgagaacaacgaggaccgcataaaagcatctcccacccccacgatctcgccctctcaaaaccctctcctaaccctagccgccgccgcagccgcagccgcagccgcgcgtcgtctcctccgcccgcgagctcctcttcccgccggcgagagatcaggagcacgcaaggcgcgcggccatggcgtcggagaccgagacgttcgccttccaggccgagatcaaccagctgctgtccctcatcatcaacaccttctactccaacaaggagatcttcctccgcgagctcatctccaactcctccgatgtaagtttgcgccgcccccgaaattaatcccctctcgtcgaggaatcgaaatcggtgcttgcttatgtgctctttgctgttgttgtacgcgtcgatctgtgagcgtgacggcatctgaggatcatatactgatagggcgtagacctgtttcaaatcaatgaggtgtgagcgttgactcgtgatttgtagagtttgtgctagtttatttgtttgttttactcatcgaaatgtgaatatggccacatctgagcactagcataaacttgttacaaatcagcgagggttgtgtgtttacccgtgcgtgtaatctgtatagtgtggtagtgtgctgatgcttttacagatctgtgtgtttgggtgatgaattcgatgtgacatgggtgtgtgtggtttctgcaggcattggataagattaggttcgagagcctcacggacaagagcaagctcgatgcgcagccggagctgttcatccacattgtccccgacaaggctagcaacaccctgtcgatcatcgacagtggtgtcggcatgaccaagtcggacctcgtcaacaacctcggtaccatcgccaggtcggggaccaaggagttcatggaggcgctcgctgctggtgctgatgtgtccatgattgggcagtttggtgtcgggttctactccgcctaccttgttgctgagagggttgttgtgaccaccaagcacaacgacgacgagcagtatgtgtgggagtcacaggccggtgggtccttcactgttacacgtgatacctctggtgagcagcttggacggggtactaagatcaccctctacctcaaggatgatcaggtataagattcagcacatttctcttgtgaattcctattacttgtgtgatatatgttgctgtccatgtgatgttttttttgtcagaactttagatgttctgtacatatgacaattggatgagttcgggcctgtatggttgagttggcatgctaccagtgtacatgatctttcttgactgttagcatgttctgaagaaatattcttgctactttaataagaggttgtcttgatgacatggtgctcattttgtagtacaataaatgaactgtatagattaggggtgtacagcagtttttggaatagtggtatcttgttctcttggttacatttactgaaaatcaacattgctgataaaccgtaattctgaactagtgatatgggtttctttggtagtaatcacttaattaaacaatagtattagttgtaacaatatatatttggtgtagtatacatcttactgttttccgttaacatgaaatgaattttgagatttactgctttcagcttgtctttctgttcttttgtgctgtagttgtgacttccttgtatgctacaataaatgaactgtatagattaggggtgtacagcagtttttggaatagtggtatcttgctctcttggttatattgactaaaaattaacaatgccgctaaactgtaattctgaactagtgatctgggtttcctcggtagtaatcacttaatgaagcaatagtattagttgtaacaatgcatatttgctgttgtatacatcttactgttttccattaatatgaaatgaattttgagatttagttgtatacatcttactgttttccattaacatgaaatgaattttgagatttactgcttttcagcttgtctctgttcttttgtgctgtagttatgacttccttgtatgctaacattgttacatagttatggtctgtctttgttgttgtattctgctaatcaatttatatactcccttcgttttgaaatgtttgacaccgttgacttttttagcacatgtttgaccgttcgtcttattcaaaaacttttgtgagatatgtaaaattatatgcctacacaaaaatatatttaacaatgaatcaatgataggaaaagaattaataattacttaattttttt

SEQ ID NO: 27015 - DNA, 8965 bp, Oryza sativa
tttgagatttactgctttcagcttgtctttctgttcttttgtgctgtagttgtgacttccttgtatgctacattgttatgatctgtgactcttttgttgtattctgcaaatcagtttatatattgtttgttccaatgttcttatcagaatgcataatggcataacaccttgttccaataattagctgtatcgttttttttgttcttattgtttgttgtttataataaactgttgcaatttttacttgcagctggaataccttgaggaacgtcgcctcaaggatctggtgaagaagcattctgagttcatcagctaccctatctccttatggactgagaagacaaccgagaaggagatttctgatgatgaagacgaggaagagaagaaggatgctgaggagggaaaggttgaggatgttgatgaggagaaggaagagaaagagaagaaaaagaagaagatcaaggaagtctctcatgagtggaacgtgatgaacaagcagaaacctatttggttgaggaagccagaggagatcaccaaggaagagtatgctgctttctacaagagcttgacaaacgactgggaggaacatctggctgtcaagcacttctctgtggagggtcagcttgaattcaaggccatcctgtttgtaccaaagagagcgccatttgacctctttgacaccaggaagaagcaaaacaacatcaagctgtacgtacgccgggtgtttatcatggacaactgtgaggagttgatcccagagtggctcagctttgtcaagggcattgttgattctgaagaccttcccctcaacatctcacgtgagatgctccagcagaacaagatcctgaaggtgatccgcaagaaccttgtgaagaagtgcgtggagctcttctttgagatcgctgagaacaaggaagactacaacaagttctacgaggctttctccaagaatctcaagcttggcatccatgaggattccaccaacaggaccaagattgctgagctcctgaggtatcactccaccaagagtggtgatgagttgaccagcctcaaggactacgtaacccggatgaaggagggccagagtgagatctattacatcactggtgagagcaagaaggctgttgagaactcccccttcctcgagaagctgaagaagaagggatatgaggtcctgtacatggttgatgccattgatgagtacgctgttggtcagcttaaggagtttgagggcaagaagctcgtctctgccaccaaggaaggtctgaagcttgatgagagtgaggacgagaagaagcggcaggaggaactcaaggagaagttcgagggtctgtgcaaggtgatcaaggaggtgctcggtgacaaggtggagaaggttgttgtctctgaccgtgtggtggactctccctgctgtctagtcactggggagtatggctggactgctaacatggagaggatcatgaaggcccaggctctgagggactccagcatggccggctacatgtcgagcaagaagaccatggagatcaacccggagaattccatcatggacgagctccgcaagcgtgccgatgctgacaagaacgacaagtctgtgaaggacctggtgatgctgctcttcgagactgccctcctgacctccggcttcagccttgaggaccccaacaccttcggcaccaggatccaccggatgctcaagctcggcctgagcatcgacgaggacgagtctgctgaggctgacgccgacatgccgccgctggaggacgacgccggcgagagcaagatggaggaggtcgactaagcgccatggttgtcattcggcccccatctcctggagccctagttctctatagctttatctgactctgtgctcttcgccatttttgctatgctggatgtatcggtattgccgtatcttagcgcctgaacatttcgtggtatttgctcaaacagttacgttttaaatttaaatatgctagttaattaatccagaatctgtattttcttattctgcattagcccttttatagtaactctttgttctgcattatctccactttgttcttagcttgaatgggcctttttttttctctgttgcccccatctctttcaatcgtagtagtacatctatctttgatacaatttttttgatatgctattttgaactgagcttcttgttgacaccggattacttttgattggcactgaatagcttgttgtacactgctcatgtcttctcgactgatctaaaatcctatcacttaacacatctgtgaaggattccatgttatttgcttaagagaacaaagcacaaagcagcccaatcttctcctcgctttgcctctctgctttaataaaagcaaagcataacgcattccttaacctgtcaatctgtccatccacacgcagccgctttaccaactctcccaagaacacacacaagacacaaactgagatgctcacctgtcgctgcgatccatttgccgctgcattttgatcatgccgtctccaacctcgtcggcgtcggcagcggccagggggagcgctggcgccggcgataccctacgcaactcctgccacgacttcgcgcgcagcctggcgcggctgccggccagcatcatggacggcctctccaggtccatggctcgccggagccgccgcccccgcgacacccagcctcaccctcctcttcctccgccgctgctgccggaggagctcttcttcgccgagttcgagcggcggtacggcggccgccacccgttcttctacgggtgccggctagccgaggcgctggggatcgcgcggcgggaggggaggctggtgttcgtctacctccacgacgccggcggcggcggaaacccctacgccgaccagttctgcacggggacgatgtgctccgacgtggtggtggagttcctcgacgccaatttcgtgtcgtggggcgccgtcgccgggagaggggaaggtgcggccatggtggcggcgctgcggcccggcagcttccccttctgcgccgtcgtctctcccgtctccgacgagagcatcgtcatcctgcaacaggtagtacaaaaccccataatattacagaagcaacagaatccaaagcgttccctaaatgtttgacgccgttgatctttttaaacatgtttgaccgttcgtcttatttaaaaacttttatgaaatatgtaaaactatatgtatacataaaagtatatttaacaatgaatcaaatggtaggaaaagaattaataattgcttaaattttttgaataagacgaacggtcaaacatatttaaaaaagtcaacggtgtcaaacatttagagatggagggagtattttgctccatcgtttcttcttcatcttatcagatacaacgaaaatttgaatttcagaacttagagtttaatttagagttgattttgatgtttcttttatttggtttaatttttcagcattgacttataaatatttaaatcgcaaataaaaatttgcccacaaactattttttgtcgttaataaacatcacagcttataatcaagtatcgtctctagtggtttcatccataaccatcataactgagcgaaaaccagtgaaatcgaattcttttgcgccaaaattttgaattttaggattttttttaatttggccggtttatcgaacggtttctaaatgcagaccagcaagacaaggccaacgaaaccgtgataactgagcggttatcgtcgcattttgaaacgctaaagcaagtagcaacaatactaacaattatgtcaacctatttgcacactaaactctacagcatattggttgcatcgatctatcttggcattttaagtttttgtattgattaagagatgacacaaactgtatcttctttcaggtagaaggcccggtttcgccttcagagctggtggacattcttcagagaacaatcgatgagcaacgtgcatcctccagacagtcttggcctgatgagcagctagctgcagcagtgagagcctcaagagctgatgaagaagagaggatgagatcagtagctctaaggctaagacaggagcaagatgcagcttatctcgaatcacttcgaaaggatcaggtagacacatgcatgttcatcatgttgaggtggtgttcttcatcatcagttcatgccctgttgatcagggtgagctcactgactccattgatgcaggagaaagaaaggtccaggaagagtgttcaggagggatctgcgaaaccaaaggcgagcaatgtgcttcgtccaagataccctggtcaatctgcaagggagcctaacaaggcagctcaggccagagctcctgctcagaatcagaatggaactgtggcttcacacagagcagaagcaaataccaaggtatgaccaaaaaaaaaggattatctcttgtcctcgtgtacagatgtacagtgcatttgtaactgctagcagcaatatttgggaaaaaaaagttaattacttaacatgaaaatttctggggtttagttattcagttgacaagtgttcagatcatgcattcaggtttttctgatgtctgaactccggttacagtgataaaaatatcaagtgttaatgtgttatccatctactagtatcattgtgcaaaggatttttatgggaactttggtgcagaactttttatgggaacatccctgagttaagaccagattaattgtagaactttttatgcagataatgataagatttcccaatggagagagaaggcagcaggcgttccatcatacagataccatcagggaaatctacaggtatgttgattccctaggcataccaggcatcggaaattatcagctcgtgagaagctatccaaggaaaacttatggtcgccagcagctggagatgagtctccaagatgcaggcttctatccaagtgtaacactgtacattgaacagcttcagtaaacatgctgtaaccatgaagatgactgcaaatttcgtgtaacaaattacgtacaaacatctgcatatgtgcatgtgtttctgcattcaactctactgaatgcgtactgccactttgcatacatcgaaacaagttacagtatgttgcaaaggaaaagccacaggcctgaaacttcaaagttcagagcatgatgttacatgttgggaaacttcaaagttcaaaacaaccctccatttcctgggctgcatatgaaccgtccgattgtatataagtggcttcagatcagcgtagtagttgtaagggtatcctcaatgattattgcaaaagtactccaagaagtaaagtgaaccgtgccaaatagtaatagtagattgaagatacaccatactacatatatgcgaagaatgggtaataaggtgagactatctaaaaaaaaaaagaaaagccaaacataagtcataccacaattaaaaagtatgtaggactcactacaaaatgcttactactatctccgttttaggttataagactttctaacattgcccacattcatatagatgttaatgattctaggcacacatatatgtctaaattgattaacatatatatgaatgtgagtaatgctagaaagtcttataatatgaaacggaagaagtataatttagtaataagcctatgatttgatagtagttaagagtatttactatttccttaatttatcttagctactagcgatacttaatccctaactttgtaaatactttttcaatacattgtggatgactggtaactatattgaggaatagtaaatacattgaggatgaaaaagtaaatactattttctcaagttaccggtatccattatttggatgaccggtaactttgtagaaaacaccctaacacaaaatcgtatgttcaaaatagcccccggctagccgaccgctagtccgctaccactgcgcgatccgaccgtcgaatttgaggtcgacattttccgccaataaaaccgcacattaccttcagaacagataaggcgccccacccgtcagtctcacggtttctgctttccacatccgccgcggccatggcgctcgtcaccgtccacgcgcgcctcgccgccgccgcctcctccgcctcgccgccgcttcgctccgccgcctcctgcacccgcctccgtgccctcagtacagtcaccggaacccgcctcagcattcggcaccaacagcgccggcgctggcggcggccgaggcgcgccgccgccatcgccgcgtcgctcgacctcaacgaggacaacgtccgcctcgccatcgacgaagccaaggccgaggcaagcttgagtcctcccctcctcttcttcttccctcgcctcgtccccaattggaatttggaacgccattgttgctgattttctgaatctttgcgcgaattcgcctctgctcctgctctctcagctgggtcagctgttcgacacatcggtgggaatcacaggtgaaacccaatcgtccaaacctgcgttgcttgcgatgaacacggatcaagaatccgggagtaatctgcgttgctgttgatgatggcagggcaagttgatctcgcggagctggacgggccgttcgtgaagctccggctcaagggcaagttctggcacacccgcgccaccgtgctcgcgcggatcggcaactacctcaagaaccgcatcccggtgagcatgctttggagtataaagtgaattgactgtttttcctcgtcagtttaagcttttgggttgaactggtcggtgcatatgcaactcaatactgttgcatctttctcacttctgtcatgttcttggctcctgcttgcgtgtggagctggagaaagttttgtattttggacttgttaagaatgttaggttagtgatttagtgagtgagaactgagaagtgattattgatttattgtttgggcaggaaatcttggaagtggagatagaagatgagaagcagcttgatgatagccctgcagccttctgaggtaaccaccatacatgaatactgtagctgctgactctctcagtagttaaatcttgtcatgcagtaaaatttgaaatcttacaaatttcaggtctagaaaagttgtggtgaaaactgaaagcacatttaaatcttccgttttattcactatgcacattttacttactgctctctccaatccaaaatacaagcatttccaggtctttagcaaaaaccaaggtagagtgaaagaaaaaaaaatctctttcagtaacttcaatggttaaattttgaattggttcttcttgccttctttcaataaataaataaattttgaactcccttcccaaaaatcacattggttgaaaatttatagatttccgtgcattggaataagtgcggaagtgcctcagaaatgtttatattgtggtataaatcttgaatcgtagatgcacttatattttgaaacagaggcactagttagtatggcagtatcattcatgacgatacgaactacctgttcagccggttgtcactgtgggcataacatagctgtatattgcagtggcattcaccagtcaatggctccctccaatgcacattgcacaaacctgaatttctgaagttaagctgaagaaccaagtctgctggaatgcactatcctacattcctaccttacttttctggtcaacatcgcacaaattcagggatctccaattcccctacattttgattgtggagatgcgtatgatttgagactattctattttactagcactcacgagtcgcaagaacctgaaaactgtactgacgggacctacttacggagaggtttattagacgcttttcctgattctgagcttgttggtatcacctttatgtgtatttatttaaaaaaagggtgtagcaatgatgtgctgctattctgagtactatatttgtgttcactctttcgaatgatgtttactccatccgtcccaaaatatagcaaccttgaactggatggaacacattctagtacaacgaatctggacaggggtatgttacatttgaaataccactgcatcagtgtgctcctgtggacagtactctggtagaggtataagttggctgctcgttcacgaaatgtactggtcatccatccaatgagcgtcatggtaattcaaattcttcaatttgaaattctgatatcctgattttctcagttcttacccatttgagtcatattttttatgttttgtgaactcattaaatagggttcttggaatgttgtggcaacgcagctgtggccatttcagtgctcttgtcaatctgtcaaatgtttgggcagcaatgaactaggagtatctgaagagaaagcagtttgcaaccctaggctctagctccgtggaacaaaccatttcgacaatcttgtactgaaatgtactgaaatcaaatactactatattcgctcttttcctttgagaaaaagttgtttgaggccacttctggttcctactccgatgtacttattggatggtgcaattgatgatgctggaaactgttgctttcaaattacagggagaagttgggcttgtctatcagagtaggtacaatagcaggctataagccagctgcaaatatattttaaggagataaatcaggagagagaagagcagcgggttacagatttgtagccagctgtagcacggactccaagacgctataacaggtgggactaggtattaatagtgtagtatgtaactattgtatgaatgagctattaaattggatatagataaattggagctagtagttggctatactattaaacttgctctcatgtttcagaccagaaaaaggtgagtatttcatcataaaaagggacgtatttgacgaagcatgtcagtgcctaatcctcagtagagtggagtactagcaagaaacaagaattccgaaagaattttgcacggaagctctatccaaatgtcccttcatccatcaacgtattggactgatttttttcagcgaatcaactcgttgctagtatctctgagtct

SEQ ID NO: 27016 - DNA, 1449 bp, Oryza sativa
  unsure (1)..(1449): unsure at all n locations
ctcggtcaaaccgccttttcttctctcccctatcctccgctccgagggagaaaaaaaacaaagaaagaaagaaagaaagaaaaagagtactagtagcacccggagagtggaggaaagggagtaggcggagccaaatctcgtttctctttagttgttgttagtacccttagtggaagaatctctccccttttcttgtgtttcttgggttttgaagttttttgttgttgggaggtatgaggaatgaaggcctaacctgaggcaagatcttcgttttccttcatttgtgggggtgtttgttggtggaaacggatcaagaaaagccggaatttcggttctgaaatcgtcggttttgatatcggtttctctctgttgattggagagagagggagagagcaaacgcatgatctgtgtctgattctgacgggccttgtcgcggtccgtatcagttcatccatcccaacttgctgttcgttttgtgtggtggtgtttcgcttttttgggaagagaggagaggaagcaatcattcggcggcgacggccccgcccacttgaggtaccagttggaaatttccccccttttctttgtgcttttgtttttgctggtttgtgcttatctcttactacttgaggtacatctttttgaccaggtttttttttgtggtaacggcgatttttggggataaagtttgcatcttaggtcgggattttttcttgtttcagtggtggaatgtctccattttgagcgaaattgcgtcttttgtgggttcatgtttggggatttgggggaaatcgtgcggcctggtttgctgtggtggggaatttttttcttgtttcagttgattggtttctccatttcatatcaaaccgtgtcttttgagtttctcgtgcatatatggagaggatatccatggttatctagaaaaaaaatgcaaagttttcaacttgctctgtaatggactcttccaacgttttgcattcatttcttgagctcctcaccttggttttcttcattattgtgttcaaacctactctgatcttggttctgaacttctgatgtttgtctggttactggtcatgtaggattgatggctttgtggtctggtctcttgctaacttcttgtgcttctgtgattctgataagcttttcttcgtgttttgtgtagagataacagtttttttctcttatcaattatgctatgagatattccatgtttaatcaggactaactaatgctgtattacctgatactcgtttcagttaaacttgattgctctgtcgcatggccagcagtagcgaccatggatccctcatggaggactggatgccaccacccacacccagcccgagaacactcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 27017 - DNA, 812 bp, Oryza sativa
aaaaattatttgtccatattgtttaaggtgcgtccatcacataaatgatccgttttactgttcatattttttttgtagcattgtgcttggttattgcagaaaatgcatattgttttcatttttcaatggctttctgtcatttcctattctactagcatctatctagatcatcacatgacaagtagaattttattagtcaaactctttctgaatggttgaccatttacacatcggagattgaaaattgaacctagcacagttggtaggaaatatggtgtgcacacctaccatggtagtttaaattctttagctcaatttagatttctatttcttctcacttaaaaatggcatcaagctcctttttaatacctacttctatcgtattacgaataaagagtgaaaaagagccaccacgtttcctcggtgtagaaattatcatgacatacactattttgatcgcgagatatgacatgcatgacggtgtggattgactgatacaaaacaaaactatatttatgaataatgtatatcaaaatgagattctatttttaaaatctagctacatacatggttgcgtgggaaaatccattaattctcatgcattaacacactagataaaaaaagtatatccaataactttgtctttacccctttaaacgttcccagtggtgatggcggtgagtctacctcaccaccatcaactgatgattgggccccacaatgtcagtaataaaaggtaatccaataactttattactagtataattcgtaaaaccttgatgtatatctcactcttctcactatgcaacata

SEQ ID NO: 27018 - DNA, 1973 bp, Oryza sativa
tttgaaacaggtctacgccctatcagtatatgatcctcagatgccgtcacgctcacagatcgacgcgtacaacaacagcaaagagcacataagcaagcaccgatttcgattcctcgacgagaggggataatttcgggggcggcgcaaacttacatcggaggagttggagatgagctcgcggaggaagatctccttgttggagtagaaggtgttgatgatgagggacagcagctggttgatctcggcctggaaggcgaacgtctcggtctccgacgccatggcttcctcctcctgtgctcctgagatctcgggggcgtggagaggacgagaagaaacgagaggcggctagggtttggaggggtttccaagaggacgcgagatggaagaggagggagagtatttaagggatcctgtggttctagaagcatctacacgaacctagaagccggcgaggccgtagtggcccttgactaagttgctgctgggccttttctcggggaagtcacgggccttcaataatctgtgatccgctaggaataagtccacttgctgtccctcagctttacgtcgattttcagttggcattcctaaactgcagtacaataaatgatttttgcaaaaccattcaaaccagatcataaggcagcaggaggcatcgtagtcagaaaaaaaatgattctaaggttttcataggttatgtatgataccattgaccttttgagatacatttgaccattcgtcttattaaagaaaatgtaattattacttattttattgtgagttgatttatcattgaatattctttaggatgacttaaatatttttatattttcttaaaaatattgaataagacgaatgatcaacgttgattaaaaatcaacaacgtcaagggagtagtatatgccctctgcatctctaattctagtacttgatttggcgaaatattcctacttcctttgatctcctctctcctctactttgcaggttctacatcatgaggttggaggagtgaccgctcaagttctggacgatcacccaccacgcaacgtgccccggtgcctttggctcgatggggttgtttagattgtagccaaaataaaccttatcaatttttggtaatttggcaatattgtcaaattttttgtaggttttcttgtgtatttaccaaagtttgacaagaaactaaatggatgcacatatctaacaactctatcaaaaaaaaattgtatggtttgaaatgacatcaatctgaacaaaccccatgcctctatcggcgacgaagattggtacctcggcgtggcaagccctcgaccatgaaggatggggcacacgagcagggcggtgatgggaggcctccaccgccatggcgcactcacaaagcatgtcatgcctgcccaagatggcaagatcgacaccgtggcgacgctgaacgacctaagcatgctggacatgcaggtgatggcggaggagaagagcgggcactggtggttcgtgggaggtggtccactggtacctcatgcagatgggctcgtcggctgccagccctctctccgccggcaagctgcgagggaagagaggggagaggaagagagatggggaagagagggaagaggtgaggagtcaacttacatgtgaggccacatcagccaaaacagacatctatattatcttagaacttgacttgaacggtcttgcaaagataaaagagtgaagagtatagtattgcaatttagggatgccaaataaactcgatgtaaagatgaggaacaacaaacgaacttattccaatccgctatggaagctgatggaaattggaaatttgggaatattcggtgctaggccatataaaagaaacatttgtacttcttatagatttcttaatattaaaaacaatcaaatcaaatatgaaaacatataaaatcatcaaattaaggcaaaaagaaaaaaggatgtgtaacacattttatagaaaa

SEQ ID NO: 27019 - DNA, 5731 bp, Oryza sativa
agcgaatcttacattcccacctatgatcctctttacttacatacatgtcgaactatcctagtgtgtgacgtatacatggctgatggctcaaacatttgctcttgattggaatgcgcagctcttgaaaaattttcgtgcgtcatgtttgcattcaataatcatgagttcatgatcctccaaatctgcaggacctctacatatcctcattcctcaatgattcatctgcttgttttaccagaacatatagttatttaccaggaataaatgctgaacggaaaaggatggagaaaaaagtaagccaatactgctttgcctctgatgagggaaagcatctttgatattgcttgactataaagttaagagaaagatggaatgcaggtttggtcttactgataatatcctcatcgccgtcactgttatcgtcctcgttttgagaggtaaaaatgggagtaaggtaatgcttgtccagtaaagcgaaagaagaggtgctgtaatggcaggaaaatatatttaagcgattaggagatcacctgctcctcagcaatactacataataaattatagaaaagtaccactctgcaactaaaggctactactggttggtactttaacacaatgaaattttttaatgaaaagttcatcattttagaaatcaaactaaagaagagcaatgagtagatacaacttcaatatcaaatgtgaactgctgtaccttctctggagctctttgagtttcattgtgaaattgcttgatgttgatgtttcttccccgtaacgttgcccagggtagccagcattgttcccatcaaagttatgctgcatattgtaagtacagcatcaataactggcaaaccaccggaatgctatggtgttaatccatgagctgtaagaaagataaacaaggacggatagtagctacatagttagggtgcatatggcattcagcaacaccaacggtccgttagtaagtgctcttattgaataaataataacccatgatgatcatttaagcataactattatctggttttttgtacgtagaacaagcaggttgcacctcaagagagaaccaattagttttttttttaaaaaaaggaatagatctaattcattatgaacaagaaaacagaaaaaaaatcgtgaccatccaaagattgtgtgtaatacctatctatccaaataagccctatggggagagtgcatggaatgcaatggaattgcatcctccatagaactgcaatgtcatttgatatttaggctgagaatgtccagcaaataaataagattgcgttgtttaactaacctaatggcaaacaaagagaaatataatgttttttgcatgtacttatgatacgcggtgtaagtacttgcctcatatggatggcgatagcgattactatccccaactacttgcagggattcaagcattgttccagttgagcctccaattagaagcacctgcaatgtttgcataaaaagacatttagaatgattcatagaatagcatgaactgatacatacaaaatcctttgcataaaaatagtcgtggctattatgtaacatcacaagaattacaaccggtaacctacagttagaacaacaatagatgtggtagcggtgaaaattgtctcgccatgtccttcaggaagatcatgaatagactgaagtgcaagggcaaaagccattgcccccctaagacctgaaaaagaaaaaaccaacaatattagcagtacaaacatgaaacttattttatgacatttttgggcatacataattacataccactataccagagtgccagctgatactgcctaggtatttggcagtgcaccggtcgtgccaaatttaatatatatgcacaagagaagacatttgcggccctttaaaataagataatatcagaaaatcggcacaattatatagctatggggcttaagcttgtataaatacacagaaagcatctccaaaaactcagcaactagtccaacatcagaccaaaagatagacagttccgttggagaagaaaataccttgcaagtaatataaagatctggatgcataagcaaaagggaaaaaaattaaggaaacaagaagaaattattgtattcgtaacaagcatgggtaagagttggtgtgtaatcaatgcgaaggatacaactgagaaaaaaatgaatccaatatgtgaccagctttgacgctccatcgcaatatcaaatcccatgtatatgaacctgtgtaaatgcattacagtttcagtatttggacttgttaaattattgcacttgaaggtcttgcttacacgaaagcctctgctagtgatgaaagtagatggaaaaaacgagctgtaaaacgctgagaatcttctgataagttatagaaggtgtatctcttcataacctgaaataaaaattcacttcttgtaagcatgtttataatatcttcctgcaaagttgcttatctataatatgtaataagaataaaatctagagaaaatattgtcacaggctaacttacaattccagtaaacagaatagagacaataccagacaaaccaaagccttcagctagcatgtacctacaaacaactggcaattatttacagcagatatttaaagagaacatgaaatggaacaaatttcaaagataggcttacgagaagtaagggaaaaggacaaacaagcaactctccagattatgaaggctggaagtgaaaaaaaaaataaattagcagtttatgtgtggggtactagtttggcaaatcggaatgtacttacttctcaacacctagagctgcatacttgaagaggtttgatagaattaaggactgacaattgagtctcaacggggataacataatataagcaaaaatgaagttcaaaaaatgcatttgttttgtttttgcaagaattttttaaaattttctttttcgacttattgtcgttggcaatgaagttgttgatctggccatgtacatagcctaaatattgttgcatggtgggggttgccttttttgttctccagagtaaatggaaaacgtttgtaaatagaccaaaaagatgattacacgttaaacatattgaattttcttgtcaaccctggaaaggtaatgctcaaggcatgcaacaataacatattggtttctaagaggatccagcaggagtattctaagttttgatagcaaaaagtgggaattcaggatgattacatagactaaacccctctgagagagtagcatttaactctttgcttgaacttttgtaattgtttcctccttttcaatttaataaatctttaactgtgggggcttcccctacagtgttttggaacaaaaataaattttcaggagggtgcaaacaggtatacatttctttacagatattaaactaatttaatatatgttataaaaaactaggtgataccatcacatacatgtaacaagtttatcagttttactttgtgtaaataaaaaatatacattaggtctctactgatagaaaatgtcaaaataaaggatatgagggcagaaatgaatccaaccccaacacctgcacataaaaaaatggaattgaaatatcaaatgttaaagtacaaatagatactcatatataatcataagtgcaagcgaagtcaagaaatccaatggaaaaagcaaaatacataggcgactcgaaatttcttctgctaaaggcatttgtaatatttaaggtacagtacctgatgacattgaaccaacaaaattctcaagaaacttaaggatagctagaaaatagttctgtccagaagaacttgttctcagtgaagccatactcctgaaaagttcaaggtgttaatgacaggattctgagaaggagccatataggcagaaggagctcaggcaatacattctcacctatacaaggatatagccaccttaatttccaaaccgtagttagacacgaagaaatatgcacatttcagtagaaataaaaaaaaacagctagtattaaataataatagggttatgcatacagcatcattgagaactgattctccaaaaaccagcgcatagaggttcacatcagtgccaagttcctgcgattgatggacattatgtgatcttttatctcaaaatttgtaaatatagtctgtatagggatatggaaggaacctgaaatatggacagtacagtaacaggatcagttgctgacaccagagcaccaaacatcatgcactcaaccagaggcaacttatagacaatgtatattaacccaccaacgtatctgtgacaaatggaaaaatataaattacatttttatagatgaaataaatatcagcgaataggaatggaggcaatatagaagatactcttacactaaaagaccagtgacaatagaagcaatgaaggttcccaagattgcaaatgttataatggcaccaaaatttgaaaagaatggtttctatcaggaaaaaatatgatataattagctgagaatgatagaatttaaccaacgaagagtagaatttaactaactaagaggatccaagaattccacacttactggtgctaagctgaatccagactgagtaagattcagtcaagtaaaacatggtaaatttccgtacaagtaattaaaaaacaaaatcaagatacaaaaaaggatataatataattggaggaagtaagaaaagaaggaagaagtcctcccgaaaattgaaccatctcctgaattaataaagcaaatgaacaccacaaaatgttcagacttaacagcgatgtcatattttgcagggaaaaattgtatacagtgagtaataagaaatattatcacctaatacttctttgagtgtttgatatcttagcaaggccgccaacaatcatccctgacaagaaaagctattaaataatttcgtaataatatggtgtcatacgattctaacattttcaatgtacctctaggctctacaaactattaaataaaatggtaagatccatcttagctagggtgttttatttccaaggcaaatagtatatgataatccaccggatgatccaaataaaacgtagctagaataaacccaaatgtcacatcacttatcttagataatcagaaatcagtaaaagctaagctactgaaatgtaacggaaatacgcttatctgaaggaaaagacatctgtttgcgctacatgccaactttttaaaggttcattttatcctccaaagccctcacctgttacaaccaatcctcaaccatcgacagtaaattttggaaaagcacagctcgaactagactacagcgcgcgtcgtgaatgcaaaatttgttcgtctgatttgtgcataaacgcacagtcgaagccgttcctcctaatcacacactcacaccgttactgctcgccactaaacatcgtgtgaataaacagttcattcggcgtcagtaaacaacaccaaacacgatcacccccgcatcaaatgcgctagctcaaagcatcgcacggcgtcgcaaatacacaacgatcgcgaagtcagacacatgaatcgataggaccctcagcgacgatcggcattcttcagtttccacaagcccaaaatgctgtaactgggtgggaacacataccgatgaggagggaggcgctggcctcggggatgtagtagaccttgcggcggcggaggacgtggccgagcacgaaggagaccaccagcatcgatatctgcagcaggatccccaccccggccgccttctgctcgtccaccgt

SEQ ID NO: 27020 - DNA, 4217 bp, Oryza sativa
ccgccgccgcctccgccgcgaccatttccccgccgccgctcccactccccctcgcgcttgatcgatcgatcgctcctcttcctcttcgcctccgactcgatcgtctcgcgttcgctcgcctcggccgcttcccgtgcgcgtcatgcggatgcgggcgagcgagtcgcctcctctctcctctcctccctcccgttgtgggctgggcccaccgcggagacgggcggtccagatgcgttcgactgtggatccgacgggtcagattgggcctggaatcgaggggcccactgggcactggcccggtgcctagaattcgcgggtggaatggaatggaatcggcgggaaggaagagacgggccttccaaaacgattttgttatatatttatcgacaaattttctcccaaaaatttaacagatataattacagtataatcgtagtgtaattatactgtatgctgtgattttttttcttcctcaccaaaacaaatcttgtaatagatttaatgattcaaaattacatgaaacttatatacaaattacactgtagttacatgcaagttacagtgtaattacatataagttacagtgtaattacactacgattgtactataattatatatgttaaatttttagaagaaaatttgtcgacaaatatataggtggtcccgtagcttctggttgataatttgatatagttgttaagttttgccgatttgatcgagtgcatgacttgcggaaagtacaagtagtgtgatcagtaacaccttttgggctaaatcatcatctttatctgatctgtaactacttactagtgacgaagccaggatctcttcaaaaaatcataacaattcacgcagattttagcactgattaagcctttgagttttttttcttgcacaacttcgtgatttgtttttcaaagaacaaggatgagctagaacaaactagcatgtaacagtaaatacttcctccatttcataatataagactttctagcattgtctacattcatttatatgttaatgaatctagacatatgtatgtgtttagattcattaacatctatatgtatgtgggcaatactagaaagtcttacattatgaaacgggggtagtagtctactactccaatatcatcatcatcatcatcacaacattatactccctttgatccttcccaaattgaacatcacataaggaaaatcatttttttttcaaaatgatcattatataaccatgtggacatatggatttcatcataatacaattaatataacatcgtataatgtggtgtatgcttgtgttttagtcgatactatatgcatcatgggagaatgtgtgtatattttgtatggtgtgttgactaatgtagtttaaataatccttagtcttggtgcacaaacattatatgatgatcaatttgaaatgaagggagtaactatctagacactccccatgtactattagaatccagtccccatatactgttactagtaaagtcacaaattaaacagcacggtcagaaaacgcggcgtgtactgatctagcacgatgactgagtgactgatcggatatcaatatctccatctatgaaaaatctgtggttgccgaacaaaagaaaatctgtggcgtggcttcactccttcagtcaggtcaagcaaaacccgtggacgtatatactcttcgtcttgggtgagccattcttcagtatttcttctgctgtcgagccactgaatcgatcagctccatggcgccctctcctgtatccttgtatggctgcactgttctccaagctgcaacaatggcggcaacaaccgcgctaaccgtatcgctgccgggctgcccgagctcgtgcggcagcatggtcatcccctacccgttcggcgtcggcgccggctgccacctcgccggcttcgccgtcacctgcaaccgctcctaccacccaccgaagctcttcctgcgcgacgccgacgccgctgaggtgctcgagatatccctcctaaactccacggtgatcgtcagcagcgccgtccggtacgacgccgccaaaggcgagggcgcgtggggccgcggcctcgccggcgcgttccgcctcagggagcggcggaaccggctcgtcgtcgtggggtgcaacctgcaggccgtcctcctggacggcgacgacatcgccgccgcgtgcaccaccatctgcggcggcgccggcgccacctggccagcagcggccgacggcgagctcgcggattactcgtgcgcgggcgttggctgctgccaggcttccatctacctaggcctcacgtcgtacggcgttcggctgtcgccgttcggcacaagcaccgggccgccgccgccgccgccgacctcctccgcctcgtcgtctaaccaatcggattcggctctcgtgttcgtcgcggacaacgagtggttcggcgggaacgcgagtaagctcggatcagcagcagcgacgatgcgaccgggcggcggcggcatgccggtggcgctggccgtgctcgactgggcgatcgggaagtcggggtgtccgccgcatgggcccgacgacacggcctgtagcagcagcaacagctactgccgcaactctaccagcacctcgcttggcggctactcgtgccagtgcgacaacgggtaccaaggcaatccgtacgttgcaaatggatgtcaaggtaatttgttactccctacttccctaaatgtttgatgccgttgactttttaaaacatgtttaaccgttcatcttatttaaaaacttttgtgaaatatgtaaaactatatatatacataaaagtatatttaacaatgagtcaaatggtaggaaaaaattaataattgcttaatttttttgaataagacgaacgatcaaacatatttcaaaaagtcaacggcgtcaaacatttagggatggagggagtataagggtgtaaccatgtaagtggagaaacaactgagggtcttctgattagcttcacaaggtggtgggctagctgttctgggttcgatgcctcacccttctatttagtttgatattaaatcatttcctaatattttagcttataagtgtgtttaacggattagtcatttacacttgaagttgcataagtatagcctctcatcgtttgcttgctagattatgagccgcggctaaaatttaaaacctaattttaaagttgattttagttttcttattatagtcaatcttttgccgttaaaattttaaaccgctattaatagttttatttataaattatttttgttcgtttagtatatttttctatggcttaccaaccatagttcaaatgattagtggaatttagaacagaatggtacaaaatttttctaaattctccctttcagatatcgacgagtgcgctctgccagaagaatatccctgctacggtgaatgcacaaacaagccaggatcgttttcgtgcatgtgtccgggtgggacgcacggtgatgctatgaacgaaggaggatgtgaaccaacgagtacatagaaatttctcttcatttcataacttaaatttatccttgcaatcttctctgcaaatccttgcacaaacagggttcagaaatttgaccgtatcttctgctggcagctctccttgtggcgataggaggaaccatcggcataggaattccatccgtgttcgtgataggcatggcaatgacgaacatgatcaaggcacggagggccaagaaactgagagccgtattcttcaagcagaaccggggtttactgctgctgcaacttgttgataaggtgattgctgaaaggatggtgtttaccttggaagagctcgaaaaggcaacaaatcgattcgacgagatgagaaagctcggcagcggcggccatggcactgtctacaaaggcaccttgccagacagacgtgtcgttgccatcaagaaatcgaatattacggttcgtaaggagatcgatgatttcataaacgaagttgtcattctttcgcagatcaaccatcggaatgttgtgcggttattcggatgttgccttgaaacacaggttccactactggtctacgagttcatatcgaacggcactctttccgaccatctccatgttgaaggccctacattgttgtcatggaaaaatagattgaggattgctcttgaagctgcaagcgctttagcctacttacattcatccgcttcagtatcaataattcatagggatgttaagtctgct

SEQ ID NO: 27021 - DNA, 14983 bp, Oryza sativa
tgacaacaactaaatgtagccactttttgggtaattttgcaaaaaacaaaaggtaaggttgaaaatggtagcaaaatgaacaagccctacaattaagtggatgcgcgcaacaaacaatataaggatttagtatgagtgttaaacatataattttacagagaacatgcaaacgttgaaaattatacttatgaacaaacaactcatttgtgagaaaaaagtcagcacacaaaactacattcaataagcgagaaaaacattaagttcatgaacatgtatgaaccatcatagcaacgatctggcctatcatgaacgcctggtaacccagctgctttcttaacaaaatgtgactgggtttaaatctacctaataaaaaaacacttatgtgtttacatataactaagacaaagtgatttctgttagaatatgatagccattttcatttagtgcatatctttgatctatttaaatatttttttctttaaacattatatattaatctagggctcttataatgaatatagcaagatatgatttcttttagtattctttttatgaacaataaataaattgcccacacatctgcataggcttcctctgtagttgctaaaaaaacctccaaagtgtttgggccacgtcttttccccctaaaacgtaccccttctagccttccgtctcataaaaaactcaatcctaactacgaaccttgacacgcatttattcagattcgtagttaggatttattttttagacaaagttgtatatgctaatgtcataactaaaaattatttttcaagttaattttgatgttgttatcttacttttttttctaacgttggtgttaaagtcattaagaatacattggtaaaagttttaatcataaattattttttatcgttaaaatgttgtttggcgtatcatttgcaattggccaaccaatgacaacctttatctttcaaaacttttaattttgtttccgtcggatttatcttccaaaacaaaaaggaaaaaaacaaatcagtttttatcttccaaaactttcaattttatgaccggcgacattcgttccaggagaaaacaaaagggaatcaaaccctcgaccagcaagttgcaaagttccatctctagccatctggaaatatggttggttttaattagttatatgcgagttacgtataagttacattataaatagttaaaaaatataattacatctcatttacactatagttatatttgaaagttttttttaccccaaaattatcaaatgtttatatagctatttgccaaagtggttaatctctatatatcacgtttagagttatattaccatgttttgccactttcatcgtattgccaacatagaccgaggatggaaaacattctctttgtcccgtcttctccatcatcttcttttcaatctctcctaatgcacaactgatagtctaggagagcaacggagaaccagttgcctcctctcctctagctcctccatctcttctctctcatgcgtgcgcattgctattgtcgtcgtctcaatctttatcttgagcctcttggcgtcctcacaaggtggctatttgagcagtgtaggggagttattggggtagggcgtggtcacagtcgtaagcgaagagaggagatgaggcggccgctcgagctcggtgccgccgcgtgcacaactcctttcccgtcggtcgtcggcccccaaccactgaccgctgcccttctcctcggcgtgtggccgccctggaaagatggggaagagcggggaaaccaataagacaggtccttgacatgtgggggtgacatgtcacacgctgactcagcctcgccatgttagtcgaaatttttaagttctatacaaacttataacttatgctatactaagtcggatatgtaaattatttttagagtaaatctcataaaactacaattactttagccaaattatcagaaaactacaaatttaacatgatgtatcacaaaactacatatttaaccctaaatttatcacataactacatatttaagttggaatattgcaaaactacaaatttagtaacaaacttatcacaaaactacatgtttaatgtcaatttgatcgcaaaacttgaatatttataacccaaacgtaacattggtgctaaggatttaaaccgaaaatctatagttttgtgataattttattattaaatctgtagttttaaggtaatttgaccaaagtatctataattttctaaaatttactcttattttcgttataaaaaaatctagtttgtggagccaccaaataagctctgaaacacagctagacccgttagacacttcaacgatcaaacaatagggaagtctccatttgtgaaatctgtggttgccgacaaaagaaatatgtggcgtggcttcacttctcaagttttagatggcggggcaggagcacttaggccgtcggttggggaagagaggtagaggggaaggaggttggtcggggtggggggagggggggctcacctgcatcgttgaccccttcctgccagccgacgaggctgggtactggcggagtgtggggcgggacggcgaaggcatcgcacgcgcacgagctcgcgagaggtggcggcggtgctggaatgatgaggggggaagggggttagggatagaaatattacacacgaaatcagaaatcttaaaatggtccaacggtctagaatttgtatgatttgtgagatgtttttctgtcatatgtcatccagacagtcccatatttcattagaaatacacaagtgctctctcttgcacactgatgtgtgtgatctcactctcagatggtgacaacgaatgggctacgaactgtatgctttccatccgaccacgttattgacccaaacaggtcccctttggccgccgccgcggcgttcttgccggagaaggacacctggaaacccagcttcttcacgctcttagtgaactccagcttgccgggcaccaccttcacgtccaggccggccggcgccgcgacggcgacggtgtaggtcgcctcctgctgcgcgccgacgttggtgacgacgcggctcaccgtcctggtgccgccggccttgccgagccccgtgacggcgatcgacgggtagttgaggccggagatgaggtccttgctgtcgctggcgttgccgccggcgccgcagctgaagccgccggggagggaggcggcgaccagcttgatctgggacgcgtcgtagccgtagtcgcagaggaactggaggtagtcctcctcgccgagctcgtacaccagcccggcgtccagcgcggcggccgggttcacctggcccgcgccgtggtcgtacggcgtcgccggcgaccccgagtcggtcgtcacggccgccccgtcgttgttcagctgggccgccgtcgtcatgatcgccgaccggatcgccgcagggctccacgccgggttccacgccctgacggcggccgccgccccggccacgtgcgggcaggccatggacgtccccgacacgaggttgaactgcgacggcttctcctcgccggccgggagcgtcgacgtcgggatccatgacgccaggatgttcacccccggcgccgccacgtccggcttgaggatgttgggcgtctgcggcgacgggcctctcgaggagaagtaggcgaccaccggcgccggcttgtactccgtcacggtgatcgtcggcgtgatggtcacgacaggctcactttgcagtttaattgatcaccatgcacggaagagagagtgatgtgatgagatcgatcgagcttaattaattctgccactaattagggtatacttcatccatttttttaatatataacaccattgatattttaagatatatttaccattcattttattaaaaaataatgtaattatcatttactccctctgtcctaaaaatatacaacttttaacatttagaatttgtctcaaaatataataacttatataccagcattttcttctcaaccaattacaatcctctaccatttaattttctcacataccttcacttctcatctaatcgtagcctaatcctatttagttatatctattttcttaatagttgtgttcaactctaagaatatatgcttatattataggagagagagaatattgtaatgtaacttgatttattaccaaatgttttataaatataacttaaatatttttctatttgaaaaaaaaataaaggtgaatgattaaatgattgttaaaaagttaacgatgccatatattaaaaaacggaggtagtatataatcgctatagtgtgaaggactacgtatagtacctggtggaggagatatacttgtgaatgtcggcggcggcgttggaggtgatctccgtgacagggaagtcgatgtaggcggtggcgacggccttctcaaggtcgtcgacgaggacggcgccaaccgcgccggcgctcttgagctccccgaccttctccgtcttgggcgtgtcgctgttccgcgagtggtgacacagcacgatcttcccttttatcttgctcgcatccagcgtccccggctcacagtgactacaaattattttgtggttatgatttgatttttgggcatgaaactacttactcagattctgctgaaactttctgttaatttaattttgtttcgttactaagcttgccttgtagtacgtaccttgctgactcggtatcagaaactgagctggacttggctgattcaccggtgatcaatggatattttggtgatttgttcaagttggagaagtttatagctccaccctacagattccataaaaatggggtagttaagatcacaagagagtgctcccacaaggattttagacggatgagatattagaaatagatgagattttttctaatacaacgaatctgggaaaaagaacatgtccagatatatttaattttgtgatatataccttgacagcggtgttgttgccgccgagcacgacgtccgattggaagtagcggtcgatcgtgctcgccgcgacggtaaggatccacggcgccgcgttcacgacggtggcggcgtccggccctgcgttgccggcggagcagacgaccatgatgcccttggccacggcgtggaacgagccgatggcgatggggtcgtcggagaagtccgggcggaagtagggcgacgcgccgagggagacggagatgacgtcgacgccgtcggcgacggcgtcgtcgaacccggcgaggatggccgacccggcgcacccctccccggagcagacgcggtacatggccaccctcgacgacgccgacccgcccttggccgtccccgccgcgaggccgtagtacgacgcaccggtgaccgcgttcccggccgccgtcgacgaggtgtgcgtcccgtgcccggcctcgtcccgcggcgagctcccgctgctccgtgctgactgccgtttcgcctcgccgccgacatcgtagtaccttgctcctatcagcttcctgcatgcgccgcccgggaaacatcaggatatatactctccgtttcatattacaagtcatttgtaatgacttttttcttagttaatttttttaagtgaccaaattatactacttccgtttcagattagaaaatgttttgactttggtcaaaatcaaactactctaaatttgactatctttatagaaaaaagtataatatttacaataccagtataatttcgttaaatctataattgaataaatttacataatatatctgtcttgagttaaaaatattactattttttctataaaattagtcaaaattagagtagtttaattttgaccaaagtcataacctaaaacagagggagtagaagtagtaaattttcaatgtaaaaccaacattgtatcaaaatatacgtcaaattatgaaactaattttgtatcataaatgttgctatttttttataaacttaattaaacacaaaagttttaactaagaaaaagaaaatcaaatttctctggcataggcgtcggcgactcaccggttgcagctggaggagttgaagtcatcgccggccatgcagacgcccttccacctggcggggacagggccaaagccggcgtcgtcgaagctcggggactcgggccagacgccggagtcgaggaggccgatgatggtgtcggccgtcggggacgacgacgtcgacgctgatgctgcggcggcgcgggcgcggggcgagcggcggcggcggtgggcggagccgccagtcttgacgtcgacggcggccgtcgtctgctgctggaggaagtcccatgacctggtggtgtggaggtggtagacagggtcggcgaagacggagacgacgccgggcttccggcggagcgcggcggcctccgccgctgacagccgcgcggcgaagccggagaaggcgtacttgtactgctgcaccaccacgctctccactggctgccccctgttcgcgtagtgcacacatgacacggttactaacgtgtggcacaatgacgtcgacgtgacgtgacacacgcaacacacgtgttgcgttggtgatcactttgtgctactgaggtttccttttaccaataatatgcatcccaatatctttgggcataaaattcagaaccgtttgacgaaaattctctatctccatatctacttctttatctttatctttattttttctattatcaaaattgaaaataaatttgtcggtactttgatacgttatccgtgttttagtcggtttttaaatttatttgcttttgaaaatatagaagaagtcatataaaaaatatccaagtaaattctcacattttatttcaccataattaagccatataacgatagtaagattaaaataatcttcaaccattgaaaatagttaaagagaaagacaatgttaaattaacaagaagtgcaacactgtagcaaagtgagagaagtgtacacgggtttttaaattaacgtaacaatgtctgcttattttaatttatatggagtttttttttagaaaactgctacctctatttcacattataagatgctttgtttttttaagtcaaatcatatatgtttgatcaagaaaaacatataaatagtttttatactatacaatcgtactatattcaatatttggaaaaacactagtggtgtggtagcggagtcgtgagtgtatgattctactaaccagggttcaaattctggtgcccacgaatattatgcacatgcatgtagacttttaatagaattttagtgagataagggatatgtcgatggtctgcatgtgctttttaacaggatttttgttagatcaaggatgtgccgttggtttctatctcttagagcatatgttaggggggggtccatttgtgagggtgtgagtgcggtgctgcgtatgtagtggcgtgtgtatgtctatcgtgatttttttttaaaaaatcagtatttagattgaatggaactaacacagtatcgtagaacttgttacatttttccgtaaacttgaccaaacgtaaagaaatttaactttaaaaaataaaacatcttctaatatataaagaaatttaactttgaaaaattaaaacatcttctaatataaaacggagagaatatatttaatgccatgctacaaatcggcaaactgagcgagtaccttcttattgactgacatgcatgctactgctagctagtgcaacttgagagacattagcaccaacaggaagagagttaaaaattaatttattttacgatggaccttttgagcacggcgccgatgaggcggagatgggtctgctggaggatgttgggcgaggtccgcggtggcacggcgcccaagtacaccacgtataccccacgccgctcgccgccgccgccatttcctcctccagccgcggcaccaccaccaccgctggcgccggcggcgagcagcaaggccaagacgaagcagatcagcggcagcaaccacatgattgctcgtataatttttatttgtactgcaccggccggtcagttcaagctctgctctctctctctctccccctctctctctctctggccacgaaacgatcgcactatgtatggctgcatttataagcgcgcgcgtgcgacgtcgtcacgtccgtacgtgccggtgaccggaggtaataagagcagtataaacatacgtgaaggagataagagagaggagagaagaaaaacgggttatagatatacatcgctgtagcacgaactttaaaatgtatgtgtatatatatgtgtgtatatatatatatatatatgatatgtaggaccaattatcatggtgtattatatatttgtaattaactagtataaattagttattagatagactatagatgatttagagttagtagttggctggagtatactactctttctgttttacaacgtaagtcattctagcatttactatatttatattgatattaatgaatctagacatatatatctatttagatttattatcattaatataaatatagaaaatgttagaatggaagtattgaggtagtggtcgcctggtgggatcggatcggatcggatcagccggcgcttgcgcgtgcgtgcgcatgatatgtggctgcgagcgcgaggggtaggttaattgtggatcgggtgcgccgtgatggtgcgtgcaccactgcgctgcgctggctagctactcgagtagagtagagtatagtatatcactagtcttggagtgcagccgcgcactagtgcgcgatctcaccttctctcgagcatgcgccgagcctaaatagctactagtagtatagacaaagttacctagttgcattctagtaccatccacatattttttgtcaggattcagtaagttcatcatcatatactccgctaatgtctgtaccaaatcctaagtgtaagcaggcttatcatgtttgacatccccaactagtgacaacaataatatcacaagatgaatagtatctttcaagttagtttggaaacatcaatgacttccccaaacctaatccaaaataagtgttctatctctcctttacgttccttgattcaatcaccataattcgtcctactttgacatgaacaaggtttgacacaacctagtatatgcaaaacagattattttacttgcccaacacaatacggagcatggacatatataagcgcatttgccatgacactatcgttcatcaccaaagaagagagggaaaagatgggctcacagagctgttgccatgttaaagcactattcaacagaatgaagcccagatgccttcaagaggagcagcagcataacaagaccagaacagtcaaggcagaaataaggcaaaacactcttcaagacatcttgtattctcctcagagctttcagggggaggcaattggagccccatcacctcggaggcactctccaaaggtttgcccaattaacccggattgttcttatgaaaataattctcctaacatccgggacagcttctccatcgatagaatctctattaggagccaaaacagcatgaggagagttagcttcagattacctgatgaatctgacatattcatcattcccgcacgcgaagatcctgaaagttgctccactgatgacgaatctgttgaacatgtaagtgaacaagacattgatgcaaggaaaatccgttatgctaaaaccagatactagcagcactgccactgctctcatgtacctagcaaaaaagaatacaagaaaagaagcttcaaagaacaaactcattggttgatctattccaaagaagatactcatgttatgcagtaatattagtgtgtgcctgcttgggtgcttgttgcttctcaaggattatactgtacgacacttcagaacaaactcgtaacttatctatttttcaagagaacgtactcatggtacgcagtacacagtaatagaagtgtatgcctgcttgttgctttcaaggatgaaactgtacgatattttacaacttattggatttcatgcagatgtatgcgtttcatgatttcagtttatttggccttcagattctccaacgtattgtaatacccagctttttacaccttttcttattcttttttttagacggttaaacagcagaataggctcctactgtgatatattaaaatataatatgtacatgagagagatagtacaagggggggcggggggaataaaaaaacagcagaaagagagagattttagctaaccttttcttattctggaagctggagagtgtcaagaaaatgttatgtatgttactgaatcacctttggcatgtataatatagatttttccatcacaataatcatttagttataatgctatataaactttattttctaatatagaaagataggagatataaatgccacatacaaaagccaaacagcacaaacctattaattctgtccctttttcctcatgaatggccaattcctagtgtaagtaactcaagttattctcagcaagtaagggtgagaagcacagctgacctacttctatacactatctatagtcagatttgaagccttccgtcagtgcaacaacctttgaagataactttgactgtagtttggaaacagcttgtctaatatcctacaaaataatcatttgggtcagattagtctagaatccgcaactattatttttaggaaacactggattcccaatgatttataggttagtgattacatacctcaagactatatcgatttgagaaatgtgtcagtacaatggctttgtttctaaaccattgggagtgctccattatctgtagacgacataccagatttgcattaatgcagtaatactttatacagacatctcatttaactatcagaattgtcccaaagctcattagaatcatagcatggcagggagaaagtgacaagtgcatcatcatttacctcagagagatgcatgtggccatgctcccgagcatgatcaacatcaatttggtcatctaggaaggttgcctgtgaaaaggtcaaataatgttggtgccaaagcattcaatagggaggacatttgaaattattttgtcatgtttcagatttgatggaccctctgatcaaataaaaaggaagttcttttgttattttacagtctgaagatgtgacaaatcaatataatagggtggttttacttagactgccttttactgttctctgatatttcaagactatagctgtattatactactctcccaatcccataatataaggtgtggtcaatgttggcacggtctccaaaactaatctttagcttataatttctcatatactataagatttgtagcaacaaaattataaccacatgaaagtaaatttagatctcaatctaatgatgtaatctttaacaaacaaaattcattttcatattatattaagtgttggtcaaatgttttaaaggttgaatcttgaaattcgtgcgcgccttatattatgggatggagggagtattatacttcacaccctttttgctgactttgacatgtcccatgagaatgattacatctctaaatgtgactgattacatacagctggaacaaatacttttgacaggcttgggagaaagggcaataatcaaggaaactaaaatctaaagccaatacctcagttataaggacttttgctctcagggcatctgcatttcgtgggtcaagaataaaatcagactttgtgtcacctgtaaaggcaacttctggatatagtatagtatctgtaatctgacagaaaagaaggcagtgagtaacagtgcagaatatatttcttatatagaacagattgctagctgacctcagcgcctgattgcttcattttcattatttgattacccttcaagtgagcatactgttttttcaactttctccgaacagagtagatgacataaccctgtgaatgtacacaacccgcacaaggggcgaaatagttattaagcactaaattgtccaagaaaggtgagaactagaacttttggcttgctaactatacttaaattgacctagggagttatacctggctgggtatagcatggtgagtctcaaatggtctggcaacaaggtcattacgtatttcaaatgtctcccctgaatgcaatcgtagaaacattagaaataaacaaggagagagaaacacagaaagaagaggtgaaacgagctcaaacccaaatcaagcgcaaccaattccactttaaggtcgacttgactcattctacgatggatttgaagtagatcctcaacatcatccttgatacatggtggtacaaatacaacgggtggcttcaaattatagaggccacgagttgctatgtacattgggagaccaccctgaacaatcaaaataacaaaactgaggtggatatggctgcatttatgttgtgattctgttagagcagcaaatggaaaaactgacagtgaagcatattcgtcagtttaaagggaaaaacattggaaaattctcccgttgctatgcaaaggagaaatatgttggcacaatcatgattttcttgacaccgctccaaagtaaaagcaggtatagagcaagatgagactatttattatttaagaattacacgcagactaacttaggccaacttatcagaagaattggtgataaaaatcctatccatcacgaattcacgatagcatgttgttgaacaaataaactaagcagacatttactaaaggccacagtccaaatagtaaattaagcaggcatttccccggtgacaattcccttgaaattactgaatcaatccccttacatcagcttttctatgaaacttcaccgatggcgcacccaagcttagctagaggcgcagttgcctctacacgaaattcacgaagcacaagcagcacaggaatgaatcaaaccaggacagggctcggggcgctcacgatgtggtcgaggtgggcgtgggtgatgaagaggtagtcctggctcacggcgaagagcggcccgcggccgatgtcgaaggcgacgttgagggacggcacggtgacgcaggtctcgtgcccgccgacggagaccccctcgatggcgtacccctccacctccacgcccttacggtgcacctgcgcgcgcgcccggcggtactcctcctcgtccgccatcgcccggtcgagcaccgacagcagcccgccgcccgctccacgccccccgccgccgccctcgccggtgcccgtggcgacggctgccttcttcgcggcgagcgtttggaactgggagcgggaggctggggcggacgacgacgcggggacgaggaggcggtgggtgaggcggagcgaggggagggagaggagggaggtggccgccatttccggcggcggaggcggaggcggagacgaacggtggcgacggcgtcgtggggttttctgggttttggggggaactcgactcgaggataacggagagtcatttttgcggggtagcccctgtcttatcctaaaattgtttttccaattggaggaggaggaggaggaagagagtcactgacccctgattactcaaggcctcaaggagcttcctgtaaaatgccaaattctatttgtttatttatttattttgatagtgtaaaatgtcaaattcagctacactgaaaataaagagagatcagtttgtgtttacaggttcagtgaggcagattgcagtgataatttatatcttaccaatacaagaagtcaggaattgatactggaacgatgatacatttccagattatggttaaatacagcaaattcagcatagattacagaactgaacactatacagtggagtgtacatttttttttttgacagaacgtgtacaagtatattgccagttcatttggaagaattgtgggtacatcacaaccaacccaccatttctccagtatagcagcagcctatttctacagttctatggttcctagatttacatatgtacaactcctacggttatttacaaaagaacattatacagcagaacgaaataatgctaacatgttgaggaagtagcactacacgttccatgggacatggcgatttctgatgctttgctgattgagcaacaagcctacttcttgccagatgctttcattggcttaaatagggagtatgacctccgatgaaggcaacatcagagctaacaattattcttgactgggaagtgaggatgtatgcatcgctgatggagaaccccttgatgataggcaatgggaagcctcttttgagatatgaattcacatagggcacaaacaattttttcaacaagatctgcatcacactctgccaatacaaaaattagaatcaattagacattcagaagttaagaaacaaatgttcaccaatgataataaaatacatgtgcagctccacaattaacaacttcattcagaaattaggcctttccgctatactaggtaaaagaactttatgaagaaggcattttcaaccgaaattacttttttctttccaataggataacgcatgtcttagttagcccctcagagtccctcttggaaattaggcatatccataaatataggatggagattcccaagctcacctcttttctattacaccatcataaattacaaactgtggaatgtcattaaatcgtataatacaggccaaaatacctgaactatgaaggtatgaagtttgccaactttgctccacttcaaggtgaatgagaaataatctaactcgactcttccagcaagattgttcccagaaaccactgcagctccagagacagtaactgactgtggaaacaatatgcgacaacggtatcaaagaggtggaaattgcacgtgtttcctcgtgtagaaatgtttatgtataatggaagtccaattgtaaatcaacggatgaaacaaaaaaagaaaacatgaacacaactcaatgtgccatagatttcatttctaaaattctcagtgggagaaaatatgaaatgctgaaggtcaaagacaacacggacagtatacaagtgctgccagatgggcaatactgtta

SEQ ID NO: 27022 - DNA, 17875 bp, Oryza sativa
  unsure (1)..(17875): unsure at all n locations
caccattcatttttcccacctactaccactacttaaccaatcacaaccctccaccctccaccattcacttctacctactttcttagtaaccatgtccaactctaaaaatgcttatattctgggacggagggaataattgtttccattcaaacatgaacacgtgttcaagttagctactctagacggacacaatcaacaaaatatatatctttcttttgtgtaatatatatatatatatatatatatatatatatatatatatatatatatatatatatatatatatatatatatatatatatatcttttgacaaaagcaagttcagataatccttcaactttacacatctgcagtaaggctttaatcctttaaccatgataacaaccactttcttatgaattctgatataccttgaaatagagagctgaaacagagttgaaaacatcttcatccaatgaaatccatagcatttttgaagagctaccaagaggtggtacatattttacacctctaaaatgcatgtgtcttgaaactgcagttttatcagatggaatgaacagtccatcgatatcaaactccacagaggaactcttgaagagtggatcactaacaaatgtcacattcatagcagcgatgctatcaacatcgattttctttggaaggcttccaaggaatgagtcaagctttgatgcaccctccattattttcttcgtaattgcattttctactgatgatctgatatgattactgaaccatctacaaacctagaaaaggtaagaggaataatatcaatccatgtggggtcagataaatatcaacagcattcaggaatatatagggcaattattttgacaaaaaaaattgcatgatattctaaccacagatataaaccatgtttcctatatatattgctgatgtacagaaaaatagaattagaatgggcatggctacccacatcgggcaattataggagtcatattttgttttgtattgtgccaccgaataagatagcgagaaatcagatcaagaatggaaccattggaacctccgacagtacaagcccttgttcgcttggttctggaccagcctttcttctcacttgataacagatcatctagctctcttttatagtatagtcaaagtctatctgggcacggaagctaagccggcaaagaaaaaggcttaataagatgagtggggaagaaaaagtatcctctttcaggataagggctggaggaagcagggactgaaccagggcttgttgacagagcagatatcaaaagcctatgttatctcattttcagggactgagcaagggatgagcgccctctgatctaacgaccaaacaagcaatttacagagcaacctcagttaatttgacaagtttttgcatatgtaaaattgtgaagcacgtacccctgataaaaccaagatgctcctccgttcagtgatatgtccaagctcttcatattacagccacattctgtaacgaacagcttgagagacccattttgattcttcatccccatggaaatcccaacatccattccatcaaccttagcgaaaaggaatcatgaatacatcttgtaccttcgtatatatacatgtcaagggtgtctagtactcaaataatacaggtaaataaggtgtaagtgccataggtgacattgtttcggtgtaaactttcaaaaacacaactgagacgtttttactttttaaaaaagaagcagcttataattccaacaaattaactgaggagcatataggatatctatgttattgaaatgttgcttgcctgctgcaatgctgctatttaggtgcttagaattgtaaactccattgagctaaaatgatctagagaaaaagttaagatcatcttgaagtaaatcctaagcacaaatgccagctgctcctaataggcagcccacatgtcaccccaatatgcaccgtgcaacaagtaaccagctattgtgcctatcaatgtaaattactcatgtaccaactaaagaactagatttgaaagtgtcttcaaagctactcaatttcataacgtgctggattctactttacatacatgtttcattccatacatgccaataagcgcaaattcagacactaaaccactaattttgaacattaacttgtcaatcatggaagtccccctccaatctagcatcatctctcgaactgtgaaaaaaacaacaacaattgaacgcatgaataccgcgacccatacctgaatcgaggcattaccgctgtcagagatcgtgacgacccaggcgctataggagtagctccaccccatagtaagattaacgctggacagcgacgcggccaccacgatcccgtcgtccccgacggcgacggtggagtcgtcgaccgccacgccgtggaggacgatgccggaggcgaccatgtccacggtgccgatgaccgggatgctcacggacctctcgatgtcgggcacctccaggggcacgatggcctccgcggcgcgggacacgaggaggtccttgacgaagtcgaggcccgactgggagatgacggcggagatgtgcggcgacgcggaggcggcggagaggaaggtgaggaggaggaggaggagggggagggtggggagaggggcggcggctgccgccatggcgacgccggcgccggcgaggcgagagaggctagggattggggaggaggaggtggaggcggtggccggagtgggagtggcgtgagggagaaggcggcggcatgggcgccgccgtcgggtagtcgcggcgggtttgaacggtcgtcttccccggggagtggccgtggtgacgtggcagagacgtggctaggcggggaacagcggcggtaaatgcctgtccatgggctcatgccgcgtatatcctcttgaaaaataggaattcaatatttcatgattgaggctgtgtttagatgcagggtgtaaatttttagtgtgtcatattggatatatgaacacatatttaaagtactagcaaaagtgtccgtacgttgcaccgggtgattacggagtgtgtatattaaccaaaagtgttgtttggtttagcaaaagtgcccgtgcgttgcaacgggaagcgtacatatcagaaaaatatgcaattaattaaaatacaaattcgctgaaatatttgatatttttaagtaggtatatgtgtataattaaataaatttacaagtaaagtaagtgtgagaaataactataattgtaatgcttctgaaaaaatgagcactaaacatgaacttattctctctttttttcggcccgagggacctaaaatagacttattttcggcccttaccggtcggcccacggccttttgcgcacgcgtgggctcacttcccctccccaagccgcaacctgggcttgagccagaaaagtggcctcactctcgatccctcttgggccgatttcggcccggatgacaccggccgtccgatttctagggttttgatcggacggccgagcgtcgatatcggggaaacaaaaccccctccctctcagccgccaaaaccctagcccatttccctcccctccctcccatttcacttcgccgccctccctccgtgcccccgagcgaggaaggcacccctccccccgtgagcggaggcggtccgcggcggcgccctccctcccgagcagagggggcgccctccccccgcgagcggcgatggcgtctcccccaccactggcggcgcggcaacgtcctcccccaccaccggcagcgcggtggcgttctccccaccaccggcggctcccggggaggtgatcctctcagtcaaagccacggcggcgcccctcctcctctccctctcgggtcggcggtggcgggttggtggcggccgcgacagatccgagggtgggggcggcggctccctccaccccctctagcctccctcccgcggcagatccggtggcggctgcggctcccttctcccctctcgcctccctcctgccccagatccagcggcgatggcggtgtcgatggcgtcggcgggtgagtccgtcggcggtggcggcggctccctcctcccctctcgcctccctcccgccctagatccggcagcgatggatccggcggtagtggcggcgtcagcggcggcgcgcccaccccccacagcggcgtcggcggcaccctcccccaccaccggcggcggatctagcgggaggagaggtgccccgcgagcggcggcgatggcgccccttctcccgcgagcagcggcggcggcggagtcctctcccaccaccgacgacggcggcggccctctcccctaccaccggagagcgccctccgccgccaccgccggcggatctaacgggagggaccggcggtggcggcgctctcccctccaccggatctagcaggagggaagccgccggcggccagccgtctctgcgacggcaatggcgacggcggtggtgacccccttgatctaatttttggttttggtttggatatatatgtgtacatgcatcatgatttgtgtgattgaactccgattgtgattgttatttttttccggggtttgattggattcggattgggattttgggggagggggggcgacgaagcgggacgaaaaaccagtgtgacgaccggaaaaattcgaatatttatattagttatagattaaacatagactaataataaaataaattacagatttagcctgtaaactgcaagacaaatttattaagcctaattaatccgtcattagcaaatgtttactgtagcaccacattgtcagattatggagcaattaggcttaaaagattcgtctcgcaattttatacgcaatctgtgtaattagtttttttcgtttatatttaatactccgtgcatgtgtttaaatatttgatgtgacatggcgaaaaattttgctagaggatctaaactttttcgtttatatttaatactccgtgtatgtgttcaaacatttgattgctaaggtgatttttgaaactcatacagattaagacgaagcttaagtgtttatacaaaacgagattgtattaacgtataattaattgagtttaattaagtattacaaatttaaaaaatatatttatctgatattttagaataactttcatataaaattttttttacacaaaacataccgtttagtagtttgaaaagcatgtcatgaatatccaaattttcatccaaccattccaaagcttacttcaaaatatggatcttttgaccacgccattccatccaacgtggcaatataacatcgacacgtcaccacaacgggcgtgatagttttatcttatcacgttagtcagggtgacgaggccaaataacattgtcacatccgttaggccggcgtgaccaaataacgatggaacattaggcagaccggcatgacagtatgcgtagctaaaagattcaaatttttaaaataagttttttcaattgtttttttaattaaaaataaaaaggttcaagacataacaaaaaaatccacgctcaggcctcacgcagtaatgccgtggtacgtgcactgacttggcattctagagcacagcgtggcatgcgctatccccgttcaaataccccaatgggtaaatccggtccgtccacgtgtaaaccggctcgggtcgggctcgccaaaccatcgacagaagcgaagccgggtccaaccccaccactcgcccagttgtccgcgcacccctctgacgtggtcactgacaggtgggcccgagagcggtggggtccacatgtcagtcaccacgttcctccgccttcgccgtcagctttccccttcccgaagcttcgccaatctcccctcctctctctctctctctctcctccccgcggtcgccgacgacctcgccaccgaccccgccgccggacgcgaggaagagacggggggagccccggaggcaggagcggcgggaggggatggcgatgcagacggggttcgccacctccaaggtcctcatcctcgtcggcgcaggtctcgtcaccgcaacctccccctcctcctcctcctcctcctcctcccgctctactatattttctagcatcgattcgagatgcggatcgccccgctgtgttctgatcctgatgcggtggtttttggccggcgtcgagctgcagggttgacgagctcgatcgtgctgcggaatggccggctatctgacgtgttggcggagcttcaggtcggtggattgcctgatgtttcttgagtagagtagttggattctgggcatctaattctgttgattgcttcgcgttatcgatcgtaagttgccaatacgctaatataggcgcgtcagtgttgcccgtgtgtgtttcaagcgatgttgtgatttatatatctgtttgtgggactccaatttatcaaatgcattacagctacatttcaccgatcaaacgttgggcgtgcacatgggcataactttttgtcgcttaatttcaatgtcgaatcatttcgatgcaccaattggaatgtcatgcctaagttaatcacccaatggctatgatgatgcgttcttcatctataatttgtagtaactcataaaatcgcagatgtttattgaagtagatggttttttccctgtttttaggagcttatgaaaggtgtaaaccaaggagaaggttcgagtgcctatgacatcgcccttcttcaatctcaggtatgcatcgtttcatatttttcatagaatcaacagttgaatggaagttacaatgcagacttcaatttcaataaagttgccagtttcagtaaaaaccactgcagtttgttgtttttattatttgtgtgctggcgcttgactgcagattcgaaatttagcacaagaagttagagatttgactatatcaaggcctattaccatattgagtggcaactccgactctggaggtttgttcttgtttgatcctctcctcgttctgttttcagtttcactcttctagcagtcatgcaaagagtctatccatataaagcttttgttacatctttttacttagattatttgtcaatcttaaggtttagatagacaattattggcttgtatcagctcctctacaaggctaccaccccttggtgaaaaagtggtcaatagtcatatttttgctaaaactcgttaaagagtgtcaatctctattctctaattcaatattgagtaattcatgaagctgaaatgcttcagcgattacagtatgaatcatgttgattggtcaataatagcaatgtaatgacaaatgggataggaatgctggtacattcagctgtttctcacaacattcatgaacatatctcactagctacttgtccccatgtgacatgtatctttttcttatccgtgttgtttattcactagcatttgcatcccttttgcaggcagtttatcctcctacatactgcctgcagctgcagttggagcaatgggttactgctatatgtggtggaaggtaaaatcaggaatatacaatgccactttgatctatcagcttttatattctgatttttcttccttgctttctttctccacaaacactccttactatccttttccttttattatacttacagccttcaataaattagtaactgaatgaagagagtaatatgatgttccccatttgcttgtttaccttgtttcttgtagttatatgtcttaagaactatgctacctaagtctccctgtaaagtatttccatgcagtcccagtggttctatgtggatccaagtatccaactttgatatataattggcatttggcacccttgtatgtattttgagacatcatgaataaaccacattcttttttttttgggcgggggattaaattgctttcttagtcatgtaataacacctctctgattctgtgaccaaatattctatcaagaatcacagtttcgggttgagagactcttttcatgatccctaggccctagtatttaagtaaaaccatcaaatctgtcttgtcctaatggtgtttgtagactaaattactagtacaatgatgaactgtatgtgttaaacttttcttacattatagtatcttcctgcagggattgtccttatcggatgtcatgtttgttaccaaacgcaacatgaccaaagctgttgagagtatgtcgaagcaattggatcaagtgtcttcagctttagctgtatgctttacatgctgaatcgttacatatttgaagtagttttccttcgcatatgctgactagtgttttctaaattcaattaatttcaggcaacaaaaaggcatctaagtcagcgcctggaaaatttagatgggaaaatggatgagcaagtggaggtctccaaaattattagaaacgaggtttgttgatttgtgatgctgctagcccttcaactttttacacatggaaatttttgaagttcctttttttttttctctggagcaataattattgtttcatttttttcattacatcaagtctaattagcatctgataactttattattaaattgtgtttctacctgaggtgcataactcttattagtttgatttgtgtagtcgcatctgaaaaggtggatcaggattttctttgtcatgccaatattgtttcaagctaaaaactgtgccctcgataaagccaggaagcacttgacatggctattataggatatgcattgaaatatggtggaattgttggcttttactataatcattgacagcatattccaagtgatcgatcttgcccataaaccataaaacaacatcatgaagccaagaatatatacaagcgcaagcataagcataatgatatttgtcatcaatgaatggtctttagttgcattaaaatataccttcttaaaaatagctactgtaaatctgcaagtactcatctatggaaagataaattttacagcatttttcattttcttctcgaaagcagaaaagttttgttcttcccaatgttatgcaaaagacatgattctgttctctatgcacaggtgaatgatgtcaaagatgatctgtctcaaattggatttgatattgcagcaatccaacagatggttgctggattggtgagttttattagtttataacccttgagcatgaacctgtgcagaacacttctttggttatcctgacctttatgttctcctttgacattatcagaaagggaagatcgagttgcttgataataaacaggtggctaaacatacccatcaatatttaacgtgctgattttttccttttgcctaacctcttgtgtttaccgacaggatgcaactaatgctggtgtatggtacctctgccaaatagctggaggtctaaaagatggaataaatgccaagttttttcaggtgagtagatatcatttataaaggttcaggattgcatgcaaggtctaaggatgccttatcttggatagttcgcttttcttttggctcatactgctcattgtgctgtaatgatccttctatgctctccattccacaggaagctaatgaaaaactcaagctcacagagttggctcagtctgaaagaaaggcagtgaaggtaatacacaattaatatgcagatgtttgtcctccattcaggtaatttcggtttctttatgccaatccatatctgtgttgtgcacattttaggggcttgaatctgttctggagagcagaaaggaacaaaaggcaatcgactccaaacaaaataccaccgcgataattgacgccgaaaagcccgtgaaaacggtcgatgggcctgtgaaaagcggcgcggtgcacaggtgtagcagaatctcatttcggaaggaaggcctcgctttgtgatcaaagcaaagcgatcgtaaccagcccgctctcgcgatgtacattgtctgcctgattgttttgttcgattaaaaaaaatataaaataaaacctgtacctggagttattttgagtaggcaggttgatgcactattctgattcaaaagtgtatgtggttcaatccacgtacgctctttttcttggattttgattcatgtgatctcatttatttttatttggtgtgaatgtttgtacacagttggttcgaaacattccttgtgccattgtgagagttcccttcggcctgcatgcccttgtcccatatgtccatatcaccctgtgaatgatgccctctccttctagtccagatttgcaagcagtctggaactctggatgatcggattttacttgcagacaggcacagggccacggtagtccctgtcctggataaattctgctctgttcgtgtacaacattttcttgtttgctgcacaaagtgtaagccgtgaagcataaacaggattacatgcactagttacgtacacggtgaaaaacatggtcctcactcctcaatgccgtatgccgtatgcccgtatacaccaattactacacatgtacagcaaatcataggtactcacgaatcacaagctggtgacaatcagcacggaagaagaggatcttctcgcctccctggaatgagatccgtacccctttactagccaggacgcgataagatgggagtattatgttcctttggatgtcagatttgtcggttccgtttgcctgtcgatcgtacgtacgacaggtgaaaaaaagaatcagatcttccgtttttttacagtcgtcaagcagctgcttcttgggttgcattctgtcacggtgtcaccgttgtgccgattcgagtaaaaaccctgtgtcctttgatatggaaagccaaggcgatctagcatgggccatgccctcatcaaaccggatacgtatacgcctccagagacgcacactgtacgttgctgtactaactgtactggtgtacgtgtacctagcgcattactcacactatccaaaaaaaaaaatcaatgttaaagaggcgtgactcctctaccataaatttaaatagatgaagagatttgttgtattagaagggatcacatttctcttctaagtttagttttttttaataaagtaagccatagccaacgtttaaatttaaattattctatgtgtttttattgtcttctttagtctttgcctttaaatcctcaacagcatgtacaagtctaaaaataaaacctaacttttattccattgtcacgcttttttacgggttattgaccggagcgaaataatggcgtacatcttcttctctttcttcttttttctttgttttttttttcaaaaaatggtgagtagctagctagttgttagggtgatcacctttcttcttcgccgtcggtcgctaatataaaaggtggttggctgattatgagacagtcaagattaacaaggcatgataagatacagactcttaatagaggtatggccatttcagtttattcttaattgatgtttgagatatcgatgaagatgaacatattaggtgtactaactcatgatcaacgctgcacactgacagtctgacaaaagcacggatccctatcagtcccaaattaacatggccacgcatggatcatcaaaccaaggagatcttacgcctacagatgcaggcagaaagtcaatgtgttgcgcgaagcaagccgcagatttttgaaacaacagtgctaagctataattaacgaggcccatctgacacagaacaccacgagatactagaataatacatgatggattaagaaataatgaagcagctgagatgcatacaaccgaagtattcaagggctagctagctatctgaacgatccaaacactgttaatatttcattttgtgtatgtgttttttttactgatatcataggagtatctatcctaaaagctagcgtcaaagctaccaaccattcaagtctcggacaccaattctcatgacatatatctcggtgccaacaaagtcaaaaccagcagctcaacaacacagggggcacataggattagatagcttgattaaagaaatcaatggtgacgattatagtagtaatagtatagtatgatagtatgatgctgtgtaaagctagctaattagctaaaccatatcaagttggagtaacgatccatctttgttgctgggagtagctaatttcgctgtgccgcacgcatgctcgggaaaaagaacggatcccgaggccactgaattccggacggtttggtcaaatgcctctttggttgggcctgaaggtttcctaccaatgccaaagcgtgcagccattggccatgggagtattggattatggccgtgtttagatttcaatttttttctttaaacttttaacatttttgtcattagacacatgcatggagcattaaatgtagataaaaaacaattgtatagtttgcatataaatcgtgttataaatcttttaagcctaattacgtcatgatttgataatgtgatgcacagtaaatatttactaatgacggattaattaggcttaataaattcgtctcgcagttgacagacggaatctgtaatttgttttgttattagtatacgtttaatacttcatgtgtgtatctgtatacttaaaaaaattttgacacacgaactaaacacagcctatattgcttcataatgacaccatcattatatatactgatatgtgtgataataggaggtagtgacccacataccaatgactgtaatgatgctgatgttatgatagatgatcctcacccgtattggacataagagcaagtttaatagtatagttaactactagctccaattcatctatagccaatctaatagctcattcacacaatagttacatactacactattaatacctggtcccatctgtcatacacactgcgtcttggagtccgtgctacaactagctacaaatctgtagcccgcttctcttctctcatctcatttatcttcttaaaatatatttgcagctggtttatagtctgctattatacctgctctaagcttcacggtcacagtaaaaaagaagtttcttattggtctatagaggctctttgaaacaaacacaagtatgttaaaaacgcataagaaagggataaatgtacgagtagaacgccatttccaacttgatctataggactccaacacgcataaataatatttggagctatatatatggagcacatgattttctttagaattagtttattttcaatagtaaggaaaaattcgtaagagcagagagagtgagagagtgcattggggttatgatatgaaaaattccgtacggaatggaggtatataaaataaacttttaggattttgtcaatcatattctctcgtgcaaaaggacgatctgaaaattgaaaaaaaaagaatgaccttatagaaaaaaatcccaaggattgaaatcgtccaaattaaatttctgaaattcaaaggagacctaaaattgtatacatggctctaaaagcatgtcctaaatataaaatttggtagtactatttaagaatttgcatgcttcatttggaaggaaattaggttttctttagggttcctttggagcgtatgaattcaaaaatacagaaacaggaaaaatgtaggaagacgtggcatactagctagttgatccataggagttttagaatgcagaaattgtgtgtaacttgttgttggatgctccatagaaaaagtataggattttgggagagagatagacctgagaaaagttctcatgagatccaaccctcatgttaagggccacattgagggctccttcggattgtaggaattttgtaggaaatatggatgatttcaatttgtattgtatttggcactattcgcttgtttggaatgaaggatttgggcataggaaaggtagagggaaattttcctttgctagagattccatatgaattcgaacatctaccaagccctatttttttgttttcatttattagctaagtccaagctaaataaaataatgaaagctctaaagaaccataatttgaggataaattgaccaacgacattatgattcttgtgttttactaagttctatttgttctaaacaatctatcttactccctccgtactcgtaaaggaagtcatttaggacaatgtttaaatcaaaccataggaatataaatcatgaataactctcaagttgttgagtttgaaaatataaaaattatatgaatagatttgtcttgaaaaatactttcataaaagtatacatatatcacttttcaataaatatttttatagaaacaagaagttaaagttgtattttggagaccgtgtcgctgtccaaaacaacttcttttacgagtacggagggagtatatttttcctacatttttcatctatgttttatatttatacatgcaatcctatactccctccgtcctaaaaagaggggtttataggttttagatttgtcccaaagagtgtctttttagttgtgggtccactagacctcttaataccatttcatcctttttatttatattctgactttctataacaacagtcttattggatgaagttttttttcttatttctgtgttttaaaggagccataaatatatgatttatgaaggatggcaatgacccctgcatgtacaaagcaccgtaccgacactagagctagggcatccctttcaaatttcaattcggagctttttctctcatgtcattatcatgaattcgttgattgccaaagagttagattctgttcacggtacaatataccacgtgggataaggctccaaatgctcacaggctcacagcaagatatatggtttttaccccctaactatgattagatcaagtgatgctattttggtgtagccttgagattaaattgtaatcctggtgtagagaccaaaagtagttatataccttcaatccttcattattagaaaaaaaatgcaactaaattgaatatatacgcgtattcgtacaatgtattactcgagtatgcagttaaagaaaccactctaatggaaaggattcagaaaattttggagagcaggcaacattcagcaagcagtacagaagaacacagcagaattgtgtccaggcctaggcgcctagatactcatgcactagaatgaatatataatcaaaatcaacaagtaccattaggttggaacttggaaagaaaaagaattgcatcaaaagggtgcaataatagaaagtacgatacaaatatataattacactcgagaattgtagtagcattcgtcaactaccaccaaatcatgaacttctcccaactgaacatcaatggtacgtggtaccggggtgcaatagtcaagagcgaaggctgcacgctaaaggcacctcaaaaatccaatgacaaaaaagaaagcaaagacagattggaacacaagtaccagaatatatggcagtactaccacatatttttgctacattaatggttctttcaaggacaattgatccatgaaccatgatgaatctaaatgcagcaccgcaaaatctgaccggaactgtccatgatctctgtaaattatctccttctctgtgcgttaattaattaactttctgtcagacgaacatactagcactctgagtgcttaccgacaccgaaaagaaacagtagtagtgactgtgcaaaagcagggattcgaacaacaacaacaacaacaacaaacacagatgatgagatgaattggacatacattaattcttccaatagctacgtattggttagagagagagagagagatctgaaaatgcataacaatctagaaggaaggaatcaatgcagatatacagtgtgactgtcgtcttagcatgatcttcattgaccatctgtagcagaaactactactagttaacttgcctagctaaaaaaaccgaagtaattaatcaacctcaagagttaattaacaacagagaaaacacatgaataatgcaaccgtttcttttttcttccatggagaggaaagctaaaggaaaggtagtacttggaacagcagagaaaatgcctggctttcccttgtatgccgcattgcagcgccggccgtcgaccgaaaacccaccaccaccatcaccatcaccaaaactcccctccatatttcttcgcctatatatcgatcctccctatatcctatcttggattcagctcaccggccggccatcccagtgtcgccggcgactcctgcgatcccaacgatggcattgggccgttgctgctgctgctgctgctcctcctccacaccctcctcatccttgctcatgagagtagcgaggccgtggaagaagaagaatggtctctctctctctctctctcgttttctctgcgattttatgattgctgctgctgctgcattggaataatactcggctttcagtgggttataaagaggggggagaaaaaaccgggcgcgagcgatcgaggtcagcagcagctgcacgggggcatgtcctcgcgcgtgccagcggcgtcgggatccggaccgcgcatcaatgcgtgcgaacgaacgaacgaacgcacgaacgaatgcgtgcgcagcgtgcgtggttgtcaaacggaggccaacagccacgttaaatatcgtagcgtgacaggcaggggcagggcaggggcaggggcaggggtggattattcgcggaatgcgcgtacgtcgtacaccgatcgataggttcgtacgcgcggggcgcatttggtagagatggatcgatcgatccgtcggtgggatgagaagattacgtttgtttgccacatgagttggggagtacgagtacgagtaccgtggaggtattatgtactgggtaccgacgctttgatttcgctgcggggggattaaagagccgggtttacatggggccacgttaataaagagagagggcgaggaggaggggaaaaaaaaacgccttgtcagagaatgaactcctccaccagtgaaccgtgaggtcccctttgtgagttcggctggaggcagcgggtgagatttgagggcttggtgagcggagctgtgtgatcttgatggggttaggcccctccaagacgatgagacaaaaaatatttatacaggttcgggccgctatgaagcgtaataccctactcctgtgcatgattgattgaatgtagaacaccagtgcttggggttgcgagacccaagcgccagttcgctcggaagtccccccctccaccactaggcctggacctccttttatacatcaaggggttaccacatgggtctaacaacctaacctagctccggtggagaagtattataatatttgcattaaatgcatgtcttgtctcttgacttgggaagctaagcacacgtcatcttgatgatggagcctgttaaatcttgccgcctgacacgggggtgcccctgtcagtcaccatttaatgggtgaagacttctgagctcctattacaccgggaaacgggagccttgcattgaccagagcgggaggaccgactccggctgggataagaggatgagaacctctcaccatcattatttgatgggatatgtcgggctgcacgtcgcctgacacacgcgatggtgcgcctgacatcttgggtcccatcattcattcgatcggtcacagaccggttgagtgcactgcataccgcattaaatgcggcgtggcgcgaccgcttgggatgccataaatgcgggtaggtgggcacctggaggcagacacctaacccaccgtacgtggtgacctagagagggggtcgggggagcccgaccctgttaacagtgaaatttggtaagcccggagtagtcatcggcttagagtcagcatcggcttcgaagtcctgagattagccgatgagagttgtcaagtcgtcagttgtcggattcttgctatattcggttaaggaaattgatctactaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 27023 - DNA, 595 bp, Oryza sativa
agcatgatcttcattgacccatcctgtagcagaaactactagtagttaacttgcctagctaaaaaaaccgaagtaattaatcaacctcaagagttaattaacggcagagaagacacatgaataatgcacccgtttcttttttcttccatggagaggaaagctaaagaaaggtagtacttggaacagcagagaaaatgcctggctttcccttgtatgccgcattgcagcgccggccgtcgaccgaaaaccaccaccaccatcaccatcaccaaaactcccctccatatttcttcgcctatatatcgatcctccctatatcctatcttggattcagctcaccggccggccatcccagtgtcgccggcgactcctgcgatcccaacgatggcattgggccgttgctgctgctgctgctgctcctcctccacaccctcctcatccttgctcatgagagtagcgaggccgtggaagaagaagaatggtctctctctctctctctctcgttttctctgcgattttatgattgctgctgctgctgcattggaacctaaaatcgcagagaaaacgagagagagagagagagagagggctgcag

SEQ ID NO: 27024 - DNA, 325 bp, Oryza sativa
aggacctaaaatagacttattttcggcccttaccggtcggcccacggccttttgcgcacgcgtgggctcacttcccctccccaagccgcaacctgggcttgagccagaaaagtggcctcactctcgatccctcttgggccgatttcggcccggatgacaccggccgtccgatttctagggttttgatcggacggccgagcgtcgatatcggggaaacaaaaccccctccctctcagccgccaaaaccctagcccatttccctcccctccctcccatttcacttcgccgccctcccctccgtgcccccgagcggtggcggcacccc

SEQ ID NO: 27025 - DNA, 781 bp, Oryza sativa
tgtgtgtatgcagatcctactccttggaacagttgagttaatgtgcacttttgaggcgtgtctttcatacaaagtcatttatgcgagtctacttagggtgtgttcggatgcccccttttcctaaccctctttcttgttttccacgcgcacgttttttaaactgctaaacggtgtgttttgtgcaaaaagtttctataagaaagttgtttaaaaaaattaaattaatccatttttgaaaaaaagctaatacttaattaatcacgcgctaatggatcactccgttttccgtgcgttactgttccggttgggatctggagatagcgaacacagccttaggccattcccaacccaatgactaggatgatgtccatagcattaaataagctgtcacgtaggatgaaagatgatatggaaagtgcataaatgaggatagaggagaaaccaggtcttgcatgagacatggtttctacacaacattcaagatatcatgtgagataagtagtatttaatttaagtatgaaaaagtggtgtttgtattgtaagagtagtgtctaatactaatttcttgatgatgtggagtttatgaaaattatgtctaatgtcttgggttgggactggccttatcatgctctataaatcttttcctctcatctctcttcttttaaaattttgcaacacggctaggcttttgagcatgatatgcctcttgtgtttctctggcagtactctttgttattaggtgtgcatactactagcgcaggctgtgcagtgggattagccg

SEQ ID NO: 27026 - DNA, 7136 bp, Oryza sativa
  unsure (1)..(7136): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaacgatactccctccgttccataatataagacacaaccacttttcttagatgttacataataaaaggcatgcatgcaagcatgcaattaactatagcatcttctccattaaattattacttttttaaatcctccactctcatgttatctaattctattggatacatgcattatatttattaggatgatccaaactacaagatgataataattatttcttagtctttggattaagagtggttgtgccttatattttggaatggagggagtaatatatattttttttaaaaaaatgaactttcttcatcaacatttcttatatacatgtatatgtatttacaggtatatgtatatacatgtatatgtatatatatactttttttaaaaaaaatcaacttatcaactttctgatatttaaatatttatttgtgttctcaaataattataatccaaagctatttttaatttttttaggactcaacaaagaaatatacagcttgagacaagtcaaatatgttccccgcaaaaaaaaagacaagtcaaatatgtatgtctaaattatatcttgaattgctaaagctgttattgccttttgactagatggttttctattttgcttcaagaaaatggctgcctgttgagaggcaactttacttgctcatggcgaacacaatacacttcagaatttaaaaaatgtagaaattaacattagccttatgaggtattttatggtccttaaaggaagataccaagagatgccacacttatttgtgttaagctatggtgcttcttggtatgtcaaacactagaagacacactaccgtaaatctaacaataaaatcacagaaagattcataaaatagctctgtaacttgtaaagcaaacataaaactttcgaaccatccaccacactgcaatacagagagccctgaatccacatggttaattcaaagatttttcccatcaaactattgcataacacggtcatgatctgcattttgcaactccatgatgttcaggcaaatatgatgcaatctaactcaacttctaaactgaaatcttacattaccaagacttctctaatctctcctgaaaaaagggaaaaccacctatcttagcatcacaagctagcagggttaacagtcgataaagaacaaaatgaatgtgaaccttacaagttacaacaacacatctggaccggccaaaagatttgaggcagctttaaccatcgatctcctcatccagaggagagaaccatttggtaccagactaatcatccagtaaaaggcatactgttttttacacaatagcccatacaacgaaccactcaagctcgacggcatgcctaggggcatagccgtgtaggagctccttgaccttgatgaaagcggtgaggtcgaaccatatttgctaatggctcggttttgcacgtttcatgccaccattgctgaaaggggagacgcttcctggatgaggactgtcctctctcagagtagagttcagcattgccagttccctcagctgttgtcttttatagtaatcttgcgactcatcctgcaaagacgaacaaaagaggtcagctatgaacggcggtcatagctgtaagcaacctacagaacatggttcacagaaaaacactgcaggaataactatcatagaatgacaacttagggaaagaataagtgagggggagaagaaacattgtatatgaaataaaaataaattactactcaagaagagctgttggaaaatatctcaaataaatagcaaagctacaatgtgagacaacatgagaaaggctagttctgtggcatcatatgcataagcttcgaaacacaaacaaaaaaatggtccaggggtatgaaacggaaagcagccaagtctgtaggttagcaggattcgggctggcacccaaaacttaaacccttgccttctcatcacctttgggcccttcatcataaacttaacattgcagatccactgcaatttgggacgatgagtaccacagtgccagatgtatagacataccgcatccacttaacaatgatttgcagcaacaaaatattcattatggacaacaatgaagcatggaatggaagtaatgacttgggatttatggaagaaactttgttttgtacttaattttaattttatgatttgatacaacatgattcatttctgtgctttcttggcaagtaccaaagacctatttctttctctctttttgtggggaaacagacattttcccgcatagatcactgctcattttcccaggaaaataaccaaacatgcccttagctgaggaaagctgcaggtctgactagtactcttttggccctcaagttgcatctgttttgttactatggtgaatgttatattcctgaaagggtagatttactaagtttgtactgcaacactctagatatagtattggcagtagactaagtttacaatttagatcatcattgaatatcttaagggtcattaactccaattaatattactggatatcagttttatttcattatatatggccctcttgatgcccacagggtcacatgcagaaccacaatcagagaaaggaaactattcctgtcctagcgactagcgctgaggactgtctccagcctagatctgcacccataccacactaaccagttgcaacaatgaggacatcaggaccaatgaaaagtgctgccactgggctgcgaatgagagggagaggtgaagttaccatgacttgtatggggtggtacctctaaattttatgtcaacaaaaccacagagatgcaaatagctgtaactactccaataagcatggagatgtaaaattccttttcagttcagtcatgcaaaaaaaaaaaagataaaaaaacataaccggtgaaaagtttgtgccattagcctgtatggtagactttatggtagcacatttctaaattctaaattgtgaagtggtattatccaaatttcagaataaattaatacataaagtcatataaattaataccactggttttagcagttcatccattatttcttgtgcctgcctcaatcttgtatcaatgatattggctggcaactcagcttcaatcaagatatgcagtggatcattgaggtgctcatagccaggttttcctttcagcttctcctcctataaaatagaaaacaaagatgtgtaactgtgtatatttggaggatatatgaggggaaaaaatatggacaaggagcaatctggaatctttcagcaatcaagattaatatatgagacagagtactatcacattattgatgtaacatgttaatgggtttaaggggcaagacagattcccagaagacaagatagaaacccatatgggaatatagtagtacaaaatactaacatatgttctacaaagatgcaataaaactcaccaccatatatcatgaacccaaaaaataaatagaaaattgaaatactagaacaatacatttgtccaatacatgtaagcaaatacgttactcaatgttactaacttattattgttacaaggtttatatggtaagcaaactgatgagcaggcaatataaaatctgccttgaggcacacaatactccataaaaacaattttttaaacagttctttttgtgtgtttcccatgtttcttcgtgtttcagatcaatttaggacgaagtttgaagaccagaattcagaaatactatagaccatggcagaaatggtcacaccaataatggatagttaggatttactaatcagggaagagtacaatgaaggatttccaagatttctacaaaggatattaaattaaacataacaaagaagtttatcatcctagctagctgtaatacttagttttaatttatataacgcatgttatatgagtatataaatgtaaagtaattaacatttacaaacgtttgttaccttatcagcatctttgatagaacccttccctctaatgaaaacacgacaaccagttgatgcttcaacccgctttagagaattacccctcggtcctagaatacgtcccacgaaattgaactggagcaaagcgaaaatagcagacattaaaaacaagacattttatctgctggatgataaatcgcataagaggaacacatacattagggtaagcatcaactggaacctccatgcgtacaatcttcttgacaatataagagccatgacttggcggtgcgccttgccagtccatacttgtcccaggaggaggaggaggaggaaagcctaatctctgtcatataaacaaatcttattagtattgctcacaaagacacaacctaatgtacgccagccaaagaacataagaatcaatggtacagagttttgatgaccttctatatacaattgaagaaaatttcttcagaatcagaagttgaaaacaatgagtaaatgtatagacaagaagattcttgtagtaattaaaagcttgttttccttttgcacttttcagtaattaattcattatacatacctcttggtgtatgccattccaaggcccaaatccattgccatgtaggttgggtctcataattggcgaagacatgggactcggacttctataacgacgcctgtcaaaatcgttgaatccatggtcgttgaccatgcttgatacccgcatgatttctaaacaacacaaagattggaaaaggaggaataaataaggttattacttagaagtaggagtttatacttttttggaatgcaagagttagatgatagctatgatcaaatcataacttccctatgagaagcatttaaggtagaagtgaaatcaagaagcacatcaagataaatagatattacatggtgcaaatatatgctacaattagaagcaggtttgaatccatagcataattcataacaacaaatatattacttacatatttcagtttgaattctcgaaaatggtcagttaaagggttaaaccaggaaagagtgtccttatcgatagttatccaacccatttacttgggttgaaccgtggagtgggttttagataaacagagagacatgctctcagtatatgacaaaaaaaggatgtatttatttgtggatacttgctctattttccagcctatagtaaacataaattaaatgcccgccttgctcatctataaaagaaaaattgcaaatctaaattacatgtagtaaatccatgaaaacaggccgtagaccactttataaacactaaaaggtgcagtgagaaattgaggcaaaaaatttgacttcccactaatgcagctaaaaatagaacctgatcaaatgcagtctgaagctattcactaaaaataaaggcaacatactcaacatccgaagttcccagcccacaagaagaatgcaaatttctccaatatgagctaactattcatgcaattcttacacattcaaaacatcttcatatattaaattcaacagtttcttttatcaagtaagcctatcaacagcacacggtgaagcgcaaaaatttgctgatgcattcacgcccactgttctagaagagaggcagccacctatagctcacttaggtgcccaccttgcctgcctgggtagcgacatagcagccaggacatcttgttggctacttgctgctagccgcacctaacagatcagtaatcatcctgtatccacaatgcgcataccattgtctgctgctgatgcaatggacaaatgattgcaactctacacataaatcttgacaactactagttctcatcaccactttatttttcatcattgatcttcagttctcaacaagtctcaatacatcgaaacatctacattatttgaaggcaaaaattcaatggcaatcaccaaaacagcgcaacaagccttgattcgcatgctgtattataccattacactcggtcatctctgttgtgttgtgcatataacccccaaaatattctaacaatctcatctcgattggcaacgaaaaattcccgagaaagaacaagagggcaactcggcaactctatccaaacataagctgcaggcaaaatcagcagcatcattccacgcattggagccacccgattcccaaatcccgattgcaaaactaacaccacaaatcccccctcttcctcacacgaaacaaacacaacccccaccaatccgtgacaaacagtaagcgagagatcaatcaatcaatcaatcaaaaaaaagaaaagatctcaccttggttgagcagccggctgcatatcggcagcacctgcatgaaaggccccagcttgtgatgctccgcgagcagctcgctcaagtactggctgcaaaaagaaacaaaacccaagaaatcgcacaaccaatcacctaaacaaatcgaaaaaagggcacgcaaccaagagcaagaagcaatccttggatcaaagaatcagcaagaaacacagtagcaatccacggcggcggcggaagcgggcgaggccgtacctatcggcctcggggttgctcctaatctggggcgagagggttcttgccggggagaaaccctggtggttgtagaggccgcctgacatggtggcggccacgagcgaggagaggaggaggaggagaagagaggagagggtttcttggtttcttttccttcctagcgaagaggttgatgatagagattagagagaggaaaaaaaatatgaagatggtggaaactggaaaggttttgatggttccaaaaagaattaaagaaaaactaaaaaggagaggtttttctgctttaggttacactacctgccaggttctgttggataaaggggaattgctggctgctcaggtgaaaattaaaaggagggcaggtgataggagaaaatcccttacctcacatcacctaa

SEQ ID NO: 27027 - DNA, 818 bp, Oryza sativa
tttgcataagtgtggagccacagcccagctaaccctggacagatgcctaggagtggtatagttgagtttgtctaggcctgaaaatatttttggctctatcattgttttgcatgaagaacaacaattgatagccactaagggcctctttgaatcgcaggattgaaaaaacagaggaataggaaaaacacgggattttggtaggaatgcatgtgtaaaacagatgattgcaaaacacaagaaaaatatagggacgaccgtttgattagaccgcaggaaaaatacaggaataagatgagagagatagacccaaggaaagttttccaagaagttagagtagatgttaactttcctacgtttttgctctagaattgtaggaatagggaagtttcctacgtttttccttttcttattcctacgaatcaaaggcatgaatagtgtaggatttcaattcctttgtttttcctctatttttcctccaattcaaaagggtcctaaatctttttgattcatactatctaggtctgttaagggcccctttgaatcgtaggattgaaaaaacggaggaataggaaaaacacaggattttggtaggaatgcaagtgtaaaaacagaggattgcaaaacacaggaaaaatataggaatgaccgtttgattagaccacaggaaaaatgcaggaattagatgagagagatagactctgggaaagttttccaagaggttagagtggatgttaaatttcctacgtttttgctctagaattgtaggaatagaaaagtttcctacatttttcattttctcattcctacgaatcaaaggc

SEQ ID NO: 27028 - DNA, 1044 bp, Oryza sativa
actcacagcggatccacactgcatgtgtacataaacatgaagacttcatgctgagatctgtatgattgtaggattggctccagggatcaatcttacgaatccaacagctgcacacacgacttgtgaatacgtcagttcctccggttccaaggttgcagcgcataaagtaaaataagccccatttgtttttggttttcatatgtaatttgagtttcattaatcacaactctatcaagagcaccccttttcagttgggttaatttgaaccgtgccattgcaaatatgtctattcagataaatgttattacaatttatctattcgtaatcgtgccacttaaattttcaaaatggaaccatgccatcgccgtcacgttttctatctttttttccccatcgacacgtggggcccacctgtcagattcatcttcttcagctccatcctcccatcttctctttttttcttcccactagttaagtgcccgtgcgttgcaacgggaaaaaaataatacatcaatttcaaattatagagtaaaattgtgctgaatagttattgagtgtttcttaataaaaagtagtaatgcaataaaatcctaattcagtctggggatatacgtattcagctgtatttacactcatgacatcaaatcaggtaactaatcgcaacaagtatatacatacagatggcattgtgtatttcgtaacatggcaagtgaatgcaagagaagtaattttgcgagtataggggacaaaaccaaacaatacagcataggaccacacgtccgcaattcaaacccagagcaataccataatgtttgcactgctaggatatgatagcgtcaacgattgattgagaacacgcacaagtatcttctgtcatgaggcacatattctctatgcctgcaatatattcaatataaaaatctaatgaaccacaatacataaagcatcaatatgtcctctagaatcacacaccacaggtgcaccacaagctagcttgtttggtcatattcatagcaggtgatattccaatgggagaggaatgga

SEQ ID NO: 27029 - DNA, 5814 bp, Oryza sativa
tcccgtataactattttctctatatgataatactatgtgtttgcttctaatatatactggagcataacatgtaatttgtgcaaagatgaaaacatcagtcacagcaaaatctttaaaaaagaagaagggaaaatagttgcataaaagagaagctttgaaatctggatcaagaaatgacattgtcccatgaactatttctcaaaaggacaaatccacattcttaaaagtattagtatttcttaattttctccacaagttcttcaacaacaaagacatttcatgggtcaattacagaaaatacagacctaaaaacaaaggatagagcctcttctttataagagagaagagggggaactttttggtggatattttagaacagtcgctatggttcaaggaaatagctaatcctcaagtgggtaatggacaatcaattctatggttggatgatacataagccaaaaaaattgaattgaattgcatatgagcacagaggtagccattcagggctcctggacccactaaattgatactttgctgaaaaaagggaacaaatcaatccaaaagtcagctctaaacaaatgacattgatctgttgatgtagcataagcagtgcaattaaaagccatggaatatgagtaaacggatggaaggtttcgtacagaaaaccccaatttttgatagcctaacaagaaccaatttagggagcctcataaataggggtggaaaaaaagctcgggctcgtgagcttagctcgggcttggctcgagcttggttggcttggctcggctcgtaagccaaacgagccaacccaagccttctttttagctcgttgctgaaatgagccaagccgagctagctcgcgagccgcttgttttggctcgcgagcctaggccatcgtgtgtttatatcgattattttactttatatggcgttattatttgtcaacttgaaatttatcattaagattttgaactattgaatatataaacttatttaaattttacatgttgatgatttgttctttgctttttttaataattacaaaatatatatgaagaggtgttttaacaggaaggcttgcaaaccagctcgagctggctcgagccaggaaacaagccaagccgagctcaagttttagtttgtttcccaaaccaagccgagccaagccaagcctagtttattgcgagccactgcaagccaagccgagctaggctcggctcaactcgtttccagccctactcataaagctttctacaaaatgcaggccatacaaaatgcaggccacacaagaaatgctatctacttacatcaaaagaaatctagctttgttcttctgaaaacagatttgtaggcagtcctagcagcctatgtactcctatttgtaagttaaatatttcttaacttattgttaaaaaaaacatgtccagcatccttgagtctagcttgcatcaacactggctacttcaatcccatgtaaacatatgaatatgacaggcaacaggataaagtttaagagaaaaatatagagcaaaaggtttgtagttgcagcctcaatcccatataaatgtttaaaagcttgacagcctgatgtaagattttttttcattttccaccgctggttgtacgattttgggtagcaatcgattgggtgggctggacaggtgcagccaaaaacgccgcaacaatcagaactgatcagtctcaatatgctgtgacttgagaatttaatgcgttaagaaaaatagagcagcacttaatcagaagttatgtgcaattgatctgaagatagcattatatagtttagaaaggatatggcatcgaggtggggaacaaaagtgtgaaaatccccaatgatggagcagaactcgatagtgaagcattacctagtcatcgaacatcagtttcttatgccaacaagatctcaactaaattgcaagctcaataaacaaaagaatcaatatcctctcttgttctttacactatacaaagaccatttcgtttgacctaacccatccatcctgcccaagtttttcaagtctaagccattggggggagttcctttagttggtttgctcagtgtttcacaaccactattttcgcaaatttgcatttgaactgtaatggttgaaagaacgagatctagcgatgcttaccttgtccacagcatggtggagagagttctggtggcatcggaaaggagagcgtgtctgttaggtagcctcctagtccttgctcacgaggaaaagcagataaatcaaccataggagatggtggaatatcattcccgttgtgtttcaaagccctagaataacaggtaatcaagcatgcatatcacacattttatcctataaatgatggacctcaagcatgatttcaagatagagtgaattcacattgaaaacctaaaaacgggctagtgcaatttacggatactaaaaaaagtaggaatgtccactcttacgtgagtgaaaatgtcaccaaatggatgactcccagagaagtcatctgggccaccacctgacgcttggcgctcagaaaatccagtagaacaatcgatcgcaaatcgaaaatgacaaatcacatattcactatttatgtcagtagtaaggaaggcaccatttggcattgagacagattatcatagtcctgtttggtgcaactgcttttaaatattattttgttgtttggataactgtttcccttagtttgatttataaaacaaactaccaggaagatagatctatatctctacggaaacttaaaaagcacatgcacagtcacagaaaatagttaataacctggtcgtatgtttcacgcttatcttcatgcttcaaaacctgagataagcatgacaaaacacaccctttagaataagaatgtccaatggttaatgtaggacaagctaagatggtgcccaaacaaagaaaccaaaaacatgttcaatgtaggacaaactaaaaatactctgttacttccttgtttcaggcttccattttaatttatgagtttccagatggatgttacatgcagcttgcactcatgcggttaggtctgcctagcgatggaactccgcccaccagatctatgctgagatgacagcgaggaaagaagccgctgaggcgctgacatggcccattctcctcccgcatacggcccctggtcatgggcgtggaccgtggggaagggatcccgaagacgaagataggagcgtggaatgttggaggtgaggaaatattgcaaaattagcatgcaaaaaacatcttaatggactgaataatatgcacataaataaaccgatgaaaaaaactcacatgatcttgttaacgatgttggtgtgatgcccccaatattgttatccatatcttaatttagtgttagccagctgaacaatcctaacagcatgcttcacatcgagagttaaaacttgtttctgtaaatcagaagaaaaattcaaaagtaaactaatgagagtgaaaataaattattctgaacttaactctgaaaacagcttagaaaagctgatgatattcgcaacatcatgttccttttgaataaaaagtatgaactccaagcagctattatatctgtttattccatcgattaaagatactttccattaggaaaaagatatattagctgcacatttcgtagaacacatgaatgcttgcaggtatatattagctgcacatttcgtagaactcatgaatgcttggaggtactctccatgcattggttatgtatatgtgtgtttctggtgataacctaaattagttacagattacaccttcagccaacatttagcttgtacaagtccaactcaagatcaacttctatattgaggcataaataaggaactctcaatttattgaggataaattatgaatacactgtgagaggtctttcttgaaaggaagattactatgatctcattaagaacaacaatagtagtgcggcatacacattttttctcaagtttctagtttgcatgaaataaatatcagttatcaatgttgataattcgaaaccacaaacaaaactatatacttattaagccgtaaggctgcactatcaggtcacttattgctattttttgggtttttaaaaaaaaatcatcatacacatggagggtctatatccttataactatgtgaatttggaatgtgagtcttatcctacaaattattggaagcatacactaataaaccattttatttgcactgtgcctcaactctgtagccaagttaaacacagaagtatttaatacagtaatgaccttttcaattcagagctttgaggcaaccttctgccacggcggggtgatcggttgctgctcggcgcggggtcgtgtcgtcgggggccagctcccatgatccagtggcgactgcagagggcgaggagggaggagaggcagtgtggggtcgcgttgttgggggccagctgccgcgatccggtggtgggcgaggagggagggaggcgcaggcggagatgggggtgggggcacggtcggagaggggcggcagcggggtgaccgtctgctgctcggcgcagggtcgcgtcgtcgggtgctagctcccgcaatccggcggtggttgcggatggcgaggagtgaggggaggcagacgcgtcgtcgggggccggtgtcgcgatccggtggtacacgaggagggagggaggcgtcggcggcgctggggtcgcgggcggaggggcggcgcaaggggtgggtgcgcgggcgcgattgcgctggggaatcgggagcgagcgggggcagcggcgaagggagcggggagagcagttgggaagaggggcgcgatagagggagccgaaaggggagagggcgcgcgtctgaagcgttgattttgcaggaggatcctagaagcaatcttagcccttgaattatccaggactcaccaccaccactagagaatttttaagtagtagagatatgtctccaccacttcttagtttcctttctgccaacccatcctgacccaccacttctcagtcggcccgccactattgcgtccacctcgtcgatgaagacgatggctgtgtcctgtccctggcgagccggaactagccagtcaggcaccatactcggcccattgtaccatgcaagcctggtgctgttcatgccgaagaatgcctaccgaggtctcgcacacgatgaccttggcccgcatgctcttcccggcgcctggtggtccatgcaggagcactgggtgtgtcagcggcagcttgacgccctcccggagctcctgcttctgcgcctcgcaaccattgatgtcgtcgtacatgacgcccggcttgtcggtgtccgccatgatcggaaccgtggtgccgagcagccggcgatgtcggagggaaccacgccgacgagtgcgagcgatagacggtgcagcttgacattcaccgagggcttgaggaggtcgtggtggagagaaatgggaaaaaaagagaagacgatgaatctgacaggtgggcccacgtgcagatgaggaagaagactgaaaacatgacgtcgatagtatggttcccattttgtaaaatttaagtggcacggttacgaataaatgaattataatgatatttatctgaatagacacatttgtaatgacacggatcaaattaacccttttcagtttgagctagagactcaagtctttttttctcaaaaattatgtgtattattccatgtaggtcctttttccacatgagttttgttgtgcgtcctctgttttgcctatacaaattaggcattacttttgcactttttaaaaccgagacttttaagcacatataggggccagttttaga

SEQ ID NO: 27030 - DNA, 5844 bp, Oryza sativa
gccagttttagacaaaaactggtacatatagtattagtatttttttaaaaataatacctataatatattatagctggtgttttttttaaaaaaaataaccaacatatgtaccactacgagccaagcttgccacgtggggagcaaaaaaaaaatgttgtgttgtgtgcgagccaaatatctcagcttctccctcacctaattcgctccctctctataggtctccctctccctctcccgatccccacttttccagctctccctctccaccgatgcctctcattggcagccaacggttcgccttggccccctccctggtgcaaggcggccagtggcccatctctccccagccccctaatttagatttggggattttaatttggatttgggacagcgaggagcaattcgatccatcggtttgattcgagccgatttttttttacctcgcgtgcatcacaaaggtgtcgatggtggaactgacattaatgacttggagtcatctgttccacctctgtggtgccggttgggaaatccggcacctacgaaggtgtcccaaccatcaccgatggcactttctgtggtagtagtgtggctatttgggaaatcatgatgttatatcatgcaagtatttacaatttacatggtgaacacgcattgaaatgcgttcaccccagttcattcatcagtcgggagaaaataacttcaagcattcatgcatgtagaaaataactgccatatactcgagacatatctacatcagtatgcacctttcactttacatagctaggcttagtgcttttttagcatttttcattgttttttattagaaaacagtttcgaatatgcgtaatttactagtcttaggaagcatcgggaatataaggtcaacgatcatcgtcctcatgatagaaattatggtagacacgtgtaaaaaaatatacatgtcggaacatgagagtttggttgttctgtgggacaggacacatcagcaccttatgtttagattcttgacttacacctgccggtggaatattggtggtaccttccaccatggtgcatcaagatgcaagatgtggacaaatatggcatttgcatagtttgcttaagaaccagaggcagatttaaaagtcactaggaatatggtagatgtgcttcctttattagtccttccttgaatactagctttactttgtggtttcttctcttttcttcgaccatcacatttgtttctctatgacatgattagtaagcatcaggaacgaaaggtcaaccttctcagtgaacgctcgatatcaatcattgcacacatattggagatgaccaggatttccttaggtgaattctggcaaggaggaatgatcacacacataaccccagcttcaaccgatggaagaagacccgaaacacaaccaatgtaaatactaatgtaaatcaaccgtgtgtacatttaatcatactactagaatactaacactacgtgcaggggttgaggcaagatttcaccgagagtaggaccaagctatgctgtttcaaaattttcaccgagtttctatctaaattttggtatatattttgccattgaaattctttgtcacgtgtggggcccaagcccaagctgcctcacacgtggcttcgtccctgactacttagtggaatgtactgtaaaagctcccacaatccttaaaacaagagataataccttctaatagcttagagcttcagtgtacaactcgaggttgggctgtggcggtgcagttgggctagtagcaaagcaaggtcgagggttgggtgaagcatcgctcgcacaaacgcatctagctagctaccgttccgacaccacttgtggaaggagctcatgtgcatagggatcccacatgcatgcctttcactttttctgtgatattttcattcccgagtaagatgtgttcgctcttcaagctcacgccacgcatttttggcccaactaattaagcagcgtattgcccccaaaaaactggattgttctcctgtctaaacctgcgttgaatcaatataccaaaatgagtagggcactacgttcgcttgctagatggtgcaaagacagaatcgaaggtgaaattgttaagaaaaaatggagagagatgagtagaaataaccaccgagagaaagtcttcctaaaagctggtaacaaatacttcctctgttttaacatttgagcaaatttatagaaaaatataataaaatttgcaacacaaaacacacattgtcacttatatgggcctgggggtacctggctagggaaaagggaagcccttcctgtgcgacgcgcccagcaggcccaacgcccctcggaggaacgcgcgttcggccacgaagcggccgccctcccccccccccccccccgcggggggcttggggtaccttgtcatacccctcgggcccgaggggctgaaccgcccccaaggccctcgctcggccgccacgtggcagccatgtggggacttgagcgggcgagagcgccgtccaccaggcgcatttatgggcagcgctccaaccgccccagtcgcatttaatgcaacgtggcaggtcgtgcgccgcccactgatggacgtgcgccgggcgaccactttttgactggtccgtgacccggcgatggatggatgggacaggcggcagcacacccacgtcccacttcatgtcagacggcgtgggggccggtatgtcccgtcccatcatgtgcagggaaaggacgtgcaggtcgccacctcccacgcgtgtgtgcccacgaagtcgccaagcatttaatagggaatgacgggggacgtcccccgtgtcaggcgaaagacttcggtgggggccacccaaaggtagcatggatcgcttccagcccaaggcatgggacgcttttttgtataggcagtgtgggcccctcttttaagaggagagcgtaggggcagtgtatatggtatcccctttatctataaaaggaggatctcgccctgcgagcaaggggacgactcctggtagactagattttggttagaagctgtccaagccctaatttgtacgcccaggatccgaactctctgtaaccacgcgaagatcattacacacacaaaagtagggtattatgctccatagcggcctaaacctgtataatctccctctctcatttcctcgccatccacctcgcaagcctaatccccgcggatccgcctcgctttcgcgaggatacgtccctaagcattgtgcctggtcccctagccgaactcacaaaggggggcctcacaatctcccgctagacagtatcaccctctgacacacatgttatcaaaatacattcactgttcaatttaataaaactaatttggtgtgtgtatgttgctattttttttttataaaccttgtcaaacctaaagatgtttcaacaaaaaaaaggtaaaaacgacttgtaatatgaaactgagaaagtaacaacaacattatccattaaaaaatgtattgaatgtgagtatcaattatgaggagattactatggggttaaatacactaggattcaatttgtgaaactcaataggaggctgcgatagttaaactaggtgaaaccccgcccattgctatgggagtttactatgataataataaatagaaataatgtgtaagatagctagacgacagaaacttgcatatagtgatgtggtttatgataatttaaataatatagaatgatgatccaaatgtaaaagtaatatcatgtgactttatgatagaagaaaatgagggagaatataattccgaccatagattaatcatttgatggctaaaaacaatttgaggtgatatggcttaatgagagaagagagaaataacattgactaagtgaggatgaattgtataggtatatagatattaaacaaaatgatggagagatatattgaaatattttgagaattatttggaatgatgatttgacatgcttggattttaaaagctctaaaatttaagtgagggtgaactgtataggcatatagaatattataaaaagtgatggagagatatattgaaatattatgtgaattatgcgtaatgataattcaattaacatgcttgcaatttaaagctctaaaacttaataaattagcatgcttgcatgaggtttgagatgcaataattgttaatggatgatgtggcatctttgcatgttgaagtttaggatttagtgtaccttaacattatagaaagataggatatgtgaaccagcatgtacgtaaacatggacatgatagaaatgtcactggtgcatactgcctcaaattagattttcgcgagattcacatatttatctctatatgcatccatgttttatgcttatgtgtaagttaaatttatgccccatccatgtaatcctaaaaataattatatatgtgcctatgcaaatggcattacgtacggggattcccattagctagaaaaatgtaaatgggatggcaataatcatagaaaccatttactatatttcctttgtttccacctacatatataaagtcatcatcttgactgtactcatctcctcacagtggttacatatagtcatcttattgggcgcccttctctatatcgtatggattgatgttccatccaccagccagtattgtttcttaggtgcataaagcctagcaagtaggtttaggaggcgatgggaacttacgattcggttcgtgaggcaaatggagtacttttgcaccttatgttcagattgtagactattggtatattggtaccttcctccatagtgcatcaagatgtgtacaagtatggcatttgcatttcgagcataggagcaaaagctaggcaagatgatagctggataggaaaatgggtctggagtggatatcttaatcaagggctatggttacatatcgtttaacgcggaacaatattatgttgctttacggagcattatgtgcatgctattattttttagataaccgcatgttattaaattgtgtgactgtgtacattttgttttgagcctgaactatcccatcttcagtacattcatctgacaaaaaaaaaagaaaagaggagcggatcggacaataaatttatccagcactagtattacagaaaactagaagaaaacatattacaatacaacatgcaaagcactaggaaccattttgggagtataagatttactctgtgcgcaccactatacacatgcagtgtcctgcgcaaaaccttgttcctcttctaccggtgttcagtaatcagtaggcttgtttaagttgtttatttgcttagtactgtacaccctattttttatgtgatacgtggtaagtttagatagtattcagaatacatggaagacttaaatctcagtgcagagaatcaggtgcatgtgcacagtctttaaaagaaagtgtgagtttcataaaacctattaggctgtgctcgggaggtgaggttgggaactcacctctcgcgcacgcaaaatagagtgacgtattttcttgtgattaattaagtacttttttgaaaaatagattaatatggttttttataaaacaacattcgtatagaatttttttttgaaaaaaaacgtatcgtttagtagtttgaaaagcgtacgcacggaaaacgagggaagtgatctagattgaaaagttggggaaagaactcagtctcagtccttttatgaagtatgaacgctagctcactttgtagtttcttcttccttggatcatcagatttctttaattttatggggtatccgctctgtcagagaaaatggaaggagaaactaatgagcagaaataacaaggaaaagatagcctatgtaaagcctggcaacaagcactactaaaa

SEQ ID NO: 27031 - DNA, 19118 bp, Oryza sativa
cttgttttgactctacggaggagggaaaagcattataggtgccagtttagctgttccggcacctatagtgccgatctctatgaggttttttttttactagtgaagagcattatccataaaaaaaaatctgtattgagtagttcaaaataaacttttattccaatgattacatggctatggggttaaacacaccgggcttcaatttgtgaaactcaatcagtagaggacatggttaaatatgtgaattatacttgattccaatacttgaagtgccaatgtcactggtgcgtactgattcaaactggatttttctgagattcacatatttatctatggcatccaagttttatttatgtcttacatgcctatcatcctaaaagttgttatcatatataaaaaccatttagtacttcctttgtttcagcctgcatatatgaagtcatcacgacattggtcatcatgacattaattcactactggagaaaccatctttggtcgatcagccaaatttcacaatagttccggttctaataaaaaccgggactaaaaaatatctttaggaccggtttaaaagctcaggagtacttctgatctttagtcctggttcaaaaaatggtaggcagtgtcagacccctatattttctttaatcccggttggtgatctatttttagtcctgcttagtaacaccacccgggaaaaagatcagcatacacggagatcgaggcttgtgcgtggatcgaatcgagataactatctcctcctccctcccagctctacttctatctcctttcctcctctcctcacttacaccctatctcttcctctccttctcctcccccctcccccctcctccccacttctggcacgcggcggcggccgggtggcggagggccgggcggccggcgcggagggcagcgcagctggcggcggccggcagccggcggaaagcagtggcctgcacggcagggcgcggccggttgcgccttgtgttgttttttttctagaatttgtggtttggatctgagatatatttgatttgtgtgtgatgtgaatatgtgacgtttttgtaatgaattttgtagaacttgtgatgtatctttttaagattttgtgatgtacctggagatgaacgatttgaggatttggaggtgattatcgatttgggattttactattcggggaggattgatttgggatttcacgatttggggacgggggatggagtgaaatcaatatactaaaaacaatgaagaaaataaaaaaaataaaggactaactagaccttgcctgggactaaatctttagtcccgggactaaaaatggatttttactccgggttatttcaaccagtctttagtcctagatttgtagtcccgattggaaatccaggactatatagggttatcaaccgggagtaaaaagcatttctccacaagtgattgcttacatatagtcattggcactactacgaaaaccatttttcgtggcggccattttggatttttgttggcggaatttgcagccaccacaaagcaaaggccagtgaatatcaagatcttcgctagcggttattgacagccagcaaaaattcattttcgctggcggtcatcttaagccagccgccagcaaaaatacattttcgctggcgttggcttaagacggccggcagcgaaaatccattttcgctggcggctgtgttaaatcagccgcctgcgaaaatggattttgggaaaaaaaaaacacgcatgcagctgccagccgtcagcgaaaatacccatgctgccgcccattgattcattaatttcaaatttcaaatccacatctagattcgctgctcatttccaaattcaaacacgaaatacaaaatcatcattagcacagatcaaacatcatttacacaatcaaacatgatttacacagatccaaacatgtgcatcatctggaacaacatgcaaaaagaaaaagaaaaaaaatcaaatctagctgaaggcggagcaaggtcgacggtggcggatccggcctccccgctgcccagcggcggcggatcccgccaccccacggcctggcggcggcggatccgcctcctagcggcctggccgctgcggatcctgcctccccgcagtccgccggactccccgcgggctgccgcccgctcctgagcgccgccgcgcccgcgcccgagctcgccgcgccacctcccgccaccgtcgcccacccgcctaccgtcgccgccgcgcacccgcctcgcgtcgtcgtcggtggagaagagagggaggagagagggagagaagggaggggagctggacagagggggcgggtgggtggtggactggtggtggtggtggtgggccgcgtggtcaatattaatagatggtggtccatctatgcaagcggtccttctaccgccagcgaaaatctggcggttgcttaagtgggccgccagaaaaaataattgtattttccctaccggtctgtatgacacaaccgccagcgaaaattatctatctttgctggcggcgcacctaagtgaccatcagcgaaaatagacatatcttcgctggcggctggtataatgcgaccgccagcgaagatccattttcgctggcggtcggtgtcctttaccccctcgttacaattttgctggtagttttggcatttctccgccagcgaaaattataaaccaatgccatgaaaaatcgtttttctagtagtgtggtctttctctacgtctacaagtatggatgttgcatccacctgctagagttggttcctaggtgcataaagcctagcatgtaggtgatgagaacttaggattcagtaactgtcacatcggattgttgaatactttctctgaccagtagagcactgtgtgggagtgcatgcgagaggtgacggcttagtatgacataattcagatgacaacgcttcggcaagcaacgatggctctaacttatagagaaaggggtatcagcgtacaactgcagttggctgtgatgcaaagatagatccttgcatcctaatgtggctgtgttttttttttcttttgcacctatgtatcggacaacaataaggttatagcgataatcagataaaaatttctccaaccttcacatacaaaacttgtgactagtatataaccactctgttaagtgatctctaaaagcaacctattgataaaaaaaccggctgatgctaaattgaacatttgtactgtgaatgccattgaaactatctaggaacatgatattagatgatcacaggcaaggaaacaagttgcaaccgcaacaccaatcacagcagaatattcatggccatcataaaatttgttcaacttgtgtgtcatttatttgagcctttataagctaccgacgattcacctaccactaataatagtctcatttgtccgaccatactccctacatttacataacatacattatttcttttatttttcctataatgtttatagtgtaagattttaataatttatatcattccttttagaaaatgatttttaactcgaggtgaatttatcggggcgtgacagaactcacctatatgttctctcttttttgcatgagtgatctgctaccctgctcccaatactaatatatgcatgcatctcagtattcttgatccaaatccatctcacaatgtcttttgctaatatggataagtaaatttacaactataggctgttgtccgtgcatttgtttgcaagtcttgtttcttagtcgtatacatatagtaaagtatccaaacataagttctagaccaaagataatattttgtctttgacctttatgtatggagagtgggttcgtagagatgtcttccaaattctgctagccaggtgaggagcacaatatatgtcagatttcaacccttggagatactgcacacttagggttctacaatggaatttgaaattccttaattagtgcaaaactgtgaattactacattattccagtgatatcttagttagacattggagatggatatcttaggggctggaggagtaacgtgggatagactgtatagtaggtaagaatactacatgcatgatgtggcacttcaaagcagaaacactactagaaaaggcattttctccgacattggatctttttctttttgcgggcgggtatggccatcggagcgaaaaccccgccggcgaaaatgagtatagggaggagttggaagtccgcctgcaaagataggttatcgcaggcggaccacataaggcaccacctgcgaaaatgatctgacggtctgactgggtgactctgtgagatagtcggtttcgtgttgttttcttgaaatttctagattgcttcatgtttacgacttctagatggtttctatccgtatgtgatactattgtgtgctgatttgagtcaagttcgtgcgaacttgtacttagatatggagtttctttgttgttaatgtgcaggtgttattttaggccatgggagtatagccggtgatggatctaggctaggctttattcttgtgtttgatcctattaaatggtattagagccatgcttgctctttttaatcttttccgattacgagattttgtgacaagcctactagtatgtctccttcgtcgtcttgtggttgtttgggtgataataataggaaccctaaacttctgaagaacaaaaagtattcatcgatcaagcatgctctaattcacgaggtgttggataattttgataatgacaatgatcatatacttttagttgattttctctcaaatcaaggtaagtcttgtgacatttgtgatttattgcttgaggagaataagtggttgaagaatgtagtaaaatgtttagaatatcaagttgaattcttatcaaaacattgttcacatttcaagaattcttgtgttgatttgaccgttcagaataatttcaattattgctttaaatgatgaactataatattctatttcatgtttaacttttgaaattgatgttttaaagtgcaatgcttctatgccatgtgaatcttgtgttgctttgcaagatgagctattgagcttgctagtgctagaagtaagataagtgatctcaagtctttagatgaaatacactctgattcttgcactaacttggctgttgaaaatgagaagataaatttggcttatgcttcatattttgatcaattagaaaagattagagctgaaattgatgagtttaaagcgtagctttgctgcagattatgatacaaagatagtttgattttcattgtagaacttctaagaacaatttcaagtatattttaaatttatcttcatgatagctaggtgccaggagtgatgaagagaagcactaaattaaattacataatcaaattctaaattttggaatcggctttatagattataatccaaacttacctcattagagcgtataaagtctggatgacatcttgtctcaaactctcaatggcatttgatcagtacatatgtatgacacaaagtctttcaatttacacagtcttctagtatttgtattagccattggttttggatgtcataacgtagtcttaggaggcatagggaatgtaaggtgaacaatattgggattgtcatgatagaatctgtcagaagaatgtacaaaacaatacatctaatctagtgagactcgagagctttggatattcggcatatatatgatgcgataaaattggcatctgtcatatgtatgtttagcattagaactagaggcagatcatggaaggttagagagcacaagagacgatggtgcaggtcaggatattggccgatgaaggcgatgtttttggctggatcaagctagtttatgttacattgttcaacggggaatatgaggtgatggacttgacaaatagcggtgaaaaaactcacctcgattggtgacggtgttacatttgaagtaaaaaaacagagaggtcggatgtggaaccaataatcattttgattcaactggcagccaacgccataacatttgtatctgattctagttatttgattttcaagccattactttggacaaaaatggagtgttaaataaaaccttggatggccattcaatccaaacatcaacaattctcttttggaatataatgttgctttactgagcattatattcatgtgattcgtttgtctgtgtgtacattttgctttgagccacaattcttcctttttcagttcattcatgaacccaaaaaaagagagcagctagtggacaattaatttatctggtactagtatttctgaaaactgtgtttttccataagaaacatattactgtacaccatgcaaagcatacgtgactctgttatacttgagttgaaattttgtgatgttcatagatctatctcccttctcttatgtccatgtgtgttatgcctatttaagaggaatgactcacagaagtttagatgtgggataatgtgtatgtgcttatgcgtcttctctctaatctcaaaaaatagctacattgatggcaaatattgaaaccatttattttatttttctattttggcctacatagagccagcaagactttgctcgtcttctcccattgctcacaaagtcatctcattgctctactctaagcctacaagaatgtctgttctatttaggcttaggcttaggaggcaacggggatttagatatcagagaatgaagaagataaagtattgaactgttatgtattttctctccatgccaatggtggcaatgtgtgagaggcatgaaaaattggcatttgcgcaaataagaaagcctccgtggacaatatcggctatatcagtcaagtgttgcccgatgggagcagacaaacacatcatttttttaaataaattgtcctttaattcctaattcaatctaaatgtgtgcatcacacggtgcagaggcttcatatattcatatatatgaacttagtgcgcgtaggaggcatcagagaaatttagattagaggggtatgttagtatcagattatagcatttgctacagatgccccccaactctcctacagctatggggcagtggatgatggttcacctgaccagaagcaaagtaggagaaggatggaaagctagttatcaaagatagttgtgttttggggtacaacgatgaaatatcagttctccggtagtgctagcacggagtcctttacggttcttgcctgctattagggtacttccaacaaatgtaagaaagtaactattttcctcctaaaatttgatggtaaaatgtaagaaaggttggattattctctcaaatgaagaattccgctccaatctgctgttttattgtgggacaaaccatcttcatgtctcttatgtgtggaggcaaatttccaaggttccgatattaggaacaaagtcagaagacgactgagacgtactggccatttgggaaatcacgatgttatatcatgatgttatatcatgcaagtatttacatggtgaacatgcattttgttatgttgaataactgtaatacgtttcattgatcaagtttcttgctagtttgttcatcacgtactggaaagaaaacagaaattcagtcatttactttggccagtactaagtccaaactcaagaatcgttatcttttgttgtgacatctcatacattagttagagattgatatctttgcaaaacttaggtgtattggcaggaatcttatacgttgtgtgcactatgatgcagaaaaaatagttgtaaaacatttttctattataacaactaggaagatagcccacgcttagcgcgggcatgggtcgtatgctaagattgagacgcttataagatgaaaatattaaccggtgaacatctaccacgatttctccgtaaattcttttcatcaacattaatttcttttataattttctaacctattagctttatattatatcatatttaagtaatatcaataaacaattatttataatcttcttcatcatttgaaaagaaggtagacttattttccctagaaaacatgtcaacgaagagtaagtgcaaagtaaaactaaggtatttttctttttttaattgcatatatattatcatggtttcttcgaggattaattgggtgggacatgaagctccactaaatatatgggtttatatagcctaatatgattgatgtgatttgagagccgatccatctatgaacatttaatgtagagtgggtcagaagtaccacgcaagctaatgtgaaagccaaatataattgcacaataatattttaaatgtgatgtaccatgtatacacatttgtttttcttatataagatagctctaactgttagaaataatgattccaccggtttaaagggcataggagtattccagaaatgtagtttaaaaattatggttgttttaatattcaacattactacgaagtaaacgttggttgtgatggaattttcccactcgtgttcatgtcccagaattaaaattctttcagtagtaggtgacgtacccgtcgaaagcgagacgtacgtagtgacttcgtccatctcaaaatatgtcatcctagtctatcagaagtactcatgggggtatgtgcatgtgtgtgttcacataggtgagtgcgcgcacgttgtaagcactcgcgtttgtactttgtttctaaaataatatcaaacatattttttgtttctcttttaatttaataaataaaacaatagggagggggtgacagggttgtgtagatgtgagagtgaggaggaggtggagattttatttttctaatttttctaaatgatttaagtgagagccgatgacagggtgtttcattttttctaagaatttccaaggtcatttatccgttttttataggacgtgagacatgataacttaagattttatttttaaaaaatagatctaatagataaaatattggatacgtcaatttaattgatcaaatttaatctagcacctcgtatgtccagccacgtgtcgctcggtgatttgtagtcagtgttcgttatgttctttttttttctattcgtgggaaaaaggctgttggttactccctgtgtcaaaaaatttagatataaatatggacaaattcacatttatccatatcttaactacttataaaaaatagtaactttccaatcgtcacaatatttttttgtccgtcaatccgaccaagcggtaccctctatccacacacacgcaattacatcccatacgatatccaaagaaaaaaaaagagtttgattcaaaatcagctaaaaattaaaccaacagactctgaatcgaacttaataaaatcagctgggatgatccacaggagtgaaagctggaaaccaacggaatcgagcaaatcacaaagcaatacgtaatatctgaccggcgacaagctcatcgtccgaagagagatggcaggtgacggacgaagatggagaggagagacaagctccagcggctcaagacacgccgtcgccgagggcgctccgtcaacccgcaggacatttctgcagccggatccacccatcggaagtagcggatggcgccgctgcggcggattgcggtggggtaggccacaaccgccgccgctcacggtgggcgaggcggcggcgacgctctgtgttaggggcaatctcaccatttcaaaaaatttctcacctgttttgactcgaaatataaaatattgcctccggtgtcctatagccaattacataatttttatagtttccattagccatgtcacgtttttacggtgtctcccagccaattacacatttttgggtgtcctgtatcaaattttgcttttttttcttataattttaggacatattatatggtgatttatgagcgctctagagcgttttaattgatttttgttaggtatagtgatttagtatcgcataatacatattatgttcgattaatttttcgttgttatttagttgccattcaaacgatagggtctaccatcaaataatgtattttaactttttatagtaaaatatagctaatgttatcttgatttatttatttaattataaataaaacaatagttatattatgttagttaaaaaaaagaagaggagataattgaattggtgaggagaggatggatgagtcatctttttttttgctttatcatcttttatcgttagtagatgtttttttttcttccgcctaacagtgggaagctttatttgtttttttttcaattatacttacgtacggacatttagttttatttccttttcccagccaccagttgcatattttttaggaaaaactatcacctttttaataatagatctaatctaatgttctaaattaacgggtccatcaatttaagtgaaaatcgacggtgagattagatagtgccacatggcaatccacatggcggtccaggagtgtttgtagaagcgccacttggcgactcgagagcgtttataggaagtttaatgtacttttagtatataatagaatagaatggatagataagtaagagcaatggcttgcagatcactctaaaaatactaataacctggactagaaacaatagagcaatggccgcagccacaactacaaactctgcgtgtcctgtggaaattatttcctaaattataacctggacctcattagagtgatatttattaaggttaattggattcatgccactgcaaatatgccgattcacaaagatgccaataaaattcgtctattcatatctatgccattgaaattcacataaaattagaaccatgccatcaccgtcacattttccgtcactgccgtctagttttccgtcacattttctttcttcaattccttcttcccttttcttcccctatttggtgggtggcagggacagaagtggtgcgtggtcgacggggaggaccatcctgcagcggtgtctgtcgccccaccaagcacgacgcgggcaagccaagccggcatgctggactgacgatatcatgctgtgagcattggccatgccgtgcaggtgcactgggctgagccaatccggccacgccaaagccgcggaagcgcctcgccggctccggcgtgtgggcacagcagccaaataagaacagaagaaaaatagaaaaaaggaagcaaacagcatcgcctgtgtctcaccgcctgcgctacgtcaacggcaaacaaggaagagcaagaagaagaagaagaagaagagaaaaaggaaagcagcgacggccgtgcctgtggaagccgcaacgacgacgccgagctcgcccaccaagcaatgcccgaacctccgagcagctcgcattttggtccgcaccggctgcatgctcggtcacgccatcccgcaccgggatatatgcccgttgctccgtcgtcggttcccatcttagatgggtcatgccaccgccggtgttgagtgaggggatggcatgggcggcggcgaggggtggtgagcggcaggacgacaaggccgtacctggggggtcaatgaggatgctgcccactctggtggtggattggaaggagagagaagagagagaacgtcaataagagagagaaaggggataataagatagaaattgacaggtgatgacagaaaactgtacagcagtgccatgtttatgatttcataaaattttactaacatctagccgatatcgcgaatagtaatggtatttttctaatatggtaaatttgtaatagcatgtataaagtctgaatgacatctattctcaatctctcaattgtatatgctctagacattaagacatatgtacaacacagagtctttcactttacatggctacgcctggagcctttgtgaattttccattatttctatcagacaccggtcttggatgtgcataacatagtcttaggaggcatagggaatgtaagctcaacgatcttgggattgccataataaaacctaccaaggggatgtacaaaacaattatctagtgagactacttgagagtttggatgtccagcatgtgataatgcaacaatagtgagttttatgtgtgtttagcataagaactatatgcaaattttggaaggttggagagcacaagcgataagcagggagggcaggatatataggctgatgtgggtgaaatttgtcgctagatgaaggctttaggttacattgttcaacgagagtaggaggtggtggaggtgacctgatatgaatagtggtgagaaagctcaatttgattgtcaaatgtggtatgtggagtaagcaaaatagaggttggttgtgcaaccgcgatcattttggctcaaccgccaaccaaatgcaacagtaacatttgtgtcgatctgattctagttatgtgattttggagccaatactttggagaaaagatgagtattaaaaaaaactttgcatgcacattcaatctgacgtcaacatttcgcttttggaatataatgttgctttactgagcattatatttgtgtgaatcgtttgtgttattgtgtacattttgctttgagcctaaattcttccgttttagttcattgatgaaccccaaaaaagagagcagctactggacaattaatttatcaagtactagtattacggaactgctattttcaaacatattactgtataccatgctaagcatacgtgcctctgttatactagagttgaaagtttgtgatgttcatagatctacctcccatctctgatgtccatgtaaaccgggactaacgtggttttgcaccacccagcaaagatcagttctccggtagcgatgtgtgttatacctattttaagagggatgactcacagaagtttagatgtgtgataatgtatgagcttatgcgtcttccctgtaatctcaaaaaaacagctatattgatggcaaatattgaaaccatttattttatttttctattttggcctacgtaaagccaacaagactttgctcgtcttctcccgttgctcacaatgtctgttctatttagccttaggcttaggaggcaacgggaatttaggcatcatagaaggaaaaagatgagaacttaactgtaatgtattttctcttcatatccttatggaccttatccctgtcaaacaatggtggcaatgtgtgagaggcacgaaataattggcacttacacaaataagaaagctgccgtggataacataacacctcgatcactagaagaaagtattggctatatctgtcaagtgttgcccgacgggaacaagacaaacacattatttttttaaaataaattgtactctaattcataattcaatcaaaatgtgtgcatcaaatggtgcagaggcttgatataaacttagtgcgcctaggaggcatcacagagatttccattagattagaggggtctgttagtatcagattacaacatttgctgcagatgcccccaccagtacaaaaagggtttttctagacggacctaaacctatgtttgcatgtggaagcctggcctgtcaggccaaaatggtctgcgaaaatccaatttttacgtacgggtaacgcacctgcacacgaaaatcagattttcgcgtgcgggttatgtcaacggcacaaaaaaataaaatttcaaaaaattcaaaaccctagcaatcctagcggtggcgacggcggataggtccatcgtggggccggcggcgccactcccagccgcctcgtcgtcctcgtccgatattctattcaagttgatacaagctttgcctatcatatatattgattctatctttaattgcatcattgtttagagtcgtatgggctaagttagaactttttcagttaggttgatattctaactaagttggtatttctctactgttgttttagattgatcaatatatccatcacgtctatgtagatatatcggctaaatatgtttttctcattatcgtcaatttttcgtttaggtccgatctattagattattgctaataagttttatattagtaagccgataggtttttctgcaatgtttcatcgttcatcgggatgtatcagctaactaggcaatatatatgtgaatctacttgcatcagatctctagcaaatgtatgcttttaccttcggacttacacttaccacactatatcagtattagctaactagtttattggttcagttctttctattattcttgttagtagcaggatcaaactaactggcacgtccaaacctcatcaagatttagggcctatactggagctaagcagatgtctcgggccttcgattgttgtgacgcattgtccatcaacgatacgaaagggggtgtggagttggtagctatatcaaggttttttttttagaatttgatcaagggttattgttacattgtttaaggacggataactttatgttgcttttcctgagcattacgcatatttgtgtgattgtgtacattttgtttcgtgcctgaactgttccatcttcagctcattcatcagcaaaaaaaaaaagagcaaacaatagatttatgaaggatcaatattacagaagattaatttccaaaaaaaaaaatcaactgtacactacgcaaagaactagttaccagtgtgtgcattgagggtggggggttacaagatacactctctataaaaaaaatcaacttcttaggattaacctagaaatatacttgtcgagatttgttcctagaaattctttttttttaagacagagggggtgactttatgtgcacatagccttttaatgaaagtgcgagttctataaaacctgttgacatcactaacacataacctcaacccttttttttacaggatgggatgttctttgtctttagcaacacaacaatttattgtgtgcttgtgtatatatgcatatctctgctggttgctacaactacaatgtccatggccagattagtccttcctcgaagactagcctagtttgtactttcttctcttttcttagaccattagatttctttgatttatggggtatcctctctatgataggtttagtaggcatcaggaacgctgggttgagctcggaagtgaatgcttgatatcaatcattcctcacaggttggagatgactataatttctttaggtgaattctgacgaggcgaatgatcacatatcaccctcgcttcaaccgatggaaagaagagctgaagctaaaccaacacgaaaaaatggggccttcaatatttcagcggaaccccaaccaacacgatgggtgtggatcccctggagttacatccaaatccactgggtggatttcactaaacccaagccgtccctttaatttcgatggctttgtttaagccatctcttcttccaccatagttatcttgtagagtctattttcttttaaaaaaaatattgtacagcttataaaaaacattatctcgtagagaacatgttatcttcgaattttctaacatcaattagagaagaacaaacaagacacgaacattgcaccgacaaaagcttgaggatgaattagttcaatgagggcctcgatgccgttaatttcataatagctcggttaagaaaagtttacagataatttcctatccagaatgctcttccgagacgctagatccaaatggacagacttcgcaagaaaaaataaaaagagaaaagaactggctatttctgtcgtaaatgtgtaactaggaagaggtgacatggccacatctagcttgtagaaacaaagtaaggggtcagatcggcccaaatccaccagggtggagttggaaggcaactccagggggtctacgccccaacgtacctattgtttacacttctgtctacattttttttcttttgatgtgcacaataaagtagtaggaacttagacttgagggcatcgagaatttaatgttgagtttatcctctccatcgctatatataagattttggtacaaatatgctaggccatttatctggttaagtatgtattatcctaatgagaataatggaccattaagaactgatggggcagagtcagagtcaatgctacttgaatcaccagagcggagtatgaccttgcattttattcccctaaatgaaatccgcacagtggaaatctaaggcctttcacagtgctcctacgtggagcattacctccttgtgtcagctaggaaagcgccgacgtgtcgagccggaccacgtcctacctgagtcgcttgcccccacacaagcagacgcgattctcgctcgcgcgagatcacacgcggcggagagaacacctggatcctgcgctgtagagggcatgcctccgacttgccgtcccttcgggccctcccgctcctgtgccgctaacctcatcaccgtctctcgctccgcgtcaccaacctcgtcgtcgtccccgcgctccgaagacaccgctgccatggccccgaagatgccgctgtttgccagagacggccccaaggacgtcgccgccactcggcgttggggcgggcggcgcttcccggagacgagcacggggatgccgtcgccgcttcactccggatccacgcaccgccgccgtcgacggtcagtcttctcatcaccggccaagagaggagggacgaggcggattggggaagaagtgccgcggcggatttgggggagaagcggcgcagtggatggcgaggagaagcggccggcggatttggggggagaagcgcgcggtggatggggaggagaagtagcagattttttttttcatttgtgcgtgaggataaaaacgaaggggtaggtggctgtggggtcaaggattcttttgttgggtcacgagcacagtgaggtgcgtggctttcgggccaatttcatcgcagaaatgggccagaggcacgcatagcatgccttgcactgccactgccctaagcatgacttaacataaccaactgagaaatgttagtgccaagagtgtcgaggaattaatggtgagaagaaagtacacaacataaagcggttctttagaatgactctgcttcttctacttattgagaatggtgccaagactatgcatgactctgttggtctctagttctaaaatgttcatggcctctttatccctttcaaggctacttagctacattgtttcgtctattttctcttttcttggatgaatctattggcatttgagcatgtctcatggcctattagatttctttcttaagtgctatcatagtattataataggcttagtaggtatcaggaatagaagaccgagcacattcaggcatggtaggatcaaactctggtacaattgttcaacatggaaaccactgtctcaggcaaagtctatatgtttctccagaagacgagaatgggtattagaagatgttcaacagctaaagaacttaagaacacaaagacaggacagtattgagggattaattgggcaggttttttttactgtattgtacagcaacaatgcagctaagtatgctgatggtagtcctgccagtaagagttagcagccttttttatggccatcatggaactcacctatacatttggcttgagcgatctcccaccctgctcctgatactaacatgcgtctcagtgttcttgatttaaatccatttcactgtgtatttttacgcacatgtgcacaaaaatttcaattttacatgtataggctattattcgggcatttgtttacaagtcttgtttcttagttgtacatatagtataagtaggcttgggatgtcttggatacaaacataaattatattcaaagacaatatttgggtttacactcttatacaatatttgagagatttgaatgctggaataacgtgtgataggctgataggtagcaattctacataatatggcacttcaatgcagaaaactcacatagacaacagtaatgctaaaatattttcctgttattaaacaaaagaatcttatgcacaacgaatactcacatagacaacagcaatagttgtaagagaataacaattcaatgtgattatcaagatgccaaagccttttgtttgttgcttgagagaaaaaaggtccagactctcaattgatcgcagcagaaaacaatattaggacgaggtagtgagattttatttaagataatagattgaaaccaagcctctacgttaacaagggtgtatacagccacaagtattcccaagcacaagaactcggtccttaccctcatgttcagagccgaaaggcacacaaagggtcaagcatcttacaaagtactgaaaggagcacaaaggctccaatacctttcaaggcaaacagatgaaccaaactaaaaccgcgaccaaatacaaattacttttttctcctctttcctagattgcaaccaactttagcaaacaattgcataaccaccatctccaacaatttgcaatcttccatcatcacaacaccatcctcttcttttaacaacagtacagattaagacagtcatttttctttcaaatcttcgtgttactttatatattacatcattgatgaagcaaattgtgtcagttctagttacagatgaatgtgttgcaacaataaaaataatcgtcatttattatattttctagtgcaatactcctatcacgctaaatattgattaggtcaaggattcacttacagaagtgttcatatatagctgtcatgtacccctgcttagctttgctgctgattataatccaaaaatattattctgattttcacagcttgctttgaagaataactttaggtagtttttttttactttccttcgtggaaagagaaccggtcaaagaaagtaatgaagaaagagctcaaattaaattatggatataactaaattataaatttgaaaatgagcttcgaattatgatctggatctcactcgagctatctattgtttacatatatatagtctggatgacatcaagtctggagctctcaattgtcatatgctctgaacacatgtatgacagagttagtctctcactttacttgctttggcctagagcctcttagagtttccttgtttctattagacattagccattggaggcatcaggaatgtaatgtctccaataccttgggttcctcgagatagaaactatggaactcatgtgcaaaataatatacctatattgagacttgagagttggattttgtgggcacccgtacctgcacatcatgttgagattcctgacttgcatcggcgagatcgttagcacctt

SEQ ID NO: 27032 - DNA, 5140 bp, Oryza sativa
ttcagcctttacattatggatgctttcgagtttcgaattgtcatatactttccctagaaatgattggtcaggaggagcggtgagtataaggcatgtgaggtacggtatgaccggcagtcacgcagacaagtaagttgtcgagtagtaaatgggaaaggataggattaaggtattgcaaatttgttgttgaaagtgaaacacatgcaactcatcttaagaacgtgtggtctatactagacaagtgttccacaatgggaatatgagaagcatgatatttttttaaaaaactatctttaagttctaatttcatagacatatgttcaattgaagtaaattttacagtttgaatccagcccaaatctgaccatatactttattgagaattacaatgacacaaaaagtgttcttgtttggatttgttagttttgtttataacgtaatgttgtagtctttcagttaattcatcgaccacaaagagaaatgctttatgagatgttggcatagattttgcactatggtttatatatatcagcctcacgcatgcacgttcatatcgtttcgtactataatacggggaaatttgcgtagacatgtgttctattgagatgcgtttgtggttgtaatgatcaggttgatgaggattccattaactgcatcatgtgaaatcggttggataagcatctgcatttgcggctacagagaagtgttcgcaattttgtcaattcttttctctcaattcaatccctgaatttcattcagttacatacctagcaaggcgtataatactgcgaatgcatttcatctcgagtgtaaaagtagtaggcttaaaaaaaacccagaattgatgtatgatacattgtctgaaagacagaaagttgccttgaattagattactcaactcatatatattcagaaccagactatgaaatcttggcgataaccggccatttaccattcctaagagagagtgaccggtaaccattaccagcccgaataatttaaatatagcttgatagaatgtctcagggactcaaaggtcccctttttttctccaacgagagttggatcaagattaacattttcgtggcacgtttttcaaactgctaaacggtgcgttttgtgtaaaaactttctatataaaagttgctctaaaatatcatattaatctatttttcaagtttgtaataattaaaactcaatcaatataatcatacgttaataccacctcgttttgtgtaaaaaacttaatcttcatcttcatcttcaggagaaaagaacaccacctttgacggcgtagtattagtatattgattgcctctacaggtaatcgccaatgattaggataaatttaaaatttcatgatcaacagctgatcataaatattcactaggtgattccccgtactttgctgcgggaattactaagcgattcttttttctgatagtcaagctagaagtaaaaaggacaaaaataacgaaacatcagggtttatcagtacttatcgtgaaacaaacaaattttaccatactttaatgtgaaacatattgataagaatatgctaaatattataaaataatagatagatttgttaaaatattgtgcaaatgatgtgaggggtgatgattggatatgcttgcatgttgattcatagaattaagtaaattgtagatgatgttgtatgcttgcatgaggttaaatacgtaatttattctaatggatgattatgtggcatggttgcaggttgagtttttttagttagtgggttataacttaaaatataggtactcaccatcaatatttactgttcctattcattcatcctatccgatgatccctatttataaactcttttgcttttctctttaatttcacctttcaatttttcagctcgattaagatttttagcatatatgtgccttgtgtttctctgacaactatagtgcaatgggcgtaggagttgtcgggattgcaacattcacctctgcgctctatccttcttctgcttgacagtacaaagcataaatatttgacggcatgcatgaaacataattccttgctagtttgcccaccttctccgaacgagttagtattatgtataaattgtctgattaactgacatgccatttaatctctaagttaattaatagttggacaacgtacattaattagtatctttttatgggtaccttatgttgacataattagaggcatgtacaaacgtacagtctgatatggtctcttagttaatacatatcacttagagatcatacttatacaatagttgagacaacaaaacatttgagccattaatgcactaacataattttttattacccttattttcttatattatcaccatacaacaaattttttctttaataaatgctaagagccgactctgagccgttgtcatgcctaacaaaaatgtttcccttttcaccctcttctcttttccatgttatcaagtttatacttgaatgccaacggaaatagcacgttaattaacaccgttgtacatgccctaagcaatcaaccgatggtgtgcctgatcccaaggaccctagaaagcttcgttgcaatgagattcttgtccagctgttgggtggtggggatggtagtggtacatatgtcactgtgtaaagctgtagagatgagaatgctaaggtttttgacctgaaggatgggaggaaggaagaaagtcgttattgtttttgccaagagacccatgttttaatagacgattttgtaaaatcaaaggtgtttttgattattattttctgatgaacaattgggcattgtagattattggttttgttatttggaatttattcacgaagtggtttcggagatgattgggtttcacaggtgaatctacaggttatcattttatgtggtccggtcagactgggctctggtagccggtcagaccggcgcagtccgcggtctgactggccgacactgtgtcggtttcggtttcgggttgtttatttggatatccgagtttatttcatgattatggtttctagatggatactatacgtatgtaatactattgtttgctgctaatgagtcaagttggagatagcttggtctcggaatatggtttctttgtttgttccatgtgtaggtaactcgatgtctcgggagagtatttgcggtgatggaccgggagtcggcttggggataagacgacgtccggggtggtcagagatcatgcgggatacttatgctagagttgatgcacatggttaatggagattccatatggcatacgatggagctattgtgtgcacatgggatgcggagtcaaatttggaaggagtccaaatttggtatgtttggttatgtaaagtttctttcttgtactagagggtttcctaaggtgtttaggactcctagtatgagtttggttcatggctttagactgcctacctcatgtataaatagagggggagcgtgaggcttcccggtatcgcttttcagagcaatagagttgagttttgagttagggttttgagtttagtcgaaatttttgtaaggagtgctgttggtgcactttgtaaacacagagagaatcaataaagtcgtcatccactttaagagttcttcgatttgtgtttcactgggtttcgacggtctaaccggcaactcaccggcggtcagaccggcggcggcgacaggcgcggcaggcgatctcggcggtcagaccggagattcaacaccggtcagaccggcggcatccactcggtcagaccggcagatcaatctcggtcagaccgcgatccgtcaattttgagggtaacatttatttccgctaaaagttttcagtttttgggtataccaaccattcaccccccctctggttggcttagttcttgtgattcgatcctacaagtggtatcagagccttgttttcttctttggatttttattgatctagagtttttgccatggctactcccgctaggttttcaactaagccccatgttttcgatggaacggatttttctcattggtgtagtaggatgcaatcttatattatggctgaagattatgatatttggagaaaagtttctcatgcttatgtgattcttgaagctattaatactgctgctgaaaaaactgtttttgaacaaaattgcaaagctcgcaacattcttttgagtggtatttctcgttcggattctgatcgtgttgctcatcttcaaactactcatgagatttgggttgctttgagcaattttcatcaaggaacaaataacattaaagagcttcgtcgagatctttttaaaaaggagtacattaaatttgagatgaaacctggagaagctttgaatgactatctttctcggtttaataaaattttgattgatcttagatctgttgattcttcttatgatgctaattatccacaatctgagatttctcgtcactttttgaatggtcttgacatgtctatttgggagatgaaagttatatctattcaggagtctgttaacatgtctagtttgactttggattcactttatacaaaattgaaaacacatgagatgaatgttctttctcgaaaagctgattctaagtctagtgctttggtttcttcttcctcgtctttggatgttgatgcttcttcatctaagtcttcttttcttgctgtttttaatgccacatccgatgatcaactcgaacagatcgaggaggaggatttggctttggttgctaaccgtattgctcgagctatgaataatgccaggaacaggaaaagaggtggtccaaatcgttgctttgaatgtggttcaattgatcatcttcgttcgcattgtcctaagcttggggaggcaaaagagaagacaaagatggtgagaagacaaacaacaacaagcccaacaacaacaagtcgaagggttcttaccaagggaggaagatggagaatcttaggaaggcttttcaacaagtttgcgccgccttcgagccactaagtgatgtagatggtgaaagtggagatgatgacaagggaaagaacgtctccgatgtttgcttcatggcgcatggtgaatctgacacagagtatgaagataatgaggtgagtacttttgaggaagctattaatattttgagtgcaaaaaataagaagtgtgag

SEQ ID NO: 27033 - DNA, 3468 bp, Oryza sativa
acagcatgcctagctatgatgaatttctggtgtatgaaagacatggttaatgaattatatttgtcccgagataatgaccaatgtagttatatacgcggaggcatgaaatacacttctcagaaattctatgccctcaatttcagaacagtacgcggaggcatgaaatacacttctcataaattctatgccctcaatttcagaacagtcaaccaccacaacaccttatatggataaggaagagtaagtgtaacttaaaattgaaggtttttttatgactccttttgatggatagactgaaccccagcccatgtcatgttggatcataagaactttgctccaccagattgtgatttggcatgtgttttctgtagtcatcaagctctagagacactaatttttggttgttcttccaataccctttttcagttgcttgctggaatattgtggaaataataacttaggacacatccttaagtatggagaaattattgttggttgcgtggaacatttggaagctaaggccctgtttggttctatgggctaattattagccctcaccttttagccctgaattagccctcaaggatccaaacaggagggctaatttgaggttaaagtgaattagccctcctcaaaacattaacccctctatggggtgctaatggggataattttgtgtagggaccatcaaaaagcagctctttctcttcctctctcctctctttctactctctctccaccttttagccttgaattagccaatggatccaaacataccaccctagactaatatttagcctaccaatttatgactaaacattaattagttctcaaaattagccctgggctaatctttcaaacagtgcctaagtaatggttcgatcttcaatcataattcacctacgttgctttcttggacacaccttttcaagtgagacctcttgctgcttcttttcagacttaatgagagagattagaatgtagtacagaactgaattatactgctgtaattgttttttgtttttttcttattaacaagagttcttaacagcaagggagcccctgctgttttctgatcggctgttgatcaagaaatttcaactttgaactccaaatgtcaatgccaactacttttagagccagtgaatatactagatataaaactgtgcgataatctaattcggctcattgcaagtatgactaacacatactagaagaagcatttcaaattattcaggccggtatataaaaaccatccatctcttcccccatgagcccatcgggcaaacacttttcctgctaggccatagctcacatattcttccagtgtgattgtctatatctaccttgactttgacgagacgacaacgaacaccaatttgcagtaccatcctcttatcatttctctcttcaccatattacacaacactctggtctctgagtgtgtgtgagaatatcaattctagcacgcatcgtcagacagtactgtaccctcttcagaatcactagaacaactatatagcaatttgatacttgaatgtggtcatgctatgaagcctgtattcccattgcctcctaagcctactgcacttcatgcatgcacccagggaacaacttgggcaggaggactgcacaaaaattctaataggcttagagcaagaccaattagatgtgtagatgactgtgtgagcaatggcacatgccttatatgtagggcaaagcagaggaagaaaataaatggtttcaatagatgcaattgacacctctgtctattccatacacctagcgccgttttccactccgttccctagtgccaggatttattgccgccgtcactgcctgctaaactgtggcatcatgtagtgacaaattaatccactgccctacaatgggtgaattccttgttcctgttgcatcctaaacctactaggatttgcactagctagttaaccaactaaggcagaggtagatgaaatggaacaatagagaattaagagcaggatcgagagataagataagataagatgactgtacctaagcaatgtgagcagatgagcaaggtcatgatgattttatcattgccgaaacaaaaggaaggaaataaatagtttctatcattgccattaacaatgtcttttttgggggattacatgatttacgcttcggtatacaaatattagagcatacatagtgcatggatgcacagtagaggtaattatgtgaatctcatgaaaatcatgttgaaaattaaatctaccccgtgcaagaacacatggaacactccatgtgctacccatcaatataatggttgtgaggcgcagaagtaggagctccgggaggccgtcgaacactccatgccgctgccgctgactgacagggtagaggccatggcggcaaggctataggcttgtctgtgcaccgcgtcgccggatctggctccccttcgctagatacggcaaacccccctaatggatcaggcttcttaggcgagggacgccgactcccctgcaatggctccctgtgacagggaggcggtggcatgcggtgaaggggcaggcggtggaggtgccccacggcgatggtgtcacacgcgtgtggatgagagttgacgagttggctagtgaggcccgtcttgatggtagcgagtggtgccggaggcagcgagaagaaggatgcgtggaggtggccgatgatgccatgggtgggctgaggctgactgacgaggggcatccggcggggaacgaagggaggctagcacgacgcaggtggcgtcagtggttcaggaaggctgatgctggttgctccaggaggttggttcgggcgatggcagggaggccgccccggtcgatggcgcggagggccgacgaaagagaggtcggtgaggctatctggtggagggcgtcagtacagtggtgaccatgtaccgatagaggatggtaggtggtggagctttggagctttttcttcaggtcttcatggaccgagcgacatagtaaagcccagcttggtcttgccaggtcgacaacaatggtgttttaggcattgttttccatctttggggcattgtcgagccacccctcttcctcaggtgggctaccaggagaaaacctattgtcttggttctccttgagatctcgacggatggcgatgtcggtgttcatcatcgtttttctcactggagatgtcgtcaaggaagcctcactgcgaaaacctctctcgggggctaggccaaaccctttgcccccgcgtcactcccagggtaggggcgacacgggaggcgacccagccgccaccaccgcaccacccccaccgccctccttccacctcgccgctgcccgagcgggccgcctgaaaccacgcggccgcaaggacggcggcggtggggcctcctccccccccaaggtcacagtgttcggagcccacgactcccgacctagctctggggcagcgacttcggcggctgcgacg

SEQ ID NO: 27034 - DNA, 1442 bp, Oryza sativa
  unsure (1)..(1442): unsure at all n locations
cggcggttgtcccgtggctgtgacggcgcggtgcctggcggcggcgttggcggtgctccacagatccgcgcctctcgaccggatcttgagggtggcggcagttggtgacagcggtggtggtgtggcgacggtggtggcggcagttggccggcagcagttggcaacggcggtctcggccggatctggacgccggcagcagttggcgatgacagccgtggtgtggtgatggcggcagcggcgacagttggcaacggcggcggcggtcctggctgtggtggctgccgtgtcaactggcggcggtggcgaaagacatggcgtcgggcagctagctgctcggtggtgaaggacgacggcgcagcggcagtttgcggaggcagcggcgacggcggcagcggcgacggcggctgcgactctgaggtggtggctacgtcggcggcagggaaggagtcgggtgcgaggtgaggatgacgacggcgaggtggttgggtgttaggcagcggcggctgtggtggtggtgaccatgtttgcggtcaccggaggcatggcggcctcggttgactagccgaggacgtgggagacagctgcatctggccggcgcggcatcgttcggtggaggggtcggagaccagcttggcgcagagaagcgcagccgatggcagcagaggccggctcggcgcgagaggcgcgggcggtagagatggaggccggcttggcacgagaggcgcggccgatggagggaggccggattggcgcgagaggcgcgtccggtgaaggaggccggcttggtgcagagaggcgcggccggcggtggaggaggcgatctaggtgtgaggaggtgctgtcggtgagtgtggcgcggtcttcggcgcactaaggctgttcggcgggggacgtcggtgcaggggtctcacatgtcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 27035 - DNA, 28046 bp, Oryza sativa
ctttgaaggtttatttgtctctagcatagcttgtatgtattctgatctttacatgagatttagattttgcttttaagggagatgatgcatgacacttaaattctatacttgaattaagaaaatatgcaatgttgatgctagcatatggtttgatttgtaaatgctctatatatatgctttattgacttgttattcctcaaatagctttaattgctcattgtgaaaaagagaataaaaatatgaaaaaaatgaataccgaatccttggaaacagtcttgacgacaaggacgtattcgatgtgagcaaaataatgggtgccaaatccctagaaacaatcttgacgacagggacgtacccggaataaaagagaaaaatatgagcacaaaggctcaagaaaagaaaaggttataaaaaaaattctcttggttattttgtgctaaagtttatttgagaaagagtgataaatgcaataggtatatgtgtttagtgtttattcttcaacctatgtgcttgttaagatgttgcattctaaatcgtatgaaatcatgaattttgattgttgattcaaacttaattgtaaaatctttggttcatggttatactttaatgcatgcttcttttgttatagatgggttcatcttctttttattgcaacacatgacttgatatgctatatgtatgctaagctcttgaacattaatgaacataattcctatgcttgatgaaatcattgtcaaaatggggagaagtaatgtgaaaatttttggatttttggagaagcaaggtgaatttttggaaagttgttgagtagagcatgtttttggttcaattgggaatttctttcttttaaaaagggggggaagttttcttttggatttttcgaacacttgtacgaagtgtgctttttaccacttttgtttttatttttccaaacaccaaaacattttttatgagtttgccaatgtgttcatcaagggggagattgtaaaatcaaaggtgtttttgattattattttgtgatgaacaattaggcattggagattattggttttgttatttagaatttattcacgaagtggttttggagatgattgggtttcacaggtgaatctacaggttatcattttatgtggtccggtcagactgggctctggtagccagtcagaccggcgcagcccgcggtccgaccggccgacactgtgtcggtttcggtttcgggttgtttatttggatatccgagtttatttcatgattttggtttctacatggatactacacgtatgaaatactattgtttgcctgctatgaatccagttggagatagcttggtctcggaaatggtttctttgtttgttccatgtgtaggtaactcgatgtctcgggagagtatttgcggtgatggaccgggagtcggcttggggataagacgacgtccgtggtggtcagagatcatgcgggatacttaggctagagttgatgcacgtagttgatggagattccatatggcatacaatgaagttattgtgtgcgtatgggattaggagtcaaatttggaaggagtccaaatttggtacgtttggttatgtaaagtttctttcttgtactaaagggtttcctaaggtgtttagaactcctagtatgagtttggttcatggctttatgctgcctacctcatgtataaatagagagggagcgtgaggcttcccggtatcgcttttcagagcaatagagttgagttttgagttagggtttcaagtttagtcgaaatttttgtaaggagcgctgttggtacactttgtaaacacagagagaatcaataaagtcgtcatccactttaagagttcttcgatttgtgtttcaccgggtttcggcggtcttaccggcaactcaccggcggtcagaccggcggcatagcggcggtcagactggtgggagcacagcggtcagaccggcggcggcgacaggcgcgacaggcgatctcggcggtcagaccggagattcaacatcggtcagaccggcggcatccactcggtcagaccggtagatcaatctcggtcagaccgcgatccgtcgatttcgagggtaacttttatttccgctaaaagttttcggtttttgggtataccaaccattcaccccccctctggttggcttagttcttgtgattcgatcctacagatttatcttgcatcagaatgagctgtccattagaccacagaatgtaagaaaatattgtatcagtgtgcttggccacaactgggtcattcaagagggaatgggtcaggtctggacggaagtagtagagaaatcccacaaaaattatcttcactggttttttttgtgagattcattgatttatcactgacattatatatgcatgtgttaattcttctgtctataatgttacatcttccatgaaatccatagaaaccatttatttatccctcaatccagtggaattggcatctggtgatgcgtgaaaggtggagcaatgtggctcaggagggacgtggaaatatattgaagaaaggtattgcacatatggctgtattattgttaagggatcatgagttcaaaagcgacattactatttattatgtttccatgtgaatcagggaatggggttaaggataatcgtatatacctttctccactctccatatacaaaattaacaaattacaagcatataaccagctcgatatatattggacagaaggcactgtgctcatgaggacgatgatctgctttgtgtgatggcccaagagaaactttactggatctgttcttttcgtgtccgtttagcaggagctgctgggatcgtcttcgaattagatggaattcaaatttgggaatttatcaaatgttggtactggcaaagattgcagtttagaaggaagggtttccttgagatcgtgtcctttgcttgctattgttggtaaattgtaagatcaaagtgtgttttgattcttattctgtgatgaacaattggcgtctgtgattattggttttgatatttggagattatcgtcgaactggttttgaagataatcaattttcaggtgatgaacagggtttgctgttttgtcgggaccggtcagaccgggcggaggttgccggtcagaccggcgctatgtgtgcggtcagaccggccaggcccgcggtctgaccggccgacgctgtgtcggtttcggtttcgggtagtttctttggatatccatgattgtttcatggttatggcttctagatggatactatacgtatgtaatactgttgtttgctaacaatgagttaagttggggatagcttggtctcggaatatggtttctttatttgtttcatgtgtaggtgactcgatgcctcgggagagtatttgcggtgatggaccgggagtcggcttggtggtaagacgatgtccgtggtggtcagatatcatgcgggatactaaggctagagttgatgcacgtggttgatgaagattccatatcgcataacgataaagttattgtgtgcgtatgggatgcggagtcgaatttggaaggagtccaaatttggtacgattggttatgtaaagtttctttcttgtactagagggtttcctaaagtgtttaggactcttagtatgagtttggttcgtggctttaggctgcctacctcatgtataaatagagggggagcgtgaggcttcccggtatcgctttgtatcgcttttgtatagcttttgagagctagtttagttagggtttcgagtttagtcgagatttttgtaaggagtgctattggcgcactttgtaaacacagatagaagcaataaagttgtaatctactttgagagttcttcgatttgtgtttcaccgggtttcggcagtctaaccggcatctcagcggcggtcagaccggcggcatcgcagcggtccgaccggcggcgtaagggcggtcagactgacggcggcaacagcaagcgggagctgatcaggcggtcagaccggagttccaatctcggtcagaccagtggctttcagacggtcagaccggcacgactacctcggtcagaccgcgatccatcgaattcgagggtaacttttatttccgctaaaagttttggtttttgggtatatcaaccattcaccccccttctggttggcttagttcttgtgattcgatcctacagtaaaggcatatatggaggcaaagaaatacgaaggtttttgataatgtgctaccaagtgaagatagttgatttgttgcttttaaaaatgagattctcttacatgtttgtgggatgaatgaagtccttagctcttctgtcctcagctggttacaacttcttgtaatttaaggctttctttctttgttctcctgtacaatgttgtaaatactctttcttttgatatataacttctaggctaggcctggtagtattttaaataaaaaagaaccttcaaaataatattaacccccattagtagatctgacttaatgatgagaccatgcatttttatagacaggatgcaaccctttctcaatcaagtacggccaaagtaacgtgctttattcatgagaggatgcatttttatagacataatgcaaccctttatcaatcaagaacgccagaacaaatcatcttcaaattaatctcgtcgcgccaccgggcagccattctgtcccatcgctgcaccaacgacaaaaatatccgtggccattcaacttgtcaccgatggcctatcgatctgccgcgtcgaattggctgagaagggaaggattcgtcgacttttttgtgcccgagttccattgaacgtcctggaatggaggtgatttggatgggtatctgggagctgcagatcgctgctattaggggtggcggatggagtttatgtgtgtagtgacgaaattgctaatgcgcaaccactccccccccccggtggacacgtggcgcgtgcagagagggccccgcggagaggtgaggggctgacacgtcgctggattttccttttttttttttttctcttttcccttttttgcggttttctgtttcgtttttttctttctggttttttacacttcgggtacgtatacaaagtttgtatacgtgtataaaactttatatacatgtattttttttgtttttaaatgtacatataccaattttatacatatatacaaagtttgtatacacatatataaagtttgtatacgtgtatacaaagtttgtatacgcgtatgtaaagtttgtatacgcatatatatacatatgtagactagtaatagtaatacatactactagtagtagtagtactagtactagtagtagtactagtactactagtagtagtactgtagctgaggcgccgcgcgcaccgggggacgcgcgactggtcgcgcattagcggccaccgtgtagtgatttgggctcctcatgtgcttctttcacaattgttgtattagagcaggtacaatagcaagctataagcctgatataaccacatatcgagaagaaaagaaaagagagataagaaaacggactacagatttatagtcggctgcaacatggactctaagacgttatgtgtgtatgagaggtgggaccgtgtattaatggtgtagtatatttttataggtaactattgtattaatggactattagattagctatagatgatttggagctagcagttggctatgctattgaacttgctcttaagagcaggtataatagcagactataagccagctataaacacatatcgaggagataaaagaggagagagaagagcagcgggctacagatttgtagctagctacagcacggactccaagagataatgtgtgtatgacaggtgagaccatatattaataagggtaggatatgtgtataaagaaatattatatgaattggctattaagttgactataggtgatctggcaactagtagttagctatactactaaacttgctctaagagcgagtacaatagcaggctacaagtcagctgtaagcacacgtggaggagagaagagaaaagaagagagagaaggaaagggggctatagatttgtagccagctgcagcacggactccaatacgttatgtgtgtatgagaggtgggaccatatattaataatttatatataactattgtataaatgagctattagattggctatagatgaattagagttagtacttggctatactattaaacttgctctaggtagtttccgccgtgattatcgaaggggcagctctttgccttctcaacgcatggagtgatctggaaagttcacacggccttctgggttttaggaaatatttctgctcgcgcgaccatgaatggaatgatgctccatcctctctaccacatggcagattttcagatgagtacacttgatttctaggatgccacgtgggccaatcaggtaccagggatggtaccctgaaatcggtatttgagaagctctacacacggtgccatgtgccccaatcaaaaatcggggtttaaaccctgaaatcggtattagagatttaccctgtttcgaaaaaaataactaaaaaattataaggcgcgcatgtgtttttatgcatccatatgttacgggcaaagattatgtggagaagaatcaacatgaatagggatagattggatttagtagatgaaataagaacgtgactataacacgcacggtatcgcgttagcgctaaccagcgatgccctcaatttccaaaaatggaaccgcgttcttttccccacgcgcgcttagaatttccgaaaaaggtactgcagcccacaacaacaccttcgcccctgaacccgtggacagcataatgaagaatcaaacggaaaaaactcacgaacagctgaaggtggagagaaaaatcaagaacaagttgagaagaactaggtcccatgccctaatccaatgtagaaaacaaacccagacctatccaaatcacaaactttgtaagaagtttacatcccacaaatttataatgctatgtcaaattcataaaataaaaagagcacaaacaagcatatcaacttggaattcatgcactaatctgcagttcttttctctcagaccccaaaatccaacaagttactttgaaacatataaaaatgaaatacatgtaaaagttgtaaaagttacttcctactaacatgcaagttacttttaaaatttgtgcgctcattttggatctcttacatgatatattttgttaagcgattttaggtccattgctgccgtcactgcagcggcggcctgatagaacggacccttttggaactttaccatcgacagcgacagatgaaatgagacacattcttcatttaatcaaacaagttcaggctttcagagattctttctttcataaggaaatggatgaatcatcatttgcagaaaagctaaatacaaccatgaatcagttctgaatccatccatccattcacacgtgcatgatcgatgcagaattggattatacagggacacagattgcgcatgcatggagaagatagacatatattactaacattactgcatatacatattccttcttctagctagtgaaggagagggggccaaatgaacaacatgaggagaggaggcattgctaatgctaatagtgtctcatggcattattgaaatatgccaaaacaataaattgacagaccctccctaggggccacttttggctagctttcagttagtagatgttactttccctagctgagaaacaaacttacatgatcatatttggcttcttggttatatgtaagttacttttgaaacatatagaagttacttttaaaatataaaagttgcttcccagtaatacttaagtttcttttagttttattgatcactttttcatacttgcaggggcatatctaaagtgggtacttttagtaataatttggataaaattaagcttccatacccaaatccttttaattagaaagttatgtataatccatcgcaaagcttagtacctgaaatagttatacagaaagttacttttaaaatatataaaagttacttcctagtaatacgtaagttacttttagttttgttgatcacttgtttatacttgcaggcacatatctaaagtgggtacttttagtaataatttggataaaattaagcttccatacccaaatccttttagtaagaaagttgagtataatccatcacaaagcttagtacttgaaacagctatacaagctatacagaaatttacttttaaaacatatgaaagttacttcctattaacacgtaagttactttttaaaatatgttgaatttatgctcatttttcatcttttaattgattacctgtttatactagcaaacacaaattggaaccttaagtttcccaaaggatcattgtttttgttgtggatatacgttggtctgtacagaaccaataatatcccctagaccaaacaacaaagaaaaactaattgctctagtgagtcagccgtgctcatcatgttcaatcatactaatgtcaggttcgaaactgatgagttaggacagatagattaaactagtgttgcatgcctgcatatagttagtaaaaacagtaatctatcattctatcctgaatcaattgatgaacatggatgaagagtgatcgagccttggagaacgagatgacagtgaaataatcaaagttaattaggaaaaagggaagaaaattaccagtcaacaaatgaattggaaatcactgtactactgatcccgtttccatccatgacagtatgacacatgtattttttttttcgagcaaccgacgacaggagtttctcctgccggaatttatagaagaagagaattgacctagttaataagggaaacagggcccgaaaaccgaacaagcacggttaattagacaggaaaccggcaaaacctatacataaaaggaaaagaaagcaactattgagacctcacagaagtcgtcattgccgagcttaccaaaggcaagcagctttgacaacataacacgaggtctccagaactaccaaacgtctactagtggagcagaaaccttctaagcagagcctctaacaagggaacaacatcaaggatgctatcaatgctcattccgaaaggaaccgggttttcacctgaaggaagagagagctagcatgacgatacctccaaggagaaaacggtgcccacaggcgtcgatatcgtcagcctaggaaagcactaggcaaggttttcacccgaggctctctcaaaatgctccacctccaacccctcgcctcgttgccgggacgtttgttgagggtcatcgttgccgagcttgcaacgacaagcagctccgactccgcctcaatagacaatcccactgcagctcgaccagagaccacctcacatccagtaacccagctgcaacaaaacctatggcacggccgatgaccagagagaagatgtcagaaaacaactccgcacgccacccctaacgagccaaggagctacccggcatcgactggaagcagcctagcctaagaagggaggagcgcctaagaagaggggagcggtcgccgcaccgccagtgagcacaggaagaacaaccactgaagaaggggagaaccggatctgagaaagaaacaggagggagggagatggatgcgccatcttcgttgccagcaaccgcaccagaccggctgcccccggctagcagatgcaaccgccgccgccagacgaccaccggggtgccgccgccgccattccccagcacaccgggtgccgcccgccggggcgccaccgccagatccaggcgcggatctggcggcctcttcctctgccaccagcgcctccaagctctgccgcctgttaacgatgaaatttggtaaatcatgcatcggatttggagttaaggccgaagcggatctgagaggaaatcgataatggaaacaaggtatgaatcggcttcagaaccgcatcgactacagtgtgcattggcagttaccgaatcggacaaggcaagccgttgtaaccgattccggcaaggtggtaatggagtcattgtcagattgagttgacgtgcttcatgatgattgccacgtacggatcgagtccgaagaaggcagttgtaactattaattaggaatagtttgttagtttcctttttatccttaggaaagtgtgtttagtgtccgattatgactttatgttttccttttatctttaggaaagtttctttcttgtcctacaaggactagtatctacccatgggtataaatatgtacacccgtggtcattgtaatctatcgctacgatcaatacaattcggcgcatcgccaccctttttacttctacttttgtttttacgttccggcagaacttggcacccgacgcggggctgcatcgtcttcgatctccggcgaagggataagtctaatgttccaccggtccaggcaattgtatcgtctacgtcggcatcgttcaaggctgcatcagtacattcgacctcttggattactctggtttggataatatatttgcctagctatttatcatatgtctatgttaatctagtcctagcatctcaatttagctctatcggctgtctctcgctttagggtttctgccggtatcggctaaatcgccttgctagattagattagcctaggcatctaccaccctgaaaatcagtcaacggcttgattgtctagatattgtgtttcttttcatacttagtgctgcatcagttaagtttgatctactaagtcgtgcttagaaccataatctctagcctgcttcttgattgccaataagggtttcatcggggtttcagctaatgagttatctggacgttgcatcggcttacaaggattgcatacatattggatttagccgatcgcaacaaaggttttactgtttaatctaatcttgtggattttatgatatcggaccaccagccgatgtatgctttaaccttcagatcagtgcttattatatcttgtttctagccaattggtttctactcgactatattgttattacatcatcaacagccgattgcatttatatcattatctacattggacatatagccgattgcttaaaccctatcactatcggctggtatcggcgtcggctggaatcactacatcggcttgtcagccgatcggctgttttatctgttgtttacatatattgtcagttgcaggatcaaactgactggcacacccgcatctcatcaatctttggacctgcacaggagttaagcagatctcccaggctggtgttttcgatttttttcgtcaacaccgccaccgccgccatccccgccactcccatcagaacgccgccgccccaatgcacaaccctgccgccagcttcctcccctccggccagccagagcggatctgggcggccgccgcctcccgtcgccgagcagcccgcgaagcgtagccccgccgccgctatccttgtggccgtgcggctttgccgacggctgctcgggcggcggcgaggcggaggaggaggaagggagaggcgggcgatggcgggctggttgcctcccgtgtcgcccgagggtaggcgacacggagggaatacataatgaagttatgacacatgtatgcatcgatcgggcatcgcttcaactattgacacgaataggtgcccattttgctgcttacctgcctactcccactgcaaattagcatccaccgcccagatggggattgggaacaagaaggatctactattgacgtcgtcctcagactcgaacaactcctcttcctcatcatcttctctgtccttgtcgctgatgcagatggcttcatcgaacaactagagaaccccacaccggaattgctgccgccattaaggagaacgagggcctcgccaccacgtcgctggagcacttccgccacttggcaccaggggcgccggataggatggcgggcaccttgcacttccccttcaccgccatggggagggaattgggaaagcgagtgaattgggaggagtggagaatggagatggagaagagagagaggagagggccacgctagcccaatcgcatcggcaatcggacaggcgtgttgtcgatcacatggatcaccatctatcggacggccccgtacagcgtcgcgcgaaagcgcaaaaacgagagcgatctcgatttagattttgcgatgaaataacaaggaacggtcctgaacctaaacaacgcgacgctctccgtcgcactgagaaggcaggctgatgggcactaagataaatctttatctaatgcctaactgacctaggatagtatccctccttatatagatggatgactccttaatctaatcctaacaaaccttatctaatcgtaacaaaccctaatcctatccaatgggcctaggacgtccgacccaaagcccatggcattactcccccccccctttttgagaaggtcgtcctcgagctgcaccacaccctgctagacttcaaacgaaacaccataacctaaactaaaactcttaagccttttgcatctcggcttttatgaaaaaacagaaataaaaaacaatttatgcataggaggaccttagcctaaggcactgaaggagaggaaaagcccattccatgatccaaatcgaaaggcccagaccaaaattgcttggctcaaaatatgagaatgatccacctttgcgtcataggccaacgtggaaaccacccagcccaactgagagagggtagaaaccctatctcctttcctttcaggagaccacgccgctaggagcgacgcagccgtggttgatccgccaacttcgcaaaccagtgtgtggggccggtgcgatctgcgccatagcgacgcgtgaatgccacgcccacctgtcgcacctacgaattacaccacacgcacgccgccaagctctgatccaaccatcaccggtatgtgcgcctccacctgtggaaacaaagccgcatcgctggaaaatagcgcctgaaaatcagatgcctgtaccgagttgtatcgctgtcgaagtggaaatcgccatcgtcttctccgccaccgttgagggcgccaatggcaacggcgccatcgccagtcccagcggcgaggtcgaagatgcactgccactcccggacttggcaccgccggaagaggaaacatgagcgcctcgccacgagtcacgccgtccccgcgtggttgcagcgtcaccactgaatgttgcccccatccgtgctgcttgaagacacgccctcgcggacgcaaggtcaccgcatgccggtataatggttcggcctcctcaaggaaagccgttggatcggctaactgagccgccaaggcccggagttgcgccgccaagtccatcatcttctttgagatctcggcaaggccttcactgatgttgggaaccgcagcgatctcagcacccatgggcacggaaccgaagctctgataccaagttgtcacaggcaaggattatgtggagaagaatcgggatgaatggggatagattggattatagtagataaaataacaaggaacggtcctaaacctaaacggcgcgacgctctccgttgcactgagaaggcacgccgatggacactaagataaatcttgatctaatgcctaactgacctgggatagtatccctccttatatagatagaggactccttaatctaatcctaacaaaccatgatcctatccaatgggcctaggacgcccgacccaaagcccatgacaccatgcatgtattgtgtatgtcatatgcctcccttctaattaaaatagaagttcacttttggtctcagcaatgggtagttacaaacatgcagccgatttatctatgctacgtgttgtgatagtaaatttctcaggtaccattattatacaccaaccatgcatgcaaataacttctttgcaaccgatttataggaagctcaagtgagcacttccattttccatcgcacactcactagtctggtgctaataaatttctttttttttttgagaaacacagtacaaacgcaggcgctcacaacgtgcgcacactcacccctatatttacatgaatttgcacattttcatatttacaaccttttatgttaattatatagtaggcttatgaggtatctggaatacaacagaagcatgaagccaatatgattgataggccaagcaggcgagaagttctgggagacgggcaagcccttacaaggaaatccaagaccctgtaattaacagcccactaatacatataccaaaggtgctagtgaggggccgtttggtagaaatgcatctagagttctctagaggtgtttatatcaccacccaataccctggtttccacccaaatccagctaattaacatcaagtccatgttttatctgttcttcatggagcaaacaacttttttttactgagatggagcaaacaactttgttgttgctgtccagaatgttaattttcatgctgcctcaagaggctttctgcatcattgctattgcttgtacttactatgtgttatcttaatgcatatgtgaatagtacaatgttttagtttgaagcaagtttgctccttggctttgtcaagcttcgacatcgttctttcatcgatgtaacttgcaacctcttattcccttcaatcttaatgaaattgtttggcctccttcgatagtcctggcaataatcagaatgtatataatatactccttgcttcacaagtacggattgaattttatgttcttatgtcatctatgccacaagacttgaacttctaccaacttgatgcactcactactaaagaaacacacaaaagagatgacactataggtgatggaaatgctaaaattggtacatgtaatgcttttcccacctacaaaagatgaaaatatagaacaggcacctttaagcaactatagatgtcggttttagagaaaaactggcatcaatactataggctaggcggcagaacgagcagcggcggcctccccttcctctcttgtgcattctttgatttggtttttgaataaacttattgatgaatgcttggttctatgatgcgaacttatcgatgaatatttgattctacgatctatgaactagatgattctctgatatgaacaagaacttgtctcattttttgtggctttgaggcatcggcttgaagtcaccagagtcaagtcgcctttttttcaaaccatatacctcaaaagtgtcggttcttaaaccagcaccattgatgaatcctcattagtgccgcctgctagttgctggttgccaaatccggcacccatgtggggttggcaaccggcatctaaagggtttttttagtagtgagtaatcttaaagtaattgggcaaattaagctaacattacatttattgctctcatgaatgccaatttagtcaatttagtcaactccaacagggataaaatactagcaataactcttaacagtgttatatgttttgcagtacgtataaatcgatggacatcaagcgcatttgtggtgtgctgtactagtaatagacgaacattatgtatgaatatgtagctaataataaaaatcttattagattgaatgttttttatcaccatctctattgtacatatcccaaatgtttttctacatcgatgtatttcacagttgtgtgttccataataggattaaagcatcctgtagagaaattccctctggactattttggctgccaaccttttcaaaactactagctactgtttggatttttcgtgtggaggtaacatttctagatttgtcaccaaaagtactttcatgtaattatgtttttcatatttatactgaagtaaatttgaaatagtgatgatcaaagcattgactggaaaatgtctcaatgtctaaaataactacagatgtaattatcaatttgttgtcccatgggctctactttcagtggtttcttcagcccatgctcaattttgctagagtctctcaggaacctgcgtagatgcatcttgtatagtgtcaagaagttcatatatgaaatgaattttgcataacgttttctgcaagaccgcaagttcctgacattttctatatatgtgtcatattcatggatcaaacgaatgattctggttgagaactctcttgttgattccatttatttgtaaagttctagaccaaacgcatcatgtttgcatgacccatctcatttcaaatttaattatggataattttaaactatatatattgcatagcataagcattgtacagcacactgagtacagtgaaaattcatttaattttcattaatttaaaatattattgacattgatcacaattcctccttgctaattactttcaaacagcagagaagtggttgagatatgaatttatacaaaatcatacaacctatgcatgtgatttggttgtgcaacaattgtcaatcatcaaatcaacatcgccggctttaggctccatattgtcaacttgtttggtggcaccggtttattgttttaccggatgaatgaaattggtggctgatactcactcattttaatgtgctagggttgatcagtgttgtggttgcgctcctctgctagaatctcttgtggtaattgaagatatggaacccttttgttttcacttatataacaacagggatctagtttcttttattttttaatatattctaccctttttcacaaaaataaaaaacttatatgtgggtgcatgtgttttcccttgtgtataagttcggcctcataattgaaacaaaagttcactatgggtcacaactcacaataatgggcagtgacaaccaatttatctcatacaatggggctggcataacgaatttctctcaggtaccgttattgtaaaccaaccacgcatgcaaaattgcttctctacaagtaccattgtaggatattaaaaagggggggtgctggtgtggtcggccacatttgcggagataaaataaggggtttaacaactcaagtgaacacctcgattgatctgtagctctgctcccaatgcaaacacactatatttgtgctaattttatttcaagtagctatgaatttacacctagtcgtgcaccttttcgggtgcatgagatatgataggtttaggaggcatcaggattaatacatcaggaggcatagggactaatacatcagaagttggattagcatgtacaacagttatgtgtttcctctgtttcggactacataaagttagcatgagactttgcacatgttctcctacttctctcaatatctcattggtctttctttaacctatagggcatgcctttcgcatctaccagagagatttgtttcttaggttcatcttagcttacattgcttatatacattcatcttaattacagtctacaagcatgcatggctgttccatccacctgccatagttggttcctaggtgatataaagcctagtaagcttaggaggcaaacggaccttagaattgagcttttgcgaaagtgtggaagttgtcaccatagcttataggagtttatggtgtcagaggaatgatctaattttcagcaatgttaatccaaatttcattttaaggagaaatttgctatacatttgtatagagcaagaggagataaaacagcctggacattatggtttgatgacaacctttcatagatttttttaaaaaaaaagtattttttccttgtatgtatttataacttgtaaatattattcttttttaatataagcatctcctactattttcgggtaaataagttattgaatactttctttagctagtacttcctctgtttcacaatgtaagttattctagcattttccgcatttatattgatgttataaatgcggaaaatgctagaatgacttatattgtgaaacggaggaagtagaacattgtgtggcagtgcgtgcaagaggtgattgttaagcatgcatgactcatttctgcgattagaacgctagcgatgatgagaaaacgtgtatcgaatgcacatgtgaagttcattggcttgtgtggatatcccttgcatccaaaagtggctgcaatttcttttgcacatgtatggatctagctatggtgttatagatcatagatggtcagataaagatttctccgacctctacagacaaaagtcttgactagaagccattgccactacataacatcgtatagttacatgacatcaaagaaaacaaccctaatgagactaagtatggtagtgcacctcaatatagttttcctctgatattgtcggtatgtcaatgatgtctatgcagttgtactatttgttggccacaaacacatggatgtgtattatcttaagacaattaatgcgataacattatccttgtctctacacgccatgctcttcctaactactacaattttgtagcatttctatgttataggttatgaaacgatatcggattcataaaaataaaaaatatcacaagcctaagatatagattacaatttacattaacacttgtttgtaatgtacatggtttttccgtgtgtatgtctcccttataatcaaaataaaacttcactatttttcacagcaatgtgccctgacactgaatttatccaggactacagggttgagatactgaatttcttcaggcagtattattgtaaaccaaccattcattaaaatagctagcttctttgcaagtaccattgcggcctatatgagtatcagtgcactcatcctcatttgtgctgaacaaactgaatcatgcatggttcagcggaccccttccagtgaacacctctcctcttcaaattgctcactcacttagagtctctagactcatgctattttcttttcctgaacctctgaactcacacctagttaatacatttccgggtttaggctgtgttctccccccacccccccccccccaaaaaaaaaaaatcccaatccacctctctcgttttctacacgcatgctttttcaaactgttaaacggtgtgatttatgcaaaaaatgaaagttgttttaaaaaatcatattaatctattttttaaaaaaaaataagttaatacttaattaatcatacaataatacgagcttcgttttacgtgccggggaggaggggttcccaatccatcctctcgaacacagcctaaggctatgaaaaaactttctatatgaaagttgtttaggaggcatcacgattaatacatcataagcataaattcaatgcggttagaaaattgaaggctatggactggattcggtggacaaggatgatctcttggttgtagtgggctgtcttttgtatctagtcgtggtgtactgtgtcccagagcatatcatgcctcagattgcactgtgagaacaagaagaatagattcctctggcctatgagggtgcagccgactacggatccggcggggcgacgacagcgggtgcctcggggggggggcggcgacggcgtgcggcgtggatgcgggcggcagtggcgggctagggtttgggattttttggattttatttttcttcgtttgctgaatttattttcgcatgcggccggtataagcgaccgcttgtgaaaatcccatcttcacatgcggatgcgtcggccgcatgcaaaaagggtgtttttacagacgatttcgtccatgcggttggggcaatcgtatgaaaaatgcatcccaaatacatggaaagacccttttttagtagtgcgttgcacccgtcgtcatcgtggtgcccggcaactccgccagaaacgagaggcaccagatcagatcattaattagtgagtaatgcaaatgtgctagtatcaattactactagagttttctgcagtgaggcattactgtgcaattgaggtatatatatgctcccacatctacaaatgatcagttccacgaactagaaaagttagagaatttagatccaagagcttggattagcactagcaaatcctagcgacgaatgattcgtgctgcagggtggtggcgatgcagagggtatagacaccctccctcgacacgattgaggtcgaggggttgccaacatccgcactaacagttgagaattgagattggtttttgagttttggggcactggtgtgaacaagctgagcgaatacagtactacggtagaacctggctgaggtggtgtttggatccagagacttaactttagtgtctatatttagacattaatttagagtattaaatatagactatttataaaactaattacataaataaaagctaattcgcaagacaaattttttaagcctaattaatccataattagagaatgtttactgtagcatcacataagctaatcatggattaattaggctcaatagattcgtctcacgtattattccaaaattatggatgggttttattaatagtctacgtttaatatttataattagtgtcaaacatccaatgtgatagggtcttaaaagttttagtcccatctaaacagggtccaggtctgaggacggacttgtcgggcgggccatcgtggttgtaactagaggacatacgggcagccctagcaggtggggatgtcgagatggagagtttgcttgccatcgtcaaccatgtatatacagtggaaactacggtatcatcaatagtatatacgtatgagatttagctatatcatcaatagtaaatgttttagtcccagattcaattgtaaaacttttaatatcaatgatgtgatcaaatatcatgtgtccttttttttaatccaacaatatttctatgtttttattatatatatggtttgcgctatatatattcccactttagagtcactaacatgtaagtccacagcaaaaggagcccatatgtttagtgactcaaagtcatgtgagtcgcaatcttgcaatccaatgtgggggatagaagagatgaagagagagatacagaggaggggacactgacatctgctgagtcagccactgacatctgctgagtcagccagttggaccatatcaataagcctcgtcaacaattaccgttgtaattactgtcttggaagtcaaattagactggttttaatagttttagggtattacggttaaggtatataaattatatcgaacataaatttgagcgactcaagttggacttatttcttcagaaatttggttcataaatgtaaaagaaatgtgtaatgaggcccattgctgcagcccaagcatgaacaagcccaacaaatcagtgccatccattccatccaaattggacatctactatacataagaatggtttagctagaactattattaaaacgggcttcactagaataccattgtcaacagagtgcagtttgatattttgctatttttatcattttgggttaatgatgaaaaagattttgctctcttttagaaccttttgtgccgaaactgcccctagttttttctttcgtcctctctctatccaaaccgagcggcatctttttttaacgcacgttttttctctcgcgtctcttctgtcgacggtcgaccacctgtttttgtcgctcgctgaaggactgagccgaccgagtggcgctggaggcggaggtgcgagcaccaggcgctcgcagtggctacgagcgcaggtggcagcgggatcgggggtggcagggagcggcgaggttgggggtggcggtgaggaatggggagatgtggcgcgccggccgacaaagcggtggtgggcggtgaggttgggggtgagcgccgaggataggagtggcggtggggagaggtggcgcacaggccggcagagtggtggtgagcggcagcggcgtcgccgcgccccttctctcgcctattatgtttcctctctcacgattcaacaagttgacctagggatataatcatctgagaaaatgtgtaatttacaaaaaaaaaatgaaataccatcgacaagcaccctaatcctaaaaatgtcattgacaaaggcaactttctataaataccattgcacaagtctctttctcccaaaaataccattaccgtcaactccacaccattacaaccgttaatttttttatagtgaccattttgcccacagtgcaaaatatacccaattttcactgtcaaagaaaaagatagatgaaacaaaatttataaccctaaccctaccaatcctgatcctagcgaggaggtccatggcggcggcgcggtagggtgtggcggtggagcggcaacacgcgacgaggaggtccgcggtaaaggtggcacggggcgcggcgaggaggccgcaagcgacggcacggcggttgcaggctgcggtgcgggggctgtaggcgccggcgaggagaggcccgcaggcgtcggtgatgagggggaggagaggcccacagccgcagtcgcgaggtcgccgtgcaggaggaggctgcagtcctaacacgtggcgcaattttttcccttttgtttgttttcattcggcgtcgccgaaggggtggaacaagccatggcgatggccgccgaggtaggcgtcccagaggtggtcggcgacgttcttggccgacctgggcatggggagggagtactggtcaccttcaccaccaatggagaggagcacggtgacattcttggcgtgctggtagtgcttgatgtcggcgccgacgctggcgacggggtggccggagaggtcggcccagtagcggccatggccgaagacgctgaggaaggagatgatgacaatgttgtggaagctgttccacgcaccatttgttcaagaggatgaggagcactataacaacaaatgagagcagcagacatttttaatttagttatgtgtcgatcgttatctgcaccgcagacattttttgttgactaaagacaaatgttgtgtacgcgtaagtatacagaagttgcttgcaatgacaaaaccgaaagatgtctcctgatgaacaaatggttgtctagggataagattgtcttttcatataacttaacggagagatgttttttttttaggtttaacagagagatgttaatagcagtttgatggtgatagtatttttgagagaaagaggcttgtacaatggtatttctaaaaagttatctttatcgatgatatttctcggattagtatgcttatcgatggaattttatggattttcttttttataatggtattctatcgaagcgatgcttataccatgctagaaatgccattttctaattcacgaggctccaaccgcgagaaaggcgagacagaatgaatcctcgccggcgacgaggcgccgacacctccctccggcgactgggtctccgacctcgtcgccggtggccggacggggcagcctcgccgcacggggagccccatcgcctccgactccgtctcggagtcggattcccgccctccttatgggaaaaagaaaatatctcaccccgattcgatcgcgacgaaccctcgcactccgactccgattccaattccaactccaatgtcggtggattttatccctcgacgataaaaagggcgccacatcctccacccgagatcaccaaatctctcaattcccaaaatcaattcgcgcaccaaacctcccaaatccctctcccaccagttcttggattcgccgaggagctcttgtccttccatccatggcggcggggtggcgcgagacgcccgccgcctccgcggccttcccggtggcctacaccgccgtcctcgcgctctacctcctcctcggcgtcttcccgcgcccgcgtggcgccccgccgtgcgaggcgctgctgtgggagctcgccgactgggcggccgtggccgtctgcctcgccgccgacgcctacttcatctactgcatcgcctcctcccgccgccgccccgacgtcccacccgcggctgccgccccctcccccgcagatggatctctgctagggtttagggcagggcctcgccgtctcgacatcgtcagggagtgtccttaacccttcttttctcatcatgctgctactgttattttcttcagttaattaggaaggtttctttctggtgtagtttagttgttagcaacagcccttgaactgaaaccatggttagaatttggaagattaatgctgtagtctagtgtcaacaacgcttccttgtgctgctttaatgagcttctgcatcacaattgctacttctgctactagtcattgtgtgattaccttttgtcttgcaagtttctacacttattaggaagaattctgatgctcttagaatattgattagtcattagaatctagttttgttagatgtgtcgatgtagaaatagtcgattgcgttcgtgttcctttgataagccttctttccaaacttcaatcttgtttttgtaatgcatatgatcctccacatataaggatcaaatagtatattctattgtcatctgctctgcaagtcttgaactttggtttttatcatactgcaaaacacccctaatagtactttctgcagttactttttgtcacctgttctgctagtattactttctgcagttaggatgatttctgttgtactgtagttgttagcaacagtcttgaactgaaaccttggttagctagctgtgaaagtgtctcagccaattttctctcctttcttaatgaaacaacagagttcctgctttagtataaaaaaataccaaaaaaaaatggttagaattaggaagatttccaatgtagtgtagtgtccacaatgttcttcatgctgcttcaaaatcgctacttttactacagtcattatgtgattaccttttgtcttgcaagtttctgcacttaagtaggaagatttctgatgatattagtcattagaatctagttctattacatatatcaatgtcggaatagcatgtgccatgtttgtgttcatatgctcctacacatatagatcaaattgtatattctactatcatctgttctgcaagtcttgaacttcggtttttatcatagagcaaaacaccccaataatttccttttgggaaaacggttgagtgatcatgaggtcgagagttcgagcctctgtcaccccaaatattgagtgatgaggaaatgctcctgtgacaatcgggttcgtcacattcatctgaccatcagatattaagagctagtctgaactcaattaacttgaatcttctttttgtaatgcatatactgtactccacacatgtcgatcaaattgtatattctattttcatctgtgctgcaagtcttaaactttggtttttatcatagtgaaaataccccaataatttccttctgggaaaacctaactgccaactagatgcactagtctaaatatacagttaagggctggatatcaccattgacttggtctcttggttgatttattgctctgatgactaccaattcaggtcgcattattttgcacttgtgcctgcccccacatatttattggtcaatttagttggctccaaaagggtataaaatactagcagttactctaacatagttctgtgttttgcagtataaatccaggcacaccaagtggacacaaatatatagaatacatcatgacttttcaccatatcattcagtatgaatatgtaactagtaataaaaatgttattgatttgaatgttttcaatcaccatctatattttacctatctcagtaaacttcttagttgtatttgaccccatgtcctttagaattgcatattccttaacaaagggagcagttgatgagtgatcctttctaaaacagttatttggatttgtcttattgtagtaatattacttgatttgtcaccaaaagcacttccatgtgtaatatctttatactgaataaaatcgaaatagtaatgatcaaagcatttactgaagattgtgtcaatggtctaagacgacaatagatgtaattcaattaggtatgcctgcattctattttcaatggtttcttaatcttgtgcttaactttgctgcagccaaacactgtcgtagatgaagtggtcaagattgtctggaaggagcaaaacatgaagtcaattgctctccagaagacaaggtcaatcactgctgtgctgccaaacaaatcagttgttctccagagcgccaggtcaatcactgttgagttcgagaacttgagcgaaaactgaagttcgtgtatgcttggagctgcagtgttgagagcttactaacttcgtggctcactcatctgaactgagaagttacaaaacccagtggtggaaaccaaactacacaggtgtaaacctggagtagcagtagcactaaagtaattctggtctaacataagttacttgtatcattagctgtactgaatcattgtagagctaatactaatatatgaatggtatatataaactaatacgtgtactaagctgtaccaaacgatgcacctatactgttgagaagttcatatatgcaatgaatgttggttgacattgcttaatgttatctgcaaattcttggctttctctatgtaccatacacatggatcgaacgagtgattcaggtcgagaattcccttcttgattcgttctgtttgtagttctgaaccaaatgaaccgtattggaaacttggaatgtgaatatcacatcccatttcaaaattaattatggacaaactgtcacaactataatcaacctccatttctcttatcagatggacagtagtcaaccacaaattcattcatgaatatgtgcaccggactaagtacaccgaaaattttcaggtagttttcatcaataaaagagggcattgactttgatctcaagaactcctcactaatcactttcaaacagcaggggaaggaagtagttgagatatggatttgtacaaaaaaaattatccaacttgtgcatttggtttgattcgacttgccggtgagggccgtccaagtgacatgtgggagtttcgcctttactgcaatcgggccctaccccgccaggtgttcgaccagtgccccgaccgccgcggcgccacgagcctaactgtcgcgccgcggcggcgtggccatcgcttcggtgttcgccacggatgacgatgtcgatgggagcgacgccaggtccggggtggcggtggatgatgacgtcgaggcctctgatcggtcggcgccgccgcctcgtgcggtatagtcggcgagcatggccttgagctcggcgagcacctcgcccatcgcggggcgctcgtgcttgtatgggcgcacgcaccggcacgcgagcgcgaacacggcgcgcacggtgggcctgtcccagtcggcgccgaggcgctcgtccaccatggactccgcggcggcgccggcctcgccgccggcctgggcgacggcccagtgcgcggcgtgcacgatggactcggcgccgcccgacggcgtgggcacgacggcgcgcatccccgtggcgagctcgagcagcacgacgccgaagctgtagacgtcgccggcctccgagacgtgccccgccgagaagctctccgggtcgacgtacccgcgcgtgccgcgcacctccgtcgacacgtgcgtcccgccctcgggcacgatccgcgacaccccgaagtccgacagcttcgccgcgccggactccgacagcagcacgttcgtcggcttcacgtcgcggtgcaccacggcgccctcccggaacccgtgcaggtaggccagcccctccgcgacgtccaccgccacctccagccgccgccgccacgccagctcgccctggaacagcgcgcgccacaggttgccgccgccgaggtactcgtacaccagcgcgtggtggtcgccgccgaggcagtagcccaccagcgtcgtcaggttccggtgccggagcttggcgagcacggccacctccgcgtagaactccgacaccttcttcgacctgtagatcttcttgatggccactcgctgccccgacgggagccgccccaggtacaccttgccggcgccgccgctgcccagcagaagcttctcgtcgtagccattggtggcctgcttcagctccgacttggtgaagatgtacaggccctcgcgcggcagcggcggcagcgacgccaccgactcgtcgtcgctgacgtcacctgccgtcgtcgtcgacctacgccggcgacggattgttacgattgccagcgcggcggaggcgaccgccacgacggcc

SEQ ID NO: 27036 - DNA, 1592 bp, Oryza sativa
gcacggccgcgagcccgccgcgagcttccccgggtcaccggtgaggtcgcacgacccgttgtttgcgaggagcgacggcgacacgaggccggaggagagcagcctggcggcgaaggcgccggagcacgcggcggcgggctcggcggggaggaacgcggcgccggtgcggttggcgtggtcggcggcggcgaagatgtaggcggcgaacacgtaccagcagcagccggtggcggcctggccggcggtggcgttggcgtagcactcgcgcgggatcatccgcgtcgccgtggcgaggtcgtaggggcacgccgtggggcctctcgccggcgccggcgacgccgccgccacggcgagcgggaggaggaagacggcgaggcgaagcatctggcggggtggtggtgaccggagtgagagggggagagtggcatcgataaatgcgagcgggtgggagttttttttttaaaggtggggcccacaaagtgatttgacgatttgacccttggagtgtattgcagctacagtgcaaattttgattatgttgataatctctttttttaaaaaaaattaatgatagagaattatagagcctgggactgggagatgatggatctcacaaagcatccatgtttagaaaaaaaacatcaaatatttttgaagttttgtccacctaaacatggtatgtaccaactagggagtgaactattgacgtcaggtactattgtgaagtgttatatgtttggaaatctcgaataaagtaagtagaacatatgtagcttgaccagaaaagttgtgaagggtaaaatatctttatgccatggaaggaaccaaaattatagctcacctctaagatcaactacagagtacctccgttctaaggccctctttttttaggcttattggcctaaacttttaaattagcttattggcttatatgatttataagccggtggatttaatatcctaagtttagtggttgagtcatacatctacctcacataagccaaaaaagcttctccaacctagcttttggcttaggccctctttgtttaggcttaggcttattggcctagacttttaagtcagcttattggcttatatgatttataagccagtggatttaatgtcctaagtttagtggtggagtcatacatatatctcatataagccaaaaaagcttctccaacctagcttttggcttaatagtgttagagtggcttatggcttcaaaaaaagccaaatgaaaaagctgcttgtttgttttgacttagacttttcgacttataagtaggcttataagcctaaacaaagagggccttaatagtgttagagtggcttatggcttcaaaaaagccaaacggaaaagctgtttgtttgtttaggcttatacttttcgacttaaagttggcttataagcctaaacaaagagggcctaaaataagtgcagtcatggatatccatgtccaatatttgaccgtccgtcttatttaaaaaatttatataaaattaaaaaaaatagtcacacataaagtactattcatgttttatcatccaataacaataaaaatactaatcataaaaaattcaaataagat

SEQ ID NO: 27037 - DNA, 1328 bp, Oryza sativa
tcccattgtagtaacaaaagcatcaccattcaatcacaaatgctctacaaattcacctgcccgttccctgaaacagaagccaatcaatacagttgttacaaaggcagcaaagcttagctcccactcggatccatccattctacaccgatgaaccatcacattgcttaacgtttatccacaaaacaagagcatatggcatatcaattgcagcttcttcttttttttttttttttgcgaggatttccccaccaaaaccccactaacaacagcagcagagcagagcaagcaggctcgccgcagttgaggaaatatacacggcgaccagttgaagaggtgcgcttgccttggcgaggcgggagcaggtggcgtagttggcgtcgaggtcccccacggaggtcatctgcaccacgcccaccctcgccgccgccgatgcccccgcggccgcagatggtgacgacgaggaggccatcccgcggcagcgggcgagcgacacgcgtgacctcgccgcggcggcggggaggagcgatgcggcggcggcgagggaggccaaggccatatgcgaggagaggattgagatcccctcactaccttaattcacatggctttgagtcactgacatgtgggcccactctgctatggacccagatgtcagtgactctgaagcgcgacgagtggggtagacagtagacttgcccgggtgcgcgtagcgcgggcgggaggacacgtggacggatcctggccgtcggaccggcacggccgttgcctctatccaccgttcgattccgcgagcccacgcatccatccggtcactcgccaactagtatccccattcgccgccgccgccgccgccttcgccgccggcgatacggtggtcagcgccgccgcggccgctcgtatctaaaggtgagaccacttgctgttcctttcctcgcagattcgctgcaagactaggatcggggttgggcggatgatttgggtggtagtggtgcctcaagaatgtcgcagaagttttatctgtctgattagagctctgagattacggatgcatctggatccggtttagggaggaactctagattattggttgatctgatagttgggaacaacttcgttggtgaggtgatgatggatgaacatgttgtgcgctgcttttcttatctagccgttttctctgaattttgtgtatcccttaaaaagggtgtagagcagctgaatgcatgtacaatctcatgcattttgttccttgacacaacattattttgttctcggtaatttagcaatgcgtgcttccgtcgcagtaatttgctcattgcatatttgcacttgat

SEQ ID NO: 27038 - DNA, 1744 bp, Oryza sativa
taggatttaaattctacgttttgtatcggtgcccacgaatttaaggcatgtatttagtgggtatgcatgcgcccgcactatggggggtgtttggtacctccaacagatttaaatcatgtcaagaggatgtgcatgtgtgtgtggcctaagtgtaatgtgtgttgagtgtccaacaaactatctcaaaaacaagaatgaaacaactcgatgctagcaaagttagaattctcaacataaagcaacggatattggcaaacattcaaaagagcacatgtaagtatataggattatgtttcgtaatcagaaatgatttgatttcaggtgagattataaccttaactactagtactataccatattgaaaggaaagaagtcttcttacaaaaagtgaagaagaatagggaattccgcttggagaggaacgactagggaagtattggactaaagtcaagatctactaaagaatgaaaagagcacctaatacacctatgtggattagactaattcttggaacttcttcaaacaatttgtgtttgccagttttgaggcaaggagatttttttagataatggaagtttttattgaactcaaccaatataccaaggtgacacaaaagcattgagcacattcccgagatgaggcaaggggattgctttcacaaatgtctacctcttcaatgtcttgaatgcaataaggtatttaaatcccctatgcaaactcttgttcagtttctcacaaccattttcatgtaaactctttgccattttagttgaatcttcatctcttttcaccagtagtccatgattattgattaatcccctcccccctctcatatcctttcctttatccataagctgacattcatatttaccctaccatatacatttcttatattaaatctaacattcatttaaccatgtaattgttcataatcttgatggggtgacctttcattattgtttggatgatcttatcctttatgaaggttgtatcctacaagaaaatgattcaaataatgcatgttcttttctttgattatcccttgactagataaatgaaatagttcaaccaagtattaattacccaaaggttgtcataatgtcatcgacatatatcgatttatcccattcctatcttggcttctttttaattcctcaaataacttttttctagaatttatctggagatggttcacaattatgaatgcctattttcaagtggtataagtcaaaactacctctaataagtaccatactagagatggctttatgaattggtcgtgtttgctcaccctttaattaccatccgagtcattaattggtctctaacaatatttcaacattcccgcccatgaaatttgaatttctctcttgaccgatcaaaaacttctttaaaattaccggcccaaatatcctcatctcctcacctatcctctcctctctccccctcctccacccgcctcttgtgatgtcatccttctcctccactcctcttatcctcctctcctcttcttctccgctccttcaagggaatgatgagtgcatggatcccaatgaccttcaccaggtaacccctccttgcctttccccccttgttcatgatatgctttggatctctagatttttgtttaggtgatataatgtactagactttggatgtttaaaattagagatagattttggtatggctatggacacatgaatgttcggaaggagtagatcaagagtgattctactccattctg

SEQ ID NO: 27039 - DNA, 1058 bp, Oryza sativa
ccgccgccgccgcagccgcagccgcgactccctttttttacttttctagggcactactcgccgccgcaggcggccgcgggggacgggggagcgcctctccgtgtcccgggtgcccgcgccgcgcagagggggtgggtgactccgattgtttccgggaattttgggtgggttggcatttggggccgggtggggtggggggttcttgatttggtcttgcatttgggggttcttggtacgcattggtgattttcgcggcgctcgtggggggttcttggcttcttgccccgtcgtctgtgtggtagatctgcttgatctgtgcgcgtctgaggatgggggatgtgcgtagattggtccatgttggtaacgtttgcgaggatttcagctttagggctaaggttgggtggcatcctttttgaaaaaaaaagtgagtttttagttgagtatctgatggtagcttgacttggagggtttcttggcacaatctggtgcataaggttaattttgcatctgttcaacgccatgaaagaaaacaaaagtgttaggaaatctaacctgaatatgaagatggcattttgcaaggcagttttagaagggacttttgtttaaagaacgccataaaatctatagaaagcgctgccttttttgcacataacgaaatggacaaataaatctggtttcagatttgaattatagatcataactgtaaacatttgtgccaactgactgctaattccgatctgtatgccctgggattatctattatttctctcaattatgctacgaagggactgaataattttggtttaacttgtgcacttgtgagtaaatatgatcttgttagatttgcaaataagatctgatactgttttatgtctgcattgcatctacttgttcgatttctttttcacactgatacttaatgcttaatacaccgtctcattcagctccataaagttatttgccttggttgatatcttcattgctcactgtgcaatttctttctttcttttttttgcgtcaaaactgcacaatttcttatgtcattttttttcctttta

SEQ ID NO: 27040 - DNA, 768 bp, Oryza sativa
tagatatgacatatactagtacaacgaatcttgatagaaatctgtctaaattcgttataatagaatatgtcaatacagttctatatttgttttttgggacagagggagtatgtatatatatttagaggagcttaagaagcaacaagtgagaagtcagttagtgagaatatataaaaaaggtttcttaagttctggtttctaatttattttctaaattctatatataactataaattttcaaaattcagatgacaacctaaactgtttggaagaacttctgacaaattatgtaagaaattgtagaaatgagaagcactccaaacacgatgatagtgaccaggcgatatgtatatgtatgtgtatgtgtatatatatatatatatatatatatatatatatatatatatatatatatatatatatatatatatatatatatatatatgatttgcttggaattgtttaagcaattctcgtaatcgtcggccccttgccaattgattctgacttgttttatcgagagcagaggcgaattatgtaaaggcttgtaactctgcgaattgagctaattccaattttgatttgccagctacttgtttcatggctttaatttgagccgcggatcctactctgaaaacggaaatacccacattaatagcaagcccgaattccggcattgaatagatctgcccacgggtcgtcaacttcttttctcggagaagaaacaatgacggtatctgaggaataagcatcggctaactctgtgcc

SEQ ID NO: 27041 - DNA, 771 bp, Oryza sativa
actgaattgatcacatgcactatttgggggcaatgtaacatatggattacctcaagtggagttccacaggcaacaagtttgactccattatcacgacagtagttcaaaaggggttcatactcctgccagcgctctggtgcccagtgagaagtgtacaaccttaagttgttgccatcaattctgagcaaagaatgaattttcataaggtaagtgcacttgatattatcataagcagcattcagacattaattcatggccatccgccatcatgcttgcaatgtagtaggtacatatcaattctagaaaatccatttggggtggccggttggaacttttacagtacaacatttgtttggtgatgttgctgcaaggcaattttagctagtattgtggcaaggtttccacaaagtttaacgctacaatctaatagagcctttaacgctacaatctaatagagcctaagtaatctcagagctcaacacaaactacagactgacaagtactaactgcacttgaatttgaaacgattaggactcaaatctctaaaaactcaaagctacagataaatcacaacaagagcccatcctgtatatagtcagtcagtcagtcagctagataactagactaataagtacaactgtagaagtgtagaacaaaacctcctgtccatgaactggttgagctgctcctggaggttgcacgggaaggcttcgagcgcaagcgagatgctccttccggcctcggcgcaccgtgccgccagcttcctcacga

SEQ ID NO: 27042 - DNA, 554 bp, Oryza sativa
ctaaaagttgctatattttaggacggatggagtatatggtggtcttcagaaaaaaaatcatttaggatgtactttcattgttactaaacacactataccagaactacttattttatttttctaaataaaaaaacaagctgagtactttcttagctcaacatatatcaactgcaaatctgaaagtaaaagacaatggaaataggaagccaataactgaacctacctgtgtgccgtaccctgagttatagcagtccataacaggttgagaggctagaccagtttcttgaaagcaagattgccacgcgttccatttttgagtcagcgctaaatgctcaatgcaattaatgaaagggaaatgctgttcctgcattcagaagaacagatactggtggcacttcagtgcattgtctcaaattctatcgatgtgagcaatagatgagcttggcagatctaccatatgctcattcatacagtacatcatactactactatatagatggattaaatgccagcatgttttgtcacataattacactacaggacactgaactatt

SEQ ID NO: 27043 - DNA, 781 bp, Oryza sativa
ttcctgcagccctgtgaagtatacaccgatcacaaaagtcttaagtatatcttcactcagaccgagttaaatatgagacagagaagatggttggaactaatcaaggattacgatcttggaatccactatcatcctggtaaagccaacgtggtcgctgatgcgctaagtcgcaggcctattgcaatatagctcaaatacggcctgaccaaggtcaactgtgcagagaattggagaagttaaggctgaccgtggtacagtcaggagtccctgccagcttgacagtacagcctaccctagaatcgcaaattcgggaggcacagaaagaagacgaagggataaaagagttaatagaaagaatacaggagaagaaagacaccaacttctccatagacgatcaaggcacagtttggtacggtccacgcatctgtgtaccggccaagaaggagttaagagacctcatcctaaaggaagctcatgagtccgcctactccattcacccaggaagtacgaagatgtaccaagatatcaaggcatacttctggtgggctggaatgaaacgagatgtcgcagaatacgtagccctgtgtgacatttgccaaagagtcaaggcagaacaccaaaggccagctggactgctacaacccttaccgattcccgagtggaaatgggaagagatcggaatggatttcatcaccggtttgccaagaacccccagcggatacgactccatttgggtaatcgtggaccgactcacgaagtcagcacatttcgtgccagtgaa

SEQ ID NO: 27044 - DNA, 389 bp, Oryza sativa
cagatacttgatactggcaggtaccatttgaaatcaaaccactaaatcaacaaggtcatgatcggaaataatttttccatgggaaacgctccccaggcccacatgtcaggaatgacatgctcatgcctctctctctctctctctcccattgcttgtgtctctcgcgcgaccacgaccgcatctcggtcttttgaccatcgtcacgttctcatccaactcctttgacaacgcgtgagtgagttgccttccccaacaaggcctgaccagcaactcacctcatcgaattctagcttgcctcctcctagtttcgatgatggcgcatatgcgccgcctcggcctcccataacctgccttcgagagttgcttgcttcgtccccgacaccggtata

SEQ ID NO: 27045 - DNA, 768 bp, Oryza sativa
ttcctgcagccccagttgtacagatcaccaggctgaccgttgatggtgtacgcgtcggagatgttcggcgcggcgccggtcctctgagcctccctgatgacttgatcgggtccgcgtcccaccattcccctgtccatcgtgccagtgccaacattttcagtgtcagttcagacgactgatctgatagttaatatgcagatctgtgtacaaaagtaggaaggatcaagactgaccgagaataagggggacttctcgcgcgggcttctcgaaggggtaggtcttgttctccctggggcggatgatgagcgcgccgtagacggtggccctgagccaggagctgtgcgcgtgccaccacagcgtgccctcctgcccctcgatggtgaaccggtacttgtagctgccgcccggcttgatcgggcactgtgtcacgaactccggcccgtccgcccaccccgtcctgaactgccggatgccgtgcctgcacgcgcgcgttgatcaccatgtgttagctagctagatctcgaccggcggcgcagaaaacaacaatcgtcgccgttgacgaccaggagcggaagtcgttagctgtttgattggtgtacgtagttgggtcgacgacacgtaccaatggatggtgacgttgtactgcgcgtggttgacgacgttgatcaccacggtgtcgccctcccggacctccagcgtcggccccggcagctgcccgttcaccgtgatcacgttgtgtgtcttgcacagcctcttcaccggcgtctc

SEQ ID NO: 27046 - DNA, 2322 bp, Oryza sativa
cagcatcaccatgctaaaatcagaatatgaaggaaaaagttcattgcaaaagctcatatcaaaatatgaaggaaaaaaccatgcatctcattagtcaaagtaactgaggaagaaaaatagttcgaccccttttatgtttcctttgctaaatgaaatgaaagcataaatagtttgttaacatgagaatgtttctcctacatatacacgttaatacatactatgaacatcaacaaatttgtcacgatttatgtgaactttaaaattcaaattggccattcagtctcttattgatttggaattgggatggtcttccttaggtatcaaaatactttgtattcctaaggtagtagtgtaatacatgtgtcagtatatgtggttttgcattttcttgctaacatttatcccatttttttttgtggcagcagtgtactcctaacatataatgaaaatggtaatgctatgcctactgtagggctatcattgttctatggacacaataatagtacctcaagatcagttgcaccatctccaaccataaagagtgtcctgtaaccacacttctgcacacacaaaggtacataagcaatgtgcttaataagcagcaacatggcagagtggagagttaaaatcagaacctgtcttatgttttgaactgctacagctttgcctccacttcgtgaagtaggctctgaagggtcaaaaccaacatactctccagaagttccaaacagtaactggatcgcaaaaatattttcaggaggaatgccgagctgcattgcaacaggctgatggaaagagcaaagggtaagtcaaagactgactctgggtgaagaaatagcaacttgaaaatagctaaagcttgtcataaaccaggagtgtaaatgcatcaaaagaaatatggatcaaatatttcttgccacaaccttcctttgttcttccaatttttttgaaatcggttcctcaagagggggcaaaaaacatcacataatactaaagcagtggacctattcaaaagttaaagtaaagattggagctgaaaacaacagaatgttggcggagtaaaatcaaagtatagcacgtacggtgactttcctggaatgtcactgggaaagcatccaacaatggaatcattataccttgatcatctgtcggaagcctccagaaaccaggtacacatcaacatttttagctttcagcatcttaacaagctcagcaattccaggagatattctgtcgataaaatgtcatttgcataaaatatagtaggatgtgaaggctagatacaatcaacgcaatacatccaaggaacatgaacgttgtgtctgcttgacgcacaaatatctagatagatcatagtttgtagcaaatttataaaaaaagtcagggtcagtttcttacgagaaacagctaatatttgaacaacgagctatataaattcctgtttatttagaataaacaagaagttatcaagtagttctgttattctgtatccaatttgaaaaaaaataaaacatgaaaacgtgtggagaaaaggattaaaaacaacttagtattctcttatggcatggccatcccaaaaatggaaacatagtagcgattttattttttgagaaatgcagaagatctgtgtattttcactgaaagttatacaaaacaaaagaaagcaaaccatctagttctggctagtagtaactacagcccccccaaggctgaaacacctaagaatcattagatacttaggagcttaccttggtggccgcttctccatgcagtcctcaacttgccccaaagatggcttgaacaacgatagccgagcagctaatgccttttcaaacggaactgacccagtcatcgccctggaaatgttttttttttttcaaaaaataaaataaaaattgaacgcttgaatggaaatttccatggattaattggcaaagctttaaaagtcagcatctttacttagccgtccattcagcaaccgcttggcctgccccacagaagtccgcgagctcatcgataccctcgtccaagcagaccgtgctgtcaacatcgaagcacaccgcgtcagcattgcaccatgcccagataacctctggtgaaaagagaagaagcatgcacggtgttaggagactcaggcctgcataggcaccatagcatgaccacacaaaactaaaggtttccagcgatacctttcaaaggcagggagctctctgaattaggggaggacatactttttggtacatccagtgctgctgctataaaactcggacgatttgagcgtttaacaccgcaaaacgacgggttggcgtagccaattgctaa

SEQ ID NO: 27047 - DNA, 2088 bp, Oryza sativa
tgctctttgtatacacaatgctaggcttcatgaaacccatttggtgcgtcgatgcttctaaatttttttataaacttggtcaaacttaaaagaagtttgactaggaaaaaaagtcgaagcgacttataatatgaaatggagggagtattatttatagatgatcgatcttttcagaatggaaatgtgtgatgtgtgttgtgcccaatgttgattgatgttcataaccctgtactccagagcatcttgaaagctcatcctcaccgagtcgctgtataattcatgtctaaatcactatttttttctgtctgtaggtagttctgaaatctgaattgtacttccattttttttttgttcttctgttttgttgggtaatgccaaggggactaacatagagtcattttcttcaggaagcagcatcctctggtgtcaaatttctttgctttcctgaggtattctcattcataggctccaaggatggcgagtctattaagattgctgaaccattagatggcccaataatgcagagatattgctcacttgcaaagttagtaagaacaaacttgctgaatttccattttgccattacatataagtgcctcttcataggaaccccttttctcaatttactttatttattagagttcacattatatgacatattaaatttaagtatttagtattttgtgttctcaatcttgacttctgtgccttacaattgtacaaatgaatcttctgatcatttgttcagtatgaacatttggtcaatctgttaacttagaaattgttttggcttatagaaagaatgaaaatctatctaatgctctgtaatttccagtttaaggaccagtgtgcacttgtcgtgcttattttgaaagctaccgcaaataagtaaatttcataactcccagtgccctgtttggtaaattagactgtagcttaacaactcctgtcatgtaatagtttaatccttctaatttcctctagcatgaacctttgatatgcgattctctgatatattttgttatgtggaggcagaacacaataataccactttcacaacacaatctagaaaaaagaactagccaaatatcaaaacatgcatatatgatatatgatgactaatccattccaccacaaggccaaatggagactagctgtgtcttgagtcttgaaacatatttctcttgtattttttaaggattttatttggttatcggatagcactttgagtccttgacttaacataatttcatcctgcagggaatcaagtatgtggttgtctcttggagggtttcaagaaaagggtcctgatgattcacaccagtacaatactcatgtactaattgatgattctggagaaattaggagctcatatcggaaaatacatctgtaggtgcttattctttctcagctcttaggagaaacatgccttcaagaattttctaaacagtttacttgcgatgcctattttaggcattcttagaattttaacagtagttttttcaagttgacatagtaagggcatgatatttgatgctatgcagttaagtactagaagtttcatatgattgttggttctaacaagagaacatttatcttacaatagccatggataaaatagatttatgagaaatcgtcacaatatcccagaagtatatttctgcattactttactgtctaaatggtgaaatttttggtcgtacgcaagacaactgttgcatctttcttcgtttcttcttgcttgttatggtacactgcaacatctcattgttcagatattcaccttcacatttttacgctgaaggtttgatgtagatgtaccaggcaatatggtgtacaaggaaagtcgttttacgacagcaggtactgatatatttcctgatattttagttttgtcatattgggatatgtaaatttttagagttagttctaaaatatcacttaaccaattgtacttttatatttcaaatccccctgcggaatgttgtgtttgtcacataaattattctagaattaatttattatacctaaattatcaacagtttcttgatgtactttttaatatgctcaattaagtgtcatagtcaa

SEQ ID NO: 27048 - DNA, 14416 bp, Oryza sativa
tcatatctctgaggaaagctcaggtgaattgcatattgttttccagtattcttctaatatgccagtgacctttttaggtcttactagtaccatccgcgttcacaaaagtaactggggaggcgcactgggaaattcttctccgagctcgtgccattgagacacaatgctatgtatgcaaatcctaactcttataagtctttcacttttgcagacacatcaggctgtttcatatggttgggagtgtgatcaataatataaaatccaccatatatgcattacatatttgttattgttaaattttcaagatttgcaataggttattgcagcagctcaagctggaaaacacaatgagaaaagagagagctatggtgattctataattattgacccatggggaacagttatagctcgacttccaggtatatctcttcattttgttactgtcttctatcagaaatcttctgttgatattttgaaggttttcttgaattttatcagcaccttgtaccttgacaaccaccaagattttattgatcttctgttgaactcctcaacaatatttgctagcactgaagtttgaacttgtcctggaaaatattgtagtctgccattaccatactgcatttatcgtgtttgtatttgttcaaatacaatattctgaaattatgtggaacgagtgtgtcacagtatgcccgttaaatatcgttctgaggaattaatcatcaaactttggctacagaccggctgtccactgggtttgctgtcgcagatgtagacttgtcaaaagttgaggctgtgcgaactaaaatgccaatctctgaggtaatactctcatggagatgctgtttgcttctgtccaagaaacaccatttagttgtgttcttcaataacagtttatcatcttattttgtagcaccggaagtttgacagcgtctggaaaacctcatcactgtaatagtatagaggtcttgcacgcctcctttctctttcttttttctttagagaacagtcgacctattattttgtgtatcaaatatcaattgcaaggcacacatgatgatccaatggtttgatcggcggtaaacttcaattgcgaagccatggttgctgtgaggtttcttggtttgaagaattcctggttcagtggaacttcaagatcccaaatccccaattaggctaggaatgatttgtcagaccaaatagtccataaataatagtgttggcttgaacgcgacgccaccaacctaggacatttcaaataagtgattgccattgaatctaatgtaaatttgttatggtacatttgttgataaatcaaagcttggattttttttttggttactgcagaattgtttataaatatagtccacacatacacttgaccacatcaggaaactcttctaatgtatacatgacttataagggcacccgcaatggttatctataggctctctacaagagatccatgtcagcatatttttctacttggaagagattaaatgaagaaagagagagagcaaagttatctactaacctggaaatagtctatagaaaaaaacgaggcaatggattagagagctatagatacccatgtaggtatatcattgaagtggtttactattaatctagtctattactgagatgtacatgttttatagataacaccttactttaccattgcaggtgctctaaatgatgaaacaaaaaaaaatgacagattggctgtgaatagtttctgaagtatctttaagttttaaaaaaatgcacatgaactatctccaaccaaatatgctcttttatccttgtgtggtggagttcagtcttgattttttgtgaaataatatatatcacttattgttaaaatttttagaaattctattagtatttttgttgcagctaaggaggagaacaaatgagtaagaatatctccttgaggtattatattctagtaattcagaccatgcccacagagtaagcatagctctctcacgtgttattgtaaatagtatactctaatcatccaccgtactccaaaactttaataagcaaaatttttaaactttgatcattcataacttctggtatgcttagctttttatttagaaaaaagaatggtacgcatggaattgcttaggcaaaatactatcataatatagcataaatttattatattttataattttgttataatataaaattgatgatcaaattttcaaaagttgaccgaatcttcttctaaacatcaaacgtttataaatagagggagaataaaaaaattttaaaagtgaaaactgaaaaagaaatgtttgcatttaactcagctgcaacttctctaacaacggggattgcctgctactgctagtgctaatgtttgctgccggcctgcaccagcagtactgcagaggatctgcactcctctaatgctatccctaatgtaaatgctgagagagagagagggagagagaatataggaggatattatttgtttttctttcatgttaacatggtgttgagtgatgttggagtgtaggtgtggttgcataaattaatttgttaaggttcaaattcaggtaaccaaactaggtagtttttttttcttttgaggtttatggatttttccctaatgtctctttgttgtgttaaaagtggcgtattcgtagatatatatagcgcgctgtgcatcctacatttgtattaaaaaaatgatattatttagtcctaatatggattttggtgtaggtccattatttagcaaatgctttaagcattttaattgcatgcaactaattgagacttcctttgaaatggggtgtttcaaagaaattgagctgattcgttttaaaattcctataaaattcttgcgtttaagcaccaatcctttgagggatatgatctttttcgtcaagaaccaattctttgctaagaggaaatattttgaagaatattttcaagaaaaagataatctctctaatattttttgaataagccttttgtcagagtgctagctttactgccaatcaacaacgtgatggctggcgtatcagtagccatgtcatatgtgtaaagtgtttggatttaaagattttatggaatgccaaattttgtttaaaaggtaaaaatttctccttcgccaatatacgaagggcctcattgtttggctgatgcttatgcttataagctaaaatttaaattttagaacttgattttgaatttatttttttttcgtttttcatcgtagtttattttacaacatctgtttttatttagtcgctaaagagaagtgcataaaacatttaccgacaaatattttttattggttaataaccgatccgaataagcatacgaataagggaaacaatattcgaaattagtacgaaagagaaaacaaattacaaacggattttattacaaacccgtttctacctctttttttttccctcttattacagagaggttagattagagttaggctcgccattaaacaacactcatctccccctcccccttgaaaccctagctccgcttcgccgtcgtcctcctcctcctccccggcggcggcggcggcggccatggcgtccgcggcggcgccgaagcggtgctactacgaggtcctgggcgtcccccgcgactgctccccggccgacatcaagctcgccttccgccgcctcgcgctctccctccaccccgacaagcagccccccggctccgacgtcgccgccgccaccgccgccttccaggagctccagcacgcgcactccgtcctctccgacccccacgagcgctcctactacgactcccaccgctcccagatcctcttctccgaccaccacccctcctccggccccggccgcggcggcggcgtcgcctccgcctccgcgtcccccgtccccgacctcttcgccttcttctcctcctccgccttctccggcttctccgactccggccgcggcttctacaaggtctacggcgacgtcttcgaccgggtcttcgcgcaggagctcgcctacgcccgccgcatgggcatgcccgccgacgccgtccccacgccgccggtgatcgggaacctcgattccccccacgcgcaggtcgccgcgttctacagctactggctcgggttcggcaccgcgatggacttcgggtgggcggccgagtgggacgccgcgcggggggagagccgccgggtgaggcggctcatggaggaggacaacaagaaggcgacgcgcaaggcgcggcgggagtacaacgacgccgtgagagggctcgccgcgttctgcaagaagagggacaagcgggtggtggacatggcgctgaagaagaaggtggaggaggagaagaggaaggcggaggaggcggcgaggaagaaggaggaggagaggaggaggaaggagcgagcgatggcgtaccaggagcccgagtgggcgagggtggacgaggatgaggcggcggtgtttgaggacgacgaggaggaggagacgagggcgaagaggaaggaggagctgtactgcgtggcgtgtaataagaagttcaagtccgacaagcagtggaagaaccatgagcagtcaaagaagcatagagataaggtgtccgagctgaggatggtgtttgaagaagaggaagaagctttgaaggatgctgaagaagaggagccagaagaagttgatgtggggtttgattttcagcctgcacaggaatcagaggagagtgaattttcagatgctgctgaagagttggctgacgagttgagcgagggattggaggtgcgtgatgaagaagagaagggtgataagcacttgggtaatggggaacaaaaggttggttcatatgatgaaaccagtgtgttagaggaaatgctatcgaggtctaggcgcaagaataggaagagtggttttgtcgctcctcaggaggaagcttcaccagctggtgccatggatgatgatgacgatgaggatacaagctatgagattaataatgtcaaaaagaaaggacgccggagacgggcagcaaagaagggaggtacttatgctgataatgggcaaggtaggaagagtgagaatcagcctgaggaatccaggcataataatgatgaaaatggtgctgatgataagatggaaggtccatcttctaatgaagacagtgctgcagcaagtaaagaagatcagcagaaaggaaaaaccggtaatactaaaaagaacaagaaaggcacagaaaagaacacaactatatcttctgaacaaaagggtacatcgaagggaaagaagcaaaaggtacattcacattattttctcctgttaacttcttcatatttctttttcatgtatagttggcaggaaacttgttatgaatttgtgactaaaacccatgtattctgtttctctgtttaagtcaaagagcaaaaacttttagcctcatcagtactatgtgaatcacatatgcagatacctagccgtgtaggtgcttcaagaaccacctaactaagccacttattagaaatgcttacgtaaaagctgtgctactttatagaggaaataaccaatgttttgaattttgtggaatacatgattagagttgcttcctttgtgagaaaagaaacttgtcctgaaaatcttatgatttttgcgggtatcaacactcacatgttggattgctgttgttttatgattttttttccttatgcaaaaccctaaatctgtctttgtgcagcacagtagcagtgatcttgctcttgcttttcacattttggaaagaaacctagaggatgattttgcataggttgaaatgatatttgatagcactgattaacatagtggataatgaatattatgcttttgtgaaatacttgttggagacagcctttcttggttttgtgaaatacttgctggagacagcctttcttggttttgtgaaatacttgctggagacagcattttgtgaaatatttgatagcactgattttgtgaaatacttgttggagacaagcctttttttggtttcatgtcaattagtatattatgccttttcctgtgatgtctgttaacagtttaacttgttgatctataattggcgtatcagtttagctttctgtgtatttgttctaaatttgtgggtgtgtacacagttgcaaacagagttaaagaatcttggaagcccccctggtttcactgttatcacgattttcttatcttgttttgattaaaaagtagattagtgccacctagagcaaagagcccttccgtttgttctgtatcatgtagatgtctagtgcaaaatactttgttggagaacatacaacttgaagctgcaaatgtggaaaagttttatacgtactaattcactgtctactgttagtgcaacccgatgagcttaaaaccaaaattcggccatgccttgagtacccatgacatgttttggatatattttgtgtggataatattgtgctatgcattgtctatagattcataaaattctatatatatttctgtaagtagttataacactttgaagctaccttcttgtaccaggaggtttcaaaggcacccagtaatgactgtgaaacgtgtggatcaacgtttgactcaaggtatgtacttgaagttcagctttccttttcctctccttccctttcatttgcactttcccatcatatgttgctatcttacaatgaaattggaaacgcagttatggtttgtctcaaatacttcttgttgcaggaacaagttgttttctcacttggaagaaacaggtcatgcaatgctgaagacacgacagaaaaatcgctgaagaggacaagaaagtagttttcttttaccgtttgtcccagttgatgctgatagattagcacatcgacaaaaaggccatatatctggtttatagcccaattttgatatgtgtagtagagccgttttctttcttcctggatttgtttcattggtttgtggtacagaatgacaagaactaattattattattcaatcgaaatacacaccatcttgtaatttttctcccttttggtgcattgtcttgttcaagaatgaaccattttgtacgcgtttgagcctactgttgctggtgctcagcttctttggaatttcaccaataacagggacattattaaaacaactcgtatgtcatgtaccatttcaaattttaagcactgaacatcagcatcgaaaccaaaacagttactatctttcttatcattcaggtgaactccaaatttccctatgctatctgcaaatgggtcttttagaattcagagaaagggataacattacatttatataatctgacacaaacttaaaatcacaaatccacaaactatcttagtttgttccttttttccccttatgtacagctccatccaaatggaaatttcatgaatggagtttcattccatgttggcatgatctgcttcctggagacctggactgaagtccccccctgcattgctgcctgaacttctttgttttctgacagcaagagtggtttgcgcttgcaaacaccaaattaaggcaagagatgaaaggatttgaatcaatcacttggtgctcctgtgacctgatgaagccatgagcaccgcgaccgcgacgatgaacatgaacagcatgaacccgagcaggatatacgtctttcgcgacgatttccggtactccccaaacaggagtattccccagaatgtgctcacaagtggcaatgcctgatgaaacagcaatgctgaagcagttagaatcatagtccagaaaagttgtacttctctgaagatagtgtgaactgctaaacctgaagaatttgcctggaagatctagtatgatgttcagtatctgaatttatctaaagatctagaataataagttgcagttatctgaagattgtctgaattgctaaacttgaagagaatttgtctgaaagatctagaatctcgccacagccatcgcgaacacgatgaatttctcttctgatgtgaagaaatgataagatttggagattggactaacctggacagcatcagcagcagcatagccagcagcctgaccacccatgaactgaaacccattgccaaagccacataggaagccagccaggagagcccactgcctgccttcccagtcattcaggtaagccttgaaggatgatttcggcacaccggccattggacggtagaggaacaggatgttcaggccgatgccgatgacgaagcacgagatcgagaagtagaagaaggcggtgtacaccaccaggtgtggtacaccttgtttcagggtgtgccattggtcattggtggcgaggttgaatgccggggagaagagtgagaagcagactcctgagaagaacactatcccaagccctatgaaggtgcttgatccgaacacctgcgcaacggagaggttcatcagatcaatctagttcattggtacaagttttcatccataattttggtattgattcaacaagcatgataaaggatgattagaatggcagtgaccgaattaccttgatcgaacgccgttcttcgagctcaatcaagtattccgcagttcctgcttcagctttggcaacatatttggttgcagaagctccattctccaagtccttgggagcatctgaaattggcagagttaagaactaggatctgatctgcaagaaatcaacattactagtacttacaacattaaagtcagttttttttttaaagaaaaggttatggcatacctttttctatgacttctttgtttggttccacacttccattttccctggaaattacaggttattaagatcataggggtcagtaaattaaaagacgcagaatctttaaatagattggaacctaaggcataatatattttctaacagaggtatccagataggctaaccagtgtgtaatgtgttttatgtatcttgatgtgaaatatcttgatgtgttgaaaaatgtgaaatatcttacccaagtttatagatatttgtggagccatttagtttttcttcattatcagctgcattggaggcatgtacagcagagccaagaatgactgcaacaaggaagcaggccactccagggaaaagaatctctgctctgttgatgcggttgtccaggaaataattcagtgttgtgcctgaagatccaacatgtgagttttctgatctactgaataattaggacaataataatggatacagcaattagtttgctgtagctactgaataaagtaaactggagatattgatctgaatatatgttcttttcaggagtaggaccaactataatgtattcatactattactaacctaattattcagtttcttcgactaacataaatatagataggttgtgatgagctgtacttcacatgtatcaccaagaatcaataattttccctcaattttctttacttaaaaaaaaatcaaacaataatatatgttgcagtgttgtaaaagagaagttttacctacctattacaacaaccatacttgagctgatgacctcagtcactgagagacctacatatgcccatgcatactgagtagagaggttccctatactgagcacaacaccccctgccattgcaaacagcactgaaggccaattatccttcattgcaaacaaaaaaaaatcactgtcagcaaaatttcagactaactaacaatcagaaatgtattaattcagggatatactatttcagatgcttaagagaaggtggctaacctgactgagctgggtgaagaaattgggcatgttgggcttgctatcgccgagctgaccgaaggtgagcgcgatgaggaccgcagcgaggaggttcgtgatcgagtagtcgaggtaggtgtgctgcgggagccggcctcggcgctcgaggagggtgaggaccgcaggccatgtccccaggaagaagagggaggccagcatgagggcaatggcaccccctttgtcctctatgatgtacatcttgaggcctccttgtctgatggacaacagggaattcacaagggggccttcaaaaacctgacaaaaaataaaataaaacacattttttcatcatgtaagagggttgagctgctactcatttggattgaatcatcaagaagtttcaagatcttgcagttgttatccacaaaatcttgtaaaatcagaaagtgttttgcatttaatactgtcctcaaatctccatctcttcattcttgcttgttacagcaagcaataatatcattacaagaaacacaagaaaaaaaaggaaggaaaagaaatcaggaaatcaaattcattccaacagccatagggaagatcccaaattgtggataagctatccttatcacttatcagcatgaaagactcccagttcttggaaccctaaatccccaattcttcaaagatcagattctgctgaggatgagaagagatccaaactcccaattaaacacataaacacacaaggaaggggaagaagaacatcaagcaagtagagcagagtaccttttggcatgaaaccaaagaagtggcacaaccaaggacatggtccatggatactacttatagtgccaagcactggttaccaaaacaaaagctaatggtatctttcaaacgcaaaaagtccaacttgatctgcacaagtttgactcatgcagcaatttgcgaattcgcggcgtcttctcatgcgcagatcacccaatggaattggagctttatggaggaggaggagggagaaatggagagaaaagaggtggagaaaaagacaactatacactcgtcatttgctgaaaataatggaatggggtgatagtgacatctagggatactctcctccaccaatcaataaccttgaaatgaaatgatttttagctgaaatatcacttattgcagactccacaagtttatgaacatatggcaattgacaccattatgtctaatgaattacatatcaaggcttttttttttcttggatacagatatctaactaggtattatctgcaatttgggcactgaatttgtccaagaatgcaaagagtgaaaaataatggaagtagagaactgtactctttagctagatataatcatataaacaactatccatttctttcagtgacgtcttatctaagaaaaaggcgcattaaaagagaatttttttttgatgattccaacaagaaaatgatgcgtctactgaatctttcctttcctcctttaagcaacaaactaaacaaaaatatttctcaatagaacaagagattcataaactgacatggatccaagaactcaaaaccaacaaaaaagagagacccatgccgatgattttcaaccaagaacatcatcttctccccaaaatatcattttttttaaaaaaaagaggaagcaaacaaccaatcaacatcgacttccactcacgaatacaaagaacacaaaacgaaacagataacaaagcagacatgccggacataaaccattcatcaccacaagctaattaatgacaaatcaaagatcaaaagacaggaacacattacctaaagtcagaaggagagaaagggatgaactgctcctcctccagagaactcaagaactgaactctcaagtctcaacagcctttgtcactgcatagaattcttcaggttaaatagataggcagctggggtttgttggactctctctactactactcactcctccagctgacacgcaagaagggaaggaattaaccatcaagagattcttgttcttctctcaagagggccaacaaaaaaaagggaagaagattcttgtggcacctaaaaatgaatattttttttgggaaaaaaagaaatgtaaaaatagaaataaaaattcaatccattgactccggatctggagagatcctcaagattccccaggcaattcggcagtatttgttgctatcttccctcgctttgaccgccttgtgtggttgtcgttgtttcgcgtgccaggagcgatttgtttggagaagagtaggtgatttaatctctttttaatttaataaaaaattggaaataggtgaattatatatgcagctgtttgacaatttgacatattattatttctgctgtaacgtacagatcagtccagcctaggcgggaacacgtctggatgaataattcataattgttttattacacggtgggaaggtttctcctaacacacgccaaaagaaaaaaaaagtactagactaatagtaataactaggcattaaaaaaaaactcatgttaaaacacattcaaattttagataatgaaataaaatcacggcctttgtttacagagctatatccaattattaaaaaatgttccaaacataatcacacctcaaaagaagacattaagacataagggacaatccaaactgatagaggcgcacactgacacaaacactaataaaaagataaagcacaaacttattgaattttatttgtgaacctcccttcaagattggtgaaaagttacataactccagtttgtaacatgcaacttttataaacttaatgtcttcgtcacatttttgtagaagagcccataatcggagccaatatgttgtcttgaaaatcatatgcaaaaaacacattcatatatatatatatatatatatatattcaatattaatatttgtaggcatcatgatctgaacctataattttttagtacacatagaatttctcttaacaaacgttgtaagagacgcacgagaccgtgactaatttctagcgataaataactagcttcattaaggccctgtttacttcctacacaaaaattttacaccctgtcacatcgaacttttgaacacctgcataaaatattaaatatagactaaaaatataactaattgcatagattgcgactaatttatgagacgaatattttaaacctaattgctcaatgatttgacaatgtggtgctacagtaaatatttgctaataacggattaataaggcttaataaattcgtctcgcagtttactgacagattctataattagtttttttattagtgcccgaacaccccatgagacaccctatataatatccaatgtgacacaccaaaactttacacccctggatctaaacaccccctaaattcctattaaaaccatgcacatatgtactggcactaatatagatcttgtttggtataactctaaatccaagattttataagctggatattcctaactctacataaccacagatctggatctgctattacgttataacatttagataaattattttattttcattttagataaagatataacattttactagaaattttaaggctgtgagatctggatcagggcctaagatctcaactctacgtgtgaagatttttttttttgtttttgagaaaattggcatgattggctttgttttcggtgtcagcctggctgttgggtgcgacgactttggaagctattaacatgtgctttcttacattaggtgtcgtggttgtacaattagaatataaccttgatttatttgtttattgaaaaaaacatattcgtgcattatatacatatatattttcttgacatgcatttcattttcatctttatcccttgataaattttattgctgcactaccaaatgtacaatagtaaaatacaacctagaagcataaaattcactttcttttcgacgacatatatggacctttaaagagtaattttacaaaaggctaccttaattctgtgatgaaagtttcaggggccctcaattagttagcttatcctagctaatcttgcatgtggcaggatactatgcacgacaattttctatgtccatgttcgaaatcttttgatgacaggttaagtagaacttgctaatggatggattaataaatatataaatatttctaccaaataaagcatggcagctagcctagagcgcaagtgtcaaagcaagtgaatagttttgttagaaaaacgtggctcgtgacttcgtgaggaggttccatatgcatgatagatatcataaattagtaccctccagttttttaatagatgacgacactcacttttaaacacaattgatcatttgttttattcaaaaattttatgcaaatgtataagatataaatcaagcttaaaataatttaagtgataaaacaactcataacaaaatatattatatttacgtaaatttttttaataagatacatagtcaaacgtgtgataaaaggttaacagtatcatctattaaaaaacgaacccagcaacaaatttagattatcaaagtgacaggcattgagtgaagatcacggtaggtacgaatatgaataatcaagtggccctgaagatttgccaaagtcctacgctgcatttcgtattgcagtgaattagtaacaatattttttgtgacggtttttaatatttcattatttggtaaatagtttctatttagatttaattatgcaaactataatataa

SEQ ID NO: 27049 - DNA, 7107 bp, Oryza sativa
cacttagagagccgcatgaaaaaatgagcttattttccgcatgcgatcctcttaaggggccacatgcaaaaatagattttcgcatgcgaaaatacgctcttcttttccacggatattttctcccctcctctctcttttccctctcaacacttcaaattttttcacctcctctcctctctctcttcctctcacctcttcctctcctctcctctcctctctctctttctctcctatcctctctgtcttcctctcctcaccaagcgggagggagcggcagcggccgccaccgcccccgggtggatctggcggccctcactctcctagtccccattcctcttccctctcctccctcactctgacggcagtggcgggcgagggtggtggtggaggacaagggcgatggcggtggagcgcgaggacgacaggtgcaggctccagcggcgacggtgaacgagtgggatggcggcgacgggcgtgggtgacggcggtggtcctcccccgctcggatccgacagcggcagatctcccctgcaccgatctggccgccaccactctcccccacccagatccagtggcagtgaccctccccgcccggattaattaatcggtggttgccctccccaaccccgatctggtggcggcccctcctgcaaggatccatcggtggcgatgacgacggggtggggatgggaggaggacgatgtcgatggcggcggctggaggatgaggacgacagcggtggtgactagaggacggtggtggcaatcgcaacgagaggacggcggcgatggtagcgacggtgtagttttctattttcagaatttttatttttttcatgattttccttttcgtgtgcggtcagcttaagtgctcgcatgcgaaaatcgcatgaggttgtgctggtcgtatgcaaaaatccaattttcgcagacctttgggcgcatgcgggccgcccgtccacatgcaaaatttgattttggccgtatagaaaaatcgaatctatattagtgacatcaattataaatttatatttttacagaataaaataaacacaaagaaaatacacaatatagacaacaacaacgcaaccttaatatgtcacatattagtaaaatatcatttttaattacgaattgaggtatcattaactcatgcggcaaaatatttttacccaactcgaatcaaagacttaggttgtgtttagttcacaccaaaattagaagtttggttgaaattggaacgatgtgttggaaaagttgaaaatttgtgtgcgtagaaaagttttgatgtgatggaaaagttgtaagtttgaagaaaaaaatttgaaactaaacacggccttagcatgagcatttgtatctattattagaatttaatcctaaggctatgtttggataatggaaaatgaggggtaggattgggattgggaaatgtggcaaggtagagaggccaagttggtgtcgtcccgtgcgatggagaccgagaccgagccggtacaggagatgcgtgcggctgtagtttgagagaattacaatttaggtttggtaattgaggatagagtcctagtgtgactaggagttgttctcctactttgagtaggaggttttcggtataaatagagagggagaggtagcctcccggtatcgcttttcagagcgtggagttgatagtttagttagggtttcgagattagtcgagatttttgtaaggagtgctgttgttgcactttgtaaacacagagagaagcaataaagttgtcatctactttgagagttcttcgatttgtatttcatcgggttcggcggtctaaccggtgacataccgacggttcaaccggtgacaagacggcggttagactggcggcatacgagcaatccgaccggcggcgacaggactacgtcgagatttccatcgatttgagggtaacttttatttccgctaaaagtttttgggtttttggttttccctaccattcaccccctctctggtaggtttgattgcttgtgttcgatcctacaggaaataaattaagacctaggataaaataaggtagaaaaaaatgaatggttaggatttaaagttatcccttcatagctggaaaatcatttccttttccgttatccaaacggtgcctaagaggtagtacatgcacagatccaggtcgtcaaggtacagcggagaagcactgcagctacagtgagactgcagcacaatatgctgagtctgctacagtgagtcaatgcagtaaaacagtgtccaaatactgtggtaaagtactatataagatcgagttctacaagtcagctataagcatatgaaggagagaagagaagagagaaggaaaacaggcttcccatcaaaaacaaaaaaaagaaaacatgctacagacttatagccaactgcaatgcggactctaatacgttgtgtgtgtatgagaggtgggaccatatattaatggtgtacaataatagactataagtcggctacaagcttatgtggaggaaataaaacaggagagagaagagaagtggggctacagatttatagccagttgcagcacggactccaaaacgctgtgtgtatgacaagtgagacagtgagaccaattattaatgatgtaggccgcgttcttttcagcagttgggtgatgatgattagctacacgtaaaacgagaaacatgattagcaatgtaattagttaagtattattatttaaaaaaaaataaaaaataaacttatttgatttttaaagcatcttttatatagaaaattttcacacgaaataaaccgtttagtagtttgaaaagtatgctaatgaaaaacgaggaatagctaagctgcattagctgtttagaacgcggtcgtagtatatatttgtagttaactattatataaataagctattagattggttataaatgatttgaagctagtagctggctatactactaattaaacaataattcgatcttttactatttcaacaattacggctcgcattcactgtttagttatactgtagcactttattttggaccgttggatgtggacccaacaacatacactgtagctccctctgtagtctcttcataattacagaggatccgaattaaagcacgtgaccgtactcacgcgaggttagacctctaatcttgtcaagacatgtgctaggacatgtctacacgttggtgtagtatcaaagtgtgggtacgctttcaacttgtacttcaaatactacctatctctctgtatttaatgtatgacgtcgttaactttttatccaacgtttaatcattcatcttattcaaaatatttatgtaattgtcatttattttaccgtgacttgtttcgttatcaaatattctttaagcatgacataaatattttcatatttacataaaaaattaaataaaacaaatggtcaaacattggtcaaaaggtcaacggcgtcatacattaaaatacggatggagtatcatttaatcccaaaagagagagtttatatgattatactttcaatggtgtgtttgagtactcttacactccaactggacggtcaattaacttaaaggaggatggcgatatggcatctcatgtgttctcgcgtcgcgatcagttaaatattactcatataataagttttctatttttttctaaatcaaacttgatcaaatctataaatttattagcaacatctagaatattaaattagttttattaaaatcaacactgaaaatattgctttattttccaataaacgtgatcaaacttaaaaaaaatttgattagaaaaaaaaaggtcaaagcgagtaacgtttctaaagccttaattcagagacatggactttggccaaacgtccaacaatcaattaattgaccaagttgctttctctcctatatggacgatgaaaacgatagagtagtgtactactcctaattactgtatcgatcacatcgaccaatgttttaacgtgaagaaactgtgagcctaattcactgcagagcgtcatcatagaccaattatgttcattaattatggtaaacatcttattacagacagttcccccggtcatatatactgatcttccagtcatgaaaaacacgtcgctttagatatatatggacgcaattgtcaaaatgcaaaattgacaattcacttccactgcaaaatttcgttagaaaaattctgattagaaaatctccgaaatactttataaaagtacctttgggacaaatataaagttatcattttcaaatatccattcaattaaataacattaatttctgaagttactcatccaaataggcatgctttcattgctggaccgagtacggttttacaaacgtgactatctctattgaaatatacattgaaagtgagaggtagcatgctatgatgtatacctctcttctgaaaagaaaggcgccctactatacgtgtcgtcaaatcttaaaatcttaaatcactcatgtatgcaactatgcctacattgaaaatgcgaaaattataccaatagatttgtcaaaaaaaaattcatataattatatttttaacaatttatataaatatatactttgaaaactaattataaagttatcgattcgatgtccacttcacccatgaacgattatcaagtgtcaggtattcacagatttcatcgccgattggaccgtccccgaggaggacaaagttgatcgtacggacaacaaacattggacaatggcctttgatggtgcatttaacagccaatgagcaagagctgaattcattttcacatcaccaaccgaagatcagtttcgacatgctgactagttagatttctgagcaaccaacaacaatggggaatacgaaggacttctcgctggacttagagcaaccgcgtcacttgtggtcaaacgactagtttggaaaggggattcagaaatagtcgctaatcaagggcacaaggatcacaaatgctcaaatcccgagttgtccaagtatctagcagaagttagaaagttggagcgtaggtttgatgggctcgaagtgtgccatgtctatcacaaagataacgccgatgccaacaaccttgcctgacgagcttttaggagagagcaggttgaacctgacacattcctagaagtattaactagtcgatccatcaagagttcaccagacggcaacattaatagcaccaccaacgttagctcaaaagctactactcagattgacaaaaccatcacggacattgagaccacttaggactggcgcacaccgctcatcgattttctcaacgctgacaagttaccggaagatgatacggaagcagaaaatataccaagttactagcccaagccctccaaacgatccttatgtcgttttcgtgttgggggcttgacatcctcgaatatttttcacgaggacaaggcgactacaaatttttattcatggctatcaacaagttcattaagtggatagaagcggagccaacaagagaaatcagagccgaacacgccatcaagttcatcagagggatattctatcgatacgggcttccatatcagatgttgacagataacggctcccaattcacaagcggtacctttcaggattactgcttcgaactcaacataaaaatctgctccgcattagtttcccatcctcagagcaataagcaagtcgagtgggccaatgggatagtgtatacaataggctcatgacctgccattcaagctgggttgaggagctcccttttgtttcgtgggccattcgtaccaccttgactacacccaccaaagatacccctttcttcctcatgtacggatctaaagttatgctccctttagagctactctatcggtctacacgagattttttttctgtagaaaatttacattattggctttgtttccggtgtcatcctggctcttggtgctatccagctatgggcgccactagtttggaagctattaacatgtgctttcttatagtaggtatcatggttatagaattagaatataaccttgatttatttgcttattaaaaaaagatattcgtgcattttatatgttctcttgacatgcatatcggtttcatctttaccccttaataaattttattgccgcactatcaaatgtacaatactccctccgtcccataaaaattacatttctagctaatttaggacataacaataggattgaaaaatgaccacaatgaccttatttaatgaacccattgcatgcacacattccatatatacaaatcattaaaaggaagtttgagagaattaacccatataattagcatacttaaattacaagctgagagaacttaaggaaacttatctagataaatcaatttgctgggccccatatggctagaaatacaatttttatgggacaaagccttagagttagaaatgcaatttttttttggacggaagtagtagtaaaatatgacctcaaggcagaaaattcactttcttttttcgacgacatatatatacggacctttaaagaataattttacaaaaaggctaccttaattctgtggcgaaagttttagtggcccttaatttaattatgttattctagctaatcttgcacgtggcaggacaatatgcatgacaatttcttgtgtccatgttccaaatctttcgatgacgagagatatatattgtacgatttgtcacttttagatgtgatgtttaatatttaccatactatctacatgtcatagatatatagaaatctacatatgatacatatataagtggttaatagttaaacaccacatctaaaagtggcaacttgctaatggatggattaataaaaaaataaatatttctaccaaataaagcatggcagctagcctttagcgcaagtgttcaaagcaagtgaatcattttgttagaaaaacgtggctcgcgaggaggttccatatgtatgatagatactaatccctccgtttcgaaatgtttggcgccgttgactttttagcacatgtttgaccgttcgtcttattcaaaaaaatttaactaattattaattctttcatatcatttgattcattgttaaatatatttttatatacgtatataattttacatagggctgcaggaat

SEQ ID NO: 27050 - DNA, 2808 bp, Oryza sativa
ttacaaactggacatagttcagctggttagataactaaacaaagttggatatcatatttttatttaattgtaattgatatgtaacaaacacatcaactataaattttattttcaagcaattaataaaataagaaaaaaaatcacaatatagcaatacgataacaaactcctttttcagaactacaacaacaaactcaaccttaacatgcctgctattaatacagtctaatttttaactgcaaattgaggtatcaatattcatgtggtggtacctatttacccgactcgaatcatagacttagcatgagcatttgtatttattagaatttaatcccaagaggtactacatgtatgcacacgggtgtgacaccaattaaagcacatgaccgtactcacgcgaggttacgtctctaatcttgtcaagactacatgtgtacacgttggtacatgttgtatgtatcaaagtgtaggtacgctttcaacttgtacttcaaatatcatttaatcctaaaagagaaaagagaaagttcatatcattatactttcaaatgtgtgtgtactttcaatggtgtgtttgactcttacactccaaacttcacagttaattaacttaactgaggatggcgatgacatctcatatgttcttgtcacgatcagttaaatattacttcatctgttttacattataaattaattttatgtattttaaatcaaacttgatcaaaactataaaaaaagttagcgacatctaaaatattaaattagtttcattaaaactaacattaaaaataatatattttctaataaacacgatcaaactagaataaggtttaattagaaaaaaaaaagtcaaaagtcaaagcgagtaaagtttctaaagccttaattcagagacatagacttggccaacgtccagcaatcaattaattgaccaagttgctttaattccctcctatctggacgatgaaaacgatagagtagtgtactactaattacagtgtcgatcacatcgaccaatgttaaaacgtgaagaaattgcgagcctaattaactgcagagagcgtcaccatagaagaatattgtgttcaaatatatggtaaacatctttttacagacagttcccccggtcatatgtactcttccagtgtcatgaattaaacacgtcgctttagatatatatggacgcaattgtcaaaatgcaaaattgacaattcacttccacactacaaattttcgtcagaaaatttcagattaattagaaaatgtccaaagtactttataaaagtaccttttggggcaaatatataattatcattttcaagtatccattcaattaaataacatttctgaagttactcatccaaaaaaggcatgctttcattgctggacggagtacgattttacaaacgtgactttgaaatatatattgtaagtgataggtagcattatgtcgtaccatctctcttctgaaaaggacggtgccctacaacacgtgtcgtcaaatctcaaaatctatagatgcaaatataccaagatttaaaatgtgataattatatttgtcataaaataatatttcatatagttatatttttcaataatttatataaatatatacttctgaaaagtaattataaaacatgtgcacgggagaatgtgttgatatccaaaacattaacaaaaaataacaaaggtagtgaccggtaagatgaatttagctataaaactatttagttacttatatatagatggctaaaagaaatcatacttatgtaatacacgtacttgtaatttcattgggtttgcaataaagaaaaagccccgaccaattttattaagattatatgaagatgttacatattacaacaagtgtgaccacatatatatatatatatatatatatatatatatatatatatatatatatatatatatatatatatatatatatatatataacaatcgaaacttaaacaaggaaaggggttaaacccaaaaacagagacaaatctatcatgggtgagggggggactcaagtccccttaccttactgaaacatcaccatagagagaaggggagagaggagggggaaaaagagggggagaaaaaagagtaggggcttgaggaggaagaaagagataacccccctctattagaattagatccgtccctacccaagtacttcctccgtttcatattataagactttctagtattacccatattcatatatatattaatgaatctagacatattaacatctatatacatgtggacaatgctagaaaattttataacctgaaacggagggagtagatcttaactgggttttgctggtaacaaattaactacttttggcaaaaccaaatgggagttatcctaggtgatcttgtatctcttccattgtgattccttccagaccagtagcacgccactcccaccatgcattcttcgaaaatacaccaggaatacgtacaggtcacaattaccatcatcatgatcatcgtcatcatccacctgtgatacagcagagatgattcctactgtatttttcttttactccctccgtaaaaaaaaaactcgttatctagctagattcgttgtcccttggttgagtgttttttttttgacggagggagtacgaatcattcagtcctatactgtgacagtattaattactggtaataggtttcctcttgatggacagtgacactgaactaaccaaaaaatgaagatttcacagatagtttctgtcagcctatatatcgagcacaactgcacaagcagtcagttagtcaatagggctgtttt

SEQ ID NO: 27051 - DNA, 6313 bp, Oryza sativa
caataagaaatgatcttcactcattcattgcatctacaaattaaaatatatatagtgtgttcaacatccttggatgattcaaacactgcaaatattttaatcgcgccacttactgtagcatgcaaacgaacctctagttaaaataactcgtgttagtcttagtctgatctagacaaaccagagttttagttgaaatgccatctcacctatgtagatggcccgggaccgaggcctctctactctttcgtttctcagacgcatgcttccctaattattaaacatcgtgtttttatattttttataaaaatattaattaaaaaaaatcatattcataattaattaatcatatattaatgagttatcacgttttctgtgtgcgggaaaagttttcccaacctttactatccaacacagactagatctagagtagcctgtaggtgtgccccaactctgttttcaaccatgacaagaactggtatggatggagtatggaccatgcaagggactaatcagcgattgatgtgggaccggtcacctatgtgctgatgacatcacttgccaagtcaccaccctttgtaaaatttactcaaaactttaaggagatgcctatgtgagtatatattcttatctgtcaaagaaaaacacaattatttttcaccgggagacacattttagtatttttgttggagtcattttagcactgataatcaacttaatgtcgttgcaaaattcagggggggaaaaactgttctaggaccaatatttagactgcacgtatagaaaagaaaatatgaacctgatttcaggaaaaaagccctcatgacgtcataatgccattattgattctttcattgtcaaagttgtaacatttctactttgaggattacaaaaaggttattaatctggttttactagagctagccttaatagctactccctccatttcacaatgtaagtcattctagcattttccacattcgtattgatgctaatgaatctagacatatatatctatctagaatcattagcattaatatgaatgtaatgacttacattgtgaaacggaggaagtagctcctcataacattgatcaaaatttatacatttgaaaattattttggttcccttcacagaagcttcacacaaagaagctgagacatatattacaacattacactatatactagtccaatcacatctccaaattcactcccccatcccatggttgctcattgcagaagaaattaattgatgtgtagcctcgccgatgcgcaagcaccgggaggcaatatgcatagatcctacgtcgagaaggtcaggaactacacactgatgtggtcagatcaatggagctgtacatatgcagcttcttcttcttcttctgatgtttctcggtcatgtccatgaggagaggaggaggtcgacggcagccgccggccggccgccatcagagcggcctccggtgcgccgacgacgccatgaggatgaccatggcgacgacgaacatgaacagcatgctccccaggagagtgtaagtccgccgcgacgatctccggtactcgccgaacagcacgatcccccacaccgtgctcaccagcggcaacgcctgcagcagaaataatgttcagaaaagttcagacacacgccccggcccattcatgttcagagtttcagaaaacccatatcgtcttcttctcatactgtcaaattccaaaaccatgatcagatcataatttgcacatatgaatcttcatcttgaggatcattaatgcttgcctgataaaatgttcaagtcatgtactcctctctccaggtcgtaaatatttaacgtttaggataagatttggtcaaatcaaaactttggccattaattttatttcagaacaagtttatcctaatctgcacacactaatttttaaaccaataattttttaaaaaatactttttaaaaaagataatgggtagaaatccggtctatatatctacaagtggatatatacagccaaattgagaagttactgaatgtcaaatcccaaaattttaatgaaatcttatcctaatcatcaaatatttataacgagagagaatatctcccaagaaatgcaaattgagctgagaaagatcctctacagttgtggagattatggataccatatacctataagacgtgaacctatataaatcatccgtctcataacccatctacttttctagcttgtttgctacccttttagaatagcagaaatttagtttcgacagcagtactgcagacggcctggattgaagaaagatggtgtacctggacagcgtcagcagcagcatacccagcagcctgcccagccatgaactggaacgcattgccaaggccacacaccatgcctgcgacgagagcaagatccctccccttccaatccttcaggtaggccgtgagcgacgaccgcggcacgccgaccatggggtggtagaggaaccagatgttgagggcgatgccgatggcgaagcaggcgagggagaagtagaagaatgccgtgtacaccaccatgtgggggacgccctccccgagcgtgtgccactggtcgttggtggcgaggttgaacgccggcgagaagagggagtagctcacgccggcgaaggtgacgatgccgaggcccaggaaggtgttcgatccgagcacctgaatgtgaagttttttttttttcagaaggtcttttgtgtcatggagaagaaacaaattaatgttgttgagttggtgtttctgttgtgaaagtgtgaattttactgcttcccccccgttttatatcataagtcagttcgatttttttcagtcaaactttgttaagtttgactaaatatataggaaaacttagtaacatataaaatatcgaattagattattaaatctaatattgaatatattttgataatacatttgccttttattgaaaatactattatacttttctataaacttgatcaaacttaatgaagtataactggggaaaaagtcaaacgacttataatatgaaacggagggagtatgttggaaatacatggaaggttgtgtcagatttttaaaaaaagttccttagagatacatggattttcatttgtggaaattttgctagcaactctgctttgcaattgctccacctgaatttctgcagtttagtcatgacattttaactaatatattggtacggttagtattataagtacgtactttaatagatctcttcccctcaaggtcaaccaggaaatcagctgttcctgcctctagtttttccacagcctgggcagccggtgccacttcaggctcttgttcttcacaatccttgggttgttctgtcaattgaaagattagtacacatagctctatgatatactattattttcagactaaatctgattagtacctatctcaaggaggtgcttggtgagttcttcattttcagtgtccctgttgagagttcaagttaattacattgtttgttcagatgaatttactgcattggaataatgtactgatgcacaaatgatacattggtcgcaattagcaacaaccaaataaaattcaagtaaaagcaaattaccttatatacgtgttatttttcaaaattttcagtatttcagaagtagaatttaggcagaactgatgaaacggattcaccacatgagtgaaaaacggaagaagagagtttatacccattggtgttgctgtggttcaccatggcactagacagcttctcctggttgtcagcagcattggaagagtgaacaagagatccaaggcaggctgcaatcagaaagcatccgacaccggggaaaagaatctccgccttgttgatccggccatcgagaaaatagttcagtgttgtccctggaagagaagtttctcagtcacaccatattgtcattttcagattctgaacagtaaatgctatacaagcatcaggcatcattcttattatcaggagagcatatcactctgaatttttttgtacctatgacaaccttcaggcttgacgccatgacctcggtgaccgaaagcccgacgaacgcccacccgtactgcgtggccagtgtccctaggccgttaaagatgccacccgacatcgcgaacaagattgaaggccagttgtcctgcatctttatttgaaaaaaaaaaggttatccagcattgatcaactgaaattttcagagttttctattaacacaagcctgatacactgggttcacttcctttttttagataatgaaaacagtttacatctttggcctcttccgacaggaaacaaggttcacttccctttttttttagacaatggattggaacccggcctctacatccaacatgaatgtaaaaaaccaacaaaattcacttcctagtgacaaaccacagtttttcagaaaaggttgtaccccatgtctgaaaagtctgaaaactgtactagaccaacatactgaatgtctgaaatgagcatcacttccttcagactaacatgtctaaattcagacaagaataaccatgggcactaacctgggtgagctgtgtgaggaaattaggcgtctccggcgtgtcggcgccgatctggccgaaggtgaaggcgacgaggagggcggcgaggaagttggtgatggagtagtccaggtaggtgtgctgcgggaggcggccgcggcgctccagcacggcgaggaccaccggccatgtgcccaggagcaccagtgacacgcccatcagcgcaatggcgccgccgatatccttcacaagatacatgatctcgccggagccggagaagaatcagggacagagtaattacctgctccatgaaactctgtcagacttggtaaacggtgttactctgcaaagtcagtgagcaacagatcactgtgtaaagctatgaactggaaagaacaagattcaatccaaactctcagtgggaaagattcattaggattttgtgtattgcattgaaaccaagaacatgagaacaaaaaaaaaacatagactgaactctggaagatgtaagagaggtgtgcgatggaaatatgtgatctctgaaagcgaaatacaagtatacagcttcagctacatggttgcagctcaagaactgttcaggaaacagcagaggtagtaacaaagaagaattgttcacctgaactttccgacaacatatacagatcagattcctctacaacaaaaggctaaaataacttaaaattcaatccaggaaccaagcttctatcagtctctgttcagctgtaccatataagtgaactcacagaaggaaggaacactgaagagtgaagctaagaacagctttggattggagtggaaacattacaagaagcattttcagcatcatcagaaagaagacgcagaaagatgcagagcataatccatggacattactttccaaagatctatgctctccaaaacaatctcttctataaataattcaagtcaacatgatccaacacactgtgtgagcaaataacagaaaacacatgcacttgcaggaacaacaaattaagaagtcaatgcacatgcacttgcatgttctaacaccaagaacatgtgaaccacaacgattcccataaactctggaagaaatggagaagagaagcttcatgttcctgcataccacagaccacagctctaggattgctaaagattcaagaagcacaacgaaaccatctctgagctcaagaactgaacttgaaacagatctagcagccttgttaaattatcttggaacaaaccaaaacacccagaacacacattcacagcaaaacacctcaacagttttgctcaaggtaagtgcagaaatagcaacataacagctagctttttttcatgcaaagcaaagaactaatgaacataccaaataaacaaggaagaagaaccagtgagtgctaatcttgttggcccttgagccctgttactatgagagagagagtgtgtgtgtgtgtatatttacactactccagccagcatgtgtctgaaaatttgtggtgcctcactgcctctggaagcttcatgcatagtcagtgagcttagctatagctaaaccttagctaattaagtagtagtagcagacttatggatatgtgatgaggagaatggagattgggagcaggtggggcccacacgagccagttcaccaaccgggtgactaggatgtgatctgttgggcccacaccttaggtggaccgtaccccaataattgcagaaattttatcctctttgtcagatctaaactgccctccttgaggtgcattgcacatttgcagtagtagcagtagtaaggcctgg

SEQ ID NO: 27052 - DNA, 6076 bp, Oryza sativa
atcagttcattattatctggaactcgtcaccatttcaccaaatgatattttctcttttctttatatttacgcctagtcgggtctgcgccggcagcaccgcaatgcaaccgaatagactaatatatttctaagacagaacaatactcactctaacccaaaatataaggaattttatgtggatatgacacatcccagtataataaatctggacacgtcacaataaaataaatatggacatgtgtccagattcatcgtactagggtgacgtgtccagattcattgtactggtatatgtcacgtccatccaaaattccttatattttaaaaccgaggaagcatgtgatatagctatacatcatacatccatacaaaatttcactgtcgcgctttatgtaatttaataatgcgagcatgagattgatgatttaattttatactagcaattgattatgcttgctttactggttttagacgcattaagctgatcagtgtgtttttttccggtaggttatgggacattaatttgtgaagttaaaagttatgtaaagtttgtgctgtttttatcctcacaaaccaaattaaggcacgaacttaactttgaaactgaaaagttaatttcagtacgggattctgaacgtactccccacatcccataatataagcatctttagcatagtgtcaggtcaaccattttaaactttaaccattaatagcaagaaaataaaaaaaatacttatattcttgttatttaaaacattttatttttatagatattgttggtcaaagtagcatcttaaagaccgtgtcaaagtcaaaaagaatacttatattctaggatggagggagtaagtaaaatagaaaagaggtaaatataccaaagattaaaaaagagagagggtaggcagttaggcacaatgtcacatcgcctaatgtcattatatgcagacatgcatgcattatatgatggagctgatcgataccgtttgatgccaggtagaagcatattcgtgaaaatcgcatgtgttggagttgataccgtttgatgccaggtaggtactggtgtctgaatcaaaaatagtattaacagattagtacttttacgtttatcacgactagtaatatcgttttataccattgcaaattatcagtaataaaaacgatttagactacttacttacgggtcctattacccctgggaaaaaaccttgtaattaaattgtactattgtattatatataaaattgaggtggtaggataattaaaagacgaaaacggtagactgattgcactaccgatagagaaaactaaaattgcctcaacagataagatcaacatgttataaaactagcaccgaaatcaacgttgataaccgagcacgaaaaaagactatagaagttgcaaatataatgacgataccgagccacaatatttattaataaaatttagccaaaacctatatctataggacactaattacgaatatatttttccgatccagcatattacatgaatatccgggtataacgaccctcggccggtgtggctctatttaagtgagagccatggctaaattcaactctactactatcctaaattcctaatacatattacaaactttaagttttaattaatttgtaaccgattatgtaagcatatccgactaaactctaacattctgcatagaactaagacgaacaatatcacatccacccaaaatattatcacaaaattccacggagatttcggaggaaataaaggtctagaatataaataaatatccaagtattccatgcatctcaattaaactgtacttaattaatttctttgctgcgcctgacgatccgtcggccctgtgctacatcccccagttcgcatgccacatgtgctgactgcatgagtccagctattgctgcttggactgtactccttcgtcagaaaaaaaaattaatataggaggagatgtgatttctcctaatacaaatctggacaaaaggatcgcattcccttagagcaagtttaatagtatagccaactgttagctccaaaacaactatagctaatctaatagcccattcatacaagtaggaaggtggcccgcgcgtatgcgcgagcacttatattattgaaaggtaagatttttattgtttgttaaaaaaaattatctcatagattaagggcaaactaaagttcgcatactgttattttgtaataatttaagggttctattttttgttaaggtatcttaaaaatccattcagagtgggagatggattaagtacttacgacttttgaatcatgtttttttctgagtaaatagattaaatcgtctcataaaggtgcatgatatagtaagaaagggaggggagcatattcatggagaaaaagaataaagggaaaaataaaaaaaaggaggggaagcgtaggtacccacgtacgtaggtgcgtactaaaggtggagaggtgggaccttgtagtatttagtttgttctaagatcaatttaatctaatggtttataatattggacccaacgattcaagtgaaaatcaagtaatagatactttgcttttttttagaatttctaatattttctctaatttattagagcaccatgtggcatcttgagggcattttaagaaattttaatgggcttaccacatataattagaatattaagatgtaatatatatgtatgggatgtatgttaatattcgttctagtttcgtccatgtttatatacacgtagagaaaaattaaatatgttgctagcaagccattagatgtttaattaatagcaattaattttgatacctatttacaattggtcatagtagttcttacagattcatcttacgactttgattatgcgttgatcaccaatttacttatcaccatgactcgcacgaaaaaatatgtactttaggggttaggacaactgaaattgatgaattatctaatttatgtgatagctatttgagattataaacgaatgaattgacttctaaaaagttaaaaagttgtttaagaaaagcaccatttagtaacatggaaagcgtggagcgtgcaaacgaaaattcaaaagatggaatcagggaaaaatagggccttaaactcccttataacactcttatcctatcaagagttctattgatattcgttaatattgtgctcacaattataacataataatttctttcaaccatacgaacaaataatacaaaatccaaatacaacataacacaatacattataattattatttaatcaactctcgatttcagcttaaacagagttaagtgttccacggtacttaattcttctctcgctgcatcaaatctttaattttcttttcatgctattaacaacagcggtagcgctgcagtggttgtgatcacccaagatgtctcaaacacgacactttatcatatgtgtgaaaggcaaaggtgcagacgtgcattgtgcagtgtgccaaaaagagaactttagacattattaacaatagatccgatgatttaaataatgggtccaccggttttagtgtaaatataaattagttaatatatatgttttaaattgttaatttaatgggtacacaacataatggtgatggtgtagattttattttaaaacactaaattattcgagaataatagtccaaagtaattaaaaaaatagatccgatgatttaaataatgggtctatctgtttaattacacatatatattagttaatatagatcttaaattgtttatttgatagttacacaatataatattgtgtaagctttattttaatatattgcattatatgaaaataatagtacaaagtaaattatcttacattattgattttagagctaatttacatataatatggtgtaaattttattttcaaagtctgtatagctaatttagttacctgtgtttataaagagttatacgatggtattttcctttttaaaaaattatgattatttaaacaaatatatatcaaattgtataaatggaaaaaagaagaaaaaaaaggagaaaaatggagggaggcgtacgtactacaggcccacgtgacctacacctatgcacgcgcgagaaataggagaggtgggacccatattatttggtttgttttaagatcaattttatctaacggtgtataatattggacacaccaatttaagtgaaaatcaaggggtggatgttttgtttttttcttaaaatttctaggattttctctaatttattagaacgccacgtggcagcttgaggcatgtctagattcgtagtcctaggatgggtctcatcccatcctaggttgtaacattatgggacggagggagtaatagttagatagataattaactataaaaatatactacaccattaatacccgatccatctctcatacacacataacgtcttggagtccgtgttgcagccggctacaatctgtagcctgctttattctctctcttctcttttcttctcggtatgtggttatagctggcttatagcttgctattgtacctgcttttataggttgggttttttaagatggagggagtggtatttataccattcattatcatcattcatcatctcgctcctgaatattatacctagggactcgtgcagctaaccatatgcatgttcatgatttcatgatttcgatttgaggcaggcatgcatgcagcatttgtataatctctggcaagtacctactcatggagaaaaataaaactacaagccaaaataacagatcaactacttgtgagggttcacaatctcactcgataccagatcaaattaaatctctgttcactagcggtatcattgaatttcgcggaatccgtcgatagtctaacaaaacttgataactcgaatgaattttttttaataactttgaattcggttccattttttaacttaacttaaagatcaagtgatttgtatttttagccgagtccgaaaagtcgagatcggtttccgctggaattctaaaaccctgctacttgccaacttggtgccaagtgtcatacatgcatacccatgtcccttggaaatgcagtgatttcagacacgaagatttggataattaattaatgcagggatgggcctagcttcgtcgttcagatatactccaattcggtatggttatctgcacgagtttatttaatagttttcccatagtccaatcgtttggccgtaatctgtcttacgtgctatttgcgagtacacacgagttgaacaatctgaccatattttctatagtttagttcgtttcaaaacttataattataactaaatgcagggccaaagaccaacataaaattttgctgaagtcctgtttgaaatactttgattttgtgggaattttgcaagaaataatttaatcccagcgaaattcctctaaaacccttacgactcctttggaatatatggaggatactcttagggaaaacctataaaaaatttacgttcgaaatgagcaataaattaacggaattgctacatcacattcaacgaatttgcttttcgattcatactccagcaaccccaactcctcctctaactccagttgaagtatgagagttaaggtataaggccccgggtttgaatggggcgggggcaatcatacttagagggatcaccgtgaaaaaatagtagtccactagtatgtaataaatacagtcgaccgctatcatatcagcagtgacatggccgtggatggaggagggtggttggctggcattggtagcaaggataaattggcgcttgtggttaatttaaagacggcgatcagtgatgatggatccggtgacgggagctgtcggagacaaggaattaattaattaatcaccaaagtaattaagctagtttacagatccatcaaatgatcaactagttaggctgtatgcctgggtttgtgcacacacgtagctagatgggagattccgggcgatgtgcgtacgtgtagctaccagcacacacacacatgcgtctaccttagaattgactatagaagaacagacatggatgagttgcaacgtcgtcgtcaaaacggtggtgtctggccggacgg

SEQ ID NO: 27053 - DNA, 18580 bp, Oryza sativa
atgatgatgtccgatcgatctcgacgtaccccgccgtccaaaaagactaaacaaggaggagattagtacattgaatctggacaacgttttatccagattcgttgtatttggaggagtcacctctttttcttctaagagtttttttttgtttttatggagggaatacgtacgtgtctatgtggctggactagtggactgtactacgtgtgacgtgtccactctaatccaatgccacacgtgtatatacgcatgtacatataacgcatccatgcctgaatatactggagtactatattactatgtaaaatataccaagctagctgatgttactgaactgtcagtatacatatgccacgcatgcatgcctctcgcctgaaaatttatatattagtttttctgctgggtcatactagtactgatgaagataaaagtaaagattaagttaacacgtcaaacgagaaatccatcagcagattaacaatttgatatactccctccgtcctaaaatataagaacctataaccggatgagatattttctagtacaatgaatctgaacaggaatcactactacggaaatcatctttcgtggcggctattttagcttttcgttggcggaaattgcagccgccacaaagtaaatgccagtaaagatcaatatctttgctagcggttattgaccgcaataaccgctagcggtaattcatttttgctggcagccgccagcaaaaatctattttcgttggcggttgccttaagacggccgccagcgaaaataaattatcgctggtgggtttcactgtgctagccaccagtgttaatactggccaagtttaaaaaaaacgacagacgaccgctccgtccgtctccgtcaacgctccaccattcaaaaatttcacagaaatttacccaagcatttattcaaaattccacagaaatttatatcaacaatttatagtaaaaaatttccattcaccttagcattcaagcatcacaaaattgacacattaacaaaaatttgaagtcccctcgcgaccgccgctgcatctcctccttggctacatcggcgagcgggtcgcctcaccggagttgctcgtgctgctgcctgatggcctcgcactgtaacgccccgattttcattcgggattaaaaatcatttaataatgtatttcccagaaattaaataaaaatttaatcaatttaatcaagtgaaattatagaggaaattaaaattttcctttaaaaatcattagccggaaatattttttaatattctctgttccctaatttactctccagatttttttcgtgaatttttggagctcaagaagtaattttaacatcacaaagtgcatttaatcaattaaataaaaagaaaacaaatataactttcccttcctccctttcgggctcggcccaaattcctcccctcctccttcccaggctggccttccctccctcggcccgctcggctctctctctccctcaagtctacaatgcctccctagcccgtttccccctccctctctccccgacaggtgggacccgtgggccccacctgtcatcccgaaccttcggtctcccaggtcggcaaccgccataccgccattgccgcccacgtcgccgccgattccggctcctcccgctcgcgacctcgcgcccaaaccgcataaaatcggttcccctccaccttctctacactctcctcacgtttcacccgaaaatctcgccgggatcgagctccacttcgcccacgatgtcactcacgtcgcccgccgcgccaacgcttccataggcttcgccacgccgagctgcacacctccttttctccattccaccatcgaaacactgcctttgtcgcgcaatgcaagccgccgtcgcctcctccactacatccaactgcttcccgccggggagcgagatctcgctcggccatgctgctgccgccaaaagcatcgccgcgctccaccgcccctctgccaccgtttccccgccgccgtgagccgcctaactcgtctccccgtgcatcccggtgagtttcgtcgccattgtccactccggccggcgtttctcgtcgcgcagcaactcccttccctaccctaacctttcctccttgttccccaggtccttccggcagccgtccaccgattcccgctcgcggaacaccgccggaccgccgttgctgtgccaccccgaggagcccgccgccggtcgcctccttccgccgtgccacccggtgagcccccatctcccctccctttttcccttgcaccggccgcctcccgtgcccgccattgcgctggtgtcgtcgccggtggccgcgtccggccgtgaaccgccgccgcccctttgccatcctgtgccgccgcccgtggaccgccgtggtccgggtccacggtgtcgccccggccgcggtggaccgtgtccactgcgccaaccccttgtgtcgctgacttgtggggcccgcctgtcggcgccggtctcccttgctgatgtcggcgcttaacttatcctttgagaaaattatcattaatcgcgtcataaattgaaattcatttaaaatggctcaaaacttctaaaattcatatctaattcatgcgaactccaatttgggccattcaacttgcaaaattcatctaaaattgagttctacatgtttgttcttttcatgtactattttcttggtttttattagagtttttcctcgttatgcgtgccagcgtatagaatccgtcgtttcggaagtccgcggtcgcgaggaaaagagtttggaagatcgtttgaagaagcaaggcaagtcatacgtttgcaaattaaatatgcatgttttgctaattacatgggatcagggtttacctatctgcttgcttgtgccatatttacttgatatcttttctttgtcaaccttggataataaatcgactagcttgtgttactatgttgacctagctagaactatttgcttagccatgcttaattaccactagctcagttgatgggataattacagttttagacctattagtatcatgacgagctgcgtgctcgagacacccgaccatgttgcactgatcgtaattatccaactaaaatgcgactgaatggtgggctgtgggtgcatggttttgctagtcgcacccatggcaattaaggaccggttcgcgggatgcactggaagacatacaacgcttgccacaagcgggaatgggtaactgcctgacttgaagtatagctttcctctggctgatgttcccaggcaagggtgagcatgatggagttgggtcggctggggtgtccggttgtccagctgtcggattcaccgcggcgcacgaggggactgcccacctccggggtagggggtgggggtgaaaccttagcgtggtgtggatggttaggggagagttatatgaagggttttgtcataatcactcgacgtggtgacgtgttcatcatgagcacatgatgacacggtgacatgccggtggattgtgtcttgtgggtacagttgtgtacctctggttagagcaaaactattcgaatagccgtgctcgcagttatgggcgatcgaccagattcaccgtgattagtcccatcctgaataattggttaatgaactggtgtagttcaggtggtttggttggacctgttcaacgtggtgtagcgttgtacaatggagatctaatattaccttaattaatcaactattttattgttttgctcaataaaatactttacaactgcctttatgcaattagccacaagccatccttttatccccttgcacgtctgcatcattggtgtggcttgctgagtacggtggttgtactcaaccttgctatgattttctcttttcagaagtgtagtgcttctgagctgaagacggagttagaggaccaaggctcagacaccagttgagttttgcctgtggagtggagctgaagctccgctagggttgcctttttccgctgctgctgctttcgtttcggtgtgaggactaagtgcctcctctgtaagtatcttacgcttttattttcgtttggaaatgtatattacttgtcgttttgtgtaccatggctggtcttggatagggatttaatacacaaaatagtatggaaatttgggctaaatttctgggtgtgacacgcaccgccgcatcttctcgttcttcctcgcccgcagcgccttcgtcacctctgtgcatccaccaccaccaccacacgcggatttcagattgctgcgtcaacaaaaatggtgaattgaagcgcaagaatggatgggtgctgaccttgggaggtgatgaggcggtagaccaggccaaggactagctccactggcgtcgttgggcttgtcccccgtggcagcagcagatccggcctcccctcggcgcgacagcggcggatccggcctccgcgcggcctggcggcagtggatccggcctccctgcccacgcccgagcgccgccgccctccttgttacccgcgcccgagcacgccgcggtcgtcgccaccagagctgccaccgccgtcgccggtggggaggccgggagggaggaggagagaagaggagtggataagaagatgagaggatgtgtggtgttttattgtgaagaagaggaagaggaagaggtaggtgggtgttttaatgtgacatgatatttgtggttgggtttactctagcggttttatttattggtcgctaggaaaaattcgaccgccagcgaaaattatctttttttttgctggcggcgcacttaattgaccgccagcaaaaatagacatattttcgctggcggccgcattagacgggcggccagtgaaaatttattttcgctcgcgattggtgcccctcacccccttgttacgagtttgctgacggttttcatatttttccgccagcgaaaatgataggctaacaccatgaaaaatcgtttttctagtggtaaatatcccatctggtcttaggttcttatattttaggacggagggagtatttgatattttaaagcaatgtatcgtttaataatttaaaaagtgtgctaacaaaaaccattgtaaaatctacatgttaatcatcggaaaagaacagtgtaattgacccaaattaagagcagcaggtcagggaattaaagagtagtggagtacattcctgttcgtggcgccatatattatggtctttgtttgggcagaacggttgtatgtgggccgggcctttacaaaagctgatttcccttcctcgaggaaaccttaccgggccgaaccttgggcccacacgacagatcgtgacagccgagcaacacggcccagagcccgtgtccccaccgagtcaccgacccgcacctccctgggccccacctgtcatccaccattccccatacccgtccgtgtcacggagaccgccaccgaccccaccacctcgttaccccccgccgtgctcgtcccagtctctgccacgtgggccccacacgcaccacactatttattcctacacgcgaatccgtacgcgtacacttcgactcgacgcgtattcccctcgccgccgtcgccgactcgccgtcgattcgccgccaccgttgccgccgcttcgcgcctagggtttcgtcgccggccgccgctgtatgagcagtcgccccatcgtcgccaacctggaccgtcaccaccaccaccaccgccccgatgtcgtcgtcgaggaagaccgcgggcccccgcggcggcggcggccgccgcagggacgaagaaggtgggtagtgggccgagccgggtgacgctggagaggctccgggaggggatcgagcggcgggcggaggaggaggagaggcgggcggaggaggagaggagggcggaggcggagagggccgccgcggaggagcgggcgaggcgggaggaggaggaggggagggcgcgggcggaggaggagaggaggcggagggaggaggagaggcggcggaggaggaaagaggagaaggtgagggaggaggcgcggcggagggaggagcagcggcggcggctcggcatcaccgtcgtcgctgattctcccggcggaggcggtgatggcgatcgtcgtcggcctgtgtacgactccaggaagactaaattgcaggccaagcctcatggggatgcccagtctgaagctgatacggcagaattgctgagctcgaagccgcaattggaggacgagcagatcaatgcattatctatcgaggttgctgctgccgcagacgcagtagaattgggagtgggaaggaaaactggatcatcagaagaggatggcactgttagtgatggtggtgatgattcttgtgaggacaagagcttggatggttttgatgtccaatctgatgggaattctccctgtgttgcagagggggaaacagaggacaaacttgcgacttctgcttcccaggttgttaatccagtcgatatcgatgtggctggtgaggttgaggaagatgggatccttgattctcaagatgcgtgtgcaatcgagggtgacagggtgctccgtgagacgatatgttgcatccttggccatgtggatgctggtaagacaaagctccttgattgcatcaggcacaccaatgtgcagaaaggggatgctggaggcatcacgcagcagattggcgctacctacgtacctgttgaatacgtcaaggagagggccaaaccccataaaggtgtgtcgtaatcaaagttcctgggttgcttgtgattgacacccctggccacgagtcgttcagtaacatgcgctcgaggggaatgagtttgtgcgacattgctgtggtggttgttgacattatgcatgggcttgagaagcagactgttgagacccttgctcttctgaaagaccgcaatgtgaggttcattgttgtcttgaacaaggtagaccggctttgtgggtggaaacattgtccagatgcaccgataaagaaggcactcgagaaccaatctggtgatgtcaaaagggaatttgggtggaggttgactaaggtactggcaatgccattacattcattgatccaatatgtttcaatgcaaatattttctttgattttatttgacaatttgactcatctatctaaacaggttgtgacacaactgaaggaaaatggctttaacactgcactatactatgacaatcaaaagtttcggaaagtgtttgacatagtcccaaccagtgccataaggtatgtctgctatatgctttgacttttcttgtttattaggtttcattttcagttgttatatgtgatttgaggtttaccttttcctaacatatgctattccatcctccagcggtgaaggcattccagaccttctactaatgctggtgttaaggtcccaagcgacaatgatggagaagctaacctttgtcaatacagtggaggtttgtccactatccattactatgttaatctccattactctgtttaatatcgagttacttactagtttggatatgcaccatttatcaagatgttgaatgtgagattgacttcatgtttgtttgatcagtgtactgtcctagaagtcaatgatgacaaagatttaggaactactattgatgtagtgctgattaatggtgtgctgcacaaaggtgatcaagtgaatgtttgcactaaacaggtataataacttcttaaatttgagatttcataccccttgaatttttccacaacggtttgatctcataatcttaaacatttttcatcttcaggggcctgtcacaacaactattagagatttgttgacccctcatccattgaaagaactgagagttaaggtgagttaatgattgcactctcttttgacagttatagtttctgtacataagtttttaaaagaaagaaacaacatatgcaaatctagcaaatccccagaaggtaataaatgtatatgcccatgagagtgaaacagttcatcttgttaaaacatgcagtttatatgataagagaaatactgaatgttatcatcacttaggctgcgttcttttccacatctccataatacaactttctcgttttccgttagcacgcttcccaaattactaaatggtgtgttttgtgtaaaaaaaaatctatatagaagtttcctaaaaaagttcaaataaatatattttcatgtttataataatcaatactctattaatcatgcgctaatgaggtgcccccgttttgcgtcctgttaatatgctcctccaatatggaggttcaaatggacccttaggctgtgttcgggaggaggagaacccctcctccctagcgtgcaaaacgaagctcgtattattgcatgattaattattaactatttttttgaaaaatggattaatatgatattttaaaacaactttcatatagaaagtttttgcataaatcacaccgtttagcagtttgaaagcttgcctgcggaaaacgagagaggtgggttgggaaaatggggggaagaacacagccttaattattatgtggggttttgagcaaaaatgggccacctaagcatgtacagtatatatgaatttaattttaatatgtggcaagattatttgacagtatttgttgggtgtttatttaatttgtccacttctattctgcagggcatatataagcatcacaaggagcttaaagctgcacagggggtaaagattgtggcacgggtgagtttatttcagttgtcatgccttaaaaaaaagatccaatctcgaactaattgttgcttaactttatcttttcagggactgaaatatgcaattccaggcacttctctcgttgtagtgaagccaggggatgatctgggacaatctgaagccaaaagccagaggaatgagaatgaagagggaaatgtaatacaagaaataagtaggctcaaaacttgcaaggaaggtgtctatgtgcaagcttctacttttggaatcttggaagcaatcattgagcatttgaacagccctggtgtgaatgttcctgtcagtggttgcaacttaggcccaattgagaagaaagatgtcatgaaggcaagtgctatgctgaagcggaaagaagagtatgcagccatcttagcatttaatgtcagggtgatgcctgaggcagatgtccttgcatcagaatcaggagtgaagattgttacagctgacacagtgtacaagcttgttgacagctttaatgaacacattaaaagatcaaaggagttgaagaaaatgcagtgtgcagccaatgcagtgttcccatgcaccctgaagattctgccaaaccgtgtataccgtaagaaggatccatttctttgtgatgttgaagtcttggaaggtgtcgtcaaggtacttcttttagccttattattttgagtgaattctgttaaaatgataattatcctagatactgatgcataggcatttcgccacagtttgagttagcacaattaaactttacatgtcagcagtttggttcattggcttttagtcttggcctacttatcacggtcaatgacagtgcaaaaatatggtaccttgttattgcatccaaattgagcttcacaaaaagtgtggcatgctacaccttagaaataaacttgatggaaaatcttggcatctatccaaacctataaaagtttacaaatctggcgctattgcaataggtcacatatattactgctcatcattgattgtggtaattgcatttcaggtgggaacaccaatttgtgtctatgttggaggcacagtccatggtcttggaaggatctcctcaatgcaaacatcaaatggtaatcagattgattcggcaaagcgaggagtagtagtatccgtaaaggtatgaataacaaagatcgttaggataatttcagttatcaacaactaaatagaaaaagcctaacatacattttctccaccagataaccggggagagccccaaggagaagacctggttgtatggacgccattttgatgagagcaatgagctgatcagccaaatctcaaggagatccattgatgtcctcaaagagtactatcgagtaagatacataaccacagccatttccatttatcttgcagagcccttaacacgtgcatctaatttttgtgaattcaccttgctgcaggatgaaatgaatgatgagaattggcagcttatccgcaggctaaagaaactactcgatatagcctgaaggattggaatacttctgtcgtcttctcgtgtcggcaatttagatcacgttcatcattttctggtctgtgttgtgtccagaaactccagtcatactttgtcatcatttgtcaaaccgttttgttactttgtgaataatggatgaatctatagatgtttgtaatggcgaatattgtcgttaatggtgaatgttgcatctgtgatatcttcctggagtgaaatccttctgtgttggactaccctgtcttcctatgtgctgctgaagccatgagaagtaccactgcaacgatgaacatcgacaacatgcaaccgagcaacaggtaagtcttcctcgatgatctccggtactcgccaaagaggatgactccccagaatgtactgacaagaggcagtgcctgatcacaccatatcatgaacaccatgagttttagttgtattacagctgaaatgcaggtaaaatgcagcaaacattgcagagctgatatgaacctaaggagaggatcacctggacagcatcagcagctgcatatccagcagcctgcccacccatgaactggaacccattgccaaacccacagagcagccctgccaggagcgcccagtgcctgccgttccagtctccggcataagctccgatggtcgacggcggtacaccggccaccgggcggtagaggagccgggcgttgaggccgataccgacggcgaaacacgagacggagaagtagaagaaggcggtgtagaccgtcaggtgggggacgctgtctctcagggtgcgccactggtcgttggtggccaggttgatcgccggcgagaagagggagaagcagactccggcgaggagcaccattcccagtcctagccacctgctggagccaaacacctgaaacccacaaaccggtattcaggtttctgaatttcagggcctatattactcctttataagcttcaccaatcttcagaggcagtgggtgatgtgaccttgatggatcgcctcttctcaacctgaacgatgaactctgcggtgccggtatcgaaatcgtcgtcttcgccattctccagttcttcttgatttggcagcaacttcactgaaaaaaaaatggtagcaaagtagcaactttgttagcttctgcattgcataatctcaccctttttcaggtggttagaagatagatagtaccaccttggtcagcaacatcactgctgagctctatgcctctactcctgcaaacaaacgaattgtacttcttgacatcaaaggaaggtctctcgaagaaaattcagattggtagtgctcaaatgcatttctgaatcctgacatgcttagcttctcctcctcatccttggcattggaagagtggacagcagagccgaggaagatagcgacgaggaagcatgctacacccgggaaaaggatttctgccctatttattcggccatcgaggaagtagttcatggttgttccttcaatagatcatggtcatccgcattagcgaagtgcaagataaatagctgcagattcaccaaagattcagttttttgcatgtttgggtgtacctagaactacagccagacttgagcagatgatgtttgtcacagacagaccgacaaatgcccacgcatactgcgagatcaaatgtccgatgctgagagcaatgccaccggccatcgcaaataggactgaaggccagttatcctgcattgatcaatggctgcaaatcatggaagaattcactgaagttgattatccacataaaagctgaacactctaacgacagtgacacgatgcaaccaacatacagttgggacaagtctctcatgcttgttttgcgtccacagataccatccaaattccaaagtcacactgtcaacttgaagcaattctgaatttccagttatcaaattcagctattcacttccaaattactctcattaacaggtactaactcacacagcttcttatgaaatcaccactgcattcttgatggctaagatattctagtcctagattgcatgacacaagaacaaccaactgaaccaagaaaccttaaaaaaagcactgacctgagtgagctgagtgaagaagcttggcatgctaggcctggtctctccaacctgcccaaatgtgatggcaatcacagcagcagcaaggagatttgtgacagagtagtccaggtatgtgtgctgaggcagccgtcctctacgctccaggagagtcaggagagcaggccaggtgcccaggaagaggagggaggccaccatcaaggcgacggcgccgccccggtcctcgacgacgaacatgtcgacgccgggaagcggaacggagagcctggggtgtgatctccggggaggatttcaggctagatctttcatctcaagtctcaattggacgaattgctcatgtccatgtgaactagtctcactctaacccccatttccctggcatgttgtcctcatctagttcatgttttggcctgaaaaaggtaaagagataatcaaggatgtggtcatgatgagcccgctacggcgctctctactcttagtagaaatcaatatgaaccctatatcttatttgattaaagagtttaaatttatttatactatcaccttagttagcgggagtagaatatgaaggggtattattataaaaaaaatacaaaggggtataatagttatttatcagtgactaaaccttttttttcttgttttagtgttttcgatgaaatatgagtgatgctagtacaatgaatgatcgatgtagccgggaaaaaaataaataataaagttactcctaatcattatattattagtaaattactgattaacagttgtattatactacagtaaaaagcaccagagcatctcattgcaaatatataacctgtgactgaataaagaaagcacaaagttcttgagatctggtttacaagtcagagctgcccttatttttctccacttcatgaaatgatgcaatataaaatgaactagttgaggatatgtgttccttgttagtaggtctacttgtttgcaaggatggatagattaattagctggagtacataattaacgatgggttcagttctctctgctctcttcattaactatagagaaaattacataatgggctaatcaaagagcagcagaatcagatgaaagaacccaaaatcagatgggatcacatacgagaaggcacttaaggtcgagagtagcagtaagtttggtgttaatgcgtaatctaaagatttttatagaaacaatacaattttaataaaaaatcgtaaaaatataggccagccagataaaatcgcaagtttagcacccatggggccatgaaaaaaataataaaaagtgcatgcatacaagggcatgtccaacatcccatgttcgacaggttctactgcacaacccctatcgaacaaccattgttcgacacagtgctaaacttatgattttatctggccgatccatatttttgcgattttacattgaaatcatattactcctaaaaaaatttctaatctaaatgggtaataatgcttgaaattttcatcatcaaagaaatgtgaacgaacctatatatattggctagtgagcacacaaagtagattttttttttgtgtgtgtgcctcctgtctcagggattttgaggtgtcggaaaagtggagatgccacggagttgcggtcggagaaggcggcgtcgtgcgagcttgaaggtaggggaagcatctgacatgtggggtcaggtgggtccgacatgtcagcgggaaagaacgaggaggcgggattgctgggctgggttgggctggctcgcggctatgttgggcccgcggaaagatgcacgccagagttgggctggatttggcccagatcgaggaggaggaatttcaatcgctttatgatttgctgaagaaaggctgaaatgatatttactcatcatcaactatcctatatttcattcaccaactttttttactcatcatctatatgtatatttcactaactcattttaatcatcatcatcagacaaatccaacagcctaaataatctataggagtactgtagaagcaaatgatccagatcacccatctctcctttggacacagatcgacctaccctgagtcctcgagcacagattggcctaccttgagctctagacttgtgtgcgaatatgcaaatttttaacgggggcacaaattaagtttgaattaaaaaatagtgacatggtaaaaaattgtaagtactcagtgattcactgtagatacgtccacggcgttagaacccgaggttcgtagaaagaagcttgggatcacagaattatccacgtggtcgttgatcgccgtctctcgtttcatcctgatgcttctcattcattctcatcctatcctacaattggttctatggctgtgtttagttcacactgaagtttgaaagtttgattgaaattagtacgatgtgatagaaaagttgtgtgtatatgaaaagtttgatgtgatggaaagttggaagtttagaaaaaaaactttagaactaaacaagacctatatttttcttcatagtactgcattcgatcgccgtctctcatttcatcctgatgttagctgttgacacctgtgtttggctcttcgactgacttggttttttatgggtggagagctggggtatgggtaggtgcataagcaaggaagtaaatttatattgatgtaggggtcactggtggagaaaccgtttgtagtcccggttagtaacccctttagtcccggttgttcaaccgggactacgaatccgggactaaagatagcatcccgggtgaaataaccgggactaaaggttaccaatcgggactaaagatcaaatatgcccgttaccctttttaaccgggactaaagatcatctttaatcccggtctttgttgcaaccgggattattgtggaattaggcctaccgacgaaagatggtttctccaccagtgggtgtccatggtgtgattttggtgggtgtttattaatttctgattaagatatatattttaccttgattttcgttagcacacatttcaaacggttaaacggtgtgttttgtgcgaaaactatttatatagaaattgccttcaaatattaaataaatcaaattttcaagtatgtaataattaaaaatcaattaatcacgctctaatgactttctcattttgcatgcccatacttaatcttcattggatgctatgttgaatggggcataagggagcataaaagtgtaagtacgatgatatgtgaatatggggtcgctcaatatgtagatcggataaatgcggatttggaggttggggtgttacaagtggtatcgaagagtttaagtgatgtacacaaatatggtacttagatgaaatatataatggggcttatttcttttaccactagagaccacggtaaaaaaattgtcctatgttggatcggatacatcatcagttcatcactgaagttcttaccaatgctgtgtttgtgagtcagcttataaatgttggcttgtacgtgacttgagaagcccaaaactaccatgaactctttttcccccaaatttgcttcagtctactgtctaggcccaatgcaaatttctggatagcatatgcacagtacaaaactgtctgttgtatttggatttggatgcatcgggaaaacagagatgactagaagcagaaactacccacgttcagtacctactggatctagtcgtatatctcaaccatggaaacacatgcatctttggcctaacagttcaattttgttgttgaatcttcatcaagctttttgttgtgccttcgtcaagcaacaaaaatccatgaactgcaaaaaaaaaaaaaagtacgctgaagaattacctaacatctaatacgtactctggcgtgcgtctatttgcgtgtaccttcattagtatcttaccctatcctcaaagggattcctaattataatgtggtctttaactttattagggttataagaacatcaaccgttggatcaacagccaatggatggtgtaaataaacttagattattctaaaaagaaaaaaaatccttttttggatgagttccgtgtcttttctttttctgtcggggtggattcccctattgggatttcattctaccccacttcctttttatttaaagaaggcaaaagcttgagcggtaaaaagcacacttcgtacaaacgtacacatcgtgctcaaaaatccaaaagaaaacttcttcccctttctaaaagaaagaaattcccagttgaaccaaaaacatgctcttctcaacaactctccaaaaattcaccttgcttctcccaaaaatccaaaaattttcacattacttctctcccttttgacaatgatttcatcaagcataggaattatgttcattaatattcaagagcttagtatacatatagcatatcaagccatgtgttacaataaaaagaagatgaacccatctaaagcagaacaagcaaaagtataaccatgaaccaaagattttacaattaagcttgaatcaacaatcaaaattcatgatttcatacgatttataatgcaacatcttaacaagtacataggttgaagaataaacactaaacacatatacttattgcatttattactctttctcaaataaactttataacagaataaccaagagaactttttttaactttttcttttcttgagcctttttgctcatatttttctcttttattccgggtacgtcctagtcgtcaagattgtttccaaggattcggcacccattattttgctcacatcgaatacgtccttgtcgtcaagactgtttccaaggattcggtattcattttttcatattttttattttcttcttcacaataagcaattaaagctatttgaggaataacaattcaataaagcatatatatagagcatttataaatcaaaccacatgctagcatcaatattgcatatttgcttaattcaagtagaatttaagtgtcatgcatcatctcccttaaaagcaaaatctaaatctcatgaaaagactggaatacatacaagctatgctagagacaaataaaccttcaaagtattgctagcatgcacaaaaaaataccatatgcataaacaaagttctcttttctcaattttttcattgtcatattattgcttgataaaaccatgaggtacaaattccccctcaaaacatgccaaaaggattcacgaataagcactaactccccctcaaaatatcaacaaaattctcatgaattgacacgtatccatttgtattaaccaaaactacaacctcaaatactagcatatgaaaaagctaataaacaagatagtagaataaaattatgtcaacccaaaaataaattgatgttaccatgaaaagcaatcgccatctcaacattgaaagctcatgaggagtatgccgtcaaaatacctacgaacgagaagatgtcgaggcctccgtgttggggttagaaataagaaattttggaatccaacactgagtcacacgaccagtagaactagtaggtacatatgcactaacaaaatcagaatcagacttacctgaaaaattacctttttgcttcacaaaagtctgagttgaatttcgcgaaaaattgccccgaggccggtatgaccgccgctgtacctgcggtctgatcgggcctggcaatcggtctgaccgccggttcaactacggtctgaccgctggccggtcggaccgactggtcagtgtcggtctaactgtggtcctcgaattaaaacccgatttttgccaacgtcgttttgcaaaagcaatttccctttcctttttctgtttatgggcaagtctaaaacaaaaaccaaccaaatatccatcttttccacaaaaagaacaagtgtacttctcacgacaagtttttgaagtagatggttttgcatcaacagaagtttttgcattcacaacatttgatttcgaagaagatgcattcaaagaaaacatgatgccagcagatttaaacacagtgttcttaggctcaatttcaatcaaaattccacctctcctagcaacacccaaaacagtaggaggatgtctagtatgatgagcataagaatcaaaacctaaaccacgatggtgtgtgttaactttagattgatcaagaatcatgttgaggttctttttaccatcagaaaatctttgcaaagaacttttcaaataagaaacctcctaagtaagaatagcacaatttttgcaagcatccaaaagacctttttgttttctacaagttgagcaggaaaacacctcatcttgtttaacaatttcttccatgtgtttaacatgctctaaagcatctttcaacttcaactcatttaaaacacactttgaacaatcttgagaaatcaaaacaacattgttttgttttacattatttgcacatgaagcattg

SEQ ID NO: 27054 - DNA, 2633 bp, Oryza sativa
attcctgcaccccatgtgcagagcaattgtatcgtaagtgataaagagcaaatcaaaattcagagcaacgatgctaccttttcagctcataggtttatattaaaaatgcaaataggcacgaagcttcactcagctatcaacttacttagcttaaacttctgacaaaacaacttccttccaagtacattcagggccagtggtcttaattagaaagtataagattacatagaagccttcccctgttctatcataattaaataagtgacaatccgaccacagctcttttccagatatattcaagtcgaggccgggtttatgttcatttcctaagataaatattcaagtggcagctaggtttcatattgaccatagatcactcaaatcagtttatatttgaattagatatataacgtgcagaacataaacaggagagtaacttaagcacatcaatggttgagatgttgctgccaattatcaatagctagagatgactagacacataattgatctggacatggctagtgtgacatcaggagtgcaggtataagctctgtgcattggaattggaggtatcaagaaaacaaagatagcgagggtagcagtgcaatcggaggtatccaggccacaaggcgggcagggagcagtggagaggacccccacatggctctctctcccagccgcacctccacgagcatctcctccccaagctgcattacaaatcgatggcagtgggccgagcttcttccacctgcacgacaatgctactaagctgggaagtagtagtgggaagacgggctgttcggcgcatcccacctttttgcttcctggaacggcctccttgtcctcaaccaccgtggttgcaaccagaacgggtcttcaggcggcgggcggacccgcctccgccggcctcatgacgggcggcgggcggcgcggtcgacggcgggtggcagacggctgcgatggagcatggcggcgcaggctcccctgcgcttcgaaggaggcgacggcggctccctcgcgtggatctgtcgggtggcggccggcaacaacgaagcattgcggcctggatccagcggtgggcgacgggtgtcgttcggatctagcagcagagctaggggttctcttgtgattttttttacagaattttatttttgcatgagggtgacataagcacccatttcgcgtgcgggtgcgtcgcccgcatggaaaaagagcaatttttgcataccttttcgggcatacctgttggagttctgcataaaaaactacttttggcccagctggaaaaaaagttttttctactagtggcaaccccatcactgccgtgatgaacttttgtgttgttggatgttgtgaattcttgggaaaaaaattgctggggaattagggccccttgatgtgaattctgtggaaagtttttctacggagctggggttgaaaaaacttttctctttgcatttttttcaccaaaaatcattttcgcagttagtcgtcttcacgtacctgtatgggaaaattgattttcacataccttttgttctaggcaggcgctccatccgcatgtgaaaagctattttggctaactgtaaggaattaaggatgtgttttgtagcagtgctagttgaggtgtactcgtttgcaagaggatggagagattaattgctactacataattaatgggcaatcggaggacggcacaatcagatgaaaagaacacagagtcagattggatcatatacgagaatgtatatatatttaaggttgagagggtataatctaaacgggtattagcatggcatcctttaaccttgatttaattggtttcttaaatatattaaacattggatcatttaaccttgattcatcacttgtacagttgtacccagccttgaagtggatcaacaaagaagtgtgagctagcctatatatattgcattggctactgagtgagcagggtaaggaacaaaacacatatcagatttccccaaacaccagctactactctttttgttccccactttgcatcaatcctctttctgaatgcattatgcatactgattgctagtgagcacacacaaagaagaaaattttgtgatagccctgaatattggatttcgaggcatcgggaaagtggagatgcctatgaattaatttaagtttatcatcctcaagaacgtatctagcttgcggagatgataatcttggaactggttaaatcagtgtgagttctcatccaagggttgcttgtcaaacatcataggttcagattcaactcactcgggccgcatctttgttgatatacatggcgataataaccatcgccgtgggttacaagataaggggtgcaggtggatggatagatatgatactattctattacaacaagctctatctattcgcatctgtccatctaaccatgcccatgtacatcacatatgcatattacatgtttaacattgccgaccgcaaacattacagggtaccgtttatgctaagtctagggactgcaaaagtcaatttgccatcatgttacgcaatacttcaacacactccgtgaatgcgcttcctaacacgtgcgaaacgcacaatggggctctaaaatgtaaaaaaaattagcataactaaaccataaa

SEQ ID NO: 27055 - DNA, 6405 bp, Oryza sativa
aagatctcttacctcatcggagataaaggaatatcaaccgttggatctacaataaatggatggcccaaaacaattttgggaatacagtaaaaatatcccctcttttataatactcaatgcgttaatttgacccagaatgtttgttttctcaaagatagtgtttgacgttcttgatattgttccaccacagagggtatcccttgctgaccttttcaggtcataaatcggaattacagatatgcataagcttcactcaactagccaacaactaagcttaaacatctgacgaagcaaactctaccaatatatatatacaagaccctttttgttctgtcataaaatatatattcaccttccaaaccacagctttatatggaagttggacaatgtgtgtaaagcagaaaaaggagagaagtgggagtaacttaagcacatcattttgctgcagatgttgcactagggagatcgaagctgccaattatcaatatatagctttggatcgatggctagacacatacattatttaaatttccatattaattgtgtcttcaggcgtgcatgtgacctctgtgtaggaataagagtcgttaggaaaatagagatcgcgagcgtcttcatcggttgagcatcagcaattatttcctccggcttaaggtgtcttccaagctgtgttctcttagttcattgtatttcgtgaagcttgagataatatatattcatgacatatatgatgatagagctgcaactatagggcatgagctaattaattcgattcaagatgattaattgtttctgtctggcacgatggctctttgatctcaaaatctattgtatactaaaaattcattagacgtcctaaaaacgctcttaagccgtcatacatgtgacactactacaaatgttcctgggctgtcacgagacatacgctctattttctgaaaagaaatagttagatctatcttctaaagaaaagaattccgaaacctgctgttcagcatgcaggtagctagccatccctcctgttgatttccttttcttctctctcctatggtggtagttaagttagttaagttaaaacatactatctaattccttttttatggccatgcaagcatacataatggtctcggtagtaggttttataaatagataaacaatcttttaaatggttgtaactttcaagttatatttcaatttattacctatttgcacttgtatttttaattaaatcaataatttaaaatcaaatagactaaatttccaatgctacaactgttgaacccacatttatcccgagacctctactaaatacaatcaaagcatcccactttattttttttacttatggactgttagacatctaataactttgtaaaaacttaactaatttttgtcaacatatatctacacaaattgatcttaatgttttaatagataaacattttatatgatcatagcacctagcttatagatatgatctatgaagtcactaataaattagagaaaagtatttaaatgatacaattattttgttatggacacatttatccatgctaagttagggcggaggtcgaaaacattacaggatgcttgatagtatggtgtaacaccctgaaaattcgaccgacaaaaatcaaaactctaaaaatgcggattttcaaaaactttttaaataaattgcatcatgccgattttattcgattattttattggagtttgggttcagagtttataaatcgccaataatggataattggttaggaataaaccctaaaaagtaaatggacaaagtaaataattaaagtgcaatttaaaataagatttggtgaggatagaaataagtaaaatattattacgaccatatttatatccatcaaatttaaaagcaatggaatgagaattaactctaataagttcaagtaaattacaataataatatataaaacatggaataaattaatctagaatgaatccatggattggaatggcgcaaatattgagtatacttcatttatgcaaaatttgggaattaaagaatcaaatttaaataataaataggccaaaatcgggttaattagaaaatggcactgttcattgcacctaaagtgttcgacgaggtcccctagccctagcccctcctttgccgcgttgccctcgcgccccgcgtgccgcgcgccgctccgcctcccctctgccgacgccgttgccatcaccgcgcctagccgcccctaaccccgcgccgtcgtcgccgtcgtttccgtcggtcgccgcgccgccgttccatcgccttgcgccgcgcaccgccgctaccgccgtgccgtcgcgcgtcgctcgacgccatcccgtcgcgccgtcccatcgcgctgtcccatcgcgtcgcgcgccgtcccgtcgccactgccgagccgtcgccactgccgagccgtcgccgtcgtcgcctcgcgccccgtgccgcgccgctcccccgagccccgtgctgccgctgctaccgcgccgcgctgcccgttccatcgccgcgcgccgtaggcgttcggccaacgcgtcgccgttgccgcgctatcgccatcgcgcgtcgcatcacctgccgcgccgcgcccccaagccccgtgccgccgctgctgccgcgccgctgccgctcctcgcgccccgcgccctgccgcgccgcgccaccccgccgacgccatgaggccgccgcccctctcccctcttccccattatctctctccccccctcccttatataagcccccctactcccactcttccccttcatcctcacctcctctcctctacccacgccaccacgccgccgcctccacgccgccgcgccgccgcctccacgccgccgcgccgccgcctccacgccgccgcgccgtcgcatagagccgccgcgccgccgccacgaagccgccgcgccgcgccgcaccttgcgccgacgtcgccaccgtcgccgtcgccgccgtcgccgccaccgcagtcggtaagccgccgcctcctccacttgctcggccgccgtcgccgccctgggtagcagagagccgagagagagagagagagagagggagaaaccgagggagagaaagaagaaggaaggtggagagaaaccgggagggagagggagaaggaaaaagaaaagaaaagggagagagagaaggaaaaagaaaagaaaagagagagagaaagaaaaaaaaaagaaaaagaaaggaaggaaaaagaaaaagaagggaagaaaaagaaaaagggaaatagataggaaattagagggagattagggaagtttagaaaatttaaaataattagcatttagttatagactagttatagacgtagaattgcgaaatttaatataaattatggattattcttggtaatttctacaagaaatcaattcgcggtagtagtttaaatgtaattaagaactaaacgattagatgaattcttatagactattatagattattttgggtaatctctataagtaattgattcacagtagaaattcggatttaatcactaggatttttagacgtatattatatttagtcgtttagtcctagactaaaattaaatcgtataatattataagataattataggattccgtccgatatttagcttgcgatagaaatttccaacctattatatggatataatgctcgggtagattaaattaaaaacttatgataacaaaatatttatacccgcaaaatagtttaggatataaaaatcgaaattgggtttgccctagttcgcgaatagtaaagttaatataaaagaatcgacttacgcgttcgacttccatttggatttatttggatttttatttgaattctaaccgaattcaaatcaattttcgtacgtaactatagagcccgagggagttgcggatccaagtgaaggccaagacccgcaagactttgagcaaggcaagtcatcactattcttgaacatattgatcccaattgcgaaattgttttgtttacaaataaaattgcatgcaatgaggaacatcctacttgcgattatgccatgccttgattattgtttaccccttattcctttgtaaccatgtttacgtatgagtccctagtcaactatgacaaatgcttagaaatgctattctagaatcatgcatactcatatttgtcaaatgctatatgcttggacaattacctttgggaaggtaattgagatgcggcatgtggagacatgagcgccacattgccatgatattgaggacatgatttgtgaaaggagaaataaactaaataactgttttcgactggggcggacggaggatttgggtggtatctggaaaaggctagtaccgtctccggtcaattaaggaccgagccatgaaattaagcatgaaacgaccctcgtacaactgcacttctcgtatgggtatagacctagcggagtagatagccgagcggaggcagtatccctgcatagatggttcacccctgagtgaggcaggtgcgttacggtgggacagccgttgaggtagggccaagaggcgtgccctacatcggtgtcgccattggtaggactgccatgagtgtgtgtgagagagaacttaacttgaaccataatttaatatgtgtgtgagacttctctttcccgggagcgccagaactcctctcactactagaaacatggacgcctagagtgcatgaggatttaagttcatggagcgggtactgccaatgcgaggttatcaaaaggctttgccgtggcgcgtctcatgtgttgggacgaggctcatgtgttgggcagtcgcggagtgcgggtaaagtgtacatccactatagtgtgagtaaaaccaaatctattcgaatagccgtgctcgcggttattgagcaccgggacatgtattacacttggctagactctaaattctttaacttgtgtgggatgggatattgcatgatgatttttatgctgatggagccacttcctgagaggcgggaatgtggacgtcctcagaaaaccataacgactcaatggcgggaagctatccttgggatcacaatggatggtggacagaaccgtcattgtttaatatgaacacaggtattaaaacttgatcagtctatgctaggtcttaggcttgtgaaaagaattacaaaacttgctttgtgcaaaagaaccatagacatcctttgaattcctctgtcatgtgcatcattgctgtggtggcttgctgagtacggttggtactcacccttgcaaatataaaattaatcagaagcgggagatgaagcttcggaggatccctatgcctactaccaggagggagatgaagacgatggcactcagtaggtcttagttacggtcgttacttgtggcaatggcgtgccgctgccttaactccgctgccttacctacttctgtttttggaatgtattccggaccgctcggtccgatgatttaagactgtgcctgcgggcttatgatgtaataatttgtactagactctcgtatatgtgcacttgatatttcagctataagttcgtgtgtaccagactacttgatccagggaaatggtactgtttacacgattgattcctgttataaaaacggggtccacatatggaaatccccaaaatttattaaaaaatggacataataaatttgattaaaaaaaaaatccaaaattgataaactttgttgaattcaaaacccatgctaaattgaaaaaaaattgaacattttagtaggactgataaaataaaaaaatacataaattttcaaataaaatctataaaacaaatttgcacattttttggctagggggccaggggtgtaagatatcctattggggaggtgaaatacccaaactttcagaaatttcagtttgaaatatagaacccttggctgcaatttaggaggggtgaagaaaacactctttccaaaaaaaaactctctccgattcgtaaaaaaaattaaaataaaggccattgagttatttttcgtataactgctaaaccatagaaagcaaagacatgcttctagagtgccccacgacatagaaataatcatattagaaagtttgagtatgtaatactttacaaatatacaaagctaaattaatcgactcatgtacaaacaaaccaatgaaatctgtctataaatgacactcttaacaattattatctcgatcccataatataagggatcatgaattaaggacaaaggaaaaactatgatacctttaattaaaaaggttatgtctagagtgggaagatggttggagtataattaggtcaaaattaaatgaggggtggttggatgaggcaagtactactatagaattattaataatatacaaaggacgtaactacacagctacacagctagtggtagctggtttataaaccagctaccactccatctataaaac

SEQ ID NO: 27056 - DNA, 1656 bp, Oryza sativa
cttatatatatatatatacatatatatatatatatatatatatatatataagataattttttcaatgaaaaaaggcattaattaaagttactttcctttttattataagttacttctataatatatgttacttacttttaggctttactgaatttacttttatatgtctaagaagtaacttagtgaaatctaaaagtaatttgtgatttttcatcaaaatatactcatgtgagatcttgttgtaaagatttaattattacaaacacaacggtgcaatcgaattgtaaatcggatgagtaatttaagagaaaattttatttgaagcatagatgataggaatatttcccctacttgctcaatgaattaatatcaaccaaaactcctgaagtactagcacgtgggtgtctctggatatgactaattggagaggcgcctccaattagatttaccaatatacaaaattttaattcacggtcttatgagatagagggagtagaagtaaatagaagaatgtctttacttagatggaacaataatattaacaatttccattctacaatcaaccatgaaaaccattttcattccacaatcaacatgagtacggtaactatccgtggccattggctagccccctgaatcaccattgatcatagatccattctcactcagttacccttttcttttcctcactaattaattaaccttatcggctcaaccaaattgatattggaaagaaacacatatgtgggggaaagactatttagaaagaacttatgtaataaccatctgatagccctcaaaatttggcgctttatcacactactacaaaaaagcccataaagatcggcactataggtgctggaacagttaaaacatgcacctatagtgattttaccgcgtccattggttgaaaacacataaaaccggcacctttaagcaactataggtgtgtcggttctaaagaaaaaccgacacgtagagtataggtgccggttttttataaaaaaccgacatctatccaaaccgagccgagccgacacctagccaaactggcgacgcattagccttgtcgatccccctatatgagtgagctggccttatcccctctcctatctctctcgtctgtctctctcttgcctccctctctcccggctctctcacatctcagcgcgcggtggcggctggaggggaggcgatgggcaactggtggcggtggcgccctctcctccaccggatccagcgggaggggaggcgcagcaggcggcggcgggcggcgacgggtggcggcgggcaatgggcggcagcggcggtctcccctcctccggatccagcgggaggggaggcgcagcaggcggcggcgggcggcgacgggtggcgacgggcaatgggcggcagcggcggtctcccctccgccggaggcgcggcaggcggcggtgcatcgtggcgcgcgacgagcgacggcctcccctccgccggatctggcgggaggggagatgggcgatgggcggcggcggcggtctcccctccaccggatccggcgggaggggaggcagcgggcggcggtagcgccctcccctttactcctctccccagttgtagatttttttgttgatgtttgtgtgaatttgttgatgaatttgttgttgaatatgtggg

SEQ ID NO: 27057 - DNA, 4086 bp, Oryza sativa
cactacatatgtgatttgcactacatattttccgccgaaaaagagtatatattgtagcaacttcaggatgaaggtccaatgaacttagcatattttcttcatggcgatgatgtgttccagggaacgatggatggataagtcgttcctcgatcctaggttgaccccaaatttttaaatttaatttctggttaacttatcgctgtttataacagactgcccatatttagctatgggagctactgcactgtacatcattgagttggctgggggggatagctacaaagatcaaaaacctttctgattaatgccactccatttcatattatatgttattttgacattggtcaacgtcaaaactaagtttgtagaaaaaatgtaataacattttcaacccaaaccaaatataacataaaactatattcaaatatcgatttaatgaaattaatttggtgttataaatattactatatttatctacaaacttaaataacttatagtctgaaacgggggagtacaacttactacactccagccttacaagaaaataaaaggatggccattagctagtacatcactgatgtgtcaaaattagaacatcattgttgtgatgacacaaaattaagtcaaagtgcagtgacagctgaaatctatctatgaacatcatcgcagcatcagttgagatggctacaaaatgtcagatggaatcatacatgagaaggtactcaaaggaggagagatagcagtaaattaagtgttaatgtgtaatcttaattggtgttaggatggagtttcaggacatgacttcctaaaatatgatacttatataactggttagctgtatagtggtgtccttgttgaccatctgctggcaagaggcggatgttatgtttgttgtgcatgtgcagataactaggatatggccagttacatcagcatggtggcataatcctaggatcgttctagacaatttcttgatgcctcttaatcctacaagggtccattcatgtatgcataattgaatgttgtctttaaagaaaggctaatttccttagtttacagttcttgttttgtctgggcagctcatgttctcgccttcattcacctgcaggtaaaaaattgaatatgattggacatatacagcctgtggttctttgttcttggataatcaagtggagatcaggaaaaaatgtcgagaaatcaacaaccatgcattcaatgatgttaaggaaataaatgcatatggaaagatgcctgcttttaacttttggaaaaagtacgaattacacccctgaactattacgatcgatcgaattaccctcctaaactcaaatactagatgttttacatcctgaattattcaaaccggataattaaccctctggctcaatccggagtggttttaatcctacgtggcagtctagtcacctgtaagactctcctccctctatctactctatctcttcctccctcttgtgcaatcccatccccctttctctcctccctccccttctagcagcgagtggcggcggtcgacaaagtcggagctcacgctcggcgaaggtggtggcaatgatggcggagccaaagctcacacatgtggctggggcggttggcaccgaagctccaggcgcagtggcgggcatagctagggcgattgcggcaactaggtcctcttcaaaggggaggatcacggcagcggcggtggtggagtggaggctttagtcctagaagccggtcttctcccaaatggcgttgcgaacgaggcagaggtcatggtccttgagcgtgcggctggtgccctcgtggacagagaaggacgcggcggtgcgctccaggctgagaaggacgcggcccagcccctgcccctgtggaactcctcgtcgccgcactcatccaacggccaccgcgtcgcgtccgcgcctgcactccccttgccgctgtactccacaccgaggatatttggccaattgaggatgttcactggcagcgatgtcgctgcccctcccccaccaccaccagctccctcccacgccctcgcgccagcgccgccaccacctctcttcccgcccttctacgtcatccccacaagcgtcagcggggcggcacataggtacgtctccatgggcgacaacaatgacgacgctgacatccccgtgcctccctgagctcgccgccaaatctgcaaggactgtgccacttcctccgccgcctctgcgtccactgctggaggtggatctagagccgccgctccaagccccttctcggcttctcctgccatatgtgcagactagagagagagatagagcaaggggagggagggatggcttgacgggagagatgacatgtggacccatgaatttttttatatattttctttgctgactagattaccacgttgacgccacatgtgcaagctcagatcaaaaccacctaaaacagtgctgatggggttaatcatccggtttgaataattcaaggtgtaaaacgtctggtatttgagtttaggaggataattcgatcgatcttaatagttaaggggtgtaattcatacgtttctcttaacttcttacgcgtgttgttttttataaaaaaaaaacctaattttcgaacaagtccccttttactttattggcagttaataaggaaatccacctctgccaaatgacccgggtcaacagtgttgttttaagtcaccggctctaaaaattgatttttagagcacattgttttaatcgagatctgctagtttagaatagcctcattttccagagacggttggcttaagcgtccgcctcaagaaatagcctctccggaaatagcttcactcaaactcgactttgttttacacataatgtcgtcttgtccctgattttaacggactgcagatcgtgaagctattgagttgaatacgctatatctgaagacaaatagagtcaattagaagctttttctgtccacaaaggttaaaatccttacggatatatgctattgtgatttataatatacaacttgcaatttgctacactctagtcagacaagaaaaagaaaaataaaaagaaaaaggatgatgatctctgatgtgtacaaaaatacggttaaagcaccacctgttcatatggaatttgtagccaacaaatgaaaatgttgatcatatgagaacacacaaccaatcagagaacaagaaacatccatcacgcccatcttgttgcgaacataaggtatcctccattttgttaatttgcttacacaagaggtatatatcctccattgatcgctgtacagatctgtacattgtatagctgccgtctgttttagtggtgtagctcctcgctgcaaattttctctccctttcgatcttcagcttctcacagtagtcatgcaagcactaggccaatgcattaacagatactacctccatattttaatgtatgacgctgttaactttttatccaacgtttgaccattcgtctcattcaaaaaatttatgtaattattatttattttattgtgatttgattcatcatcaaatgttctttaagcatgatataaatattttcatatttgcacaaaatttttgaataaaacgaattgtcaaacgttggtcgaaaagtcaacggcgtcatatattaaaatacggagggagtaaatcttaaagaacagactagctaatacccacacataacaatatgaacaagctgagcaatatcaacacaagagcaaatgctatcgacctatactattcaaatccgtgtttccaaatcacttagtcccaatcactgtctctacaatgatcgcggctacatgacttggaatctaggattgaatgaggattaatggtgaatcatgttttcctgataccgctcattcaatatatacatgttggatgccgggctctttgccgtctgctatcatcgatgctagcatgtgtgcaagcaggtagaaataataagaaccgacagaactgagcttgtcgatcagttcgtgtgctaaccattaatattaaccaagtactccctccggggttttttaatagatggtattttattcaaatgttaatttgaccattcgtattattggggtgcagga

SEQ ID NO: 27058 - DNA, 2733 bp, Oryza sativa
  unsure (1)..(2733): unsure at all n locations
attaaaaactttgatcaatgcactgcatagttacagttaggtagaagtggtaaacaaccaggactttcagctctcgtctctggcctttacctatacctattcgtttttcaaggttgcaaatttgagtgattatgcatcgtttgaagggcacacaattaaactggactaaccatttgcatagtttcaattcaagaaaattggtagcaatttgagatcttttaatcttcaattcttgatttgcaatcagtgagttcgacgatatttacaaacactgatatacaactagataatgaacacgtggaaggaggagtttaaaaggctagaacattgtttcctgcccggagatgatatgatcctgacatgcatgtgtttggaggtattgttcaaggcctgattctgtctcattgcccatgatttaatgttgataccatggaaggttcacaaaaagaagcttggtgttagagaactagcaatgcaggctgcgactgccatctctcgtctcctcctggtgcttctcattctcaacctcttgtatgatgtgttctatgttcttggtagagcatagcatggatgatagcttatagtatctgttctcaccttgtgattttgctctttgactgatgtgggtttttattggtagcgagctgaggtatgggcaggtgaggatgtaaagaagtaaactacagtgtggatgtaaagaagccacttccatgagcactcgatgacctaccataatatttgaccaaattcataaatatttgaaaaaaaaatccaaaaagttcggtggagatttgtgttggagttgttccaaattcacttcaagatattggccgggcttctgacgaagcggagcggtatatatgccctttgctagggtttcgtggagacttgattctcttgtaagccgccataagcgtgtaacccaaaactcttgagatagtgagattgttgctggctggtgcccgtggttctttgccctttcgcattaaaggggttttccacgttaaatcgtgtgtctccgctgagattgtntttcgtttactttggatctctatacgtcgttcataacaagtggtatcagagctttggttgctgttagggttcatgacgacgtcgatgaagttcgatcttccgctgctgaactacgacacgcggttctcgctaaggcaagtcaagatgcgggggattctggcgcagactcatgactatgatgaggcactggataacttcggcaagaggagggccgagtggactgctgaggagatccgcaaggatcagaaggcgctcgccctaattcagttgcatcttcataatgatattttgcaggagtgtttgatagagaaaacttctgcagaactatggctgaagctggaatcgatctgtatgtccaaggatctaaccagtaagatgcagatgaagatgaagctgttcactctgaagatgaaggaggaggattcggtgatcacccacatggctgaattcaagaagatcgtggccgacctagtgtcgatggaggtgaagtatgatgatgaggacttaggtcttctactgttatgttctttgccaaattcatatgcaaatttccgtgacaccatacttttgagccgtgatgaactaaccctaaaggaagtttatgatgctctccaaaacaaggagaagatgaaaattatggtgcagaatgacgggtcgtcgtcctcaaagggcgaagctttgcatgtgagaggcagaactgaaaacagaacctcaaatgaaaagaactacgataggagaggccgttcaaagtccaagccgcctggtaataaaaagttctgtgtttattgcaagctgaaaaatcataatattgatgagtgcaagaaggtccaggctaaggaaaggaaaaacaaaaaggatggtaaggtctctgttgcttctgctgctgcttctgatgatgattctggtgattgtctggtagtatttgctggttgtgttgctggtcatgatgaatggattcttgattccgcatgttcgtttcatatttgcactaaaagaaattggtttagttcttacaagcctgtgcagaaaggggatgttgtgcggatgggagatgataacccatgtgctatcgtggggattggatcagttcagatcaagactgatgatggcatgacacgcacgctgaaaaatgtgaggtatataccagggatgtccagaaatcttatttcattgagcacgcttgatgcagaaggttacaaatattccggttcagatggcgttctaaaggtatcaaaaggttctcttgtttgtttgaaaggtgatcttaattctgcaaagttatatgtccttagagggtgtactttaactggttctgattccgctgctgctgctgttactaatgatgaacctagtaagactaacctttggcacatgcgtttgggacatatgagtcaccttggtatgacagaattgatgaagagaaacctgctgaagggctgcacttcgagtaagatcaagttttgtgagcattgtattttcggcaagcataaaagggtacagttcaacacttctgttcacaccaccaaaggtactcttgattatgttcatgctgatttatggggtccttctaagaagccctcacttggtggtgctcgttatatgcttacagttattgatgattactctagaaaggtttggccttattttttgaaacataaagatgatacctttactgactttaagaactggaaagtaatgatt

SEQ ID NO: 27059 - DNA, 4027 bp, Oryza sativa
actgataatggtggagaattttgttcgcatgcctttaatgattattgcagacaggaaggcattgttaggcatcacaccataccccatactccacaacagaatggtgtggccgaacgtatgaacaggaccattatatccagggcccgttgtatgctgtctcatgcaaggatgaacaagcgtttctgggctgaagctgcaagtactgcctgttatttgataaacaggtctccttctattccactaaataagaaaactcctattgaggtatggtctggtatgcctgctgattattcacagttaaaagtttttggatgcactgcttatgctcatgttgacaatggaaaattagagcctagagctgttaagtgtcttttccttggttatggttcgggagtcaaaggctataaattgtggaatcctgaaactgggaagacttttatgagcaggagtgttgtattcaatgaatctgtgatgtttactaacagtttgccctcagaacatgttccagaaaaagagttgcagcgtatgcacatgcaggtggagcatgttgatgatgatacaggtgttcaggtggagcctgttcatgagcaggatgaccataataatgatgttgctgatgatgatgctcatgatgatgttcagcaaactcctcctattttgcagctagaggaggaattacctattgctcaacgcaagtcaaaaaggacaacaaaacctcccaaacgtcttattgaagagtgtaatttgtcttactatgctttgagttgtgctgaacaggtggagaatgttcatgagccagcaacctataaagaagctgttcgttgtggtgatagtgagaattggatgtctgctatgcatgaggagatgcattctcttgagaagaacagtacatgggaggctgtacccttgcctaagaaaaagaagaccatgcattgcaagtggatcttcaagagaaaggagggtttatcttcaagcgagcctccaaagtataaggcaaggttagttgctagaggttacagtcaaattccgggtgttgactataatgatgtgttctctccagtaggtaaacacagtacaattctgactttccttagtatggccgcttcacatgatcttgagcttgaacagttagatgtgaagactgcgtttttgcatggatagcttgaggaggacatatacatggaccaaccggaagggttcatagtgcctggcaaggaaaaatatgtgtgcaagttgaagcgatccttgtatggtttgaaacagtcccctcgtcagtggaacaagaggtttgattcatttatgttgtcacacagttttaaaagatctaaatatgatagctgtgtttacatcaagcatgttaatggatcacctatatatttgctgttatatgttgatgatatgctgattgctgccaagagtaagattgaaatcactaagttaaagaagctgttgagtagtgagtttgatatgaaagatcttggtagtgctaagaaaattcttggtatggaaattagtagagacagaaaatctggtttgctatttcttagtcaacataattatatcaagaaagttcttcagcgtttcaacatgcaaaatgctaaggctgttagtacccctattgcaccccactttaagttgtcagctgctcagtgtcctagtatagatcggagattgagtacatgtcaagggttccttattctagtgctgttgggtctttgatgtatgccatggtttgctctcgtccagatttgtcatatgctatgagtcttgttagtagatatatgtctaatcctggcaaagaacattggagggcagttcagtgcattttcaggtacctcagaggcacaacatgtgcctgcttgaagcttggaagaactgataagggccttattggatatgtgcttctattatgctggtgctctggacaggcgaagatcacttactggttatgtgtctactattggcagttgtgctgtgagttggagggctactactacagtctgttgttgctttgtctactactgacgcagaatatatggctatttgtgaagcatgcaaagagttgatttggctaaaaggtttgtacgctgagctcagtggagttgaatcttgcataagtttgcattgtgatagtcaaagtgcaatttacctcactaaagatcagatgttccatgagagaactaagcacatagatatcaagtatcattttgtgcgtgatgtgattgaagaaggtaagctgaaggtatgcaagattagtactcatgataatcctgctgatatgatgacaagcctattcctgttgctaagtttgagttgtgctcaagcttagttggtttaattgaatagtccaagagactattgttggcaccagtggttttctatctttgttgttcaagatgattggttgatttatgatacaagaagaatttgtctcaaggtggagtttgttggagttgttccaaattcacttcaagatattggccgggcttctgacgaagcggagcggaggcccaagccggaggcttgggcctgctagggtttcgtggagacttgattctcttgtaagccgccataggcgtgtaacccaaaactcttgagatagtgagattggttgctggctggtgcccgtggttttttcccctttcgcattaaaggggttttccacgttaaatcgtgtgtctccgctgtgatgggttttcgtttactttgtatttctatacgtcgttcataacaatttgtacttaccggtggggtgcgaaattaccgaaattttgaaccgaagttttaaaccctgccggtgaatatagaaaggatagagttatcaagatctggtctgctagtcacaaagaaagacctgccactatttttctgcacctcgtgcagtgatgagctaactgatgacgggtgtccttcctcaattgaactactccattgtttctgcaacacagatggacagattaatgatgggatcagttctgtgttgaactactccctccgtcctaaaatataaccacttttaaactttgatatagtctccaagatgttactttgaccaataatagctataaaagtaagatgttttaaataaaagagttatacattatgatagtttgtttaatgataaatctagtaacatcaattttacatgagtgatcctttttatttttttttataaatagtgaagtttgaaaatgtttgacttatcactatgttaaaaatacttatattttgggacgaagggagtacaaaggattgcatcatccgatgtgaaaggccacacggtcagatgagatcatgcatgagagggtattcgaggtacaaattaaattaccagcaaatttggtgttagtctataatctgaagggccattactacgctggagatggaccatcgcctgaaatttgaaatactaatatagaagtacagaatacatccgtgcaacttaaccttgatttggtttctgaaaaatccttacaagtggatatcaatcatcacttgtacctggcattgtgttttatagggagccctaagtggatcaccactcaagtcttggtttatacttttatattgttggacgcactaccaatgtcgtgtgtatgagtcaacttataaatatttggcttgtaaacttgagaaggtcaagcaacacaaaacacgtaccagattccctatttctactatatatatatacatatatatacacacatatatgtatatacatatatatatatacatatatatatatatatatagagagagagagagagagacacacacacacatacactcatgttgttacttaaatttgcttcggtgctctgtctggatgcatgctaattgctacagagcatacacgcagtagaaaattggttgtagacctgcattttggatttggaggtgttgggaaagtatagatggcaagacactggagtttcccatccatgtggcttaacaactgcagtgtcccatccattgcattagagttatcacggctggaacgcttcgaaatacatcttcatatcaaata

SEQ ID NO: 27060 - DNA, 12814 bp, Oryza sativa
ttcctgcagcccggaattttaggattcgaccttgcacctgccaccatagtcaagaatactcaccagaaaatagtttctcagcattaataaaaaactggaggttgggtctatacatgcattgtaattggaatgtaggagatcacaatcaaatacttcacattttatttctttagataaaatgttttacatctccaccttctgtcataagacacatatccataagtctattaaaagaaaacgaaaaaagataaaaagaaatgaaaataagacaagaggtgatgggaaaaaaaacctcaactcctcttattattggcaagcgtttaagcacatagattttttagccaacaattgtaatggaactacaccacccatagaataagacatccttggatacagattccaaaagtatagcactattgtgcatatagtatcctgctctcttgtggtagcatggtatattaaaagttgactcaataggaatacatgatgataacctgcatatggttagacaattgtttacgattaaaaactttgtcattacaacaccgtcaaattgactaacataaaacgctagctccaactagaattttctttatggacccagttatccctctaagccaattaccaaacatatttttggcattatggggtggtgggatattaaatgcaaaaaccacacatctacaaacaaaccacaaaacatgacacccaaaaacatgtttgtctccccctattttccattagtcaggttatctttgttaggattactttcatatgaagaaaccacaaaaaaaccttgatagtagaacctttaggtcccatagattcctcttatggatcataatattagatttcatggacacggtatacttagagttaactggaaattggctattttatgaagcaaccatacaaagtaattcttttcatttgataaagttatattagctagcatgaggatcaaatcattccacccgattagcttttggtaagctgtggctctcctaaaagaaacattcaacaatgttgtgctcaaaacctctgccacggtagactacttctttcgagccacattatataaagtagggtattgatctttgagagcattctcaatcacatgtctttccaaaatcttattttggtcccattagcacatttaaaggatccatacctaagaaaatggttgtttactttgttaaatcagcctagaattgacaaatacttgtattactggacatatcagagagaggcttaccctttaaattataggaacaaacacaaataaccaaacttaccagaggggagatgaatagtagattatgtcaggggaagtcaaataatcaaattttaatagatcaaagcacaccccaatctcaaaatccaatgtaacacatgtccaacacgatctatccaatctactagggtcggtctgactgaggctaggctggtctgaccgcatgacaatgcacacggaacattgatgaatacaatgctttgcccaaatctaaatatattttttttctaacgattagaataagatgtatgcatgtctccataggatagaacactattgccggaattgaaggcaccgggaaattagagttggaaagaagtttgttatactttctgttatcacgaactaaatgccattacaataagaagtccagcttattgcctaaaacatggtgctacatagccctgatttggtttctgaaaaatgcttagaagtggacgtcactgaagttcctgggttgtggtgttctacattaccaatgttcagtgtgtgagtcagcttatatatatattattgggttggcttggcttgtgacctaagtagtgcaaggaattcatatcagattccccatttggaaacactagctactcttgttcttccctcaaataccctttaatttagtcctttgtctagatgcatgctaattatttctagtgatcagcatgcacagtaaaaaattatgtgtaaccctgcatcttggatttggaggcgtccggaaagtgaacatggcaagaagatacacaccatcgtcctgacttgcttgatattccagaaaaggtccattccagaaacgctttgaaacacatgatggagatgaagaaaacaacccagttattgatgcttcaattcgtaaagcttgctagtgtgtataattaatccctgaactatagatcagtcatgtgctaaaaaatttcctaacttacaatatttcagtgcccccctacttttgtgtacctttatttccttatttctagttaatttacttgtgcacactctcttgggttttcatactattaattcggctatcttcttccaaatatgacataataggtgtcctattaatctataaacatcattgtcaaaaaaatatgatgttaatctctctcttttaagaaataaatcagtgcaaacaacaagaggttaatatgataacccatgttctcacagtctgaggactagcaagtgcaacattccagcctgtttgaagtagttatagagttgaggcccatgtggcttagaagtggttgcagtgggtgttgtagctagtaccaccttagaagtttaagttggtaaagatcggcttataagccttggtactctaaccgtgttacttcaggttaaaccctttatacaatgtcagagaaaaaaaatacatgtaaggtactatgtgaatgtagacacaattgtacctctagcaaatacagtgaaaacagcttatttgattctgttgcacagatatttcatttttggtcccttggaaaataatttggatttggaattatttctaatattaattaagtagcaggtatccaagtaatctaaagttcctcatcaaaacatgaagtcaacagttgtgtttatgaggtaaaaaaaatcaaatcaaaattctaagagcaataatgcctgtttgctaccttatctacttatatatttgtagcacccttaatttcatttgcatttatttaaaatcttggcatttaaaattttggagttaatttggatcttgttgatttttgtgccaaagagatctcaaatcctctcctagaaattcccttcaaattctgtgaaaccctagacaaaattaaaattataatccttctcaaaattcaactcaaatcccaaagaaaattgcgaaaagccactgttcatttgggcccttattcctttttcttctcctcgggcccaactccctttcactcttctctcaagaattttgttcgattttagattttttttaatattgacagaaataatctatcggccaaaaaaattgcataaatagaccctgccaccccaatggtgggcggcaagctgacgtggcagacggtgggtcgaccacgccgtctgccgccgtcggccaaaattgcgattaggccctaattgtaattttggccgcccataaagagcttgcggccgtaatttttgcatctgggtcccttgagggcagcaagggacccagatgtaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtactttattcgacgttttagtactcggataattaatatagacctatcgcagtctcggtcgtagaaacattatatggacttaaacaaggagaattatgtaacatgaagaaatagtaggacaatttgaacatgatacaactatttccattgcggttacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatctctctcctctctcaaactgcgctttagtaaccctgtattgctctggtagttcaagctgcacaacacggctaggtggagttagaacccttctggtgtctatccattctctgtattgacatctccttggtggtttctgggaggaaagaatagatgtaaagcgagcaaagttagtaaatgttgtgagaaaataaggattcatgtaatcaaaatattcttaccatgaaatcgtcgtcaagaatatttggacaaacaaagaaccttcgacccaatgttgtaggatttatggaacgaagaacctgacaacgatcaccacacctgcatcttggacgggcttcccatggagggagtgccgtagttagaacccgccagtcgctctgttgttcatgacattgtcgttcataagccgcttttctctataagtattgctcagtactttcggatgcgaaataccagctaccttcttgtaaacaagtggttaggtcaagaacgggattttctgtatcgacccactcgatgtatgcgcaagccgtagtgcgggtctgccgaatagagtagtgttacgaagaataaagcgattgcccatacggaacgaataagcatatgcagataataaaatacctcacggtcatagttagggcacctaaaaaagcgctttcctcgaatatcaggattcctcgaagccattagttggcatcgatcaccgcataggcagataggacgctggcaccaaggtggtagtaggtatacacaaggatcgctacgccagtttggatcctcaacaccccggcatctagccattgacgaaagccggtaggatttgtaatgaagcaagtgggcaagagagtacggaatgtgactgagttctgaaagattgtgaggcctcactcgttaagacgacttatataggtgcaaaaaattgagtgatacccctgacatgtgaacgtggtggggtatggtgggtacgcctgattggcgccgaaagttacatgcctgatcggcgccgaaagttacattggtcgtacacgccaaatggtgggcaaatactcgtattgcacgcgaataaaggaggctgcatcggtgtggcagaaagtagtcgtgcatgcgccgaaaggtatcgtgcacatataataacaacgtagtcattacacaagcatacagtactggaaagtgaagcaaaaaaacaaagagcagactgctctactggccctgccccgcgccgcgaccacgcttggtcctccgggcctgtgctcgcacgtggtcctgggagtaggtgaaacgatccggtggcacagcacgggtagcacgagtgtctggcggaggagtggcctgcgcctggtcctgcgtctgcaccggcggtgcgcctcccagctgtgaggggccgatgacgtcctctgtcgagcctgaagcgaagtcgaagtcagtgatgtcgaagagcaaggtggaaggcagcaagcggtccgacgaggtcccagcatggtccagtggtggaccctgactcgacgtgccggctgcctgtgacgaagtcccggtgtattgccagaactgcgctgagtgcgaggtcgacgcagctgcctgagacgctgatcctgcagcttgggagaagtgggaggcctgcgtcatagcgaactgggcgaaacctacacatcgacaacggggcccttgtaagctaagacataaaatgcatgtaaattgattgtcaaagtaatgttgtttttttaagtacccgtggggggcacaacagaaggcctagccgaggaaggcggggtgctgaacggtgcacgaaaccctgaagcaatcggcaagtgaaacgactcacatatatgtgcgaggcatgtacagaaaaatccttaaaaatacttacctccgtgcggagggggagtcggcctaggaacgtgcgcagctggacggggaccagtcggtacgggtggccgctgtacagctgcgtctgcccgagcaacgtcgtctgcacgacaggtgagcactcggagaatcgagcgcatcgactccaccatccgcgtgtacgtcgtcaggtgctcctctacgggtaccggaatccccgcgcctaaacgttggatcgtcgttgaaccgtcaacgacgacccggttaatgtcgtcgatctgcatggttaatttgttcgtacatatttgtaaaatttgacgaagagaaagacatgaaacataaaggaatggtgtgatgcagggtactcacagcacgagcgaagtcctggtcgcggtgcctggcgtagaggtctctagtgctcgcaatgtggggctgctgctccaagggagcgaaggtgaccctagtacgggtgtgtggctggtaccagcgtaggtaggcctggtacgcctcctcagtgtgtggctctccctcatggtccatgacctcctcggttgcgagcaaccagtcctcaacaaaagtcgccaacttggcgggccagtcgccagctgacttctgacccttgcgcgagtacctgtgaattaatgtgtaatattagtgtgaatcgacagatgttacaaattattgtgaacaggtagattttaatgcaacaacggaaagcatagtgaaagattttactggtgaacagcagctgggatggtggtcggaaatggtactggaaagggctgacggaagccgaactgccgcatcacgcggaaaggggcgtgaggctcaatgcagatgtcgaagaccatcggaaccgtagtcatccagtacgcctggtccctggtgcagagtgtggacagacccaacggcgcacgagcctgggtagccacggtactgtagggctcccacacgatgtcagtcggcagaaggcggtcgaactccatactcccaaactgcaactcttctatcgctcgcagaatgccagcgtgcctatcttgtatcaggcacacatttggcctcataccaacaacttttgttttaaccaatatcaggaaccagtacagctgtcagtattctcactctcaacaaaagcaaatgccaagggcaatacctgattgttcccatctacccctattgctgttagtatctagccccgatactttcctgtcaagaatgtcccatcaatgcagagaacaggacgatagttcacgaatgccatcttgcatgcatgtagagctaagaacgccctttgcagcacactcttgccaggatgttcaattgaggggaatttcttcactttgtaagagctcccagggtttctttcctcgataacaccaagcaggcgtggcaaattgtcatacgaggcttcgtaagttctaaatctcatctctattattttctgtttggccctccaggccttggcatagctaatagtatacttgtatgtctcctcgatgtgttggattattgaccttggttcatatgtgagattatcgatgacatgcgcatacatctcagatgcaacaaatgcacatgtaatgttcctatggtatttatgaacaccaggtagaaaacatgtatgcttggtaacgactgacactgtccaataatccttccatttccccttatacgcgtgcactctccagggacaaccatctttttccttaacacaccgaactttatattgcgaccggttggacttggcaacccaaaactctctatgaagtgacactgcaaaatgttttactgcctccttcatatcttctgctctactataaatcgctccctgaataacctcattttttttactcccatctcacactatcctcttcagagacgatcagcccagaaaaatcctcactagcccattatgctggattaatatccgtctcatcatttgacgaatcatcttcctctacacgctcgttgtcagaatcctccctctccatttcatccacaatggcaccgacagtctccccctcgtcggccactccacctggttgaatgcccattggagctactacgcccccgtcctctcgtgcgttgacctcctccacagaagtctcatttacttcagcacttggtccctcgccatcatccatgttcatttgcacacctggatccttcgggtgaacaaacggaaccaaagctagaggccacccgcgttgcaatgcattttccaaataccatctccacactcgagagttttgaactggcattagttcccaataaaaaccctcagttgcccgacttactataacattgattgttatgtcacttgtctgtggatcaactcttaagcccctcattaaccatccttttatagaaagtacactcctctcagccggtctatcaattcccctttctgatacaataaattctgacagatctaccccagttggcccgtaacggacgtttcctggtccatggtaaacttggaatatttgtttgttcgacatatctgtcaatgaattaactagatcatattactctttcatgcaataaacatctataatgtaatatcttcttgtgtaagccaatgcaacggtaatgtattgattccaaactagcagatctacgtagttaccgatatatacaatacacacttctagattagtacaactaaaaccctaaaaatataatgcatttattcaaacaaatttttaaaaaatacacactatttaactcaatagtcacatataggatctatgaatattacctgaaatcggtgtctgaatccggcagggcttcgccccttcttctcttctcctcccctctcttctttttttttcactggatttgagggggggaggaatgagggctgggggctgggcggcaggccttttataggcagcgaggcctgccgctcggccagagggcggcaaggggccgcctgtaaaatggccggccccgactggcttttttgcattcgggccccttgccgccccaccagagggcggcaagggttttcctgcaaaaaaccctccctctgtcaccgcccgttcctcccccgtttgccacgtcagcttgccgccccagaggtgggcggcagggtctatttttgtaattttttaggccgatagattatttctgtaaatattttttaaaaaaaatctaaaaaggaaaaaaaattccttctctcaacccctcctctgttctcctccctgagcaggccggcccagcccagcccaactcctattcatcatcttcctcttcaggccagccagccacgtgcacacaaggtgttcggcgaaatgtctcgcccggacgccgcaccatcccgcatcgtgtccgagccacattgcatcgagccgaggccgcgctgcgccaaaaccgcgtcgcgccaagccgccctcgccccggtttccctctgggaaacatggagaagtcccgtcgccgtccatccatcaaatcgccatcccgtcgcctgtcgcgtcgacactaacggataacggccaccacctcacccttcgtcacctctaaccctaggtcgagtcatcctcggtttacacttatccattcgcccttgctttgtgacaaaggagcttagccgctaagccacgtctctctctcgctcgccaccgcgtcgccgcctataaaaggggaagcagcccgagctccttctccccacaccatcacaatcccaacccatctctctctcctctcccattctccagtttttgctctctgtgccaccaaccagcgcccccgggcctcgcctcccagtgccgccgtcgccggcggagctccgccgggcctcgcctcccaacgccgctgctgccgctgcacacagcaagagagggagagcgagagagaagtggagaagtggagaaagggagagagagaaccaggcttctgaagaataacctatgtaccaagccaatgaaaagctaaagaaataacccgtaaggaagaagagctttttcttttgtcaaaacaccatatcgttcatgcgaagccataacaaccaataaatagtgcccgcccctaataggataagcgactttaagtatttcctaattccccgtagccaattaccgaatatatgtgatacaccatgaggtaggaagagccatgtagccacttgaatataccacacacgacgggcaaattggcacacacagaacaaatgtaatttttcctcatctttgtgacaacaacaacatttcttacttccatgccaatttcgcttggcatggttatcccttcacataacccttaggatgcaaatatcataataagaagatcctgtctttaaaggtaattttaacttccaaagtactttttttatattgggcatatctaaatgtaccaaggcaagataatgcaactttaatgaaaactctccattctgggttcatgaattatcattgatgtgctatgctttggttggtgcacctgcctccgtagttaagattcctttacaaacaatactttttctttattaattgagcaatgtaggttagaatctaatgcgtatgtagataatgttactacttattatagttgtgtgtgcgatgtgattccttcttctatcaacactacttctgacagtacgagttaaactagaagtcccacttgttaattatttgaatgtacaagtccacgtctgacattgatttaatggataattttaccatccttataaatgtactacaaggtaacacatttttttaacgtaaaattagtgctacctcatggtaccaaaatttttaatgtaaatttaggtatcttgaggtacttttttaagaactataatttttttcttaatttaatactatacacttttatgtagctagcgtgagctgttactgtcagatgaatattcttgaagggtatttgagctcactagtcattaatatacgtctcacaaattgtgaagtttcaaatttggagatcagctcaaatatcttttggtttgctttttatttttgcaatatataggaactgaagtttaagaagacgtctcttatttctcaacactgaacaggtcacaaacttgcgcaatgcggcagcaggatataactattgtgtcaatccatcttgggcagaaagagattcacccaaagaactctgtgctttctttctttagtcacatctctcacaaagtatatatatgtggagacatgtgactaaagaaagaaaacatggagctcttgaggtctgaatcacagttaagatatgtgtaagacaaattgcaaataaattcagttccctcccaaaatatgtgtaataattatacatttctacatttggatggaattatattgaatagtcatgtaattgacttggttctagagcacaacacaatggccataaactgtctctaatacctggttttgtataggggctaagagcaagtttaatagtatatcccactactagctccaattcatctatagccaatctaatagccaactcatacaatagttgcttactatattattaatatatggtcccacctatcctatacatactacgtcttggagtccgtgctgcagctggctacagatctgtagcccgcttcttttctctttcatcttttatctcattaaaatatgtttatagttggctaatagtctgctaatgtacctgctctaatgagtggattaggatggttccaggggtaaaatatacttcatttgaagactatatatatacacatatatatagtcaatgctgtagtatttgccacattgccaatgctgcatgtattgacgaggaattttaccgtacatgagaaagtatcttgaggtacttaaattttaaattaattttttttactagaaaatataataccactaggtaactttttaaggattctaataaaattaccctatattggtatgcgagtgttataaaagggccatttggccaacaaagattcagaaatgcaatttcaatgtatgtagctgccattcctgttgttccccaaatttgcttcagttaggtctagcttctcaacaaagtgcacttgttgtttgcttgcttggggtgtaaaagattgtgtgtaggccagcagcatgctggattgggaggtgccgagaaagtcgagacagcaaccatctgcagttttcggagtatgattgaataccatacagtgatttatcctgctttaaagcacagtttcttctgaacaggacgatagacctagatgtatggttattcatgaaggatcatgcatgctacgttgggattgcaaggctctaaggacaggaagtcatttgtgttaattaggtgcaattaatgactgcagaagtggctaatttgacagtcctaaattcatccttgttgcactgctgaagttcacatctctaatccaagatgtcctatgttcgtgttccacttggatatattgcagagtttatcgtctagtccctgttaatctgttatttaggcgtgtaattttcatgcaaaagaaaagggattatactcagaggtacatcctcttttgtcacaaaattgtccatataccaaccaaagtatgtgagttgctatacaacaatgaacaaattgatttttaccagtgtgtcagttgattcctaacaatttgtgccccaacatcctttccacccacctttctcattctggactttcaaaccaggaaaaataatatagtgtaaaccatatatgtagtaaaaacctaaaaattactattgaatcgatggatgtatgagattcgtccatgtccatttttcaatgatgatgtggacgaatcttagacatccatttttcgatccaatgatagtattcaggttttcactacatttgtattagtttctaccatgtattttccctacataccatgcatgcaacctattgattgcaacagcagtaaatagatactccctccgtcctaaaatattacaacttttagccctcaacatttgtctcaaaatatagcaacttctccaccaacattctctttacaaccaatcacaaccctccaccattcatttttctcacctacctccactaattaaccaatcacacaattctccatcatgcactt

SEQ ID NO: 27061 - DNA, 8890 bp, Oryza sativa
  unsure (1)..(8890): unsure at all n locations
aggtattgggaaaatggagatggcagcgattcctcactctgctatatatgcttaagtaacaggagcaagcttttgcatttgattgagcacagaacatctgggatcaaccagcttttatatatttgttttgacttgagtaatcttccgaagatgaaaatgttatacatgaaggttggttatgcatcaccagtggcctggttgtgcaatcccaaatttttagttttctataataagtagatatgtaagcacagctgccattgttgcatgctaattaatggccgcaggatttagcaacctagatcgatgcattattaagcacttttagtgcaaaacccaaatgattgcaatttgtttttaggaattctccaagaaacaactcaaactacattattatatatgacaactttagcatatattcacatcagtaggcttgaaaagtttggcacacatagctcccgtacctactatctcccttctcagtcttcacattgtacttgcaaaaaatcacaatgcaatgcaatctccaccaaacaggcgcttgtgctagggtttaaattcctcgatgcattgctgagtggctcggtggttgcgtgcattggttgagctgatcgagttggggcgcttgagataggcccctcagtggttggccaagagcatcgcatggcaacatcaagtcatgcgaagtactagtcagcaaagaactacgaggccaggatatttctagttcttcgtgacgtctaacgcaaggaaaaaaatgaaggcctcccctgctctcccccactgaaatgcatgtgtagcacagatatggtggtgaaacttaattagcaatagtttcaacaagtgattgaaattaagctcgttgtagtaatatatggtgatatggcctacactatgctcagttataggtatgataattgagaagcagtgagattaggtgccactaacaagaaccaaccctgaattgctgacctgcatgccaatagagacatactccctccgtcccatataaaatgaatctaggattggatgtaacatatcctagtactaattcgtagtccgagaatttttcacatccgatactatgttggttttttatggaatggagagagtatgactaaatttcactgacctgcagcaacaaggcaccgatcattgagttgttcctggatcagggtatgaaccatattctagatgccccagcactgggcctggtggcctaccctaccatatgaagccctctgcctctgggtgcacctatatatatgttggatatgagttgtgaataagagttgacaagggttaatccagttcctttcaaggttttcccatcactctaaaattattgatccctgtccataggtaattaattaccaacttgttgctcgctaataatccgcttgaatatagttgagcactagttattttgcttcagttcaccttctaactaggatgttcgatgctgcagagagtatatatacatgtcgtgattgggttggaacaactatgtttgcgtgagtacttttgcttatcggaattggaggcactaggaaaatggagatggaatggaggtccttctccatccaatgatcacgagccttcggtactacagtgctatcagatattgtgcactatggataacctcatagtcgcagattcacctcccgggtaacacgggcagctgcctaggcttcattgcaaagttcgctggcacataacactaattcttcgctgcgatggattaattctggggcaagatttgcatgtgagagttgaatacggaaaacatgcaggatttgtatatagtgttaagtttagcatgtgggccttggtcctcggctgcctatggcctctgcctgcctcattgtaaaaagaaaaatatattagtgtggtatatgttttcactcaaattaagcaacgtactcgatgttttatcttttctttcgtccataaatatttacatgcatttttaaccatgttttgtataaagcttttttattgacaactttgattacaatatattaaaatatgtatgaacatgttttagtatagtagttaagttaggccagcccagccttcatagagctcttggttcttccactccctcacattgggtgtttgcgtaggaattgcataaatcaacaagttagaggcagtcatggaagcaacttagaagtaccaaggaggacaaatgttgtccctgtagcagtgtagccacacccattgccaactttgaactggaagaagaaaataccatagatccataaacgattgtttttcctttaaatttttgcctttcctctgttttcaacagactgcaaaaagatagcaattggagatcactggtggataaatgctttttactcctggttggtaacccctatagtcccggttttccaaccgggagtaagaatccgggagtcccggttcaaatacaatctttagtcccctaaagtttttttttctttttttttgctattttgtatatctcacgcccattatctcaaatcaatcacaggaatatagttcatcccaaatcattcacaccaacatagttcattctcaaaatcgttcacacaacaaacacagatcgaatcacacaacaacacagatcgaatcaacaaagatcgaatcacacattaaggaaaaaagaaaaaaaaaatcccggcaggcacaccggcctccattgcctgccgccgcaccggcctccgcgccggccgccgccgggtgtggccctccgtgcaaggccatagccgctgccgcccggccgcttcccctctcggatctggcggcggccggctgcctccccacccagatccgccatgcgaggccacctccgccgccgcacgaggccaccgcccagccgcctgagaatagggaggagaggggaagggggcagatccggaggaggaagaggaagatgggtgagtgaggagaggagaggaggaagagataagggtgagggaggaggagatagaacttatcccgtgcgcctcctcctttcgcctcgatctcgcgcgcatgcttcgttctcaccaaccgggactttctctagtccaccaactgggagtaaagataatagaggggtctgacacagcctgccgtttttttaaccgggactaaaaataatctttagtcctggactaaagatcaaaaaacagctttaaccttttgaaccgggactaaagattatctttagtcccggtttttattgcaaccgggactatcgtttgaatttggtcgaccgaccaaagatggtttctccagtactaaatactgcattgtacatcatgatgctcaaatgagataaatagagcatgaccagagaaactttttttttgtttgttcttggccagaaaggttaaaacacttcgctattttcagttgctacacattagtattgcaagaaaaaaaaggatggccataactacaccactgatgtctgacacgattgtgctgtgacacgaaatttaatcaaatcacacatcttggttttgctgaaatctatctatggaattgcaaattctgccaataaaattaaaatgttcatacgagcacacacagtagaggggaaaaaaaacatctatcatgcccttaattttgcagacctaaggaatcctccattggttgttgttgtatgcagaacattttagccattatctccatttctcaacctttagatctacagcttctgactgtcatgcggcaagacgaacaagctaaaatccgagcactatatttggcttccaccatcatgctcaatgcatacataaataacaaattcgaagctacacacgaggagatgtcattgacttcgtgtgcacttcgaatttgtgtttcaaaattactcagtccgtcccttcatatggatcaatggctgctgcagcatttgggctcaaagaattcaacctggagaatgagatcatgatgcatctgggtgtggaggtggtgcagctagagtacgttttcccgatgccactcatgcatatattctaagcccggctgcaacttatattaccgtgtgctgctctctaggctatagcatatgtgtatgtgcatttgccatatgttacagtcttgtagagttggttggctgcaccctctcacatatatatatcctctcttctagttaattttatgatttctggaattgaatctggtgctccttttctttatagtacagaattggtccaattggacaagcaacttctttggcgaagtactgtatttgtactcgctcaggcccaatatgtatttggaccaccatctaatctgtttcgtactaattaatgtgtatcgatctcagtagataaatgcaaggactccacatgcgatggccaatggtacagaaatattgattttttttttaatttttcggtggtctttgttctgtcggcgatttctgacggtgcacttacaggaatttattttttctgacagtaaaattaatttttctgacggtaaagccaaattttctgatggttttgctcctagagggttgattaagtctggtagtgagaacatggtctggactccatccaaacgtgagataccaagcgtcgggcgacaaggggcagcacacccacaattatagtgcctaaacacggtgttacataaccctgatttgatttctgaaaaaaaatcttaaaagtcgatattcactgaagttctttggttagatgtccccactacccacattaatattaccaatgttatgtgtgtagagtaagcttatatatcttgtgacatgagaaaggcaaggaacacaatacatatcagtttcgtcccatttggaaacactagctactcttgttttttccttaaatttccttcagtcctttgtctggatgcatactgattgctattgaacatagacacagtagaaaaactgtatgtatcccagtagaaaaacaaagatgacatgaagatagcgagaaacatagacagaagagaactgtgtatagctctgtatgttggatttggaggcatcggtaaaatgaagatggtaacaagctgcagttacccatcgatgtgagttactgatcttgcatccactaccagaatgggagtctctcccgagtgggagtaaaaggttacggtgtgcttgatctggcactgagtaaaaacggagtgtttcctagagacactaggtaaccaatcttgttatgtagtgttcattctaaacactatatatgtaatgttaggagattacagagtgcctatcaattacgcccaggaatttgggcccgatgtccatcagtcgaacaattttttttggcgtgaaagggaatgcatttagacgcccacatattgatgcatggtggcgcgaatgctatttagtcgttcgttactgtgtgttttggtgtacacacccggtaagtataagagaaaatccctttatacccctgggattttagctaatttctttcatgcccctgaattttgcttacttccttgtaccccaaaatttgattatgatcccttccatatacctcccatcagttgaccaacgaattgctataaaaatgatcattttacattttggatgaacatataaatttatgaattatattattgaaaatgctaaagtttgtcacacgagactactatagttatgagtttgttgtgcgatgcattatttacgacaaaatttatttttagataatgagataaaaatatgtatttattgctgtgcgatacactctggtgcccccttctcgtcctccactcatccccggcaatctgttactctgccatttttgcacgcagttgcttcaagagttgcccccgatctattcctggcggcggctgtgcgtgaccgataaatgacaattatatatatcactcggaaaatatttaatacccccatatttcaactactattaaatgtattaaatgaggtggtagaagaaataaatctggactctaaacccattcaaatgaaatctcacctgttcaaaatgctttttgtactaccagtagagagcaccaaagtaggatttccgtaaatatattgccatttgtgtgttataaaaagggaaacaaagatgcaaaatgcaatttcaatctacgtaattgctactctcctgtggtgttccatgaatttgttcagcttgaatatattggcatgcgtgtgcactagtagcttgcttgtttgggaatgtaaaacattttgtgcatgcctagatgttggaatggaaggtgtcaagatagtcgagatagcaaccatcgggagttctccagcatccagaatatgatgcactacaagcgagctatctgctgctttaaaacaaaatgcttgttgcactttgctagagacctaaatgattgttgcagatgctagatcgtgcatatgctaggctggttcttcattgggcaagttctatgtgtgtacaggaagttattctcgtgttaggtgtaaatgacagcagaagtggctctaatcttacctttcatcctttgttgcactgtggaagttctcatcactgatccaagaagtgttgtgcatgtgctttacttgttccagttggatattatagagatatttaaagggttaatgtgcaatttaggtggttagagcaacaaaggggttatatccaattggtacatcctctttgttttgtcagaaaaatgtccaccataccaatcacagtgtgtgattttctacaattaacacaataattggtaaaatgtgttagttgttataattcttgttactttgttataacacatcgcaatatcactaatcttgaatcagctcatgtattcttaaccatttgttccccaacatcctctccacccacctgttgattgtaataataccaggaaatagttacaatatatggctcgttaacaatgttgtgtatgtcaaatgcactttgatcaatagatctgcataactagcataactgcagatcaaaccatactaatgcctattcttgttctttcaaaagttcccacatgaagtctacaagattgatccgtaaagtcattggctttcttcctgccaagcaatagaaaaaatatgcatatttgcatgtaatggaagaatttatatatttgcttataggaatcggaggtattcggaaaatggagatggcaaattgttgtgaggaatttatagctttgctatgcctgaggaataggtgcattgttatgcattccatcaaatagaacatctgggaccaaccagcttttatttgttttgaaattgaccaatcttctgaagatgaaaatattatggagtttggttttgcatcaccatgactttttggacagtgcagtagcccacttgtgcaatccctcaggataatatgaaaaaccgtcagagacaaacatctagttgagtgctaatgactgaaatgttcagtttctgtaaatagaatagatatgtattcgtgtctgcctggttgcgtcacatagatctgatgtatggtaatgaccaaattttttttatatattttctcgttgtatgcatgactccacgattaaactagcaacctggatcaactgttttttcatggcagtcttatagaagcacttttagcgtacataaaaccccaatcattacagtaatttgttttagggaactcttaagaaacccatgtgtatgtaacatactcaattttagcatgtaacctcctgtacctactcatctcccactctcactcttagcactgtacatgcaaaaatgcagtgcaaactgcagtaagtacattggtacaactgataaccgacgctagtaaaaattgtgactgatgtgtacatgtctcaatatctatcgcataataaaatggatcaatgggtttaaattttcccaaaagaatataagaggtggttaagggtaggattgggtgaaaattaaatgagcggtggttgcatgtgacttctccaacccgacatgctactcacttaatggatggtgtcattgtatttttccttcctaaaatctcttatatatatttgggacagaggtagtatatgtcccaaaagggcaatacataggccagctacttgtgttgttacccaaatttgcttcagtgtcctctatctggatgcaggctaatcgccttctatcaggagagcatagacaatagagaactgcgtgtagcactgcatattggattcggaggcgtcggtaaaaacgagatggtaacaacctgcagttacccatcgatgcaagtaccttgatcttgcatccgagttcactgctgaaatactttgaagcacatccggaacagaagattagattgctgtttatgatgctttgatgcttcatcaagtacggcatctctctctttctgttaccgacataagatgtcactttcaaactgctaaactgctaaacaaaagatgttacagacacttattacagtgacaaatattaaagggtagtggttgtaaaattatgtcgtcactcactttcttttgccgacaaaagacaatgaatttagacatattctcttgaaaatttgaatttcagttctttttttcaacttcacaagatgtgtttgagaaaagaaaaacatggaaagtctgataaccgtgtgattacctttgcatttgtcaaccttgctgaggactagtaagggtgtccatctctttatataggtaacgcgttcgctcctatacttttttttttttgtaaaatcacctatctcatttgtaaattatgaaaggtcaaaatttacaaaagagtagatagattgatgtgcacagcaatattatgccactattgacagaaaagtcgattcaaattttcagatagtaataatgtatattgatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 27062 - DNA, 134 bp, Oryza sativa
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 27063 - DNA, 505 bp, Oryza sativa
cactttgttgtgatcgagaaggtgttttgcgccatagcaatgatcctcggcgacggcatcttccagctcgtcgcgatctcgctgaggacgatacacacggtgcgccaccaccaggtagcggcggagacgctcaggtccttctccgacgtcgacgccatgccgcggccggtgatgagcttcgacgaccgccgcaggacgcaggtgttcctcagggagcacatcccgagcaccttcgccatcagcgggtacgtcgtcctggccaccgtctccaccgtcgtcatcccgctcatgtacggccaggtgaggtactaccacgtcgccgccgcgtacgcgttcgcgcccgtcctggccttctgcaacgcctacggcacgggcgtcgcggagaccaacttctcggcgcagtacaacaagctggtgatcctcatgttcgcgtcgtggatcgggatcaagaacggcgggatcgtcgggagcctcgtcatctgcggcatcgtgtcgtccatcgtct

SEQ ID NO: 27064 - DNA, 1382 bp, Oryza sativa
tatcatcttaatggcttttttggattaatgtgtgattcttcattcttccacgcaagattggctactggacatcgaggaatataaatattaatgaatcgcttgtttacgaggaatgactagtagcatatttaaatggataataagtagaatcacttatccttaatttatgtgtcaaagataaaatattactatcaaaaatagatggagagagtattatcattagtgttaagtgttaaataaaggtagttgaggccttaagttaagggggtgtgcacgctagcgcgccagctagccacccccaccgcgagtccgcaactacccaaccccacagcaccgcgtgcccgcgtgcgatggcattcgcgccgcgcgtaggccgcgcgggctgatcagctgatggtccgcgcggggctacgattctgctacgacttcatacgagtctacgaaccagtcgccgcagcccggtaacgatcttggggcaggcttgcacacaggtgcaaagatacgtgtggcagacatccgctcgacggcaaccgcctggcagtggagccaccgtgtcactgtcacctaccaaagctctgcaaggattctaactttccaatagcccgtgagtttacgttttgtcctgatgcatgatgaacagcccatcatcaacgggagaagccaaccaatctatcatggacatgtcgtcctgtgtcgtatggcgtgcagtttgtactttggattacaggtaatattgatctgtacatatactacttttaataatactccagaaactaaatactactagaaaggattttgttcgccttttagtacgtgagggataattatcccttgatgttattggtcggagtaccattgcatcaccatgaatgagaaataataaagaaatgaaaagaggattgcaaaccaaactgggatgctccccgcatatgggttctgcatttagcagcataacatctaaaaagcagataccacaaatattttcaggggactactccaggaccaataggaactagagattactaccatgaagggcacatgcttgcatcgcatgctaaccatctactgtagagtagtaaatacaaaatctccagttctgccaaaaacaaccaactcgagtcaagaaaaaggacagcagtttcatgcaaaagaaaacattaaatagtacatatccgggagatatgcattacttactgcgaatcagctaaatatttccccaatttattaggcatgtattcccccctggaaatataacaaagaaccaactggagtctggagagtattaaaaccaaggcaaggggttccttctcatggcgcacaccattctactcctagtagtgctcctcctttcctccaccaccaccatttcgggctgcaggaat

SEQ ID NO: 27065 - DNA, 1325 bp, Oryza sativa
  unsure (1)..(1325): unsure at all n locations
gagtcagcgtaggacccacatgggccctatatatcaagatgccacatcatcaccctctctccccatcctctcccttcctcctcttctctcactctctcttcctctctcacttttctcctctcaggtaggcaggctggtgggtggggaggaggtcgccggggtaaggcgggggaggaggtccaacggttggcgatagcggcgcctgccggtacgaatcctgctgccgcgccgccatgtcctcctcccgtgggccgtaggaggtctgacggccggcgatgggggagaaggggagggcagcgcctgcgggtatgaatcccgctgccacgccgccatgtcctcctcccgcgggttgtcgtctcctccgtcccaccagaaccctaacgatcccttcgccgcggcgaagacggaggcggaaggggaggcggcgccgcccggaaaccctatcatgcccagtgaccctccctcaccgcagatggaggccacttcagagacactcacccaagaggagatgttgcgtcggcggaagagctgtaggcgcaacaccggcgtctcgtcgacatgtatcggcggctctactggacgctcgggaaggagcgtcnggcgcggcaccagtagtacgcctgggagcttgtgcggagctcgcttgagccgagcagtgtcacgccccgaaccagttccggctggaactagcccgtgacgctccaaattaacctgttaatcgataccagtcccaggaaacagtgctggtatcacagggagacagaatatcatagcaacagaggtctctttattatagagtaggagtacagtcatgttgggctacggacagatcccgagctcacaactgcattacaaaagcgaaacggaagccaggacttggaccaatcatcacaggcgcgacttgggaactaggccgaaaccctaaaactcatcgtagccggcttgctcctggaagaactcctcatcagcaggatccacttcatcttcttccgcaactgggggggggattatttatatagagcaagggtgagtacgggagtactcagcaagccaggggaaaataagtgtttaatgcaggcttcaaggaaaggctgttgtttttgcaattgattttatttgaactcttttctaaaagcaactaagtgagtgcttctcaaacgacacggacgaggcagtgcgtctcgtccggtcggagtatgtgcaatgtatcagtctttagattttgaaacaaggttggcacccggccaaaagctttttaaacggccacccgggccaacacctttcaaatggccacccgggcctagctgatcccatcagctgcaggt

SEQ ID NO: 27066 - DNA, 628 bp, Oryza sativa
attcctgcagcccttgatttagttgtagacttgtaaagcatcactggtcgtacaaaagttacagaaccgacggggaggagcatggaccagctggaggatgtacgtggtagcttggcttatgtgacctgtcgatgcgctcgtgaacatgataggagtaggacgacgctacagtagtgcaattccattattgtccaccagaaatgcataaatggccagcatgggactttctgtctgcgaaatgacatggttgaacagtacttctgttacttttcaagagcagcattatcagtattgttttgcaagaagtgtactctaagcagcgcgtttttattacaaattaagttatactggtgtagttacgatgttgttcggtgggtgtagcaagaagtggtggacgtcctggaacggtgggaactggtcatgacggcggcgaggcgaggcgacctccagagcctcgagtccctcctcagcaagcgcgccggcgtccggggacgtgaccagtacggcctgacggcgctccaccttgctgccatcaaagggcactgcgacgtgatcgcgctgctcgccgggtcaggctgcatggacatcgagtgcgaggacgtggaagggcaccgcccgctgcacctcg

SEQ ID NO: 27067 - DNA, 8079 bp, Oryza sativa
  unsure (1)..(8079): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatacaaattgcaatcgtctgtcagttcttctcaagcataatatcgctgggtattcctcttaagcataatacaggatcccagtggaaacaaactaaattacaagcataagaataccacaaactttgatgtgaataaactataaaggatccaatctcgaaaaaagagatgaataaaccaccaactttactaggaatcaaatgctgcatcttctccttgatgattgctagctgttgcatagtaataagaaccaatactttgtttccaatagtcagttagaccctccagcagcaagttaggtgtagtagggctgggcagtggcagatgaacagtcaagcatatcagttgtaatgttcatcttcaatctgtttggatgtcctgttgcgaacatttacaataatctgttacctaagggcttatattaatacatggatgatatacttgaacatgtaaattccattgaaaaaaaaaacaatgctactgaatggaaattattcgctggatcccccatcatctttgttactcagggttcgaattattgcttctaacaccttgatatcactttctttctttgcaatctcctcttgctttgcccgcaactcttccatgtgtagcttgaacacttctgcaagatgataaaatgaaaccagataagacattcagcttttgacacgctcagttaccaaatgccaatggtttacaacgaaacataacatacttgcagtgttctccaattccttggtcacttcctgcgcacgtaactccgcagctcgttgagcagcttcagcttggcgtttctctgtacgagctcgggcagcagcagaaatggcagcatctagttcacgttccagcgactgcaccctctggtcaagaatctaacatgcaacaagaagtgcaaatgaatcttacatagcttcttttgggacaatgtttagttaaaagccaacatacatcagagtgatgtcagcactcttctacaacataaatataagttttagcgaattttatatttttgtaataataatatactagcgtaaagccataaatgccaatttactgcttcagatttgcagccattgactacaacatatttttatatttgtaatgataaaaatgttaagaaccatgaatcttacatggtggcttattatcaacatacatacaatttaacaattgtattttagcaaagtaaatatggacagcaatgacagcacacttctacaacataaataagtctcggtgaattttttgtaataataatgtactggcgtaaagccatgaatgccaatttactgcttcacatttgcagccattgacttgcaaaattattaagtatttctggagagagatgaaatacatccctccagcttaaatataagtcggtttttacttcttgcagtctccaatgtatgactgggcctatggtatactatcataatttatactagcaaaatgattgaacttatctattataaaagtattttgcaagagccaaattttaatattttctcatgtagccaataaatatactttgacatattttcaagatcaaattttgaaaaggtagattgagcagatcccatatcaaccttttttcagatatggagaggttatgaaaggttaataatttgtgacatctaaccaacatgttatatgaacacagaaatgtgagtactatgatgtcaataccatatttaatgttgccaacacaggacggaatacaaaagaacaaaaatcagaatgatcctaatatctacatggtgtccactagattagctacaggtcatcagttttagtgttctgattttcgtgagaacttgtgaccccaaaatataggttccaatcactcacgagatccaccaatctgcacaagtgtgttagatcatttagtttgatcaatggattagatatgcaattggtccattagcctaaaagataacatgagtcttaagtaattaggctatcagaaaggcttaggtcccaagtcaggttatgcgctataaattaagggggcgtcccactactgcgaacttaactacttctcatgtcacagtaagtgagctccaaaaagtttattcccaaaccaatccggaagtataatttgctgtcttgaagcccaatccactcctgaggatgttcatcgggatgatccatgaacgagtgacaatgaatcgaggggatctgtcctacgaaacctcctctggagtggatcagcctttgagccaaccaaattgcacttcctaattagttcgggaatgaggttgtgaggcagtcacttgctgacacacaagaagcacttagatttgtggtaacaagatgctcctcaatttatagtgtaaaatctgactagggacctgacccttttctataaattctatttagccccacgatcaaagcatatcagcgaattaaccatttgtgacaggctaattgcttaattacccatttgcccttcaaccaatgggttaattacacaattcactcatggatcacactaaatggtctaacattctcccacttgattgaataactaatcttagtccatactttggcaagagcaccacacaaagataatgtagttagggtgacaaaataatcataactgaacttcattgtctatggtataccactatatctcatatgggttattatttacggcatttgggagttcagaaagaacgtgatcatactcctttctcatggtcctcaatatagtttcataggttgtttttccattaatcattatgtgcacttcgtaagggagaaacaaactttcaatatttccagaatcaaaattcgacatcttatcattataattatccctgagttatatgagcttttcattagtatcatactggcaataagttctcgaaggagatttggagacaagacttagtaagggggtcaacaatcattaacttagtacttaactacttgtatgctgaaaattaattggttgatactagattctatctttgaaaacttgatagttgattttgactaagcatgtagtattagtcccttgtagatagtacagggttctcttgatagctttccagtgatctaaacctagattagaacaatatatgccaagtaccttgatcacaaatgctaagttagggagagtacacattagcacaaataatgctcctaactactgagatataacgaataatcttaatctcatgtataaaactggtttctcggatatgccatcccaaatgactatgtcatatcaatgaggatgtgaatcaaattgttcttattttactcaaacaaggatctcagcggttcacctagtgcaatcactcaagatctgatcagatcaaaccattcttcttttacactgggagagttcttggagagttcacactacacatcattctgatgataactacatgatgattgatgaatgatctaatcaacccagtcacattttgagtggagtcgacaccaattcagctgggttgagtagaatccacatcaaattcacgacgcatctgggatacgaacaacaattgcaaatcctacattccacttactgacaaaacagcatcgccgaggataccggcgaagggattgggggcgaatcaggagcaccagcaacgagcaaagcaaagcagagcaaaatcaccttgatggtgcgggcctggtcggcggcgagggaggccttggagaagatgtcctcgtcgacgaacaccgccttcttcgcgagcagcctctgcagcgccgccacgttcgcccccagctccgtcaggttccccaccgccgcgccccaccgatcccctccaccccccgcccccgccgcatccgccgccgccgccgacgaggtcgccgcggcggacttctccctcggcgccgccatctctcgccgccgatctcacaaaccctcactttttgcaattaaccccctcgaactattctaaattataaactagggctcacttccactgacatgcggggcccacgcttttcccagtccccaagaaatatctgtcgttgacaagtcaacgcccagatccaacggcggagaccaccgccgccccgttccgatcggacggctgagatcgctcctcgagccctatatacggctccacgggcgcatctttttccttcccccctcgccgccgccttctccatcgtaaaccctcgtcaggtgagacgcttaaaccctagctcgcgaattccccatctaatttcgttgaaattttcttcgattgatttgattaattaatatatatcccgcgtggggtggtggtggtgcggggttcttcgcgcgtcggtgtgatccagcgatttggtgcgaatctgtcccccattcttttggggggctttttggtggctgggtgggtggatgcgtttgtttagttggttggcggtgtgcggggtgcgttagggttcgtggagatctccgtggttcgtaagatagacgatctattagtgttgcgctgttgttgctcggctcgtggggtttagggttttttggctggagggatggagggggcttgaatggtggaggagggtgagtagatgtcaccatgggggtggtgatgaatggaagtttttgggtcggtatttgagggcctgcagattctcatctgttgcaatgtttgatctttgagtaagttttgttaaaaaaaaatcacatgttttatggttgaagttgcagaaaacccttagtattctgatggcctgtagcatgtttgcttgatttatcatgttacaaagtgtccatgaaatagtattgaatatcaaaccttgtgttagttgatattctttcagatattctattattagatataagatttgaacaaggatgaattctgtgaatctttgaaaccgtaaaactgggcactatgtgccataaagtcaactatcttaaatcttccttttttttggcctccaatagtgaatatcttaggctttttcctttttaaatgtggatttcagcatgtaactgatgttattattttagtaacgttgagatagtccagcttgggatgttcctattgagatttccacttgcaagtggtgcaatttttaaaaccattccatcgttcttgagatatgagatggaatgatattgaagttaattgctatatgagatgtctgatttagttgttagatgtatggcattgctttcttctgtaaattggtgtctgcacaatcccatcgagctcggattctaatcaaccactctgtttttgtgtttcttcttgctgttattgtttcttcctgtgacactacaaggacttgctccagctgtattgtgttatttagatggctatatttatgtcttcctttgtttcaccactgcatgtagtttggaacaatggcgttggctaataagattggtaatctgctcaagagagccacgagctcaagtccagctctctatcaatcaatcagatgcatgtcatcctcaaagctttttgttggaggtttgcaaatactatattttatctgtttgatcatttgttcagaaaacaattattctctctgtactgttcttttctgatggctacaaattattggtgtaggcctttcgtacggcacagatgagcagagcctcagagatacttttgccaattatggtcaagttattgaaggtatcttatccttatttttgtaactgcactcctgttggtcctttgttttgttaacggggtctacttttgttctgtccagctaagatcatcaatgaccgtgaaactgggaggtctagaggttttggcttcataacttacgcatcaagtgaagaggcttcagctgcaatcacagccttggatggaaaggtaatcttatagggaattaattttagcgggcatcatgtttatgttccaggattctaagagttggtccctgtatggtgagggtcagattaggtttaatttaattttttaccccatcatctatatgtttatccagacttaataggtattctgtcaaacttaaggtgtaatgatttatgctggttaaattcacttagaatgcttctaaagttttggagcccttaatttctattactctaatggattttaccactgcaaaccaatttaagtggattttcaacactgccatgtttccatacttttgcaaaagatatggtttgtagaatgtcaaatttcatgctgcctgatcagcttgtatgcaacacgatcgcttaaatgaatattcctactctagattccttgttacagaaattggagatgttccatttcaaaggttctgattgagcttcttatttgttattttactatgcattatggtgttgatgctttgattatttacctctggttttctagttaaaaaaaatatgcaacagttccattaaaccaaagtcatttttgttcaatcttatccagcagcttattttcttcctggctggtttcaggatctcgatgggcgtaacatcagggttaacactgccaatgagagaactggtggcttccgtagtgggggtggtggctatggaggcggtggctatggcggcggcggtggcggctatggtggtggtggctacagtggtggtggtggctatggcggtggtggctacagtggtggtggtggtggcggcggcggctaccaaggaggcggcggtggttatggtggcaacaatggagggtatggcaacaggggtggtggtggaggtggttatggagttgcagaaggatctgcagatgccttctctggaatcaacttaggtggtgatggtagttttggtggaaacccagctggaagctttggtgatgctggaggttccactggcggtggtgatttctccggtgccggtggtgacagctttggaagccgcaagaacgatgagctcatggatgacctcttcaaggatgacgagcctgacaactatgccaacaagcagggctaattaatctacgtccttcgagcctcagtttgcagtctcttagtgatgaaccggctcacctgaatggtcatcacctgctcaagcatcaaattccagaacaatacacaatgactgggttttctttttcttctgttctttttcatagatgtggtgtaataacgtaaacatcactcaaggtactacttctagttatgttatgttgagatgacaatggaggtgttttaaatgtctgtttttattccattagctctgtttgaaatcactcaaggtaaactgctgatgcgctgcttctgctgctgctttgttttgcttgctgtgcttctgggcttcttgcgttggacagtaactgttgacgtgctgtttattttgccctcaaatgtctctatgcatgcgtaaggatgcgctatccatgacttatttttgtttgttttttacatctggtaacttctccgttacccggcatgaaacaagcccagactatccatgattttagtccgttttcgatcttgactttgctctatatatcatgtgacatgaagcaaagcgttttataactgcttctctgtgttatgctatgtgttatctatcttgtcaatagactccaattaaaaacggtactccctccgtcttaatataaaggattccctccgtcttaatataaaggattttgagtgtttgtttgaattgtttgaccactcgtcttattcaaaaaattttagaattattatttatttttttttacttgctttattatctaaagtattttaagcacaactttttgttttttatatttgcacaaatttttaaataagacgagtggttaaacagtttaaccaaaaactcaaaatcccttatattaggggatggagggagtatagacataaaaactcaagggagtatagacataaaaactcaaaatcccttatattaggggattaggggacggagggagtatagacataagtctgtccattgggattagccgattagccggcatttagttacctgtaatgacaaggcaaaccatttcattaggtcttgtagaacgctaga

SEQ ID NO: 27068 - DNA, 5992 bp, Oryza sativa
agtagagtgcattttctttcagcgttcgattcaaatctggagtactgttattattgtactccctccgtcccaaaatataagcttttttagctatgaatcttggcaactatgtgtccagattcatagctaaaaatgcttatattttgatatagaggtagtattacttcagaacagtgtagcaacaaactcataacaatgttcaaacaattgcttctcaactatgaaaatataggattcgtttccaggacttacaaactagctagttttcctgatgaacggcgtttttctcaagtcaaccatttgcaaaataaaaccttttcaaggcattgatgccattctcatcctcaacaacaggaaatatttgacttgaatgtgattcaagagtccaggaaatcttacaataaagactaggcttgaatgcaagtttttgtttgtaaaacctttttataacgttttaaaaataaaccctctagtattcttcttttcaaaagtatacattttggccatgcttgctaccaagacacaccacacccaattgcatcgtaaaaaggtaaaataaaataaaaagattcttaaggagggaaaaggagtgtaacaagtcaagacagaagatagctgcattgacagatgagtattttctagatttttttttcaggtctgttatgtgttgtcaattaatgattttagctgtttaggtggcagttgttcttgatggttatatatattttaagtgtgacattgctgcccattgtatattctgcttctatcatttcaaagattggtctgctgaagatattgagtaagcaaaagatgggagtaaaaaatgaataggtaaccaaacatgtttcacttttatgtactgttatctcaaatacaaaatttttcagactagtgtgaagatttaaaatagtttgaatgactttgttgctcttttcttttactaccacctccgtcctaaaaagaccgcaattttatactatttatatccaacaattgaccgtccgtcttatttgaaaaaattttatgattagtatttttattattattagatgataaaacataaatagtgctttatgtgtaactaatattatttttaatttttcgtaaattttttaaataagacagatgataaaacgttagacatgaaaacccacaactgcactaaaaattagaaggaagtagtacataggaaaataatcatttattcaagatattacaaaattgtcagtgtctggaaattttagagctgtttatattagttgagcctacatttggagtaagaaagaaataaaagatagatttgatagagcagcacgcacgaacaggatgtttgttatgcaaaactcaattgaagagaaaataacttgtatataaatcttttcatgcactgttttttttgtcatcaatctagttggttgaagttaaaaatttaaaatcctaaaactattgcatatgcagggtgctaaattatcatttagattcaaagagatggcaaatcctaacatcaaatattcaaatttaagtgtatcatatgataaaaattacctcataaccatttcagttcacttttatcgcctggcgaattcaattcactgatcagatttatgggttagtactttgaattcagatattcatgggttagtgctcggaacagcagttgcttcctcctagatgagacccagagtttatatgtgatcaagatcaattgaaacaaaacatcccaaaagtgacaagaaccttgtttttttaagataatagtaccttgtttttctaataacggaataacataatctcggtcaaaccaagcaaccatttgttatacaagcaggatcatcttacaattatcaacccaaaggcggcagcctacacacagtgagtgttttcttacaattatcaactaaaggcatacttaaggtcaaacaaatgcaagctatctctccttttctttttcttttttttttactgcacgactctaaaatggtcgggaaacaacacttcaggacaacacaacaaatcagaaagcagtcatggtaatgactgctgctaacggttgttgattaacaggaaactgataccattgcctttgtcagctgaagagtgactgccccagctccggtgatgtcaggttggctacacactcaaactgcacacgaagtacaattaaatggtcacaaaagatgaacaaatgaccctttttagtctagtacctcaagaagctggtgaagtggtgatcatgtaccttttgttgcctatacttttcacgtatagcattgagagggcaattactggtgttatgctgcagttcccgtagagcacagacacatatttgaatatcagagcttttgtaagaagtgtagtgctcaagagtatgattctgtaaaaagataccaaggttgaagattagaaaaaatgttttggggtgatacagaggtcgatatagtgcatatccttgttatacgaacccatggaatgtcagattggtcaagtgtccatcttgcaagaaagactgcagatgctgccaccactgaaggaagaaatttgaggaaactgtaatcgatcagggtcagctctgcaagataattggccagatatcccaaggtaattgaaggaacctggaaatacagtttgaaaatttggcgttcagggatatacacataaaaggaatgaatgaaaattgtagctgataaaaggtcgggtgccaatcttacattacgagaagcctgtgcggctctaaggaatctcctgataaaatataaagaaaagcaggacggtcatgttagtgatagaaccacaacttagattggacaagaaacaccatatgtatgtggtaaccaaaactacctgagaaatgtttttgttgttggaacagatagatgaaaccccatatcattaagcaccaggccctccattttcagcacctattgaatcagggggatatcatatcagcaatggcagttcaatggctcttctatatacataaattagcaatttcttcagacatcacattaaacaaatacctcagcttttgtgtatgtattgtcagttatgaaacaaaattcttcaacacgaggagcacatatctcttcatatttcctataaaaagaaggtagacttagcaatacttccaatgacatgaagacaacatgcaattccaatgacatgaagacaacttgcagagttgttagcttgtactttacattagctacagactaagctgcatcagcagctaggtaaacctttctatggtacattttgggaaaatcacatatatgtatccaaaacttacgaggcaatcagcatgcttgttattccaagaagttggagtttctgtctttcaatataatgttgagaaagaaatcggtcaataagattaatggttaggtagagtgtgtctggcacaagcttatattcttcagaaacctgaaatgaagacaatatacagaacttcataagctcagaagtcatgaacagttcatattattaaattaaaatgtacaaaggatgatcatggtttattataacaaaaaagaaaaggcagattcttcgaattttgcaagaaatgtataaagcttgcttctgatgcagaagccaactactcatattctcacctcttcagtatctcaggctctccgctaaatgatgagaagagtgattttataatccacaacttattcaattatctcatataaacttttcatcattgaaactatggtactttcaaagggaaatgccaagggccaatggaaaaagtataaacaataatgattccatagaaagaatgttcttgtaggcttttaaccagatgcagcatccagtatgtaacattcacatgtaactatgtatttcatgtttgagttgcacatacatgagtttctatgtgacatgcagcgagatgctaacggcctaacaataaacggcttaaattcgtttgaaaagatagcagggcagtttatgtgcaaattacatcaagagaaatcaacctcaacaagccaatcaatgagaatgcctcgcatgccctttgtgatgtcacgttgcaaagcctccatgtaatttgacctgggtcttctgataagctgggaatggcataagcagaagatggagtttgaattcaaacaagaagaaagcaccaataacacagggatgaaacacaaccatgaaaaactgaaattacttttgtcatactagaatgtttgaaatatgaagaaaccatgagcatgttaagacagtaaacaagattttgtttttcatcaaagaacaaaaacatacctcagaggccatcagatttgtgtatatctctgaagcataggaagcacacatttgaggatttccattatcattgtcaatatctataaaacctaaaccactagagtcacctggaacaaaataaatgactctttagcaatcagcagtgtacagaaaaatttatattcatgtttttcttgattatgactagcaaaatacccgtgcattgcaaggggattacagtaaagcccaaaaagcaaaataaaattattaccactctctaatcatcatatcatatttggtacaattgtatacatgtaagtcgagctacacagttgctctagcgataaacaattggtataaattatccacattgtatttgatttatatagtggacactgacatcataggcccacatgacactggcagaaccaccaccaccactaccaacatctgcagtagtaagtacagattatctacgaatatctcagaagtcagcagtgtacagaaacatttatagtcatggttttgtacagaaacattatagtcatggttatcttgattctaagttctgtgacaacagaaagacaatcaagagtatgttcctgatagaagtgattgacaaccggtagataacatgacacgctaagggatatatgaatcttttttatagaattagctgacttgaaaagaaaaatcagtaagtccagatactcattgctaaaaataagcacgcaacgtatgcaaaataactaaccaggcttggagtcagcgagttcatgtttatccatggcgtttcttgcctcaaagaatgcctcatggcaattactgtccctgtttcgctcaatattctgcaatgacagtaacccctcgttttcaaacaaatttgtgggttcctctgcttttgccaaaagctccaccttttgagtttcttcagaacttttagaatcaatcacaaatgaagttccagcaacagccggagggggtagcttaggaaccttctttgcacactgctttttgctcgggatttgtttcaccctttgggtgggctttgacttttgctggaacaaaggaataaccttatcactccatcaacaatgttcatggaaaataaaggtctaaaaatcataatagcataatgcgataatgcagcagctcttgatacctgcagcttgctcgtggtggtgcaatttttggatgagttggcacagccgatgttggttacatccttgagcactgtgcgccgtttaggctgaggagctgaagttgcagtacttgcactagtgatttcatccaaagctcccctttttgtctttccttttgctgtctgctttcgttcagttcttgcgggtagtgatacggagggagcaaacccaaaccgtccacgatttgcagcagcttgagctcgtgtgattcgaccactgggtgcttggcaagcagtaagcaccggattttccttccttccagccatgtgagcctgaatgtgttaaaaggaaaaaaaatgacataagaaattgtgcagttttgacgcaaaaaaaagaaagaaagaaattgcacagtgagcaatgaagatatcaaccaaggcaaataactttatggagctgaatgagacggtgtattaagcattaagtatcagtgtgaaaaagaaatcgaacaagtagatgcaatgcagacataaaacagtatcagatcttatttgcaaatctaacaagatcatatttactcacaagtgcacaagttaaaccaaaat

SEQ ID NO: 27069 - DNA, 847 bp, Oryza sativa
ggtggcggagcaagtttccacgccgccggcggcaggcgacggcgcggcggcggcgaccggaacgaaggtgggggtggaggcggggggtggcgaatggtggtggtctcctcccctttttgaagtttgaaggcgtaggcgggatgggggaggaggattgaggaagaagccgagagcgagatggggagggggcttggtgggcccggcccgtcagggacccggaaaagggaaagtggggttttgggcctatatatacggataaggcaacttttgtggccctagaaaggaaggtggcttttttagttgagtacgtacggcccatgtaacatgtttgagcccggtccattttactctcttttttttcaatagatgacgttgttgactacacatatttgaccattcgtcttattcacaatgtttatgcaaatacatgagatataaataatgctttaaatatttttagtgataaaacaactcacaacaaaataaatgataattgcataaattttttgaataagacgaatggtcaaacgtatacccaaaaatcaaaagaggtagtaggtagtagtggacttggctagcgaaaaaacttagaggatagcattattcgcaaccttgcaaaagttttagggcttctttaggaacgcgggaatttttttattaaactttttgtaggatttagttcaattactccattccaagggagtcattcgctgaaaacacaatctatgtgcgaagagataaaaaaagggggtagggctttttcggaacgtagaaacaatctgtttaactgcgaaacttccccattccaaagagacctaaagtgcatttatagtgtgtagaccatgtg

SEQ ID NO: 27070 - DNA, 529 bp, Oryza sativa
accatgctcaacaccacaaatatgttccacattacaaccccccaaaggttggacctttctatttttccgggctctttttctagaaattactgggaggaaatcaccatcgctactagcattactgcatgattgcatttcttgtgtaccactgctagcatcagcactgtttctgaaacaggagaatttatcatgatttgctttgtttagccaaccttcactgccaccacatttagaacccctgagatctgtcacttttgactgaacacacggagggcactcatttttgtcaatcaacaagttctcggtatcatcactgaagttccaactgctatctgtgtaatggccatccaaagaggaatcagtaagagtggaagtggaggcactgtccaaacatctggagttattgctgttagattgctcacagcattcaaaataagaagcatgcctagacaattctatctcatcactacaagatgtacttgatatcagagttatgaaagaaccatcgttaccagtttcactatcaggt

SEQ ID NO: 27071 - DNA, 3456 bp, Oryza sativa
ccacgcctcatcgcttgcagtatccatgctgctgctgctgtatcagtgccgctgttaggtgccagttcagtttcctgatttcctctccaactacaagcaccaaattgcagcgtctctggcctcctaatgacctcgatatggatcgattgcacaaatcacaatctgatttgttaattgtcactagctgtatgatttgatatcttcttaagaaaaagtgcaaagctccatgttcagatcacagtagtacaactagtactagcagcaggcaaaggcaaagttggtggctttgcagatggcacgcgatccggcctgggagagcatgcaggattgcagagcaaagcaaacggcagaagcagccacatcacatctacctatgggctgtgtggtgtggtgtgctacgtgtgctagttgtgcgtggcgcccatgtctgagccatcgtctactccacttgtggcgattctatatctgaactcagaagacggtcagattgctcgcatcagcgatcattgggcttgaaaacgccgcgactcacgcggtcacgccgcgtccgcgcgccaacaaccagcggaggctgcatctactcgcgcccaggaaaacaacaattatcacgaagctgtaacttgtgacttgtggaatggaataaacggaccctggaatggaatatactccgcctgacatctcgtctgtaaatccgtgcagtgaatataaattgattttgaccatagttacggtttttggaatagtaaatgtcttggacataaaaaatggcgtaaccaggtttgttacaatcaaagctttcataatagtgttagtactctatcgttccacttattgacggaataagtaaagtagtatttttacaaacagaaaataatttataaataaaaattttatatacgtttttttagcgatataaaagcaaagactggaaaaataaactacgataaaaaaaactccacaatcaacttcaaatttaagattgaaaattcacattttggcttataaggataagcatgggttaaaagatgaggctgttagcccttgtgtaaggcctagttcttttttctcaactcgaaacttcaacttacttattttctgttagcacgattttcaaacggttaaatagtgtgtttttataaaaaagtttttttagaagttgtttttttaaaaatcaaattaatccatttttaaatttataataattaatacttaattaatcatatgctaatgagttttatcgttttgcgtgctcctgagtatcttatatttacgcaaaagagtgaaatgaccaaagctacgttttattgactttaaaaaaaaatgcaaaaccactttttttctacaaaagagagtaggagctaatcttttcataaaaaaaaccaaccattcatacgataattactgaaatggttttaaataggaaataatccaccagcattattgacataaatggttactccataccttataaaatataataactcttagagtttaaactttattagtaaaaggtgattttccccactaaattatacttaccatattaactctttgttttattatatcttcaactagtataactctataatttcacccactcaaggaaactaagtctttttggatctattcttaatactcgtgttgaaaactaaagctaactatatattggaataaaatgagtatacaaggaccaacttaattaaattgaaaataaaccatcagctgctattgctacaactcagctacatctatctctttgcatataaaggctgggttttaactatttttttaacaaaaaaattgctatgacccgactgctttggctactgctgctgctacggctgtctgccataggactgtatcatttcgcttattggtggaataagcgaaacaacgtatttacaaacagaaaatattttgtaaataaaacttttatatatatgtgttcttagtaatctaaaagcaaaggttggaaaataaactacgatgaaaaaatcccaaaataaactacaaatttaaggctggaaattcaaattttggcttataaacataagcataagccaaaagataagactgatggtcagcagttaggacaactaatcggagtaatcaccctactctttagttcatccgtggtgtgagagcaagtttgatagtatagccaactactatcttcaaatcatctatagttagtttaatatcaaattcatataatagtttcctataaacatatactacataagtaatattagatcccacatgtcatacacacattacgtcttgtagtatgtgccgtaactggctacaaatctgcagctcgctgctcttatctctcatcatttatcttctcaatatgtgtttatagctagcttatagtctgtacctgctttggttaggcctctatggcgaaaggctgagtttgttttccctctttctcaacttgtgctttcttcttttttcatgcacaaactttctaaacaacaataatctatactcgaatagtaaacctgcttgaaaaaatatatattattatattgttcgaggttttagttaataattaattaattatactctaacgagccaccctatttacggagggattagttattatcaacatggagctacgaacacagcctaaatgggctgctctgccgcaccagccgggcagccccatatcggcccatatctacgatgaatcgtgggcccagttagcgctcaacattgggccgtttcactattaaaggcccaacagagcagcacccaaatcaaaaaaatgttatggaaaggaggcaccaaacgtgggccccacacggcagagacagcggcaggtgccgggagtcccttccggcgtccggttcgcgcaatcttgaagaggaaggagaaggcgagcgaacgagtcgacgacgaagcctccgcgaaaaggcggaggagtcaaaatctccaaccaacgcccgcagccgcagcagcagcagcgagggcggaggcaaaattacgagcgctcacgcccaaatccgcgaattcccaccccttctccctcgcccaaaaaatcctcgcctactcccctcccaaaccctagcctcctcctcctcccctcctcgcgcttccaatggcacggtagcttcgcttcgatcgcctcctcgcccatggatcccggcgggatgctgctcgaggacttcgggcagcgggtggacctcacgcggcgcatccgcgaggtgctcgccaactacccggagggcaccaccgcgctgcgggagctcatccagaacgccgacgacgcgggggcgtcccgcgtccgcctctgcctcgaccgccgcgcgcacggcgcaggctcgctgctcgcgcccgccctcgcgcaatggcagggcccggcgttgctcgcctacaacgacgccgtcttcaccgacgaggacttcgccagtatctcccgcatcggggacagcaggaaggtgtcccagg

SEQ ID NO: 27072 - DNA, 563 bp, Oryza sativa
caattcagtgatagcttcctcatacttgccaatgatgtaaaacaaaagacaaaatactccctatgtttttaaatgactgatagtggacactattcccttttgaatttagccactcgtcgttttactaaatatttacaaggactaaaaggaataatatgttattgaattgtattatattctaaacataaaacatgaaacttttattcaattactctaaccatttcagagtaattactagtcaatattcaaatagtaaagctaaagttatcagttatttaaagatggaggaaggcaccgaaacccgtcatgctgtaagcgggatggagtaatctatgtgcgagcaaagctcgtaataagcttgtcgtttgcttgcacccactccaattaagcaagcagagtctctgtagtatatttgcggctgccggtgagtgccgcggcacagcaacggtggaaaagcacatggcaacatggcgatcgatcgattgattcgacgaccggccagccagccttgccttggctttggccttagccttgcactgcactgtctctcctcccaccggccg

SEQ ID NO: 27073 - DNA, 266 bp, Oryza sativa
ttttgtgctccttgcaaagtgacccctcggttaatcaccctgattagtcacctaaatcacacattagtactttcacactgctaatcaccaccttaatttcttgcgtatttttctttgccaaacttaatttttcttcctgtccttggctgctgtttggtgggccatgagtagtagaaatgtggagtggttaaaattgggaagaagggtgaaaaatgagtctctctctggcaagaagttactgcgagcctcagtcccatacgcctgaa

SEQ ID NO: 27074 - DNA, 389 bp, Oryza sativa
aaacatacaagtaatttacaattgatcaagagtttgatcatgaaacatacaagtaattaattaagaagaaccgaactcgaaccaaataaaatcaaatcaaattctcagcatcaagatcagtcatgtatagagcgtagctacgtactgtccgggcctccgagctgggtgacggcgtcgacgaagcggtcatggagctcgacggtccagcggaggcgtggcttggggtcggtggtgaggacgaggccggagtcaccctggacgcacaacggcggccgatcattcgagctcgccgccgccgcggcgccgccgacgccgacgccgccactgagctgctgctgcttcttggaggaggaaggagaaggagaaggagaagaagaagggaacattct

SEQ ID NO: 27075 - DNA, 238 bp, Oryza sativa
aataaatttttttctccttcgcgcattcattttaaggtggaaatatttcgtgtttgcatcgccttctttgagattggtgatccttgaagcttgccttttgcgagctctttcaattatagacagtcccatgactctgtccttgaggccccgtcttaggttgagctcagcttgactgagttgtcttgactcttgtgctatatctaactgaaggatgacctcgagggccatgtggaggtgc

SEQ ID NO: 27076 - DNA, 350 bp, Oryza sativa
tcccagtacttcagcaatggacaatcaatggaatgcagcgccatcttcaggcacgaattcagagtaagttgatttaccatggctatattaatttgttgttcattaattcaaaatgcaccctctttttagccaaacaatcaaaattaattttcttttgtctatactttctgatcgatctagctccatgcatgttcatatgttttcaaaattaattttctgttctgtcgatcttcacagccgcaacgtgcatgtgaatggggcagataagaaggcccagagccaagaacaacaagaggtgagagagcatatgtatttttaaattcatcattgcatactgatgactagttcac

SEQ ID NO: 27077 - DNA, 699 bp, Oryza sativa
cacgagcaagcagcgcgatccagcttcctagaatcctgttctaccgcaccaaccatcacctacgcaataattccagcgcaagaaaaaacttcaaaaaatttaccaccgcgtgagcgtcaacgagctcacgaatcccagtttgctcccggagacgcgcaaaactcggctcgacaaacgggctcagccacgcaaaaggatcacatcacaattgcaatcgcaatcgcgcggaaatcaccttgaggagcgccgggtcgaagacgacgtgggcgcggttctggagcagggacacggcgacgcgccgcacgccgcggcgggccgagacggcgccctcgacggcgctcgtgcacgccgagcacgtcattccggtgacccgcacgtgcgcctcctcctcctcccccgccgccgccgcggcggcgccgccccccatctcctcgtcgtacgagtccagcagccggacgtcctccatctcgtcccctcccccacccgccgccgccggccggccgccgccggcgaccgccgagagctgcaggtgggccatgcctgtcagagagagagagagtagccgcgcgaggtgggaatatttggtggaagagagagaggagacgaaacgatggagaatggggcgaggcggattatataaacggagagggaaaaaaaagttaaagcgcagggggcaaagtggaattattttgcattttt

SEQ ID NO: 27078 - DNA, 310 bp, Oryza sativa
tcctgagcagctaccaggtcagggagcacagttgctccagacttcctccagctctcagcatcggcggtcttgaatcggtccagaagcagcgcgtgcattccgatgctccgtgcaggggtgtagtccttgcgcatgctgtcgcctatgtgaagcgcctcttctggcgcgaccttgcccgccatttccagtgcaatcctgtagatacttggatctggcttctccacaccaactattccagagaacaccccaaagtcccactcggagccctggttaaaaaaaaatcaagagaagtcatgaaccacaacattta

SEQ ID NO: 27079 - DNA, 11891 bp, Oryza sativa
attcctgcagcccatttctcaacttacaaaccaaccattgttctgtcaatatcaaaataatagcaaacagaaggtaggaaaatgtgagctgtcggtcaatacctgagcttaaaaacgacaaggacaataaaaagaaaatacttactgtaggtggaaaacagcaaagctactcaatgaggaaatagcagtaagtttgtgcttccacaaaaccagtcaacacaaaaaaagtgaatgcctcttccagctcaatcagatgctaccaaactcgagttccataggatgagcttgcaactgctagcaaatatacagtaaataagctgaggaaactaagttctgaaccatggtctgaatatcatgatatgttttctttagttcaacggacaaggcacccattaaaatttttgtaacactcaaaagcaccttctttgattattggagtgcacacttgagattaaaaaaagctgccgctatacaaaataactaccaaaggctaaaaccatattcaagtcccactttacaggtacacaagcaacatatgtaagagagagaagtacacaacacaagaaaggagtctatttaataaagcacaatcaaacacatgctaaaatattactacctatgttcttttttacttgtcgttttggacattgacacaatctccaatgtatatgtctcatactctcatcattactttttctagttatatatgtataaaacttattaaaaatataaccatgtgaatgtgtttttcatgacaaatctatcaatgtcattttcacatcttaacctttttttttaatttttaatgattatcatatcgagatttgaatgtgttctctaggatggcatccttttgataacagaggtagtacctctccaatgggcacctctttcactctttgtcactaacttcagaagaagaatgtacgcagaccgtaaaatgtaaatggatttcaaaagatattgaaaaagggtacataaaccacagattgagttatttctcttagcatatcagtactgattgagaggaaagttgtgattaatgatatcgacaatttaagcatttgtgaggttaatgcatgaaacgtatgcttaccttgcatggcatctgtttgttaggaacccaaagggatgaaatgatgaacatgtcagcaaggtagttaattacatccaataacagaaggaaatgttttgatttttgacatgtagaagtgtggagcattgccatccactgaaatttctactcaagccatcaagccctgtcattttcccattagttgttagctttcaaacgagttcatctagaactctggaatacacagacgaaaagaaagaggtagatatgtaatatgttcaacaacttttccaaaaaaaaaaaaaatcctccatagaatatttagctaactaaattacctcattgttgaaattgtgatatgcagttagcatcttcaaaagaaataagatggtaggatctccctgaatcctgatacaaatatccgcttcactcaggctcagtttcaactgacaaacgttacggtgaaacagaaccatcaatccataaagtctttggttgactgcagcaaccgtcattctgtgacctatcatgcaaatgaattggtcatgatagtgtaaagtaacagaaacgttgaacactggggcgaaagttccccacataggctcgtgtcgctccagccccaggggcgatgcgagcgcccccacacgcgccggccgccgccgcgccttccccctccccttcgcctcgccgccgcccgagtggcccaccggaaagccggccgggcgcaaggacggcggcggcggggcatcccggcgcccgtggcggcggaggcggccagatccggggctggggaggcgacggcggcggggcaaaaaaggtggcggcgacggggcggacgaggcggcggcggcgacggggcggacgaggcggcgctggcggcggccgacggtgcggaggaagcgctggcgacggtggcgacaggacgggggtggagctggcagcagggacagggcgggtccggcggcgcgcgacgtcaccgaatctggcaacctcctcgctggatccggcgccccccagtccggatctgtcctctccggcgtgggaggccggatcccctccgtcgaggcggcgaccggcacataccgacgacagtgtgcagccgggtgtggaggcggggaagaaagagaccggcggctgtgtgggcgcagcgttggcagcgggacccgcgtgagagacgcggcttgaggccggcacggcgcgaagacagcggcattggtccctgtgcggcgacggcgcggtgctcggcggcgatgacggcggtgcctccccagatccgcgcctctcgaccggatctagagggtggtcggctgtggtggtcggcgacggcggtcgacttgcgacagctggtgacggcagttggcaacggcggcgacgggtggttgcggcagttggcggcggcgacgtcggccgacgacgccggcggaggacttggcggcggcgtggcggagggcaacagtgaagtggccgctagcagtggcggtggctcgcggaaacggtggctggtggtcgcaacagcggtcaccagaggcatggcggccttggacggctagccgagggcgtgggagactgctgcatttggccggcgcagcatcgtctggtggaaaggtcggagaccggcttggcgcaaagaggctcagccgatggcagtggaggccggctagtgcgagaggcgcgggcggcggagttagaggccggcttggcgcgagaggcgcggcggcggtgaaggaggcgacttaggtgtgaggaggagctgctggtgggtgtagcgcggtcttcggcgcacgaaggctggccggcgagggacgccggtgcaggggtcccacatgtcggtagagcttgtgtggtggtggagcatcggtgtgtcagctgtggatcttacccctcaagggtgattgccggacgaaagctcagtcttggctcctttgagtttcgacggacggcggtggcagtttttctgtcgcttctcttcttgaagacgtcgttttggcatcccctagggggcaatctcggttgtccctttgttggtctagtggcagccggtcacgcttagcggcggccggtccgatgctagccttctcctgggcttgtgtgttggcgatgtcggtgtgtgggtggtggtattttttcctttttcctgtttacgaccctctagggttgtaatcttgtaattttttcctgctctatcaatagaacttcgcactgtctcgtgcgagtcgttcaaaaaaaaaaagtaaagtaacagaaacttgaccctatccgtcttggttgatgggtttgctccaatcattataaaataaaccttgaacaggaaatcagtctacaatatatacagaatgcagtccttcgggtgaaactcaaatgtaactggcaggatatgataatatgcaagtttctgattcattcgggaactggtgaaacatcatatcatcccttttttgagatatcaccctctgggaattattaagcagtttattcaattatgaataaaatctaagagagtatgtgtaagcttaaaagctgtggttaagtgtataatttgtccatgaacaaaaaaaaaggaagaagataacattgaatagtataaataataatcagaagaagaatgagtgagttttcatcaatgttctccattagatatttcatacctttcgcattaaggggattcaagctgtatagctcaccaaaatgatgatttcctgttcatatttaagggaggtacaaagaaaataacaatattttcgggaagctaatgggtttacaaggaaaattgaaatggtgcatgcattagtgaataaaatagtcaagaacaaaatcatgatggaatcctggaagagctctgagagagcctaacaggaacaaccgcccatatgctggtagagtacatcatcattcgtatggaagaatattttactgcgctaagagtatcaggggtgtttgatatctatttctgaaatgaaactccgtatagaacaccataaagaaaatcaaacattagcagtctcaggtagatttaaaataacatacgggattcgaaagaaatgtttgaggactacagaaatctctattctggtgaatcctcctgatataactagacactgctacgtgctcaactcctgtaaaatccttgaaaaggatacataaacgctgaactatatatcatgtggttttcgaaacgatgaattcatcaaccaatacatacaaaacagtaaacagatgcacgccaaaccacacagatgaacttgaggcgtacaagaccagcaacactgagcttgagagttgaggcgcgctacaaaccaatggaatcagagccttaacaaatgggacacgaaatgccatcttccaatctccatgtcaatgtaccaaacccaaaagtctgagcggttaccgaaagctcacgagttgtcgaattcgttaccctagaaaaaaccgcacgcgcatccgtacgcaagctaagcacgagcatacacgcatagatagagaaaactcggggtgaaaggggagggggggaatccgtacattacgcgctgctgcccgatcgagagcctccttctccggctccggctccgccccggagatgtccccaaactccagtagagctcacccgcacctcgcggctggagagactcgcggcgagaagcggcagcctccggcggggagctgctccccaaatcgcgcggcggccggcggcgagagatggagggagtgtgttttgcgtgtgaaaagcttctggcggaagctatacgatggttgggccttagtgcggggccgaattagtaggccggaacgggactccggcccacgtgcagcgtgcggcccgttctagtttgcctcacgcgcaccgttggaaattggacgacgtcttcaacgaaaaatcaatgacatatgatagcgaaaaagagacaatacaatatatactggtgagaagtgttatacgtacgagtaactcatacatacgactagcgactagcgtacgtcttacctcatcatcagactaatcacgtagcttggattaccttcatgtgagtccagatttttcagagctagttatgaacttgtggttgtacacttgtacgggagtcgtatgcatagttattatgtatgacagtttgagggtctatttgggaaagtttttagcagccgtagcttctcgcataatctccagctcttcaaataatgtagactgtcactcagattataagaatatgaagttataaaatcaataaaatgatctagaaaccagaagatgaaaactcggattttcggaagctggttatcaaccaacagattctcagaatcttaaactctccacacaggacctaatacacactgtacactgctaagaatgattaaggacttttctttaaagatgatggaagagcattttcccggcctccatatagaatgagtaaaactaactagacaggaatatttccattgtttcactaaactattcactattcagaattttcccatccgcccgtcagatatacatttcttgccgtgtgaaacttcctcctatttggatggactatgatgatgatgaaacatcagcattggcaaccttctcccgtagcttttgtacacgagcctgaaacagggggggttgagtgtgtcaaaatggagagttcacagtgttacaattgccgtgcgtgtgatacagacacagaaaacactaaccctgaacgacttggtccggcgaatggatggatcaaggtccagggcatcagcataagcatcctctgcagctcggtactcttccattgcaaacagagcatcgcctcgtgacaagtgagcctgcatagagcagcacagccatgacaaataggcccatggaaaaaaaaaaacagatagtgaatttaaagactggctctctaagaaactccattttatcagtgcatagaatagaacgttatggtgtttcagactttctgttaggcagggggaggctccatctacattatacaagtgaatttcattgaacaccatgtgcgaacgtaagctatatgtcagagacatataaatcaatagaactatacttgctatcgcccgtcatcttttttttgagaatgcgcaaaagagctgcgcatcttttttattaagattggggagaaattgtgacatctttacaaagcaactgaaatagaaaccgaaaaagaaaggtaagaaaaggaggctaagctataatctcgtgacatcaattttgcgaccacgacagccatgatctactatgggagaagacctgctagtctccagagggcggcctcctctgctgctgccctagcaacctcctcccacgatcgctgcttctggttgaagaccctattgttcctttctttccatatggaccaagcgcctaggaccaccactgtatcgaaaccacggcggagttgctttgccactcccttcctggatgccgaccaccaagagatgaaggaattctgagaggcggggaagaggtccggacgcccaatggtattcattacaatccaccagaattgcgcggattccgggcaggaaatcaggatgtggtctattgtttcttcttgttggtcacaaagcacacacctcgccgggtggggcaatcctcggggcctccgtcgatctgcagtccagcaacgacgatgagccacgagccacatgaagtaacggcagcggggaggcgctttgtgccccattggtccatatgaaggctgagggcacttgtgccccgttgaattgaaaattaagcatttcactgtcatgccatccaatgatctaaattctgcaatcactgttcactactatttagtttggcaatcatgcccagccatactgtttggttttattgatcattgtagcaacctttcctctctgcataaactactaggtagccaggtaggtaatctgtatgcatttgcaaatgtttgtggcatacacaacagtccgcagcaaacaagttaagaaacaccaatgtgataaggaaaaaaaatatttgtattgtagcaatcaacagtatggcttggctgtggacgagtagtaacaagaagatgataaattcaatttacagggcaggtgtttacctgaggaaatttcggagcaatctttgttgcttcctcggcatcagcaagcgcaccagtgatattccccattgacaatctagccctagacctgcacttagcatcaagcattcatttcagttaacgcaaactctcattctcacttcccaatagtgcaacgaaggcagcatttcctaagagaaaaacataaattgtgaaaaattaagctatcacacatactcccaatcccaaacactcgttctcataatcaaagctacagaaaggacctgcttctgtacgccaagtggagaccgccaccagcattcatctcgatagcctgcagtgcatacaagcaagcaacaagttagaaattggaacaggaacactacatgatagtacctgtagcacgggagatgcagcttccttgacgccattttcaagagaaaagaaaaaacaaattggcaagcacactttgcttggtaagaatggggtgaatcctctgcagagacctcagtcaggagggcttccgcttcggcggcgccacccttctcgagggcggcctccgccttctcacgcgccgcgagcgcggcgagccccgccgccgcgtcgaatccggagtcgccgagcaggtgctccaggagctgcgcggcgcgcgcggcggtgcccacgtggccgaacaccgcggcgccgccgccggagacggaggcgccgaagtttgggcccgccccgcagcggccgaggcaaccgcaggaggccacgtcgacgcgcggcggcgcgagcccctcgagcgccgccaggacctcgcgcccgccctggcgcgcgcacgtgcggttggtgcagacccgaatctccaccgccgcccccgaagctctcgccgtcgtgggactccggcggtggcgcggggaggcgaaggagcaggagaaggcggttgcagccgctgccgccatcgccgccgacgaactctgatgaggcggggggacacggaggtggagtaaagtaataatacgttttttaaagggtttctttgcaaatttccgcggacattttccgggtccacgagccaaaccggatattctgatctcaataccgacccatgtttttggtgggccttacgaaagcctgtctctagcgagcccaactttagtgggcctaaatacggttagggaggatgtgcggcccatgaaggctcggcccattatactgcaactaggcccaatacctagccattcagagtttcggacctgtggctatcgcggaagggagcggcggcgaacccagctcggtgagtcgtcgtcggcggcggcggcgacggcgacggctaggaccacgtgacgcggatcagctcggaggcagcgacgacccatctctgatctccctcacgttcagaggcgcgaccaagcgtcgagggggagcgctcgacggcgaggtacgcgtgtgcagatccccttcaactctaggtcgcaacgaagcctcgacagtgttcccaaattttcttgatttttctgtcacctgctagtttgttgatctgcttgatttgtttgtcgcctgctagtatgttgcaactatcggtgctaatcgatttaggcgattcttgcacatctttctgtgttgactcgctggtgttagcctgttaggagtgatgctctctagctgttcgatgaaatgcctgataaaagcatctttccacgccaatatatctatacatttattcgcacgatttgttcccctttgctaatgtacctatcaccatcgatttgcatgcgataggatcattggatcattagattactggtgaatgtcgtataatgatttttaccatacaaagtattgaacaagaatgcaagtggcttaatggttcattgttctttctgatttctttttggtttgtagagtcatgcagggggcgcgtgttaatctgaaggggtggcaacaggctgctgttgcattcggttctgcatttggggccttgcttgaccctagaagagctgatctgatagctgctcttggggagactactgggaagccagcatttcagcgtgtgcttcagcggatgaggaacagtgctgaaggcagggtaaactcatgctaccctatatcccctaaaagtgcaggacgttatgtcgatgcatccatttgttgtgcttgaccatctctttatatatagcctttattactagcatattctgtaaatagtatacatatatactcagcttctgaaacagtaacaatttctctgccaacaaatgctaaggagcatatgatgattatacaccaatactacgaagtagatttttttgtgtgaagtagcattatcctttttacttggttgtttcagggagcaatgttatactgaaaaatggaatagtgtaggtcttttcataagctgtccattttttttgttgttcatttgttatttatgcatttaactctccaaaatatcttccttgtttggctgcagtctagacttacccattcaataaatttaaacctgcaattgctatactttgatgattttttccttcttgttacatcactgccatgcaatagcaacacatgccagctgaaaatgtgtactcaacactgtggacttctttcccaattgacttaactaagatactattcctacaggatgttctcctggagcgtcctcgagttatatccacacaagtttctcatgcctgggacatgcctcagaacacatttggtgcagcatatgctcagttcatgggatcaaggaacttctcaccggatgaccgcccacctgtccgtttcatggatacagatgagcttgcgtatgttgcgacccgcgcccgtgaagtccatgacttttggcatgtgctgttcggccttcctacgaacctgattggagagactgcccttaaggtcattgagtttgaacagatgttccttccaatgtgcatgctttcagtcgttgggggctctgcgaggttcaatgagaaacaaaggacactgttttttcagcattatttcccatgggcttcaaaagcaggtcttaagtgcacagatcttatgtctgtgtactatgagaagcattttcatgaagatttggatgaagtgaggaggaactggggaattataccatgccctgatcccaaaaggagcagtgtttagacttttagatcggtacattttgcatgaaagatgtctgaacttggttttcactttgtctacgttagtattagctcttccctttcaagaataatagcaagagttatgctattgatacctaaaaaaactagtaattctctttaacttagcatagcaactaagcttgcaatgttgatgttccctttaacaatagtgtagatgagttaattacatttttatgtgtaatactagctgaatgccggtacttcgctatggacagaagaaaacatatcataatattgtctgaaataaataaaattatattttccgtgagatgtgttgcccatcctctttttgcagcacaaggtacaactatccttgcatagttgcatgtgcaaaagcaaaattagaacctcatactggatcagaatcaaaattatttggcaggccccttgttgccagtggctgaggcaaaggtacctgaaacctccttgctgagttgctggtacacggctacaccacctctgaagagagagaactgcagattggtgcgtatcccaaaacgaacggcagaagtaaaaaaaactgagaccaaatggtactagtagtaggtagtacgtccaaaagctgcactgtaattatggaccaaatcaccttaaagttacagcaaaagaacagaagaaagaaagcatgcagcaaagggacaatggtgaaaaaagaaatttacatcccctgtcaatcttgctcatcttcatctatcttactcacaccgccaacgcaagacacaaaacgaaaaaacaaaagggagagcccaatcaatgcagtagatcatcaacttaatttacaggtgaaaaattaaggcgagctatgtagttaaatgcccctatgtgatgtggtggcaaatcttgaccaacaaaaagaagaattcaaagaagaagaagacgtattactgcttgatccatcattagcacagcctaggcaagcctctaccgccggtttgatggcaggcggcggcgccgaacgacgacgacggcctgccgcccttggccatcttggacatctgccctcgcatctccttgcacgctctctccagctccaccacccgattctgcatcttctgcaggttcagcttgagcagctccttctcgtccatggcgtccaggtccacgctccgggcgcggctgccgctgacgatgatcttcctcggcgtctgcgacgggtcaggcctgcagccgccggtgcccttcgccgcggcggcggcgggtctgatctggagcttggactgctgcgaggctagcgcctgcacggcgatccccggcgggatcctccggttcttggccaggtccttgcacgcctccagcgtcagcttctcgtagttgaggcaccggcatagcgtcgtccgctcctcgatggtcagcgtcgggtgagactgcatgcagacatagaataaacttcagtcaaatttgcacaaagttcagctaagtttcatcagcattcagcaacactctcttgcagcctagttatttaatttgcagaaaattcagcaaagtttcatcagcaaactaatgccttgatcaatggtactcgctgttaattgtagcacaattaattaggcccaatcatgcatgcagctaatcacattagatagtgtcaaggagcagcacgaaaagaag

SEQ ID NO: 27080 - DNA, 6151 bp, Oryza sativa
aatgacttacattgtgaaacaaagtaagtacatcgcagagagaattaaagaattgtttagttcctttttgcgcgcgctttaccacgcttgagagaaaggcagtggatgcgatgggaaacaggaagcacaaacatgtaggagaggattaaagaaaggccatttgcacatagaaagcaccgaagccaggataaaggcaaaatctgggcagaccgggcacttgttaaagcctccctaggtttcattgctgataaacaaattggcgagatctcagttgcaaaaatgatcggttggccaagacgaaatggtcaccaatgtgatgggctaacgacagtgtcatggatcaaaagtgaaacgcagacagggaaaaaggttaaagtttacgtctgcatgcatgcaaataaagcttgaacgactatgtcagaaaaaagcagttgtatctatccaagggttgccaactctgcaactgtgaagaaacaaaggaccacagtccacagaaaaaaaaatgtgatgcagaagtgcagaaatgctgcatggattcctgaggtaagtatgtgatcaagacatagcgagtttcagtaagttgaaattatcaacttatgattttgaaacaacttaaagttagcatttttgttgaaatgggatcagacttcagtggataggactggtaggacagaggaatgtatggtggccaagtgacaaggtttcagatctgacgaacgaaaagctcacactgcacagtgcaaaagggttaaaggcaatggaattatggaaattggacaaatgaattgttctacccataacacaaagtactaggcgatctctctgtccatcattagcgtcccatgatagtactatcaaactttattcagtcctttgtaaaagaccaggcaagaacaggccaacacacaggaattatgcagtggctaagaaaaaaacagttcgaaacaaagttgttgcaaagaaagattggaaagatatgcagagtcctggaggaatggtatatccatgacagaagttccaatcaaagaagctgtattgaagacagaactgacaaaaatgtaaatgttgaaatcatagccattacgaaggtgaccttcaggtacagcaaaagcgtactaccagactactacctaatatctctccaactattaaccttcctatcacagttcttgccagtgtttatcaacattctaactgcctattgccacctccaggaactcatcatggctccaatcatagcgtgagagaatgctcctattcactgtcagtgtcaggtgaaattcccggtgccctaaactacctacaagtctgtttctacccagtcatgatcaatcattcacgaagtcagaagctcagagcagaacaagtaaacctcaaaatccagctaagggggtacagagaaatacaggattcacgtcgaattttccaaaatgtaaaatctggatgcttactagacgaccaaaatgccgtcttgtcccatgcacaacggtaaactttaccttggcaggcaaagaattttaccactgctcctactaatccaagactagactggtacttttttttttgccgggacggccaaaggatggccggccaatttcattaagataggagaaaagactagactggtactgcccctataattagccactcaatagcatcaagctttttgaacagcctatcaatcatgttcccaatcatgaattgaaacagaggtagtactatcctattattcataaacaggtattactattaggacgaaattaacatatattttgttcactgagccaaacactaccaccgaaaataacatttttttttgctgaaaaatatgaaatatagatttcatagaaggtgatctctttaattacctcaaggtagatatccaatgccctgtacacgccgtcgtagcattcccgagccgagtccggcaggctctcggcgacggcgaggaacttggacaccctcaggccatggtccggcgagatctcaccgaggtacttgtcgaccagccttccaaccttcctcatcctctgcgacggcaagtcggcctcctcctcggagccgacgaacaccctgaccagccgcatgaccaggttcacgtcgtacacgccaccgtcgtcgccggagacgaggaggtcgtcgagcgtggcctggtccagcatcagccccatgagcctctccagtttgtgcctgcactccttgctcagccccacggccgacacgatccggagcacccagaagaggccccggcacgagaacgcggtgccgccgacgagcgccacgccgtgcacggccgtgtcggcgagtccggcgagtccgccgccgccctccctgcacagcgccggcctgcgcgtggcggcgcggaggtagtgcagcaggaaccgcgtcaggatcaggttcttgttctcgatgccgtagcagccgagcaccctcatcgccttctcgatggtctgcgggcacagcgacgtcatgtcgtcgaaccaccactccctggcgaagcacggcttcatcgactcgggcgtcttggtggacgacgaccggccgaacccgagcgtgtccggcgacgacgagcacgacgacgacgagcggttcggcgtcccgactgcccccgcggcgacgggcgtctccggattggcggtgatcttggagaacagcgcggagatgagcctctcgaggaggccggaggcgtcggccgccgcggcgaatggctcgcagctcttgacggcggcgaggacgtcggcccatgtccagtagtagaggccgtccacgaatgcctctgcttgggtcaggaggttgcaggtgcacacctcctcggtcatctccaagaacacggcggcgcagtgcaggagcgggaggttggacgggcagagcgggacgcggccattgttgtagcagaacctggccacgagctcgaacccctcgccgccgccggggaagtcggcgagcttgacggacaggctctccgcccggctcgtcttcctcttcttcttctcctgcgtcaccattgtcctcaacctccccgagaacgcacacatgacgctctgcacatgaaacaacaccaatcacttgtaagaatagatgattcttgattacgtgaaccgatttcaaagatttacgcaggtcgcacgtacctgatgaagaagaagcgtgtgatggccattgatgtgcaccttgaggtcgcagagctcattcatggctcgagagagaaagagaaagggagggagagagagagaaatggaggcaatggcactgcagagaatggagtttaatagtatctaggagcaagtgagaattgggaagatttggttgcttggttgctgcctcagttcagttacttgggacctcaaggcagatacagtcacagctcacaagctcacagtgtagtagactagtagtaccacattgcttgagtgcatgtgtcctgtggagagatatggaggaacacctcatgatccctgagaagaaaacaaaagcaagttttggtctgggtaggcaacaggttctctgaactcttcactcttcaatgctgggctgatgggctctgcatgcagttcaaagaatgaaagggaaaaaaaagcacccctgccttccaaaggcacgagagcaaacaaacaaaaacgtccccttgttctattctaaaacagagagatctcatatgaaaataaagaaaaaaagagaggaaaaaaacagaggaacagagagatcttgttcatggccactatggattgagtgtttgcactgctcaaggagatgattcagcatctggatgctaagattgctagtgcgcctggctggaattgattggcaacatgtcaccaacttgacatcagagcacgcaacaaactgtagctatgcacccttatcctgtagtattactccagttcatgctgtgcatatttgtcaaagtgcagtaaaaattctgtggctaggcaacgaccaacttttgcaggatgaaagatgaacttgtagctgttacaagcactgttaaaagttttccccttctttttgctccctagtccctatactatccagacattctatggctatagtactgttgaaaatcctgtgctgaaaaacaagcttagagagttgagaggacatcaggacacatggcccttacaatgtattcaattaactaatcagagagagagagagagagagagaggtcgtgacatttgttcaggcatgtgtgctctgtcaggagctggtgcaattgcagtggctccatcgctccaaaaacctattatgccagggctgtcatattggcaatttgatatggcttaggccactcaaggctttggtattgtcttctccctaagaaatgggctttggagttttactggtgctcacagtcacaggcttatcatattccatgtgggagttggagaggagccctctttcatgcttaaattatctgtaacataaagtgttcatatgaaaagatgaggaggatggagtatggaccattgctactacctttttggtgacatattaatggatgtagctcaagaaccttcaaacaagaagaagaacaaacacgcaaaacaacaacttcttctagttcaggctgagctgtccgccggccatactaatagaggtaagcgtgggaagatttgccaagcgtttagtttttcatgttcagatgtttaggatgtctaatatcaggttagctgatatactgatataaacacatgagttaactaagggacaaatcaattgaaaggtaggtacagcatagtccactattataatcttatggacagaaattcagagggtcaagacgaataccgtgataagatattgctgcatatgcatccaatctagcacggcgagaacagcagggagcagcagtacgactagctaaggaatcccgctcacaagtgccagaagaaatgccactcgtgttagtttatcatcaggctcgcagcaactccaacatgtgcagtgttaataccaccatcaagtacatccaatgtggtactgtagaaattaaccacctagggagtagaagagtatggtcagttcgtgtttgatcagacaaacctggctctgaattggttttgactgtttcggaccaaaaaaactacatatttgaacatcgcattcgaggaatgcgaattcgacacattgtacttacaaaactttaaaccacaggattaacacgtcaaagaaatgctactacaatgtatgctactctcaaaatttcggttggcctatctttcagctgaactgattaaaaaaacatatgctactgcggcacctgttttttcggtatcttgacaggttaatctacaaccaatagcaatcaaaatcaagaacagtagcagccagcaacctgtgtcaagaaacatatgtctaacagatatccacatatcgcggcaattattcccgcggatggatcacgggagagggtttcgggagacaaccataggttggcgatggctaaaatacgggtgttgggaagtggagatgaatgttctcttggcgcccactcaccaactgaaaacggataagcgattgattctcctctccctggacgccacggcatcacctgccggtgttgctcacgagtgcaagagagaccaaagatgataaagaaatgccgtactcacttaacggccaccgttcttcctctcatcgccatcaattcagttagtgaagagaacctaattgcagaggttaattgctactacctacttctaatttttttggatgcttgactagagggagaaagacttacgttgttcagagttgacgatctagtagaagtatctgaactttgtacacaatctgtggttgtttctgaaccgaagcgcggagcgccacatttttatcagcttttctctccctgcatgttgaagaatgttcagtccaaaaatccaatggcgtgagcatttgaaaaagatgaatgatcaagtaaatgtacgggagaaagccaaaagccgccatgaatgggaaggtgaaacgagcaaaggagttcacctcacgaggtaaacgagatccgcctgcagaggaatggcgatgggcactactggggtctgcaggtcgccgcgcgtgcccgcgtaaaccaagtcacggatccgccgccccccaccccaccccagccgatcagtccaacgccacgccgccggcgtgatgtgggcggtacgca

SEQ ID NO: 27081 - DNA, 5391 bp, Oryza sativa
agcatttctgatttctcctcctctaattaccgcctcctcctccttcctctacgtacgaaaagccaaaacccaaattcgcttccccccccccccccccccaaaaaaaaattgctcttgcggcgccgcggattcttcgtctccaccaccgccctcgacgtcagatcaggtataaaatccgtacgcggggttcaatcttctggctggttgtttcgatctggttcctgcctttgatcgagttttgagggtgagggtttgttttggttttcgcttgcgcggttgcaggtggtgcggtcgatttgaatccatggcggcgacggtggcggaggcgctcgcggtgacggacgaactggccttgccgcttcgcgcggtgggggatctggcggccgccgcgggggtctcgcgggaggaggtggtggtcatcacgcagtgcgcctcgcttggtgagcttctcctcgtctccttgcttccctttttcctgctatcatatgagactccgatatcgattaggatttttcgtgtttagattcaataatatggaactgtgcctaaccctgttacgagcgtttgttctttgctggttaggatcagttccaactcaacaaatcgcaacagttcaatcgatttcaatcgattcatggtagagttcttcgaaaaacagtttggagctcaccattcctttagtttccgacgactccccttatgatgcttcatatgctaattcctatatagattcatttcaccatatatgggaccaaataggttatgagacagtgctattggttgacgaaggaaagaaaagagtttcatattctcacatcaatcatgaggagaaaattttggagatcatctccctatatgttttgtattgattatctagattcattagtggcaatattcaattctcacccatgactactactccaaaattggagtatgttccaaaatttggaccctacaaccgacacactgttttgctctgctatatgttcagtttcgatttctgttatgctttagtataccttatccttgtagtatacattttggtttgtcataagctcgttttgaacattccatgttggcatggttcaggtgggaagttaccttttgatgatgcatcagttggttctgttcttgctgtcattaagaaagtggaaaacttgggcgatctgttcataactgaaataagcagggttcttaaagctggaggcatggtgcttatacagagttccccctctgatcaggatgtatgtactgttttgccaatatactttattttgtaatgcttaatttgcactccctgatcttctgatcttctcttcatcagcccaataactctattcagcgcaagctactgttaggaggatttgttgacgtgcaagcttctgctgcaagttcccaggatagcgagcattctgttactgtgagtgatctagtgccacaatatgtgttaatgcttctgtgccgtcatactttctagtgctaactgaatcacatgcagattaaggcaaagaaggtctcttggagcttgggctcttccttccccctcaagaaagccacaaagggtcttccaaagattcagattgatgatgattctgaactgattgatgaagacagcctcttgactgaagacgacttgaagaaaccagaacttccagttggtactgttttatagaacccttcagctttgttcaacgtctataaatttaatatgtagatcctgaaggtttgcttatgttttaccagttggggattgtgaggtgggagccacaaggaaggcatgcaagaactgtacttgtggccgggctgaggctgaggagaaggtggagaagctaaatctcacatcagaacagatcaataaccctcagtccgcttgtggcaatgtgagcatgactgctttttaattaagtgttttattttttgcctttggtcctctccctgtgaaaatccatagtttcatcctgtgaaatgataattgcagtgtgggttgggcgatgcatttcgatgtggtacttgcccatacagaggtctaccagcattcaagccaggcgagaaggtaattatctctcctgaccctaaattcttgattcatgagaacacccaagatgccagttgaacttgtttttaagaaacaactcactgttctctgattggcagattgccctacctggcaacttccttgcggctgacatgtgatgatagaagggaacatcggcaacagcagcagataggaattggcttctttaatttgttcgttcgttagaatgttgaagttgctgaccaagtatgggtgtgatagtagatggaaagaagaggaccattgctgtagtccctgctagggattgggatccagtgcagttgctagggtaactgcaacttaagcagttgcactagcaccacatgataacaaattaatggttctagcacctgtatactgtagcagaaattactgtttcacgtgttttgtagcaacaaatctggaccattggatgaaaatacaaatggatctcaatccccctgctagttatcaccactttctggttcccaggtttcaggtgtgagtgtgactcgcctatgcgttctgttttgatgatatatgtaactgagaaaatactgcactgttgtttcattgtgaaactgtcaaatctcaaatcgcacgtcgctgctctctgctgatcttgcaagacagtgaccccttaacaaatggcatgttagtttcaatgcagtgggatgttgtgttcttatctgctgcgtgcggcgtggtggtggtggtgttactttttcctgattatagccttttattgctgttgttttgtttgtttttctgttatatataaataatataagacctagtactatcttgtgcagttcgttaataaaaaaaaacgtatgttcgcagtattttgtgtggtttgttttttaaaaaaagacaaacaaatggcatgttcgtgatccctgaaagtgcaaactgcaaatataaacttatctctgcggcatgtaacccacttgtatcaactgtatgtacacaataacaacgtagtagtaataacacagtactaagcatcctatgcttgaaacctgaatacgacttgttagcaggagcatagggtccaaaacaggaacagttctctgtactttagaagtgcacacagactagcgacaaaaaggagataatttatcattcgcgacgttttgggccggttcattttgatgtcatttttaaccttaccaaattttagtaaagttgacaaaaaaatggctacatttagtttgctaccaaattttgtaactatataagaaatcctaccggtatagttgccaaaattttgtcattaccaaaatttggtaaggttttttttagcatcaaagtgaacaggtcccttgtccgagatacaggatatcaccaaagtaggccttctttgaaattgaactaatttatatgaaaaaaatcatgtaaaatacctttgttctaaaaaaaccagagttgtattttgcgattacatggtagagatgtacacacactattaccaatgcaacgctacactaacgtcacgagtgcgtcccctagcacgtcatgtttgacattactctgtaactaagggttgttcggtagtgctgaactgcggttgtacaaccgcagcgctgacgcttccctagcatctttcttgtggtgggactatacctgctgctgcaaggccgtcaactagtagcactaccaaatacaccctaagttttttttacaaattatttggacctgaagttgtgacaaaattgataatattttaatgagtcattttgtttctacaaatataaaatctaaattactataatttaacttgaaactttaaacgtggaggtgcactaaacataaccttaagtgttttccttgtaccagtgtcgcacttgacccggtctagaacttaacggggggttagatcatgcgtatttttgtatatacatcatacatgtgctcaaggaaacagtaccatatattttttttcaactagaatagtcaagctgcttattattatataggaataagaatgacactaatgcttgattaaatagcaatttttgagcttcatgaacctctctgtttacctacaactttttttttttgaagttaagcacctacaatgaataatcctacatgatatgacatggtaagcactacatgaagtactcttttataaaagagaaaagggattaagagcctccaccatgaagcaattctttttgtttggtcttttgtaccgtttaaaactaactaacctcaagtcatcttcccttaaacctgttcttatcgaaacatattctctcctcttctccgtctccgcctctattccgaagtgtagagaaccctgcgaatttcccaaccaccgcctccgctctctcaagccggcctccgctcctccgatccgcgggctcccggtctcctctggtggatccgcgatggaggagcagcagcagcagcagccgctgctcgaggtttgcccgtctccccctttttcttttgccgcgtgctttggcggcatcgccttgtaggggttccgtgctgttctagtgctcttgcgtcgaattgggtccatgattgggagcatcattgcgcctgatttgcaaccgtcggctctcggtcttgcctaagtttcgcacccatctttttggtctccgttgccaacacgcgagggaatttctagcctataggataattaataatgggtcggggcatcgccctctacttgttatgtagattgtagaggtgttttttttgttttgttttgttttgtttcttgggtaatctgcgcatccagttggatcatgagcttggggtttatccttttgtgagcttgggttgtctattatcactcattcaattattgggttattttgttaaaggagacgtctgatgcttgatatctggattatttggagtgccaaatgctctgggaagtaactgatatccgacgagtaaccctgctgtagccttataattgatacgctttggtctggatggtgatttggctttagccttataattttgttggtcggcccagacaacgagtctatgaccatgatcttaagttgtaatgcaattcagaaacacggatattatctgtggtaactgacatgatattttacaactatgtgctccgagaatcactaatgtacccttttttgttggtaaaacttctgaaacaggtactagcaacttaaaataaatttaatttgtgttcagaaagaacccagagataggcagttagcacagcataatcagtaaattgtgttgacattgaacatcatttataatacatgattgcagttttgttgatttagatatgactgctaaaagctgtgcttactgtgctacaatctcacgggagaaaatctgttata

SEQ ID NO: 27082 - DNA, 2210 bp, Oryza sativa
ttaaccgtttaagttcgctgaatgtcatgcacggcgagagaggcctgcaaaaccttattcgattttttgggtgcccctactcagtttctagagtattatcgggctactcaaacactggcaagttacaggacaattcgagttcaaaacttctttagaggtacataatcacaagtcttcaagcactgctttcatttcatatgttggttcatgcatttcataagccattttttatgaactccttcccgatagattatgtattgttggagtaaaaaaaatgtggtccttaactaaaccttccttgcctcttaaatcctttggcttggtcataatgattcatcttgctggtttcaactacttatatttctgcaaagttttatttttactttttcaacttaaggaaatgaataagcatgcaatcatgcataatgttagtatctaggtattactaatttctcgtcgtgattttctttaaaataattttagcctactcacttgaatgaaaaaggactggagccaactaacagattgtaagatggttgtagatgatgttattagttattccacctgcttggttactgcacgcaattcattcatgatgttttgtaatcattgtaatcatggactaaagcagaggtttcatttacatgttttcagtggtagaatgtgtatattatcatttgaagaaacatttatggaccttcttgcagacataatggttctgctgctgacactaaaacagtggattgacagtcaatagccagttagtttgcataactgaagctagttgtgaacataacattacacaaaatagtccacgcaatctggtagaggacttcattttgaagggaagttatactgtcggcattagtcttgagctggaactgttctcacattgatttactggatgcaatttcagcagatgctgaaatacaatgtggtccaatatattcattgcctacagagtacggatgatcttgaggtgctgatggttgaggccataaattgctctatccgtaattgtgagcatcatcagtacttgttctgtgtgaaagatcccagtctaatgcttcggtgttgcaggagaaatcaacgtgaagattaaatctggcagtgatttcggtgttgtaaaatgcttggaccacacctgtttgttgtcgatacattaacacggtatataggaaaaggaaccccacggctgcttttgtactatttacacactaactagccttaaattggtcggtaatcttataaacgtgtcatatactgttccatgtgttcttgccatttttgtccagattttatgtaattcattcaactgagctttttggcctgacaattgtaacgggacacagctcacgtaattaatattgctgctgcccttgtaaccatttgacctcatttttgttccttacggagtatggcctttcatgaaatcatcaaagtttggaattatgggagctgctgcgtcagtttgttgaatggttcgtctgaacatatatgcaaatggacatggttactctggccatacatgcaactaaccaagctgcattgatttcatcatttcatagcaacagtacattatattaatattattatatactgatgattgcgttgtccgcctttgaatggaggctggctaggcagacttgtcttcagtttcagcttcaacagtttctttcttctccttttcttttgtgagggaaggaatttggagtatgcaagattgccttggagtaagaacctttttcttttccttttttgtgattagaaggataagcttcagtattacttgttggcttgttgcattttttctaaccttcaagctcgtatgatttgatgttgttgtaatggtctgatcatgggctttcctgaactgcagatctgaagaaattgcttcagcttccactgcatgtacggatgccacttgacaaggatctaccgtgcaatttcacgttggatcggggagagatattgatcatattgttaactacaaaatcactctaaattcagagagagagagagagaatgcggctaagttaactgcaggtatgtatgtctctcagatcttaattccttcacatgctttccttcgatcgcaagcaattttatcaattaattgcctgtccttgcattgcatttgcatgccccgttgtcccagcagcaagcaggctacctctctcatctcatctttcccatgaattaatcatcca

SEQ ID NO: 27083 - DNA, 12433 bp, Oryza sativa
gtatgtgctcatgttgggattgtggtcggtggcctccaattctctgaaaagaaagctgaattgtagagctccccgttctgtctttggtcgtctctacctgttgatggttcaagaaagcccatggaaaccatgccgcgtctttgtgtgcttcccgttccgccatccggagaattccggccacacagatccctgggggggttgaattctgtggttttggttctgaatttggatggttttggctctctggggcgtaattctctgagaattctctgtgtgggtgttcttggaccatccagtacttgttgctcacttgaattccgccgttgcggcggagaattttgttgaattcttggtgtttgttgacttctgtggcttgagaaagcccatggcattatgctgcatatttactttggttaaattcagcaacaggatggttcttctcttctgaatttcgcccttcttaaatgtgtgtggtcaggcgcaattcggcaaaggtttccttgcttggaagtctgccttctctggatcttggttttcctcgttttgtttcttctgctcgatcctacaattactcttgctgctgatgtactgaattccctactctaggagaatttgggttcaacagtttgtctaacattgacttgttctttaacacactgtttatgaaaattcaattcagcacaggttcttatgaaacaattgcctgacgaaacactagagagctagcatctggattcagcgaaaaagatcttcagatcatacacgcccatggaagtttgatgaagcaaatgctgcggggaattgctgaacggtgcgacagccggtggagagaattcagatcagaagtacgctcagaaggtttggctgaagcaaattccagattttatttcactgaagcaatcttcagaatttgataattcagaacgaaaaacgtactggcgttttcagagtccatctagaattcatcatgtatcccaaaaactacttttgcatccgtatccctaatttcaaaatgaaaccactacaaccaacgcgtttaaatttcaaaattcaccactcacaattctcattggatctctctgttatttgccagaatccgagccccgacagctcgtacttggccacacgaccggaagctactgacacttgggtttccaattctaaaaccggcacgaaattagcataccatgcaagctctctcctaattactgcagcatttacgacaaaagcccttttccaaagtagcccccaacccagcctcacatccctgacaaagaaacaaacagaaaggcgagctaccttagcctttgctgcttgtcctcattagtacttcaccactgtaattagagctaggtcagttcactgcacaacatttatctttccccctactttggcaaaaaaaaaagttaattagaacactacaaaattcatgtaaaattttaaacttatcgtattccaaactgccatttctgagtaaaaaaaattaagagagagagaaatgaagtgaagtgaaggaggcagaggcagagccgccagggcggtggtgggggttctgtcctgagcaggtggaaatcacgcttgtgcagaaagagatctgaaggaggcgaaaagaaaagagagagagagagagcaaaagcaaaacaccgtctctacggtccttgagtagatactatgaggtactaaaaatttagtgtaaaaattagtatctcatggtaccttatagtatttagataccaagaggtatcaaatttataatagaaaaaatggtatctcatggtaccaaatgctaccatccaaaagctaacataacccccacataaaagtcatgtgattctcccagcaaaaaagaaaaaaaaaccataaaatctcactcgatggatccatgatccgtctcgcgattaattactgcatcctcctgctgctgctggtgtgcctgtgcctgcctcacctcacctgcagtgcaacaacccaatccgggcctgcactggcagcaatcagggggaggatggaatttttcgcgcttctcgaggggcaaagcgaactgaattttgcagctgcctgtgatgcccattccatccaaattccccctgatccacgcgatgttactgttactgtatcccctctaatttcttaattagtacacggaattgcatgcagtgtgtccatcagaattacatgttaatctatgcaattctgcagctgttactacaggctgatctccacttgtaacccttctcctactacctgatctctgaatgcagattactgcagtatattttcaagtgaattcatgcaatgttatgtcggagtgattagctagctaggaggtagtagcatggtggatagtagagttatatgggaaactattctaatccctcgaagggatgttccctcgtttacctaaaaaccatctaaacggttatgaaaaattctggaaaaatttaacaacattcatacaacacatatatacaactccacaaaatcttaattccaaactcaactcacacgtcgagatataaaaaagacaaattcaacatatgaatagtagcgtactgtttatatctaaatttgtcttttttgtttctcgatgtgtagatcgaatttgaacttgaattttggtggattagtaggtatcattatactctacattgtcaattttttttcagatttttttataactatttgtatcgaatttgaaaaaaaaagatatatgaggggatattatccccctcgaatcccctcgagggattagaatccattcccagttatatggatcacatgactctcaatgatggagaggccggcctgggctggctggctggccctgcctgacccacgctgggctgtgcagatccagacccttcctgccctccgaggggaccaaccagatctcccacagatattcgcctcgctgtattctcctacctacacacatcaacctgacctagctagctcgctactgctacctccgtcccaaaatacgacacagttatatttagataaaatcaattattttttcagtttcatatcataagtcgtttgattttttttcttagttattttttaaaaagtttgactaagtttgtagcaaaataaagtaacattttcaatacaaaacaaacattgtattaaaatatattcaacattaagtttaatggaactaattttgtgtcgtaaataatttttttataaacttggtcaacctaaaaattttcgaccgaaaaaagtcaaaagactcataatatgaaacagtgggagtacttcatcattctcgccctcacctagcaaaaagtaaaggcgaggagagggagaaactacgtactggttcatgcgtgcaacccaaaaggtaaaatgatcatgttatcctactataagtcgtagtgctagaaaggtacgcacttgaaaagttgagagcccaggtagatcagatttggttgctgctgtgttggttgtggtaatattgacagtccaaataatgtagtacttgcattgctgctcggttcctagtagctatttatatgtgtcacatgcatgcatgcgggctactagcaaaggcatctgattctaaaaggaagcaagacacaaggaggctacgacattaatgtatgtgctactgctagctatatatgaagttgtcatggttgagtgagtggtcatgagctagctagatagatggctagctcgtcgatcagctgcatggtagctaggaggaggggagcttggcgatgaacgcgtcgaccttgatgttggtggtccgggagaggaatttcatgcagatgggaggcttgacaccggcgagggcgagcaccgactgcggcagcgtccagatgccgtcgccgcagatgaggcccgacgcgacggggggagcgaacgccttggccctggcgccgtcgaggcggtcccagacgaagcggatgaggctgccgatgcacatgtcgatgccgaagtaggggccgaggtagaaggggatcgccatggccatcggcagcgggaggaacctcgccaccttgggcgccgcgaggtccctggcgaggttgacggcgatggcggcgacgaagaagccgatgcagaggtcgaggcagtgcttgggcagcgagccgaggccctgcaccccgaggatggccatgttccggtacaccagcgcgttcggcgacgggtactccgaccccggcatcccgatgtcgtggaacgccttgtagaagagccagaacaccgacggcgcgatcacgcaccccatggcggtgccgatcacctggctcacgaacatggaccgcggcgacgccagcgtcatgtacccggtcttgaagtcctgcgtcaggtccgacgccgtcgacacgatcccgatcatcacgccgcacgccgccagccccgcgatgatgccgccgtccgacgcgtccgcccacgcccccaccgtgaagatggccagcttgccgtacgtcgtcgccagcgaccagtccgtcagcccgcacccgtacgcgttgcagaacgccagcaccggcgccaccacgtacgacaccgcgacgtggtaccacctcagctggtggaagatgcggggcaccgtcgcgatcgacaccaccgcgatcaccacgtacgcgctcagcgccagccagttcgggatctggtccttgaggaacagctccgtccgccgcttgtcgtcgaacgtctcctccggcgtctgcccgccgccgccggagaccggcagcgtcggctcagacatcatcgcgcgcacctgcatcaccagcgccgttgtggttcttgtcatcaccttcagaaagttgtacagcccgtcgccgaggatgagtgaaatggagatgaacacctgcatcgatcgaatcacaattactccattgatcatgcaacagatgatcatttgcaagaagctcgttctacccggtagccgacgatgccgcggaggctgctgggtttgaggtcagcaggataccagtcacccttcttgtgctcgatgagaggccacatgattccccacgacatgacgcctccgaggagcacggagatgttgacgaggtaagggcagatcatcccgacgccgacgtacgtcgcagagaaatcgaagaagaacctgcagcaagaaaccaactgaagaattcagttaactgttgttgactgtccagtgtggcgagcatctgtatgtttcaagctagcatgacatttgtctatttcttttattcaaaatacttgtattattattgtttattttattattacttgttttatcatcaaagaaatgtaactttaacttatatttttaaataatgtattatacgaaatattaacgacgtcgtgtataaaaaaacaaagacaatacttgtttctgtaggcctcgagacccagcgtcgggaacgacatgaacccgcaaccgtcgccgccggtgtagaaccactggaagaagccccaggagaagctcatcacgaagaatttgcccagcattttgacctgcatcctgcaggaaaatgattcagaattcagacaagagtcttatttgttctctgtattcaccacatgtacatatctttagcaaactttcttatctgaaaaaaaaaccgtacttggcaagctttgcaccctggggagtgtggaagctgttgatgagatgtgcggttgcagtgccactcgggtatatgagcttgtaatcgatgatcattatctgacagagaaaaattaacatcatggttcaattaatttaactatgtccttcaaagaaatcatatatctctgaattttaggagaaactgtaacagctgagctgatgaaatgtactaagtaccttcctgagtggcacaactgagaagaggcccaggaagctgacaatgaagaggaatccaatcatccagcccaagctggggttcttgatgttgtgctcgtccctggcctcgcctgactggtcgctgatcctgtcgctcatcgcgaatatgtagctgccaaaaccccctgtaccaccagtgcatagatcagcatctgaaaccatcaccaccctgacaccaagcagagaacgtagtgcacagtgctctctgtggatgtactactgataacagggagagcagtgataaaagtctaggacgtgaagaacggaacatgtatgcttatagtaacaaggtgcttaaagaaagataagtttttttttgttagtaaggatgcaaattaccaagtgctaggggaaacaacacgaggaatgagtctccaatcaaatcatttctttgtaggtgctttcccatgggccatggctagttggctacattatcctctgtatttaaatgcagcaatcatttttttttgctaagcaccgtatttgtcctacgtggcaattagaagtacacctatgttgtgtactcccttcgtcccaccaaaaaacaacctaatattagataagacatttcgtaatataatgaatctggacattagtctttttttagacggaggaagtatgctcaataggccagtttccaatggtgtgctaaaaacatcattttggttggaaattcaaacacctgaactttaagaaaggcaagcacagaacaagaaaaagaatccagaaaaaacctaagatcaaaattcatgctacacaccgaaatggaattgtggcctgtgggccttgatatacatccaaaaaggaggccatcgaggcctaatttacggcccaaacaagtgatccgtcgccattcgattcgacgcaaaatttgcatcgcgcaatcactgaatcgtgcagcgagcgagcgatccgatccgcggcgagtgcgaagaatggcagcggggaaaccgtaccgctgaaggcgatgccggagcaggcgacgacgcaggtctggacgacggtgttctcctggcgggtgaaggggcggacgctggcgacgccggccttgtcgaggagcttggtccacgacgtgaggaggaagaagccgaggagccccgcggagacgttgagcgaggggatgatccccgtcgtcaggttcagcttcatcacgatcacgctgaacatggcgcccagcagcgcgctcaccgccagcgcccgcagcgtcacctgctccttccaccccggcaccaccctcccctcgaacacccgctccaccgacaccaccgccgcctcctcctcctgatctctacgctccctcccgctcctcgccatggcccgcgaattgagctctcgctctcgctctctctctcgatcgatcgcggttgcgaggtgtggaggcgaaggcgaaggcgcgcgtgtttccggggagttaagagttgtcgtctgggccccacatgtcagtagtactggttgtccgctacgaggggatgacatgtggggtcactgatgagtttcacttgggttcagtttgctagtgccacgtggcagggataggggcttttccgtcgggatccgcttctatcggcgagtgtcacccccgtctcttgatcgtcttcccgtcaacgtagcactagctcgcggttaaatttggcaaatcaaccgcttgatgatagatacgagcccggaatttgacgaccaaatgcccaaaatttcacgaaacatcgtcacacggacacgtacgtagtgcaaaatcacatggcaaccaaaaaattaccctggcaaaaatgggtgaaaatttttagcgtgtcacatcagatatactgacacatatttaaagtattaaacgtagtctaataacaaaataaattacataatccacatgtaaactgcgagatgaatttattaagcctaattaatatatcattagcaaatatttactgtaacaccacattgttaaatcatggaacaatttggtttaaaagattcgtctcgcaatttatacacaaactgtgtaattagtttttttcgtctaatatttaatacttcgtacatgccttaaaaaaaatttatcggtggatctaaacacccccccccccccttcccccaatcaaacaggccatggctggtggtgctgatatatcgacagaaacatgccatgccatgacaatgcggaatgcatcagcctctgcctgcaccagacatttctgctctgtgactctgtccgagtgaagaagacgacgacgacgctaaaaagcaagtgccacatctgctggctagatgccgctacattttactgttgcgtttggtgttggtgcccgtggtgggccccatctccttggcgatattccggagcacgtacttctggatcttcccggtggacgtcttcggtaactcgtcgcggaagatcaccgtctttgggaccatgtaccgcggcatgcgctcccggctccacgcgaccacgtccgccgccgtcaccgcgccgccgccctgcttgaggctgacgaacgcgcacggcgtctccccccagaactcgtccggccgcgccaccaccgccgcctcgttcaccgccgggtggccgtacagcacggactccacctccacgctgctgatgttctccccgccgctgatgatcacgtccttggaccggtcccggatctccacgtacccgtccgggtgcatcaccccgacgtcgccggtgtagaaccacccgttgtcccggatcgccgccttcgtcgccgcctcgtcgttgaggtagcccagcgtgatgcagccgccgcggagcacgatctcgcccatggtcgacccgtcgcggggcacgctgcggccggtctcgccgtccacgacgtccacctcggccatccccggcgtgcgcacgccctgcctcgccttgagccgcgcgcgctcggaggccgggagcttgtcccactcgcccttccacgcgcacgagagcaccagacccgcggtctccgtcagcccgtacccgtggctgacctcgaagccgatcgcctccgtgcggtacagcacggcggccggcggcggcgcgccggccgtgaggatccgcaccttccccgggagcggcttccgcacgccctcgggcgcgttcgccagcatgttgagcacgacgggcgcgccgcacaggtggttgacgccgcggcgcgcgattgtgtcgaacacctcggcggcgtcgacgcggcggaggcagacgttggtgccgcccaccacggccatcccccatgggaagctccagccattggcgtggaacatggggagcgtccacaggtacgtcggccgcggcggcaccgcccagtcgaccagcgagtcgacggtgatgaggaagatcccccggtggcagtgcaccacccccttgggcgccgacgtggtgccggaggtgtagttgaggatcatcgggtcccactcgctcgccggccgcacccacgcgaactccgggtcccccttctcgacgagcctctcgtacgtcagcgcggcggcgggggcgggagggaactccttctcatggggatcctcgacgaggacgacgcgcggggccgtgtgccccgccgggaggaggcggagcgcgtcgcggaggacggggagcagcgccgggtcgacgaagatgagcttggagccggagtggcggagcaggacggacaccgtgcgcgcgtcgagccgcgtgttgatgctgttcagcacggcgccgctcatcggcacggcgaagtgcatctcgtacatcgccggcacgttcggcaggagcacggacacctgactcaatccagcttagcttagcaacacgaggaaggtgttcgacgaaatgaccgtggaaggaaaaaggatcgatggatgctcacgacgtcgccgcgggagatgccgagggaggagacgagcgcggaggcgaggcggaggcagcggcggtgggtctgcgaccacgtgaagacggtgtcgtggtagacgacggacgggcagtcgccgaacacggtggcggcgcgctccaggaagcccagcggcgtgagcgcgcacgagttggccgggttggcgccgagcttgtccatggccgccgcgtcgatcgccggagcacgagctgtcgcctgtgtgaacgccggtgactccagctatcgcggggtggttggagtggaggcgaggaaagagcgagtgaggaggctgcggtgatataaaaccagtttgctattgaccagatgacttattctccgaatctcagtcaccttgattcctgcccgttggatcgagatcaacggctaaggatagggcaacagcgagtgaaatttacgctggtcaactatgtcaaataaggaggaatggatttagtagtaatatatggagtacagtatatagtactaatttccaattgcatttataaagaaatcagtggtcttccatttaaataaaaagaaatttatccatataaattggcagcagcttcgtttgatggggacggccacgatcagttgcaggcgcaatctggatacacggaatgtatccttccttagtcccagaagtagatagaaaaaacaaacgtatcgattataacacattaataatgtgaatctaaacttactactacctccgtctcaaaataagtgcagccgtagaaatccgtatccaacgtttaaccgtccgttttatttgaaaaatttatgattttttttaaaaaatttagccacacttaaaagtactatttatgttttatcatctaataacaataaaaatagtaattataaaaaaattttaaataaaatgaacggttaaacgttggagatgaatagtataaaactgcacttattttaatatggagggagtactgtgttaaactcgatactaaattagtgttttataaggcgaaggagatacctcatcatatgctagttcatgccgcagtaaaaagaaagattgaagataattcattttcttcgatccagcatcccagccaaacctcggagaacccagagatgagacaagagaacgaatcaaaatacttttcatcatatatgaacagatggcagtagttggcagtagcatgtttttttttactactcccccttcaaccccatagatttgcatcaaatgtgcatcacatgatctaggacctctgtctttctggcactgtagattaacaaacgatacagaagatggtacctccaaactactgatgtgcagtattaaacttttttaaaactggtaaaaacaagactcccgtttccatatacccggaacgtacaaaagcttgaaacttttcatttaatttgttcttgacttatggatatatgatacagatcagcagcatgacaaattaataccttaccatgatctggcgatgtgtatgtacggtccaaaagatgagtcacgaacccacgatatctatacgagccttattggttgacctaattaatcaaagcaaaagctaaaaattaaaattttaaacttgattttgaaattaaatttaagatatttttaacatagttttgttttttattattagcttttaaatcgctaaaaaaatatataaaaattttatataaaaattaattttattatttaataaatcagtgttttattaggaaatatgagcaaccgacgagactctacctatctcccatgctactccactatgacaactcgtatgcatgtgtcgctttcagagttccgtgcaggagatgaacataccagtgtattatcttcagagaaaagaaatacaccggagtatgtagcactgttcttcaccaatccttggctccttgcagctatctaatctgctagttgctactgcatgtgtctaatttggtcagtcaattgcaatgtgcaaacaggctagtcaagaatgtctatctcgtgcccggcgaagaaaagattgtctactcgtcgatcgttttcattggtagttctagtctagcaattggtttttttcctgataaaaaaatagtgccttttctatgtaggagtatatgtctgactcatcttattttatttcagattattggctggacagtcatcttcatcagttatactagtaaaacattcgtccatactccatagaaatttcagaccatcgtaggtgtaaaatttcttctggtctatttgaacacatgcaccagccgcctttcaattcttacaattctgcgtactcgcgaacgtgaaattcagacgacatcaatggaatttccctcttggccttccgttttttctctctctagaaactgtaaagctaccgtggagcgaaaagatggctggtgtgggcataatctagtcataatccacccaaagcaacgctgatatatttgactgaccactgcaaattgcagattggctagaccaactgcagctggtcattcctgctctgtctccggggctttggaatcatcaccatgatgtagttttcagaggagaatctccttcagttacaacagcatgttataagccaactataaatatattttaagaaaataaataaaaagagagaaggccagcgggccatatatttatagtcagctgtagcacggattccaaaacacagtgtgtatatgacaggtgggaccaagtattaataatacaatatataactattgtatgaatgagctattagattagttataaatgaattggagctagtagttggct

SEQ ID NO: 27084 - DNA, 8304 bp, Oryza sativa
attcctgcagccctctctttaaatgaaaatttaggtggggtagctctccctctggtgaccagtcaaaaaaaaactgaaactgttcatctccttaaatatcttctagaagcgaaagaaattgcaaagaaaaacactgtcgttggcagctgaattccatcttgaaccagttaaacacaaaactgaaaaaaaaaacattatatcgaaaagacaaccagtgtggaataatctgtcatattccacccaaagcaatgcagagagtcattggcaaactgcagattttctttttgatgaaaagacaaggtacagatttgtttgactaattacaacaatttattctctattcttgtagaagataaagagctttgcaagaaaataagaattagaaaaggaagtcgttggcagttgaatttcatctcaaactagcaccctgtttagatgggactaaaacttaaaacttaatctctatcacatcgaatgtttggacactaattatatatattaaacgtagactattaataaaacccatccataattctgaactaatttgcgagacgaatctattgagcctaattaatccataattaggatgctacagtaaacattctctaattatagattaattatgcttaaaaaatttatctcgtaaattagctttcatttatgtaattagttttggaagtagtatatatttaatactctaaattagtatctaaatataagtactaaagttaagtcactggatccaaacaccacctaagcacaatagcaaaaacatcatgtcacagttttctgcttaatttgaacatataaaacacacaggcgtgcacagcggaaagaatggagaaatcacgaaagctaaaagaaaagctgagagatctcctatgccattccaagtacagaagaaacagtgcatgtccacatctcaaagcagtcgtggtcagaggtgacatcacagactcgttgcttcgagattgcacaccacctgtttgctgaaaagcagcagccaaccacacaccaaaactaaaatggaaaaaaggaaaggcagaaatcagtcgtcgtcgtcgtgccattctcaggccgtcttgtactcgacgacggcgatcttggcggcggggccgccctggatgtagacgatggtgagctgcgcgccggcgtcgagccgtgtcatccacgacgggaactcgtacatgtccttggcgttcgtgcgggagacgccgtagatctccccggagagctccttgatctgcagcttcaggtaggtgatggcgtggccgcacgtgttcttcgccgtcaccacgtgccggtagtagtccacgccgtttgccttccacgtgttcgtcaccgtgtgcacgaactccaacggcgacccacctgacaaagaaacgcacgatcacttggaggagatctcaatggtacaagttcgattgcattgttgatttggttaattaattaccatttgatggcgagggggcatttggcgccggcgtgtactccggcgtgttatcggcgggcgaggcggcgaggcgggcgaagacgccggacatgggggcgttgccggcgagggtgggctcggcgtgctggtagttgcagcggtcgtcgtcgtaggcgtcgttggcgtcggggccgccgacgagggcgccgtggaggacgttggggtcggcgttcttgctgttgtagtacttgtcgaagctttccatgcacccgacggtggcgttcatggcgtagatggacgggatggacgcgccgcggtggtggacgtgcgtcgggtagtagctgccgtatccgaccatgtagctcatccccttggggttcttgccgaggacgtagtcgacctgcgacctcgcgaaccggaggatctccgccggcttcacctcgccgtccgggcacctgagcgttccccgcgactcggcgaggtagtcggcgtagacggtgaggaggaacgccgacgagctcacgtactgcatgttgctccagtcgctcacgtacatgagaccacctggataaccaatccaatccacacaattcagaacaatcacattgcaaaatctattaccaattcttcgaggaagtggatttttgtccctcgggaggacatcccctcgttttatacatctcactcaaaattttatcaatttttttttaaaaaaaaattgtcaagatagattaatatatgacatctttcgtaaacatgcgagttaaaattcaacttatacaattcaaaacaaaaataacaaatttaaccttaaattacacgttctattcattgtcaaatttattatttttgtttttatttgtattaattgaatttgaatttgtatatttattaagagtgatctatcctactaattttttttatgatcatgcaaaaatgaggagatgttttcttaaggatgatttgagttttccatccttggaagaagaagaagctagcaaggatgggatggattaccaggggtcatcttgacgttgtggccgttgttcttctggaggcaggcgcagaggaagaactcggccttggcctgatactgcttcagcgtgtcggcgtagccggcggcgctgccgccctgctcgaagaggaccttggagaggaggacctggaggccggcgtacttgttgtcccaggagaactcggtgacggcccagccggtgccgccgaacgcctccgcgttctgggacacgtagcggaggtactgctcgtcgccggtcgcctcgtacagccacgccgccgcccacagcagctcgtcctggtagccggacgccgacgggtagaacttcttggcgctctgcagcgagtcgtcgtacttgcccctgaacgtgtccgcgaacgtgaacagctgcccccccaaaaaaaagagaaaataactcatcagaatgttgctgctgcatttgctgattgctctcatacgctggctgcgttcgacagcccctcctcccgtcccgcaaaacaaagcttatattattataaaattaattaactattaattatttttttaaaaaaaatggattaatatgattttttaaaataactttaatatatatttttttaagattaaattgcactttggtccctcttttatttcccaagtttcaatttggaccacccttaaagctatctttttaatttagactgggtaaatttaccactgttacggtttgtactatcataaacaacttttctcatcatgtataacttccctttcggcaaacatatgaaccatatatagaggagttcggccgcatactagagttgatgtgtttaagctcgttggttgtactgaaaaaaaatcgttcgtggtaatccaaattacaacaatagtaaatttattcggtccaaagtaaaaatatatgtttaaaggtggtctaaagtgaaacttaggtaataagatgtggcccaaaacgtaattcactttttttttataaatcataccgtttaatagtttgaaaagcatgcgtgcgaaaaacgaggaaggtgggttggaaaaatggacgaagatcacagccacatgtgtctctgtacctgcttggagtggaggaggaggaggtcggagtacatgcggtcgtagggcttgaaggccttggcggcggcggcgagagcggcggcggtctcgccggcgacctccgacccggggttgttgatgtcgatcttgaacgccgtgcgcggcgtcgacatgtcctcggcgcgctcccagcacaggtggtcgctgtcgccgtcacccacctaatcaaagaatccagaaaatttttcttgagggcactagtgggccgtgttgggctcttggtgagatgggccttgagtgcgtgcgtacctggacccagagggcgttgtgctgggtgtgggccttgacgaagtagttggtgccccagcggatggcgtcgaggacgcggtggagcttgttgccgtcgaccatctccttctcgaactcgaccaccccccacgacagcatcgtcaccgcgtacgccatcgggagcccgaacttcacgtggtcgccggagtcgtagtacccgcccaccaaatccacctgcaaattcatccatccttcgattcaattcgcgccgcattactcaacccgatcgagcatttacccggccttgccttttacatccaactggatatacacggccattgcaatagagaactttgtcccgtggacaacacaatctaaaatttacttctataaagatttaaactcaggactttaaagtactactctaacgactgtaaccactatcgagcatttggttgattgaaccggaggcggcggagatgtatgtattaccccctgggagaagccgtcggtgagggcggagtcgccgcgccaccggacgaggcggtcgtcggggagcttgccggagcgctgcgcctcgaagaacaggaggcacttgtcgaacgcgccggcgtagtcgaacgccgacgcctccaccgacgcggccgccgcgaggaggagaaccagcgacgccgccgccggtatcagcaggaaggtggttgccggcgtcttgttcatcgtcgccgccattgctcgacctcggtagtggaatactggattgagggagaggcccgcacggcggaggagttttataaggtcgccatgatcgacgacgtggaggacggtggcgcgcggccgtggcatcgtgggcgcacgcgatgtgcctcgcacgtagcgaggaggagagatacgacgacgacgacgacgaggtgagcttttggcggggtttgagccatgcacgtcgtggagccgaaactgcagaaatggttgcaactcaagcgtgtaatagtttaattggtaatataataatagttgaagattagttttttttttaaggtaatggagttgaagattggatgcttgtagttttaagggaagattagaaaaaaaatgaaaggctgggtgcctgggtctgatgatcattgtctttttttttttttgagaatttgatgatcattgtgtcaactaccaattgtgtcggcttggatcgacatgaagtccactccagttacactgcgtgatcttgtgttgcaaatgattttccaatcaattttatcacgtttgtgccattgatctggatatttgtggaaggtcaacccagatattatgcatatatattcaaggtgagctgagccaaacatctctgtaccttcctgctgttcaagagctttcacagcaccatctgcactcgatctccagtgcatcagaaccgaagtaccttccttgctctcctgtgaatcctgctgtatgagtttcggtttcctttatctcctgagacaggcagaactccgtgcatgttcttaggaaaatgtgtcattttcaaaaaagaaaaagaaaaatgttgtgtcctatagccaactgttggcttgaaatcatctataatcaacttaatagccaactcatacaatagttacctataaatatatactacataattaatatttggtctcatctatcatacacacatacaccttgaagtctgtgctgcaactggttataaatctgtagccccgctgtcattctctctctttttttattttttcgaaatgtgtttatagctggcttatagcctgctattgcacctgctctaagcagaccaaatgcacaactgcacactggttttattcagtgtaactgcacatcgactccgccatggcacggcatcgatctaccatgccggccaggccgatttactgaattcatcagcagccaagaataaaattatcgatcacttcttttggttgttgccaccaggagtgatcagccgacgactagatgtgccagctttcagctctcgagcgaagtggcaatggtgtcggagctacgcggctctggatttccggcgaaggagacggcgcggctgacgtagagccgcaccaccctggccgcgagattcgaatccaacggtgtatgtacgactacgagccatcaggatagcgatctacggacagtttccactcggccgcggtgatcctgagttcctgaccgcttgattcggatccgacggtttccgtacaggcccgtacggtcgctaacgatgcgcagcgtcgcagcgatccatgtcgagcaaggactctaaagaaaatactaacaacaaactgagggctcttttgcaaaagtcaccctgtgcttacgcgatcgcagccatgaggttttgatccaacggtgtcagttaatgccactcctcctctctcttcttcttcttcccccggcgatctctccgtcccagccgccgcggcgtcgctccggcaggcgcatccgccggaatgggacggcctcgtcgttatctccggtaaactcgcctctcagagcctccgatcccctcacctcctccgcagcggggccgtcccaacacgctcatcggccggaatggtgaggcctcatcgtcgtcgtctccgataaactcgccacccaacaccgccctcgcctccgctctcaccgtcatcaactgcggcccggcgccccagatccagcatgcgcgtcctcagaacgacgaagcgttgtcgtttcctccagtcaatccaactcgcctgctcacctctgtcgcagtgtaatccttgtaacgtatgcatctttcactggtcatggactacaccccctcccaccaaaaaaaaaaaaaaaacttcaaactatatatttagatatagactatgttcaaatacagaattagaagttactctctccatcacataatataaggcgtccacatattttaagattccaccttcaaaacattttgaccatcatttagtacaatataaattgaattttacttgctaaaaattatatcattggattaatatttgaatttattttcatatggttataattttgttactacaaccttattatatatatgagaaattataaaacaaagattagttttggagactaatataggatagagggagtagtttcttgaagaaaagaatggaggaagtagttgttagtcagatggcgtcaatttgagccttgtgtttagtggtcctgcatatgattgagcaaacatacttcaaggtggtggttttctttttgataaagtttaagaagatggtgggtgatgtgttctttgataaagaagtttaagaagatgttcttcttaacgaaaacaaagtctacttgggagcaaaaaaaagatgataatgctattgagtattggcaactctttcaaactagacaaagatggtgattctattgacgatgcttccaaactacaatgattccattgcaacttgaacaaccggaaatttaattagttgttgagtgattttactctttagcaggtacagtgaggtatcctttttttattaagaaacttggtatacctcttctcttaatacctcggctattaagagataccaaaatctacattaaaaaattgatctctctaggtatccacaatacctcggctattaagagaaaccaaaataaaaaaaaaatgatctctctaggtatccacaaagacagtaaaatttctcttgttctacatatgggatatattcaactgtcctacattccgacattcctcctggtggcaaaaaaaattgcctcgcgaaaataacattgagaacattcaaacgagcccatcctagctacagaactcttctactatctggcatataaaaaccgcctggaggatcgatctgcatggacaaaaattcccatttcaagcaagcacagcatacactacaggccttgaacccatctgcaggtacccagaagcaacgctctaagtcttaaaggatttacttaaaggggcaagcatctgaagtcgaaaacccacgggccgagtcgctctttcaaaaaaccaaaaaaaaaaacccttcgggtgttctgctaccagtctactactagaaagagctaaagctcatcaacttccagccttggtatgatggtaccgcgctagagcatagtctgaaactctgaatgttgggactatggaggtgcttctggttctaggacccatacagtacaggtaatggagagaacatgatgtatttcgatgccgtggagatcatgcaaccattcagttagaccgagataggaagaattcatagtctggatgacggttgatagacttctccccgttggccttgggtatcaccatgcttgacataactgatgcaccatgtcttaaagtcttcagcctctgtttcaggacttcagcacgatcagttttggggccaacgtctaatgacattggcttgatctctgggtttctcagttgaaaccattgctctccctgtaaacaaaaaatataaataaggatgagttcagcattaaaatatctatgaaaatactaccagcaagaaaactaaaa

SEQ ID NO: 27085 - DNA, 851 bp, Oryza sativa
gatacaaaaaatgattattgtagagatgaaatattaccttgtcattgtaactccagaaaccaacaactggacaaaccaaatgagtaggttcatcagccttgtctggagagtgaatttggggaactactttgcccagggagtggtaagtcaggaatgcagcacggcagtttccttgaggaattcggcaaataggataccacgcaacacaaaacctggaaatggagtccggtaatatcattagcaagagttaaaaaataatcagcactaataagggaacaaatggtatataaattcaaaattcagtggatagaaatatccaatattagaacataccaggaagcaggatgaagatcgcgcaatttaagattttccaacatcttgggatccccaaatatttggcaagtagagagattttcaccactggtaagctgtttgatcctataaaatattgtaatgcataggaaaaggaaacgttttaaaacaaaattgcaacgtcctcattttatttcagcagttatatgcataaggagataaaaataaaatgtatcaagtatcatcaagaaaaaacatgtgacagcccattaatgactggtaagcatctaaaaagtcaagaagaagaacaatgcttcctggctaagctctttatgattttaaaagtcaagaagaacaacaacaattcctggctaagctctttatgaatgatttctgatttattttatttcatctcttcacaactttgtttgtttcggtcttttttttttaagtcaagtgtagatgattactacagtctgtagatacccaacatcaacaatagaaggcttacttctcaaaaagtggagggctgcaggaat

SEQ ID NO: 27086 - DNA, 15695 bp, Oryza sativa
  unsure (1)..(15695): unsure at all n locations
aatagtaaatactcctactaggagcagtagtgagcttttttatggatacggatgatttgtaaatgctgttcccaatgtggagcagcacaaccgattctctgacgatatctccccttctcgtaccggacgcccccacttgggttctgatgacttgggcaaacgagcccttctctatctctatctccgaaagcagcagcagcagcggcaaggattcgatacgatgcgatgcgattctccggcacgagagcatgttgccgcgatctcctcatctactcctactaccactctcccgggtggtccatccacatctactactcgcaacttgagctgcaggttgccgcagtgaacatatcccggagtaggagtactactcctgtccaccgtgtcctcctgacgccgactactcttgtgattctcgggaagcatatccaaattcacaaaaaagaagaggaatgcgtgggcatggctggcgtgattgtttgcatgcagatcacgcctgcctctgcttgcgttctctataggagtatcacactttcagagaaaagcctctgcttgcgttatctaggagtatcacagtttcagagaaagcgagcgagctgctcttctcctttcccttccccttcgaggcaagatactcaaagctgcagcctagctgtaccagatctgcgtaccagaacaagggaatgactgacatccaaatcgacacaagctgcgacgatgcttcccatgatgtagaacctagagacaaaaacagtaagaaattcccaggttcttctgactagctccacgaggtggtgggctagataaactgagttcggagcctcacccattcaacaagttatttaagaacccttctaatatgttcctttatcaataaaaccgatgttaaatctgttgtttttatacaatacgttaaatctacaattttattaaaaaaatagttaaaactatagtatatacattcttaaatatgtagttttataaaaaaaaatatatgatgttaaatctgtactttatcatacacgttcttaaatttatgattttctgatagatcgataaaggacatttagttttgtaaatattacgttaaaaaaacatacgtacgagtgagaaggaatgaatgatgcgattgttcgtaccaacttttttttaaaagaaaaatgcaagtgagaaagaagggcaaaggctagacagatgcgattgcccgtacgattgtaattcctgacctgccgaggattctgaactgtacatacacccccacccagattctccgtatccgtcacatgccaaaccgactgatcgatggcgtgcacagatccaacacgatcaagcaaaaccgatttggagcttctcctcccatatctcaatccgtcgttttattttgtaaactgcgtgcaccgtacgttgccaactccctcttctttttgcacgatgcgtttcagattatgagcaatatctgtataatccaatcgatgatttgatggttaacaaatcatgtccatgttactctctgtaacttttacacaagtcggttaatgcttacgagtgaaattgaccataaagtatgaagtcctaggaaattagtactatctccctctccgttccatgaccaatgatcatcgtataaaaaaactaaaattttcaaattactcaatcgtataacacgtgtttcatttaatgtgtaatattattcgttaccttatgtggtgtcacattcccatttaaattagacctcttcggcaagcaggtgcagcagccgaccacagcctgcccgctgtttttcttcttctttttttttcttgcttcactgttcctatcaggccatggagtgaacggaaattctagaggcccgaaatgaaaacgatactagcatgatcatacagctcccatgtgatcaagatagtcagatatataccactgccggccatatcggcaatagaccgtttcttgtttttcccttaattccaattctccgttaacgtttgactaagcgtaggccacctgagaagatggaaacgaaagagaaatgaaaaaggggaccagtgtgtgctgctggggtcacaggtcaatgcaggtttacatccagacacacaaggtagttggaggaggagaaggtttcaaccaaaacttttcaacgcgacaggtgagaagtttcgacgctgagaatccgctcggatacgtggttgacgcaagcaagcgcacagatacggccttcctgcaaaagcacacggaattcgcagctcctgacgtgccgaatcggcggcaatggcatcaagccatgaacttttctgtcgtgaagaaaatattatccaaaaaggagagagggagggagcatgtgccccagctgatgggaccacgatacggggctaataatttcctgaaacttttgtcgtgtagaatatcaatggagatcttctagcaactggtcaatggagtcaagtgtacatataacacatcgcaattaataggcatgggcggagtcagaaaatctctaaaagtaggcacaacttgcttattctctactactatgcatttatatgggtaaataactttttttataaactatgcatttatgcgggtaaataacttcatgttcaaatagaacttggcagaaaagaccttaccttattcagatcggggtctgacatcttctattctcactaaacaagttagagaaattaaacgagtaatatgcaagtttaggtactgggatgacacagtcgaataagtttgaggatctaaacagtcgatttgcgagtttagggaccgggatgacacaacggtacaagtttagggaccggtgatggactttactcttgaaggagtttccattcttaaatagtatattttcatatttgaatataccttttgtataatatcagatatgtggtattcctggtagttagaaatataagtataggatgtattcataacctgtaaaactgacacacatatatatcaacctttaggaaactttatattctacagttattgtgaatccaacaggtgagaatacagagaagccgagaatctaaacaaaatgttaatttttttggggggctttaattctgtaagaagttattacgggtagtagaaatactattataggccctgttctaatgtaatgaaaaggatggattaaattttgtattaaagtggcacgttttttaaattgctaaatagtgtgtttcgtgcgaaaactttctatatgaaagttgttctaaaatgtcagattaatccatttttcaagtttgtaataattaaaacttaattaatcacacgctattaacacctcgttttgcatgaaacacttaattttcatcttcagtagattcaaacaccacctatgtcgctatgtgtcagttttgttgttgatcaagttaaatactatctctttatccaaaagttttaagtatatccattttctttaaacgagatagtcatatttgtaatcatcatgtatccaaaacttaaataaagataaatttaatggttgattgaaacttaagtggctatcttaatacttactgtttgcatggatgtatatatttcttgatttttattacatataggatgagctgatttttctttgatcttcataaaaaatgaaatacgtcccagaattatggatggagggagtactccggataaaaagatacacgttttgtctaagtcaaatccgatgttggaatcgagacagagacaggggaaggacacattgaaggaggacgatcacaaaggacattgcttccgatctcaagcgtccgtaaattgatcttctgaacatgaacaggcccagcacagcacggagagtatcgcagaaaacgcagatgcaccctactactactcctactggcacaattatccgatctgtccttttggtataggaccaaatcgagcagcagcaccgtgacattcattcatccatccatccatccgaccacagcagcagctagcaaatctccacaccgatctctcgaatttacgcacccgaatccccattggtttccgcggcagaggagttaatggatcccctgttccgctgctcgccgtcgatgcagctggccggccgcccggtcggccggcattcgtgcagccatgcggattgggtgtcgattaaaggacgtaaacggatcaatttacgaacccacttatttcagtgctaataaatggataatccgtattatgaggcattgaggctgtgttcgtttgtgtccggtgagaaccatccctttgacacataaaacagaacaacatattaatataatattaattaagtattaaataaaattactttaataatgattttttataattttttaaaagcaacttactaatacattattaattataagtattaaataaaacttctttaaagctgaattaatataatattttaaaagcaacttttttattatatttttatatagtttaactgtttaaaatacgtatgcgcgaaaaaatctaagaacacagccacccaaatatggactgacacgtttacacctttggttaattgcaggtcccctcgtcgggcggcgtcgcggtcgtcgtcggatcggacggcgtacgtgccgcgatatcgatcgatcgattgatatacgtatcgatatcgaaagcgagcgatcggatcggatcggcggtgatggcaacggattgaaccaccgggctttgaattcgcgcggatcctgccatgcacgccacgactgattgatacactacatggatggattgatttgatcgtgtggcatccagaggagatcgggtccagggtgttgctaacccagaagccaggaggttttgtcagactaaaaactaatcaaatcaaatatggccatcaggagaagcgattagtactagtatatttctttaatctttcccagcaaagagccagctgacctttcaggaatgctaatctccgaaggacaaaatcctctcccagatgttggcattgtctggttcacactccgtattgcctttcgggttaagtctccattttttttaatagtaaaaaaccgtgtttcaaacagagacgcctaaaaacaagcgatctgtatcatcagtcaaacccgcactgcagaagagatcagaacaaaacttcttccgaaccaacatatcaacgatgatacggatttggatatcgacgaatcctatttgaactgaactaaatcagccaaaccggatagctaaatccaagaccaatcaaaagcggattgtgcaatcgagagagaaaaaaaagcagagaagaatcgcacgcggcacccatgcatgcaaatctccggcacgtaaacaactctcggattcgccttctgataccgcgagcagcagcacagcaaccacagcattcaaaagcgaacattcaaaagcgaagaagaagagaggagatcaaaaggccaaaaaaaaaaagaaaagaaaagaaaaacagctgcgcacgcagaggagaggagaggagaggagaggaggaggcgaaagcgacgggggagagagaggggcaggaacggcttctttggtttgaagccaattttgaccttaccaaaaattttggtagtgctaaaatcaaatcttgacaagttttgacactatcaaattaaatgctattgagtttaaactattgtgtcaaaaaattgatagcaaactaaatatacatttgttactattgaacctaccatgaatttggtagggctacaaattggtacgaaaccaaccaagcccgaaaatcccaggcggatcgcggggtggcggtgtctggcgtgtggaccccgcggatcccgtccccggatcgagccgtgtgggtgtgggccccacccgctgtgagggtgagggggggtttactcgatccccgagcctcggatccctttggagatctcgcaggatttctcccatttattttttcttttttctttttcttctttttctaattacgagtcacacgacacgcatatcaccccgcctgtatatatacgccagcgatggctgcgcctccaactcattgcaaccgcaaagcctcttctcctcttcttctcctactcgcttactcaatcgctcgaggattcttggattggattattgggttggattttgagttgatcaatggcggcagcggcgcaggctccggcggcggcgaaggtggtggtggcgacgtcgccgagggcaggcggaggcggaggcggcggcggggacaggaaggtggtgccggttgtggtggcggcggcggccggcgacgaggcgcagagcgagatgcacgtgctggcggtggacgacagctccgtggaccgcgccgtcatcgccaagatcctccggagctccaagtacagggtgaccacggtggagtcggcgacgagggcgctcgagctcctctgcctcggcctcgtccccaacgtcaacatgatcatcaccgactactggatgcccggcatgaccggctacgagctcctcaagcgcgtcaaggtaatttaaattcgattcgatcgaattatcgcgatgatccatgtgaatgtggaacccccaatttcttgagactgaatttgtttcgtgtgtggttcttgctgcaggaatcgtctcagctcaaggagatcccggtggtgatcatgtcgtcggagaacgtgccgaaccggatcagccggtgcctggaggagggcgccgaggacttcctgctcaagcccgtacgcccctccgacgtgtcgcggctctgcagccgtatcagatgatcgctcgctcgccatgttggatcatggagaggatgattaactcctaggattttttttggtggctttctcaattcttggacatagttcttcttcttctgctgctgcctcaaacaagaagctaaacatttggggctttaggagatgattagccttactgccttagcaagttagaattgaaattaggtgtcaggcatttgcttgttcccctgtgtgctctgcaaagacgccatgaaaaaaaaacagagagagaagagattcttctgaagcttctgttcaggaggtttctcttgtcacaatgttgaaatggcaccagagcatcaatctgttctttttaactgtttcaagatcggtcagagttttgacattaatttaagtcttgccaattaaccatgcatcatcatcatagtttcttcacatatttctgtccttgtgattgtctttcttgtctgctctgctctgccctaccctgtatatgactaattcatcaagaaaaaaaaaagggtctcttatctgttcttttctctatgatctgtacgtgctgtattattgtatcagtacaggtataatcgcaatcttgttgtgatcatcgcactagcgtgtatacgtataaacaaataataccacaaatgttcttggcctgtcttaggtgagctgttgttgtatacggtgtgtaaacaaatgaaaaagtccaaagggggagcataatatagataagataattgaggagatgacaagacggtggaaggatctgctcagagatttgcttacctggaagcagattcttcaaaagagaccctgcattgcatgtggcctctcagccctgatgtcgttggaatgtacagtgctaattccagattatgaaaagagatctgaagaaaataaaaatctgagagagagagatgcattcagattggttagcaactgttaggtcaggtacaggaactgttctgatttcttgcgattttctggaacgtcaaagttggagagcctggattggacgtgttggttcgttggaatagtttttggtttgcttgcgaggaaaagtccacgaaaacactgtgcgatatgccatgccatgtttttttgcttgatcgcttcagctgtgtgtgtgagcacgtctgactttgaccttgatttgtttactggttaaaaacgatgtactcaaacatttttatttcttttgtccatctccgtttgattgctacgcatggacgtttcacttgtgtagataaatcaaacattttttttccctggacaacaggtcgtctctcgtctgctcctcgttgcatctctacactcaaaatctaacctgcacgtactccaaatcctgattgatagtgaaatcgcttttctttgggtctaaattcgtgttgaattagtactagcttaaacggcacgaatggaatcagcttgatgagaaactttccttttctcttgacgacattgcattgattgcattgcacggttaagacggtcactaaactcttccggccgggcaccattaatttcaccagtcaccactgctccaactgaacgtcacatgaccaatcggctacagtagcagtatcttaaatgcgttaatggaaaaatgtataagggcaagtataagcctctgcatgttgcccctaaatttaccacataaggcactgtttagattctctaaaatagtaaaagttttgtcattttatagcactttttgccattttggatctaaacactagtagcaaaagttggcaatttggtatttggcatttgctagtacatagtagcaaattgtgccaaaaagtgctttgggaccactccctctctctttctctctctcactttagtgctagaatgacaaaactttaacatgcatctaaacaccaactagtacttttgtaatgccaaaacttttgccaccaagacttttgccatttgccatttgccattccaaatggatctaaacatgccctaagattaggtgatgagttggaggagagaagttaggagagagagaaaatgagccacctctcatgtaaggggcaacctccacacaatctccaagaaaaatataagatgatgtgagagtaaattaatgttggggtttgtgaactataggtggcatgttgtacttgttacctcttaattaatgagaatatgacatggtttaaattagatatggcactcacctccattataaaaatttccctaagggcacccacaatggttatctataagctctctacaagagatacatgtcagcatattttcctacttggaagagattaaatgaagagagagagtaaaactatctactaatctggggatagtctatagagaaaaacgaggcaatggattagagagctatagatacccatgtagacatactattgaggtggtttactattaatctaatctattgctgagatgtacatattttatagagagcaccttattttaccattgcgggtggtctaatactacctccgccccaatataaatgtagttgtcgtttttgtgtccaatgtttaattgttcgtcttatttaagaaatttatgaaaagattagaaaaaataagtcatgcataaagtattatttatattttatcatctaataacaataaaaataccaatcataaaaaatttttaaacaagataaacggtaaaacgttgaatacggaaactcctaactacaattaaaataaaacggagatagtagttcgtcatatctcgtcctagatcagtttttctctagacggagatcgagcgtactggcgattccgattctctacgggaaaaacccaaccaaacgcatcgatcgcgcgtacggggagagttgatggccgaggccgtatgcagatacgagacagcgacgggcgcacgcaacacggcccgggtgggtcgtgtagcgtgcgtgcgagagtgcgtcgcggcgcgtgtggggacccgacgggatcgtatcccgtgtgtggtacgtggtgtacggggggaggtgggggcgttgtacttaaactaagctagtaaaccctgtgtgctttggttcagttgctacttgccagttgccactgccacggccgctgcttctcgtgggatcctctttttaacaactggtccatcccctaagctaggagtacttaattatggtgtacgtggaagcggttcctctgacgtgaactaaccgataacgtggtcattgataggtcggcccataagcggtgggcctaacctgtcagtgaccacgttcctctgatttcatgtcatacgatcccaatcagatgtacgtttaggtctatacattgccacctgaagctacctctctaactatgtgtattgatgtgtatattatatagtactagtagatattgtttcggagagtgaattttaaactctcgagaaacgttcactcgttttttcatgtcactcaagtagttataaaataaattaagaagatgtatagcatataatcactctgcaaatatgcaagttgaaattcaaattttacatgttaaaaaaaattaaactacaactagttaatgtatattcgcaattaaatttatttttcctcgaaaaaaatgttttttcattgtaacatgtagaagttaattttacatttcatgtttgtggaatgatctgtcacatgttaatctatcttgttgattttctaaaaaaaatataaccatttgagtgatatgcaaacaacgaggaaatatctcctcgagagtttaaaatagtttcccaattattttgtcattactttttctaactactttacgcagggtgtgtttgattaccagtcatactttgcagctaaaagtatggcgtggcaaaatgtagctaggaaccaaacacctccacggtattttctcatgtgcagtggtgaatccagaaaacaaactagataaagctacaatcatctctctcatctatgtatggtaaaaaaaatagcggtgagggcttcatcagggctcttagagtcttcacgctaatagtggagactcgagaccccgctaccatatactggatccgctcctgctcgcgtgaagttctaatatttgtatatttaagtttttgaggtttaacggcacgtattttacaacgtcatttatttgtaaacggaagcactcctgtacgaaaaacaggtgcagcacatggtcacattgcatttaccagatgggagtacattagtagatgaaaatgaatgacgacctcgcattcgcgtagaatggacgacacaagcagagctgtcaggttgtgtacagtgtatgcaaattgagaaccccagatgtcgtacatgaagtttaccctgtcgtccacagtaggccatagacgtgtccggtgcaactaggcacgtgctacggttgaggcctccatgactgaacatcgttgcatggccagaccatgggcgttggcgttggcgttggcatggctgtcatcccatggagaagcatccaaatctcggggattacgggaaagggatcacgacgagcgaggcaaaccgcgcatacaatcgagagggcagaggcgacaagcgagaagaaccgagacctggggctacctgccgtcaggtggaaccaaatactccaatcccagccccaggtcatgcaaaacggcaggcagccatccacattccaccaggctacggtggtgttcttttctcttaaaaataaaaataaagatcaatctacttatgtaaaataagttggtattaacgtataattaattaagttttaattattataaacttaaaaagtatattcatatgatattttagaataactttcatataaaaagttttcgcacgaaacacactatttatcagtttaaaaaacgtgtcatgaaaatttttatcttcatccaaaactctatagaaatgaactggacagctctctcgtatttggcatatccacgagggaaacgtgggcgtggaaaccatgagcgctcgcggctcgctcgcgcgggttttgcatggcatggaggcgcggtctggtggttgattggtcggggggatcgcgtcgcctcgcgcctcgcccgcgacacgaacgcgatcgcgggggatttgaccgcaggatcgcgggggagatctcgcgcggtggaccgccacccgaccgcttgatagcggccagcgccgacgcggacgcttggccttcccatgccgctggccgctgccactggctggatcgatcggcacggtcgatcggggttgggctcatccggacccctactagaatagggaacactagtacggtacttaccactgtagtcctgagtgtcacaggagagagatctacccaccagcagtaacagctaatggtttcaaaggaagggactgtttggcacagctttagctccagcttcacctcttctggagctggagctcagccaaaaatagtttcggctcaatcaaaactaggagtggagctgagtggagctctctcacaaaataaactagagttgtggagctgggtttaggcagctncacaactctactccagactcaactcctagagttaaatttaggagttggagctgtaccaaacaagcccgaagcttttagattttagtaagaaacagctaatggtaatttagctgatgagtctataatttgggaatacaatcttatggtttttataggactccgtatatattttttaaaactttaccataagctacttaaaaagaagtataatggcatggttccaatttttcctaaaaagaatatcagccatgcatgtggcgtgcattcacccagtgaagaaggtaaggaactagagagtgaaaacataaaatacgggtccacggtgacatgtacgtttgcccgcagacaccggccatgcatgggaccggtaggtgagcttacgatgtacagcgtctcaggtcgtcaattgcgtccacaggtacatgctatcatgtccncagggcgtaatgataatcaaatgggcacggtacaatcaaggagattgggcaggagctagctcacctcgtcgctttcagaacgacctgcgaacagtgcaagagaccggctgctttgctgctagacttccatccaagtgcgtgccgatcttttccaagatcggcgacttgcgatgcttccattgcaatggagcccactgtacgtacgtaggtgcgatttagtagtcatgttatcaaacatgagatggagctgggtgaaacatggaagtcacgcttgcagatctgcaaagatccggtgattttgccccgtggaatggaatacttaaaattttgatgtgaggccgagagattacgacgggaggatgcatcgatctcacaatcacaatctatccaagacttgacggagccggaaggatcggatgcgatgtcaatacatggaatgccaccatgtcgttttctactgcccccggtttgagctgatgagacaacgtgcatggttgtgtgtcaagtttcagcaaagcatctggactctggatggactaacacgttgcgatgcctgatgcgtacgtacgctgcgattctggagttgtaacgcttacgctgcggttctggagtattacatgtcactctctggctgcacacacggcgactgacgtgccggttttctgcaagctctagaagcatggagtatctgtctaattatttgcaggcaaccacctgctgtacaaaaaatactacagccacggtaggtatcgtgcgagacgtgtaccctttcacctgctcatcacgggctttaaatactcactctgtacgtaggtgcggcactcatcgaattaaaagaggggacatgtctctagcacgggaatttcttaggatctaagggttggtgacaggcctacgagcaaaatctaagaggacaaagggatcccagatgaggaaggacgatctggctttatggtatttaaaaaacttgaaaggccaggacggttgttaagcaattcttcagatctaacaaagcgaccaaaatggcgcccaagcgctacgcaaagtagctgcacatacgacaaccgaaacaatttagatgtttcggtgcggcattagataccatataagaactgcgtaattacattagcattttgatcggccatatataatttaaggtcctacaaaattttggccgaattcgatggtccttgcaacaagtaccttcaaagctgaggtggttgtcaggcagacagaccacatgatgtcttcaaatggtctagagttgccaatcaatggcagatagtcccagcctctccaagatctgattcgttttagaaaagtgcctgtttaagataagcacagcacaacgatcatcaataaaaatttatcctattgcaggctgattcaacgataatcacaagggcaaaagtagcattagaatgatttgaattggccccataaacagtatctgagatgccaatatccaattcacgttctatatgttgtgcctgagctaatgctcatttggatctagccattaacactagtgagtgaaaaggcaaaagtaatatcaagttggcaaaaacaagacaggacaagacggccaaaagcattgagggtttatagcagtatagcaccactcagcatggaccgacagtaccattgtatagtggtgcaggtgagttaaagttgatcttaggataaatcattataacccacccactaaatcatctacagtaacaaagataccagccattggtgggttgtctagcatcaaatagatattatggcgccgcatatagggcaatcctgatatgcaagtgctgaacaatcataataattcagttttatactaagtaacatagtctttattctctctgaagtatgctattcaaatttaacctaagttacagaaatatatcagctctcccttctgtgatgttttactcctatgtagagtctagtcttattttttaactcacagaaacaaatgaagaaagttcattttatctgacaagaaaacaaacctgcatccaaagaaacctctgcttgcagacagccctgatggatgagcggatttcaaaatgtggtgttttgtttcatcaatcaatctgcaaaacagcatgcaggtactcttgtctctcagctgacattataatagccagttttacaaaatattcttttgatagcgccaacattccaagtcacagatttgcagatgtgaacgaagcaataccttgtctttgcttgagctgagtttccccagagaataaagactattccagatttcttcagtgatattgtcttaatgacagcatcagtaaattgctcccatcctttcttggcatgtgaattggcttgatgttctctcactggcccgacaagatgaaaatgaaatcagcaaaaatatacccaacaagatacaacttccaaacaaatcaattctaccacagcattcaggcagatcagatactgagagtagattttaatgggaaactaacatggtaatgatattagtattgtttatctcctgctggaaatgcagaacagcacagctggtggcaaccaaacttctagttggagctttcagtaaggaaattgtttagcgtttacattattatcctagcaatatagtaacaacaaaagagatgttttatttctctgattatagattgacactatagaaaattaagaagtaggattgttcagtgctgataagaaactcgtgcaaggatagagcaactaagatcacaatagtgaattcccatggaataaagattctcaacagaggaatgcattactttgcactaagctagaggaagaggacaagcaacatcaaataaatgtgatacagtagcaactggaagaaacctttggggagcctgtaatccccagcccatctctgtggatgggccatggatcgtgggctcccaaaacaggcctatgtgtaatgcaacactttattatttttgtggtcatgattataaaagaacctacaagttacatcacagtttaatcaagattatgaatacataagagctaacaaagcaacaaaaataaaaatagttttcaatgtaaatgggaacaataatcataccagttaatacagtg

SEQ ID NO: 27087 - DNA, 15405 bp, Oryza sativa
agtcatggctcatgagatcattttaagcacatcaaagcatcaaagtggaacgagaaccaaatgtgtgtgctgatctgcaggttcttttttcatacttctaaagttctaattttgattttatcttcttctttcactctgagtaatacattgttttttctcctcaagtatcaaggcatatgttacatgcaaaatgcctcttttttttctatttgctatatactccggtgttaaataggcatttatttattttcatatttaggtccagaaacgttgaattcacaattttcctagcttgccagtttgctagtttatactttatgtatgccaatctttagagtttccctagtttgccagattgctatagtttatactttatgtatgccaaactttaggaatttccctagcttgccagattgctatagtttatactttatacaagccaaactttggaattttcactagcttgctagatcgctatagtttatactttatgtatgccaaactttagatgtacctatcccacttgtacatcattcttttcaagatcaacggggccaagtcggccatctgaacctacaatacacgtcaattcaaaagggtctgcgtcaacggctccttaatttcaggtttataaagtttttcaaattaccattatcgctcattatccatatgttgtgtgcagatcaagttttcagcaggtcaaagtcgatggcccgaacctggttttcaaaaaacagccaatgggcgaagaataaaacgggcgcccacgtttctctcctaccgtttcggatgcgtggagccaaagcgaagctagggtggtggcaactgtagcactggaccccgtctcatggtaaatttttcttcgccatcacctgttgctgttgctgttgccacccccaacgagtctatcaggacacaggagaggtatcaggaggtatggcctttgctacttctgctaatctgatgatgtcggtattgcattgcatatgatacagaagtgaagtgtgctgtttgtagcgttgcgtcatgcagaatgggggcgtaacagaacatgggaacatacccattacacgtgtgcgcgacaccctcaaagacggggtggttcgttgcacgggtaaaatatctgtatcttccctgcaagtgatgtacggtttgttgtgtggcatccacggtaagtaaagtaaaatggctcggcaaaaatcagaaaatgacgtggtatgggcacagacacacaccccaaagaaaaatcacgataaaatgggcgtgctgttcacgctggactcgtcataacctaggctaggctactttgtgattcgatcagcttttgggtgtgtgtttagttcacgacaaaactaaaggtttgattgaaattgtaacgatgtgacggaaaagttgaaagtttgtacgtgtagacaagttatgatgtgatagaaaagttgaaagtttgaagaaaaagttaggaactaaaccacatttgcctggcattggaatcgatttgatcaaatgtcataaagatgatttttgtaactgtttcctatgaaattttcgttacgactttaatcgcagaagcacattctagtagaacttgcatatcggaggagattttttttttctttgatcaatatgtacccagagaaaatattatggccccatccttacctattagcccgtacattttcttgtttataagcctagctgatcgagtcggcacatatgccatctgacagtaacttactagtccagtgtgaactgcagaagagtgcaagccttgcacttgtagttgtacgatgatgtaggatgcgatgtcaccagtggaaacgcgcggccctgcacggagcttgagtgcctggagattgtaagatcaaatgtcataaagatgaaagctctattagtgggggtaataagccagtgatcccagtctagttattaatgcccttaatggtacgataaggaaaaaaaatatctttaaggtttagccaaacgttccagtatgttctgctcgtatatctttagcccgcaaggtaggagaagaaattattacgtgtatgtgttcattccagtctgccaagtacctacggtgtgctgttgtgcaattaccacatcgctaaaacatgaagggaaaaaaaagaatcgatcccaatgttcagaaagaaaacgtcatgccaaggtaaaaagtagatgacgccacgcgcatactcgaagtaaaagtatatatatgtggtggattgcgcatacttgaagtaaaagtatatatatgtggtggattaccgataatctcgattaagtccagtattaaaatggacaagtagagagctaaccctaattagattctgaattttctttttcccctctcgatcgataccaaaaggagagacgagagggacacatgtcgtctgcagtactgcgttatctcaattgagacgagagaggcgtggaggagtgaaaaggcgaattcttattcagaagtgtttccgatacgcgtcttacgcggcgggcccacgctgccgccctcccatcatcttcacagccgagagagagagagaggccatctcccccttcccggaaacgcattcttgccggggacaaaagcctcacgtcccgtcaccttcaccttcgccaccgttcacaccccccgcgacgccaccgccacctttatatccttctccccgccacatcctcgctcctcgtctccgccgcgagcttcacctgaatccgatccgatcacccttagcaacccagatgttcctcaccgacaagtaccacgcgcttctccctttccacgccagcggcggcggcgtgaaggatcaccggcggaggccgggcaaggcggtgcccggggcggcgggtggtggtcccgggtccgcccggttcggcgccgcgctgtccgcgaggctcgggagtttgctgccgctgccggcgtcgccgttggctgcgttggcgcggctcgcggatctcctcgcgcttgccctcgctgacgctgttcccgcgttggctggtgagggggacgcggccgccgtcgccgcgcacctcgacgccggggtcgcgctgctcgacgcctgcaacgggatcaccgcgcgcctcgaccggctccgccgccgccgcctgctgtcccggttcgcgctccacctcctctcgtcgtcgtcaccaccgctgccttcctcggtccgccgcgcgcgcgccgcgctcgccgaccgtgacgagcgggccccggcgtcgcctcccccgccgctcccttctctcccgttcgaccagccccgcgaccgcgtctccggcgccgcgaccgtcctcctcgccgtcgacgccgtctcctcgctcgcagcggcggccgcgtccgccgtcctctgcggcgacgccctccaccagatcgccttccccctggtctccggcgaattcccgtggaccgaggccttcaacgccgtgtccatccagctcgccgccctcgccaccaaacccagcgaggtggacgccgtcgacgaggccgtcggcaagctcaaatccgtgctcgacaacggcgacggcgacctcgacgaggcggcgctgcgggcggcggtgcaggaggtggagaggcggacggaggagctgacggcgccgttggaccggctgtccgacgccgtcaacggcgtgttccgggcggcgctgtgcctccgcaacgcggagctcgggagcatcatggtgggacccgccgaaaagacgccgtgtaaatagccgtttccaccgtgtgtcgtccgtagccatactggtatgtcactgtataaatacaagtataattctggaagtagtacagttctacaggtacagggcaacatggggtggtgtctcagccaaatgcagtggtttggtgctttttctaccagctgttactactatctgtgtgtcaaggttgccacatatgagaacacagtgcaattcgcacccttttgcagatgtggaatccagtaaaaacttgggaaaaccgtggcaactgttcacctacctatgtaattttgcggcttcatacatactgtatgtataccatgaggaactttgtgaagaaaatctctcttaccgacttcaccagttgaaacagacacattaatgaaacaatcagcttattatggctcagattttttttttttggcgagcgaaatgaaacaaaacattaatgcacgaataattaagtattatctttgttgtaaaatataataacatttgattatctaggtagacaaacccttgtatagagccggatgtgttaatgtattactccttccgtcccataatataagagattttaaggtttagcttgcactgtttgacttctcgtcttatttaaaaaaatttagaattattttttgtcacttactttattatctaaagtattttaagcacaactttttgttttttatatttgcacaaattttttgaataagacaagtggtcaaaagatgtaaaaaaaactcaaaatctcttatattataggatggagggagtacaaacttgaaattttagattcatttatttttctaaaaaaaacttttatataaaaagtattttgtataaatcgcatcatttaatactttagaagatgtggttacgatgaatgggggaatcatagctagggagtagcttagccgagccgtacaaacaaccagcgtgagagaacgagcaacctggcaccaacggcgatcgaaccgcggccgcacgtacggcgaaaatgtcagcggcgcggcccgcatgggccaccacggcgtgggcgcgagccgcgaggttggcttgccgagaggcgcaaggaggcgctggccttggcgacgacgatgacgacgaggacgccgtggcgcactcaaccgcgcaggcgatcgaggtcaagcaccacccgcccacgcccacgcgcgcgcacgcacagtacagtagtcgcgcacacatcgcccatgtgtgcggtggtcggagccgtcacgcaagcgatctcgcgggcacgcacatgcggcgcggggcacacaggtttgccgtcgcggcaagcggaagaaggtcgcgccggggcagggtcaggtgaaggtcaggtcggccgctgctgtcgcggtagcccgcccggccccgacagagcacggcgcttgccgatacacttccgctactcccgatggggacgccatgctttgtccttggtgtcaccacactgtccctccttggtgcgagatagggtaggagtactacaatacgggagtcgcgtgcttgctcggattctcgaacgtactagggctacagtatctttttacacgcatccggtgccagcgaggagggctcggtgcatctcacaccgttggatccgatacgatcgtactgcctgccaggctgccactggccagtgcatcgtctacatacaacggctgtgtacgggctccatctcaaaatacaacaatataagattagatgagacatttcctagtcctatagctcgtccatatttatggtactaagaattatctcatctgattttatattcttatattttaggatggagggagtagtagttcttcagaatgtgtttgttttagctttctccagaagccgggtaatcaatatttagcctgttataaaaaagaaaactagttcttgttcgctttgctctgcgttctgcactgggccgttggctagtagggccgcaacttccactacaacaattaggcccaggatacgcccatcagctcagagcctgagaagtgagaaccaagttagcagttggcagttgattggcacgtcggtcaaacgaggcaaccaatcgccgagtcatactagacatgcaagaatgcaagattgcagctacgccaatgcggcccacgtagtcgcaatctccactattccctccctggctgaagactccaaaaccgccgccgcctcctcctcctgggacctgggctcctggcttgccgctcgaccatccgcgctctttacctgctattaattcgctctccgccctctgcattgcaccatctcgcgatcggtaatgacgacgacgaaccacctcgtctcccccgcgctgctgctgcttctcgccctcctcggcgcatcggtccggcgtgccggcgccaccaccttcgaggtcggtggggaacacggctgggccgtgccgccggccaaagacgccggcgtgtacaacgactgggcgtccaagaaccgcttcctcgtcggcgacagcgtccgtaagatcactcgatcgatcgatcaatctccatttcgaataattctgtcggcaatgaacagggaaagtgatttcatctctagaggggatattcatcgtttcgtgcatgccacctaaatagtcatcgaaaaatttaaaaaattttgacaaaatatattaatatgaaatatattacatcataaacatttaagtttaaattcaacttctaccggttgtaataaaaataacaagtacgcgacattgatttgcatttgatgcagatttcaagtacgcgaaggactcggtgatggtagtgacggaagacgactacaacaagtgcaaggcggagcacccgatcttcttctccaacaacggcgacacggaggtggggctggaccggcagggcctcttctacttcatcagcggcgtcgccggccactgcgagcgtgggcagaggatggtcatcaaggtcatcggccacgacgcgcctccgccggccagcccgccgccgccgccgtcgaacgctccccctacaccgcctcaccccagcggcgccgcctccgcgctaggcgccggcggactcgccgtcgcggccatgctgctgccggtcttcgtgtacggtgtctgatggtcaccgtagctgcatgcacctgcgtgcatgcccgatcgaattgatatcgtcttgtagattgtcaggtctttgcgagtgttatgcttagtgatttttgacgtgctcgttcattgcaatctcgtgtaattcttacttagattttttttttgtatttggaattgactttggataatttatttgtgactttgctgaatgttgcatcccaaaccttcagtttgcactcgcatttttctcccgtggaaaaccgcgcctctcgttgattaaactataaactataaaccatctttagcggaccatcctttgtattgaactctttgcgatattataaaaataataatttggaaaattacaattattcgattgaactatcactttgctataacttcgacgtggtattttacaaaaccaaaacaacaaatggtttttatcaaagaaatataactctatctactatgtgaatgatatataggtctgacttcaaaaaaaataacatgagggatatatatgtggagtcaaatttgttagacaaatcttaactaaaagattcggatttttcctttcgtcaccaatttgtcgtccgtacgctttttcgtccgtacgcgcagtttacacagatccgatttttcgtccgtacgcgcttttgtgtgtgatcattgcccagtaggccacatctgtccacaggcccacaagcaagcccgggtccaagcgacaagcccataaagcctaacccacaagtccaggtgcaccacaagcccacaaggccacaaaccgcaagtcctccgttttccttttcttctgttatttctaccgctattttttagcgctcacactaacacgattttacagatttctctcgcaggggaaaaatacacatacacgaatacaatcacaggcaagacatacatatagaaataatagaaacacacaagaaaatacaaaaatacaaatcacgaggctcttcctcgggggtcaagccacttccacgttatcattaaactgaaccctgaatgcagttacaattccattaggtttatatataactcaagaaattctaatgcagttacaattccattaggtttatatataactcaagaatttctaatgcagttctactccattacggtaacacattgaggtaacaaaattaatatgagatcatatcatagtagcatgaaattaatgatttgatttaatctgcaatttttgaaccaccgtgtcatattgattggaaaattcacagtaacaccttgaggtaataaaattcacagtacttgaatgtttgcaaatatcaatatgaacagtatcatttatcatttagaggttgagtttcctactttagctgttaagcttcaagactaaattcaaactactgaaaactaaccaattcaattaagattggtaatttcatgacaaaaaccttaccaatttccgaccagcggcggtgaaaacatgaacccagtttctcctccactcccgaagttggaaaatagatttctacaggaattgacatagaaaaatgagtagtttagatacttctggtaatccatagagccagacatgataatttttagctgattaaccttcaaggctaaattcagagaatatgaaaagtaaccaattcaataaataatcaaacacaaatccataacaatagctgcccagtatcatgagaacatccctcaacacgggaatcgaatgcatgatctattgtataaccctgacagcaaaatcatagtagaattcttagtcaatttgaacacttgccttagtgctcattataactaatataatcgacaccatacaattatcatacgaatataatctgaattaattggatttttctgaattgttgagcaccaaaccggttttgttgggcgtcctaagattttggagatcaagctagcagcaatggtctcatttatcaagatgatcaactggtaattaataatggcatttgtagtcacaagatgtatcattgcattttaagggggcaaaaaaaaaaggaaaacaagcagttcagtccaggaattaagctgcctgacaaattttctcacttacagactagcatatgtatatgtatgtttagaatttcagaatggaaataattccattcttttgttcactatagtatttatcgactagattcttgcactaggaagctacatgataacataatcataaaaacacaatttgccctcctacttaagaaatactactaaaattttagtagtaaattctggaacattgctatcgtccacgagccccaccgagaagaacgcatcaagattcgaccaatatagagtaacaggacaagtttttaatgaatacacttctccacctagacatatgctcttggttgatccactcaaaccaaacaaatcaaataaactatttgtccaatctaattattctgacaaagaaaaacatagcaaagctcatatcagcttaaaaaaactcaccggttcagacacctcgactgcagcattcgagacaacctccgatgacatcaccactccatcctaaccaccatctctgcctcgaatccactcaacaatccgctcctcccctacaacatagagcagatggacagtgtgttacctaactaacatgttcccaacctcggactgatcaacatgttccagaatttactattttcacatacgcttgagtataatgattacaaaacatattattttgtcaaaacatgtgtgacctaatcaaggatgctgaaatactacacatttttcccaaattcaattcttcaagcaatatatgtctaaaagattaaaatatctgtataacagcttaatcaatcctgaagatgttggtctcacaaacaaagaacacaaattccgaaagaagaaaagtgaacatgaactactccacagacatgatatgctcaaattaatttttagaatcactgactttgtaacaagatatgaccttgtgtggcaactaatgaggtatattcagtataaaaacttcagatccatatagtttaaatgagttcaataatggttgaccaataattctagatgcgaaaaatggataaaaagtttgcatgtgaaaatagcagaacagctcctacaaagtctaagtaatcatacacaggtacacacaaacaggatcatcaaagagtttgtagtcctataatcctatattaaggacaaaactaaccccaatctatggcagccataggacttaaggacttagataaactgaatcagatatgctttacaggagaaaaaaatttactatgtttagatatctgataagtttacaccaatacccccaacaagcaaaaaaaaaaaacacccatccatatccctcggacccccacatgcacatacacagacaaaatcatgtctaaccgtgtaatcaaaaagctaggaaaatgttaatcaaccgagaacgcacctgaaatcatgaagaaacgcccactatcttcagtgccaccactcggctgcgctctcctcggtccaccttcgtctgcaagcttgaaccctcctctccggccggccggacagctagcggggagtccgttgagtgatggtgatggaacgagtggggatcgggggagctcaagagcaatgtacatcttcttggcgctatcggcggctttggtgatggagaccatgagacgcatacggtctcatcatggacatcggcacctcttgaaaccaattgccgtcgtcaccctaggggaggccgccgggtccgccctcccgtcgtcgctggcggcagatccgtgcgagaggggggcggagagacgacgagaatcgtgtgagaggggaagagatcgccggatccgcacctcccatcaccacccacgaaggatccgcgcgacagtggggaggagagacgacaggatccaagcgaggaggagtgaagccgcccacgggatccgtgcaggaggggaaggggtcgccggatccgcccctcccgtcgccgacgatggcggatctgcgcgagaaggaggcagagaaactatgggatccaggcgaggaggggtgaatccgtctcaatacggaaatgcactatcgaagaagctaaatgcaatagcaggtggtggcatggtggatctggttggcaacgacggctttgagcaggagtggctgctggcgatatatgaggaggtggagaaagacacaggaaaacagggagaaatagagagaacgagagagagagagagtggtgtgtaagtgtaacagctctcattttctctgacctcctcgagctatctagaaagtgagagctggcagctggtcaggttggtggtgtgcaacagctcatcacctcctcactattttacttttctaatattaacataaaaaacatcaattcttaacttcaatatttactaagacaaaaatcataaattataaaaaatgatataaaggtttcagaaaagaaaataaaatgcaaaaaagtagcatcgatattcacaattctaatgtgtcgtcggtttaactccacacatttttttcatgtctcaacacgtactatatattctcatagttaaagcacatagattaccagaaaattccatttattttttattaaacttacctacttaaaaaatatcaatatttatgttcatcacataaatttccatccgtcgccttctgcgcaaacacaattgtaatgttcttccaaacgttcttccatcgctacaaccatccgaaccacatgtcagaggcatcatccacatccctgttgacagaaaacacgaggcctgggagatctgcttaactccagtacaggtccaaagctcgcattcgggtgtgctagcgtgccagttgatttgatcctgtaatcaacaagaaatagaagcaaagaaaccgcagttaaatctataaatgatagtcaatcggctaggtgccgatgacatatcaattatctttgagccgatgtcatatatgcatcgatcggcagtcattaataaataagaagggactaaatctactcgatcaactgcagatattaacaatatataatctttatatcgatatatacttaaattaagtgattgggatagatcggtcgctatgccgagacagtataaatcacttagatcgaaatatatattaataatgagactatatacgttcatagtataaccgatcagatagatctagcatgtatcggctaatactctgataccaccttatattaagatatcaaagcaagtagaatatactaaacaacagcctaacatacttaaatgcagcaagatcttaacgtaaagggcagatttaacatgtcaatcaagcatataggataaaaagtagttaaatcaagtaagatcggctgaaactccgatgctaccctaatcagcaaccgagaagtagtagagattgagattctaatcacgactcataagatcaaacttaactgatgcagctataagtatgaaaagaaggacaatatctagacaatcaagccgtcggatgtgtcatagagtggtagatatcctatataatctaagtcagcatcggtatttaacttaatcggctgccttctattgacggatgttagccgattgtaggttagatatcaatattgccagggattatgtaggatatatgataactcggcgaattacataaacaagattagagtgtcataaagatggaatcactaatcccgagaacgcaagccgtcataacaagttttacctcttgttgaagatcgaaaccgatgcagctcaactcgaaagcaataactcgtcgaaataaaactaaagcaaaaagggtggcgatgcgccaagattgtattgaacgtgtgttcttttagttacatagggctcggggtctatttatacccgagaattataagatatgtccataccggacacgactattatctctaacaaactctaagatatcataagtctttgcggcagacttttgccctaagcatatctctaaggaaattacgtaaaacatcctaattaatagatacaattgccttctcaggactctatccatgtgcggcaatcatcttgaagcatatatgttgtacaccaagtcgtattgccggaatcggctgtatcacctaacccagtctgattcagatttagtcgattttagtcgtagccgatctggactccagccgattcttactctgttcccgcaacaatccttatttccgactccgcttcgatcccatcttcacctccgacgctgatactaccaaattcggttgctaacaatcccgcacatgtagggaaaattaattgtctagaaacaaacacgacttcttagtcatcgaacatatctctgattcttatgattatggttgggtgctttaataaatcgttaaaatcctacttcaatcactctgcattacacagtgcgacgcacggggatttacataaggcttccgggttttttcgtcaatctttttttcaccctttttctcatccgctttttattcatcgccttttttcgtccgtcttatttttttgccttttcctttttttttccatccatcgtttttttgcctttatccttcctctcgatgcagagagtcgacgtgatccatgcgggaggggaagaggtcgtcgaatccactcctcacgtcgcacaccgatagcgaatccgtgcgatagggaggcggagagatgacgggatcagtgtgggatgagaagagttcgccgaatctgcccctcccgtaaccgctgacggcggatccgcgtgagatagaggcagagaggcgataggattcaggcgctggtggtggatcagtgtgcgcatcaacaatggcttggagtcagtgctcaatttgtttggcgacaactacggctctgttctgatgctagatacaatgagtgattttttttgtttattattttttattgttgacatcaaaatcaccggaagtttcactttaatatttatttgagataaaaaatatcaattgtaaaaaaatgtgtgctatcattcacatgtcacataccggtctcaacgcgggtccatatatgatagtgaaacaagacgcatgcttacaacgtgagagttgacataagcgagaaagcaggcgtaacctctacaaggctattagtaaatatccaaaagtattttttatccatcttgattattattggtattatgaaaattttctattttaaatacatttttttgttaatcacaatttttttgtccattgcctcttgcatgaaaatgaccatggcattcacactattaactcatcaggtacatcgttcatattatacacatacacgtggaataattgtcaaaaaaaactctgcgattattattgacatactatattgcttaaaaaatcgttcagttaaacttcaattgccgcgacattatccagtgcaacgcacggacattttactagtaaagttaaaacaacgagctaaacttgcaacgaactaatagcttcaacaaataggtttctgagatttttctttttttaaaaaaactccaccaaccatggcaggcctatcaagaaattccaagtcgacgtacggtgacgtgctagtattatacatatagaatggatttggcgtggaagaaaaacacgagattttcttagtgctgtgtttacatttcctccttgtctttgatgcggaaaccattacctcgtttttttttctaagtattaggctacattcggtacaccatttttctttttttaataatttttcacgcgcacaatttccgaactgcatgacaatatattttttttgcaaaaaaaattatatagacaaatttatttaaaaacgattaattatttttattttttaaactaataattaatgaattatgcgttacctcatttttttttgcaggatggagaaattcctaactcatcctatgaacgtgcatgcgtaggttcccatcctccactaactcgttttcccacgtgtacacttccggaactattgaacgatgatttttttttctaaaaacgaaaaacttatataaaatttacttaaaaatcgtattatttcattttttaattttttttaatacttaattaatcatatgctaatgagctactttattttccatgcaaagcgaaaacgttcccaaccaacaagaccgaacacaacttttagtgggattgaaatcatctgcagtcaaatgtatggtgtctttgtcattgacatgctgacctagggatcatcagactcatatgcaatgttctaaatctcctgctaagcttcttagcggttgagctctccagtatctaagagcagctatagctggctataactgcagctaagacatttagcagtttttgaaaatattagaaaaaaattcaattttttcatagaatttgaactaaaaactgacatatcacttacttgattgcacatagaggaggattggtgaaggggatggggaggaatggtggccgttcgttgtggggaagaggcagccgccgtcgccgagagaagtagcagccaccgccgggaggagcagtcgccatcgctgggagaagtagcagtcgtcaccgctgcttgagggagaagccgccgccatcgggagacgaagcagccaccgccgctgcttgagggaggatccgtcgccgccgggagacgaagcacctgccaccactgcttgggggaggagccgttgccgtcgag

SEQ ID NO: 27088 - DNA, 455 bp, Oryza sativa
cttgggggctttggtttactacagtatgtacagaaggtatagttttccaggtcatttttcccaaccatgggatagctgccccaccgcatgtctgccggtgcaccagcagatttaaaagaggccaagcaataacttgtgatggtaaatacagctagtacacctgttaatatgcagtgaaagatgccacaaaatgtgctgatcgagaaaacaactggatataccgcccagaccccaccacctgtgagacaacaagtttagtcatgtggaacagcagcacaaattgcatgaataaacaaataaacatggagagatcaagatggaaagttttatctaaagcagatgacaatagactcggaacctacatatgacgaagagcatgaagaggatgagcacagtcacaaagaacctgtcccggaaattcctccaatgagaaaagcatacactgtcaggttttc

SEQ ID NO: 27089 - DNA, 1309 bp, Oryza sativa
cgaattcgagctcggtaccctttggttgttggaactatatacaaacacaaccaaagaaaaagatatgcagtacaaatcagaaatactgtagcattcctgattaaaaaaaaaggtagactatcatttgtaagggaataatggtgtatgaaaaagcaaagctagcgagggaactggaggcaggaaatggaagatacatgccaagcatacataagtgagtgtagaaaggaacgggttgtggcttaactcaccaaaagtgaccatgagaagcaaactacaaatggaccctgggcaaggcgacaacacatggttccaatatcaccagatctggaatcgttaaacagtggtggtgccgcacggccgacagagcatcaagctaaccagcacccacagtattgacaaacttgagcaccttctatggcagcaaccaatcctttttatacagataagacaaaatcaattatcatatttgatattcatatttataattagattgcattttttctcttttttgaaaaaagattccacttatctattgaccaacacttcaaagtatcacctagagtagaaggcaaactgaagagaaaaacatagattttaacaatctttcaccttcttgtacatagaaacacaactgtaatgtacattaatctgctttttcattagccgatgaggacggtaattttaacagagctaggaagatgcaaaataaatggctcagcaaaaaagagtaagttgtgtctcctaggcaagaagttttttggatttaaatcaacagcaactatgaaattgtaagtcccttaaatataattgcatgaaagcacataaaccatttcttgcatacttaattaaactcctactcttaaacccaatccagtctagagcatacattttcatttaataaagttttcccgaataagtaacttgagttatgtcacaaataatgttttcactattttcaagtcagggttatgtttgccaggcaaagtcaatagggacccccaacatccaaagcaacattataccagctcggaaaaaaatctgagcatgtcaggttttattggctgatgtgcactgagtaacataagaaaacttaattcaccatcatttcacataataaacatctactgaatatgccagtattttacacggcaaatataagaatgctagaaaaagaaaaataatttgattcaccatgcaactttctccgcttgaacttttacagccatggttactcaagctgtcgatccacccccaagaagggtcatcatgctggaacaaaagtagtccatgcataacaataacttttcag

SEQ ID NO: 27090 - DNA, 1840 bp, Oryza sativa
  unsure (1)..(1840): unsure at all n locations
nnnnnnnnnnnnnnnnnnnnnnnnnnnnnnnnnnnnnnnnnnnnnnnnnnnnncttattcactacttagaatcccatgttatagctgaatctaatagttacagaggttcgcaggcagtgatcaagaaatatatgggggtatcaattttaattaaaaaacatttgcagttctacaggaaaagatttgccatctatatatgtaccaagatttcaagttctaccaagaaaaatgcagagtccctaagcagcgcatgtaggtgtatgaatcttggtagatatttgcacgggccataccattaatctctgacctccaaccattatatatatatagatatatagatggcaagcggctaagattgtggcaataagtcaaaagcagctcatgaccatggacaagcaagaatagaggaaaggtttgcactcatctgagaaaaaacatggctggcaggtggtagacacagaacgggaagcagatcagtcatgcatagatccaacatgaaggggatttcttcttctttttttcccttgcacacatcagaacgacttccccaatgggtcaaggggtgaggcaacagattgacctccttactatcgaactccatcaccgtgccgcggatctagtgccacgccgtccgctccctctgcttgctgggaggagagcggtgggggagtgccaggagatgggggagaacaggggagagctcgagggggaggctgtcgtcggcgaaactccatcaccgcacccaaatccaatcctgcaccatcgagtcccccagtccccttgctccactgggaggagagtgatggagggagcaccaggagaaggggaggataggggagagcgcgaggagcaagttgtcgttggcgaggagaagccggggagggaaggcaaggcggcggcggcgcaagagcggggaaaggaagagaaggggtgggtgaacagtggtggctagggtttgaggggaatggaggggatagggatgttctgttttgcagaaaacacccttactttccttttttcagagcgcggtcctatatttggaatttcgtctccttcacgtaggatataccaagacattgagggcttttacaaaagaatacaaaatacagaaacatacagtgagggacttaagaatgattatcaagttaatcaaggacttttttgcaagattgccagctccagcgcccagcgtggacatcacgggaagcgaacacgccagccgaaaaaccgcagaatcgctgtggtgcgagcattctatggtcctctttaatatctccgatatactgcactcttgtatattcccactggaaagagctgaaatttatatggctaatatttatgagaaattttcttctattctgctgtttctatatgtacaaaagtactatgattttattatattaattaagtattttagcacaaacagcgtcttggagtgcagatccatatcaatttatgcgattatattgtaaactgacataacatttcttattaaaaagacacaacctcataacatcaccatactgtttaagacttgagtctaaaagcatgtaacttcacttaattgcatcaaccggttttcccaggggttggagagctgctccccatgctcgaaatatatttgcatgctagcaatttacagaatatgaaataagatatgaccaggtcagaaatcaacctaagcaagcacaagacgccactagcacataggggtgaaaacggtacggaaactttccggattccggacttatttccaaaacggaatnnnnnnnnnnnnnnnnnnnnnnnnnnnnnnnnnnnnnnnnnnnnnnnnnnnnnnnnnnnnnnnnnnnnnnnnnnn

SEQ ID NO: 27091 - DNA, 679 bp, Oryza sativa
  unsure (1)..(679): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttagactgatctaggtacctggtacctgatacctgaggtatcaggcctgttacatatggtactaatccggataatctgggtaccagttacttgatacctaggtatcaagaacatgatacccagacattaaatactgtgagtaccatgtcttcacaccgatgagagccatgaggagaaaggaaataaggaaaaagcaagcgcgaaaatgagatggctacttccttagaggtggagggatgccattcattctcgttgccatccttgattcggagcgtcgctgccctgatcctcgacacccacacaagtgtgatggtcgcagacatcgtttgcgacacacctcaactcacctcccaccttgaactcgttgcatctcttcccggaccctagcatacgagagccccatggccaccaccggcgacgtgacattagcatagcgagcgctggacaattccaatcttgttaaaggggggtaccgagctcg

SEQ ID NO: 27092 - DNA, 891 bp, Oryza sativa
atgttgcaaggggcattggctcattagggtacaatcggttcggaggtagcagtggaagcggcactgctggatccaatggtgacatggcttagcctttcaacagtgttgcaggattctcacaggccaatcaggaattttcatttgccacccaagtaatgcgagactcattatcacttgattgcctggacaacatggcaaaggtggactttttctgagataatattttgccagagaaagcatggtcaactatcgattttggagggtgtcaatcactcctttatttacatcccaatatatcattcctttctattttgtatcccatcatcccatttccctttttaataataatttcgcttttcccttttttagatccctacaagctagtcttggttcatgtatttgttgcatctgattaccagcttaatgcttataaacgatgaaattcctatctagaaaatgagcaactagaaaaacaagatctgagtggataaattaaaaaaagatctatgttcaacacaagaaaaatcttaagtgcgaggaaaatgatttttttgtcgattcagcctacaataccatatgaaatagttgaaacatgaaacttagtaaaactttaattttcccacaggatcttatgccagaagatgaatcttttcccatgatatttgttgtcctaacgaggcagacacgtttttcctatctttttttgcatcgtgctggttttaggtgaccaaccacatgtaagctatatttggaatgcaaccacccataacagacatgattaaagcatttatgtggtgcaagtgcctcatattgccgatacatttttgtgtttttaatgaaagaacatacagtttgttgggacaaaatattatcttagcgaacatggcaagt

SEQ ID NO: 27093 - DNA, 865 bp, Oryza sativa
  unsure (1)..(865): unsure at all n locations
nnnnnnnnnnnnnnnnnnnnnnnnnnnnnnnnnnnnnnnnnnnnnnnnnnnnnnnataatctgctcgatggtgagaccatcgaggcttgggtggcggccattgatggcttcaatgaggagtagcttggtctcgctttcatcagcttcgcgtcccagcttgtgcaacttctccttgagcttgtcgatctgcttgttgaggatgccctctaggtctatcatcttcttgtatctgcccagctgcggcatggccttgaagtgctcgagaactctggtcgcctcccacaccgacggccaaaccttcgttgcttgcacctcaacctcaccgtacaccatgaggaacagtgttgcgaactcactaaccttcttcatcaagcccttcagatgcttcctaaatgtcacccgccgcttcacatcaatgacgatccgcagaagcttcatcttcttgcgagccatggcctttgcagttcaccactttctagcaagaatgcacctgtaaattgatgagagatggttagattgatgtgaaatcaaagaaaggggaatatggtggatttatagtgggagatcatattgcaacaatcgccatgatgtggaaagaaattattttgcaaatccaaaaatatcaaatgaatcaatgtaagttaatgctttcctgaaaaaaatgatcggttaatgtgtagctggcgagcatatcttcaacctttaatcgtgtccgtctttagaaacttccttgcaggcatgagctagcaatagccaatagatattactcgctagatgataatgagttcacaccaaagatacgttnnnnnnnnnnnnnnnnnnnnnnnnnnnnnnnnnnnnnnnnnnnnnnnnnnnnnnnnnnnnn

SEQ ID NO: 27094 - DNA, 13622 bp, Oryza sativa
  unsure (1)..(13622): unsure at all n locations
nnnnnnnnnnnnnnnnnnnnnnnnnnnnnnnnnnaaaagaaatgaaaatccgttatatttgtggaaagagggagtatacaacactaaatagcatgacaatgaatatgtgtgagtgtgactacattggtgcatataccgatagttgtagtcggttgcagtacccaataccaacatctgacacatgtctagcatatcaaagccttataccagtatatataccaccagtccaacacatcgatctgcaggggtgagttccagcgttctgtctagctaggttgaacaaattaaaatattcagactatacttcaacagttacagtaccaatattttttcttccaattcaatagaaaacggtagctctgctgtcccagaaaacttgaatatgccacccttgccaccatttggtcagacttgtctgagttattgaatagaaaatggtagctctgctgtacataatatgtgtgtgtctgtgtgtgtatatatatatatatatatatataaggttttattatttatcataggtttgataggcatcaggaacatctgctcgctacgcaggaagcagaaatgtaagatagcagaggattattgcgagctctagagatgcatagtacagatttggggtgaacttagtagcactcttcaaaatctgccacctagaatgagatagggcatatcgacggccccatctagatcagtatcatctctatgaggcaggagtgggagcccgagatccctatgtaagaatatgaagaaaggtgatgatctgctaaaagagacatgagcatgatgaaactagttattctagccagctgaggctatcagcttctaatcatgaccataaactaacatcaaggcatgtattaaacttgattggaatcgtaattcttacttttgccttatttttatttccatttttttattttgtaggtatgtgttaaaattttaaagctttttttatattcacttgagtattaatttgccaccttcaactatatattctcatttttttttctgaaatttgtgacgcaaaggacctgtaattaacggttatatatgaatactcttccttatatattttcatttgacatgcaaaaattcccatttcaaataccacaatgttatatatgtgggagaaccaccaaccatctctggctttgaattatcccaacgcgtactgaggcatctatatactaatgttactggactcggtctgaaaagtgtatttacttcattttgttgatcatatatacaacagcctgtgtaaaatagttgagggcgatacactcaaacaacagaggcaaccttgtcatgcacagaacatatgacaaattactatgatagcagcaatggttttttaatacattactataattttgtagactgatgattaccaatttatagacgtctttagtgaaccacctgtgacctaggcctgtaaaaattaatcaacaattttcttatgcgtttagaaggaaccgcatgtgacaatcacattttcacagacatctctcttaaggaaatacttgtcaaaatgaattccagtgttaatttgtttctgataatcacaagtcatgcgaaatatgtatgcaagcggtatataggattgggaccctaatattgttactccatgcgtggtcttcttggcatcttatctatgaaatacttcattactttggcacgcatgctattcttttgacttcatctctacatacatatttggtgctctaaatgacatcaaataaaaacgtcattaactacaaatttcatatttagcgctctaaatcagtgcctcctctcttgctttttgtactttgcattgatgctgtcatattgagtaacttggtgatctatttgtacatgcttatatcttgttgatcaccttctagctctagtatataagtagtgtgcaaagtactctatctataggttttattttttctatgcagggtcggattgtcctatcattgttagagtgtcaaacacttagtgttgtcggactgtccagcaccgaggtggacagtacgagcctatatttccactaggcgagttcatgtttttctctgtgttgatcggattgtccagtagctgccgggttgtccgcttctgtgtgttgttggactgtctgcagtggtaccggattgtccggttgttctaatttccattgcatgtttatgtaattgcaggaaacgcctgttcatcatcctatgggccatatccatggtcctcagtgcactttcatttcatttaagagcttttcaagaactccaatagatctttcacgacctgcgaaatcgtttttatagaagtgttgcgtgggagatttggctccccaaatggattccgaggtgttgcttcccagtgtaaagtaatgtggtacaagggtttgattttgttaccttaccgtttaatcccaattagcactaaataacttatatttttatttttaaatagttattgacccgtgtattgcaacagtatttttatagacgggaaggatttatttttttctttttttttaattctgtagtttcgtggatgcgaaagatttgggcgaagtaggttatttggtttactctatacagtcgtagattttttttttgggaaattgtttttttagttggacggtttttataagttgggagaggttttcacgtatggaaaatgagagggggagtggccagacaaaagaccccatttatgtagtagagagctataactgaacttgagatatgtcgaaactactcccgagtatagcaaactgctataaatacaaatctttgtagtagaattacccctacattttggtttctctgagtcgatcagcatatggagataaaatatgacctcaactatcgttgattacgctatatgtaatttcaagaatttcgggaatttgaggcactaggaactgcaatgagtttagtttcaaaatgttgttataggtttagccaaaccgcaacacctcggggctgaaattaagacaggaggatagccatgccatttcgggtctttgggatgagagagtggtgaattttggttgtacgatgcgcttagctgacataagttttatgtcgaaattcactttcatcaaaggttttaagtgtcatgcttgtgttcaaacgaaacaatgtcgcaaggctcacaacacatttgaggcaagaaatttggcaacgctagaacttattcatttcgatatgtgcaaaatgaatggggaaagaaatacttcgtgatacttatagataattgcactagattctgttcaggattgggagacattgggaatcttagagataccgaatagtttattccgctatgggacacaagcgattttgctggtttagctggtggagactataacatgggcgattagggtagcgttagttgttacgattgtttacaatgtagtctgaggccctgtttagatcctccaaaatggcaaaagttttgtcattctgaagcactttttgccattttggatctaaacactagtagcaaaatttggcaatttggcatttgacatttgctagtccatagtagcaaattgtgccaaaaagtgctttgggaccactccctctctctttctctctctcactttagtgctagaatggcaaaagtttaggatgcatctaaacaccaactagtactttttcaataccaaaacttttgccaccaaaacttttgccatttgccatttgccatttcaaatggatctaaacaggccctgagttagcaagctaactcttaccctgaaaaaaaaaagcaagccaactcttagctaatctgttcgtctgtgcatgctgtgactgtgaatcacaacttatgatgtttgcttctttacgattcttgtatgtaggatagttttctgtagaacgagctgtgttctactctccaagggcctgtgagttagtccgttcattatgattcattataacaatgtatcaactgttgcatcctggatagtttggttttttgataactgaaagacttgcatcacccgtttttcttgtacgcatggcatgtgtggagcattgaaggtttgtttacaagtccaaatttattgcacagaattctattcgtagacattttggtgtataaaagtttctagacttctagtgaaaagcgagaaaacaagttttggaaaggctaatgattatgcctggtctgtattttggaggaatatatgctaaatattagttatggaaatgatttattttataggattgctcgtatgatgaatgtgacacatctccttataacaatgaacaaatttgtatttcaactaacaaacattccggcatacggagcatatgattgtgaacattgtgggcatcagttttcgttgccattcataccaaagatcatcagctcccacataagggttttcccttcaagactttactaacggcaagtccttgcatatgtgtagccacaatggttttattttatcttgtgtcgtagcttaaagttgcaacagtgaaatctgtacagtgtagttttcatatgcggctcgcaacgtgtaaccttcagcttataaggataactgaaaattcgagttttaaaacataatttttagagttgatttcaggttttcttcacttagccttcagcttataaggataagtgataattcgagttttgaaacataattttggagttgatttcaggttttcatcgttgtagtttgttttcccatatttttttaaaaaaattactaaaggacacacatataaaagttttacatgcaaattattttctattaaattattttttgtcattaataagatgttttacttataataattagttataaataaaaagatgagatatacataactataaaaaaaaggcagccctgctttacttacagtataattatatacctcatgcatacatgatcactataaaaaggcagtcctgtttcagtttttgctgcagcacgcaaaaagaaaatgtgaagctcccaagacaagaggccatatcatgcactgtagtcaccttagatttctcaccgccattcaggagtgggaagctttaggaatactagtacgcttgttgtgcagtatttgtcctagctccacatacaccaagaaaaaaacaatgtttgtaaaatctagggtttgcaagggtgcagtgcggacaggaacgaaactgctcactcctgctatcttgcgtgttaacccggtccaggcccctgtgtgaagaacggggctgaaccagtctccagctcttgcgcttcttggactccgtcacccgagcaagttctccgaggccaactatggtaagggattccagcttcatcggcatagctagtggggcaatgcaacatgcagcgtcgtggctattggggctgacaaggatacgccgacaaggaggagcagtacatgcagcatcgatgagcaccggctgtcatatcgtgtgtgcgtcgacatattgctgtggggctgcggactaggattagtttatatattgatgtgtaattgcctccaccgagtgatacttgtaattggagtatattttaagtggttaccatatctcctaaccacgtgggtctataaccatgtccccacctccgacaccctatggggtgaactccccgacacttgatcggggaaattgcaaatccttgtaaaacccttcacataatcttggatataattgatgaatttcctgcttttttccctgaccgaaagccagccaagctcattgagaaattctacgccatctcatgtcaccttaaggtcgacacgcgcaacaaattctctaccatctcgttgacaaataatcaacctgtgtgaggtgccttcacacagtttcgttgccttcgtaaaaatctcaatcttactttcatgatgtcttgacattcatttttacacgtgatgaactcgaacatacactctgaaatcatgtacagtcgtttattttggcttgtgctgcaggtgatagcatagttaattaggttgcaatttgatgtttcttacagtagttttcacctgcagtacatgctcttgcatgtgcttctataccagctcagaccatataattaacttagggagcaatggatggccggatcacgctcatagtctatatgtccagaagcccttcattatatattctcacctcagcaagtcatgttttgggtgggaagcatcggaaattgtattgtgtctatttgacactatcgaacaccagaataatgtaccacttaattttactttgtgcctgaacatataccacttaatttactccgtgcctgtcatacactaagtccaataagcaatgcacaacatctatttacctttgcatataaactaatgtacttatgttgttgtactgtgccgtaccagctatcttgttgcagaaaagatcaacttgtgcagacacgtgacgtgctatatacagcataagtgtagaatagtgaacttgttttgacatggacagtagaaagcaaagctctgtataaatactagcacaaaaacctctgtttgttcgaagtctaggccatatatgtggagagaaacagtggaagactccaactacgtactattgggtcagctctcaaatttaattcatctccaatacaagccttcacttgatgacgagttctaggaatgggaggcaccaggaacagctgcgagtttagtttcgcaaactctatctaggtggagcgcgatcgcggtagatcataagagcaacagtgtccacatgattgccagttaagccgctttggcctcttggaaaggatggagttccattcatggtttacatacttgcctagagcaaatgctgctccaggctttactactaattaagctgtttatggtgctgggaatcctaccatgtggcagcacatagtaaaacattgtgtatcgtccaaaccggatgttttttccatttcaaaggcaatcaatccttcgcgagtaaaaatctcgatcttctcgatagggattatacaaaattaatctacgtacaagcagtttttcatgtaatttacatattaaacttgttctaatctaggaattagtgaagcggttctctaaaaaaatatattatatattaaaagtccattaatcatcctacaaaagctctcaagcagccacttagcttcctaaaaacgctctcaagccgctacgtggcactctaataaattagagaaaatcctacaaattctgagaaaaagcaaaacatctagctcttgatttttacttaaattagtgatcctgatatttcaggctattagattaaatctattaaaatcattccttctaatatggatggagaggaaggtacaatgactattcgtaaacagaaaaaaaaaccaaaaagatccttcctatgctatgcatatggatggagagcaatgttcgtatgtactacctaaaaaacaaaaaaaaattacatgttacctttgtacgaacgtaacgtacgtaactcctaaaggataaagccaaaaaaaccatattatatataaaattactctaaactttctagaaacgctattaaaccgccacgtaactcctacaaacactactaagccgtcacgtggccctctaataaattagagaaatctaaaaaattctgagaaaaaaaaggaaaacatcatatcattgattttcacttaatatggtggacccatcattttatctcctattatctcaccggctcacttttatatccaaattttctagctagcaactcagtacataaacaataagcaatgctatattaactatctattatatagtaaaaatcaaataactccctacaaacactctcaacctgtcgtatgcgtggtgtgctacaaacactcctagatgctatatagcgctcaaataaattaaaaatcctaaaaattatgataaaaaaacaaaccattcgttttccttcaaataggtgaacccaataattataagtactacaataaatattttttaaaatattgtttctatctatattgattcacatgcataactaattgcacatatatgagaagtaattaaagagagggcttgcaggatggtaaaaaaaccaatgaaagtttgttgagatttcttcacgaaagagagatataaagaacactcaattcaaaattgaaaataagttactttaattttaatttgttttgttagaactatttttgaaacatactaatgcgcatgcccccgcaaatgtgcgggctatcttcctagttcattgtaaaagtgtatgcggttttttagaagtctgtatgtggaaaagtttctttgccttccttcttttagaatggcgaaaattttaaaattcgtagaaaactttctttaatattttgagcataattatgaagatatttttttatatggtccgactatataaaataaatatcataacggaaatcaacttgaacaatgctgtaccaaaactacagtggttacttccaaagtactactccctccatttttaaccaacgtcgtatacttaaataaaagagagtatagatctcccagcaaccatctgtaatttagttttacgtaatcttaatttcaacgaccacgcttgcactccctaaccactcctcgtttaatatttaaaattacggtcatatatcctcactatatatctcaataaaagacaaacaatattatttggtatttgtggacaggaggaggaaattacaagctggcatgactactacacactattgtttacatataccatcccatggaggatcataacaaatgtcgttgctatagcataaaatagcaatcagagctgctgttttgtccattcatgctaggagacacaactgatagatgaacttctatatatagttttttaggccggtgtgtcctgcactgcatatatccatagccttacggttttggcttgggaggactcaggagttgtagtgatacgatttcttgctctcctgtagcactcgttagttcgagatgggcatgtttacaggttaacagcaagcactgatcaaagagtagtaataccttattagggtgatcatctagagatgatcccgtagggtagattcaaataaccatgtccctgtatcgaagtggacacagctcgaaatgggcgaagctagctgtggtgagctgatatgtgctagtatcaagatgatttcttagcgctacgagcttcacaatggtcaccgtgtcctgaaaagaagggatctggagttttgacgaattaaaggctataaacacatcaagaaagaaatattaatgcattatcaatagcagaaactgcgaatagtttttcaatctctagggagcccaatcttttttggggttattctccaaaattgctagttaaatcaatttcatgaaaattaaggccattggcccacaagttctcctcttgaattgggcctcataaataggctctaagcctcaaacaaggtagctgtatcccggtctgcagcaaaccaaatttggtctgttggtgtatattctaacaccctgaataaagtgccacttaatttacttcgtacctcaccatatatcacttaattcacttcatgccagacctacactatgcccaataagcagtaatacgcaacttatatctatgtttgcatataaattgatgtacgcaactcttatttatgtttgcatataaattaatatatactgatgttgctgtaccgtaccgtactatatgtatcccaaattgttgcagaagatatcaacttatacagacatgtcaaagctatatacgtacatggatgcctatataaatacttgctcaacctctgtttgttccaactctgagtcggttatcttggatagaaacagtggaaggctccaacttctattggttcagctctcaactttcatctcctaccagccatcagttgatgatgagttttgggaatcggaggtgccaggaactggttcaagtttagttttgcaaattctatcgacgttatggccgatcacggtagaccataactgcaacactgtccacatgattgccgagccggcttggcctctttgatttttttgaaagggctgcctgcgcctcctggggtacccaagcagggaaagaaattcagatggaggatccttgggaaaagttatagagttctattccttgtactttctttgcctaaaccaaatgatgctacagcctacatttctgcaaaaggctacaacggatttttgcaagcgggcaatgcaagcgcttgccccccgagtttatctataaaaatgtaaaaatcaacattttcccatacgagtagcaaaaccccatgcagatggtaattttcacataaggtcagttatgccatccgtttgcaagaacgaaaatcacaacaaaaataaaaattcaaataggcaaaaccctagctcaaatccgcccttgccgccaccatcgtctatgcagtccgctaccactatcatctttgttgagaccccgccactcccacgggcagagctaacatcaaagtaagggtggtgcactaaccattgaaaatctataaaaatttcgatgcaaagctgcatattctagtgtttttaagtgagacattgtaagtttagggggttcctgtgcaccacccaaactcaacgtggctccgccactggccgcacccaaggccaacaacggcgaatccgcctttcccggggctgtggccactagatccaccactgctaagcttgccgccatcgtcgtcaacgccactgccacacttgacgctaacgcatgtgaatccgcccctcctagggccagggccacccatcattgtcatagccagatctacaagagaggccagtggcggtggatccaccgctcctgaggccgccgccaccagatctgcgagggagaaggctggctgtgctggtttgcatggaagaaggccgttgccatcgggtctgcgagggagaaggccagcatcgccggatctgcgaggtggctggcagctcctgaggaggtgatgctgttaccagcgtcaacgcgagcctcctctgctagcctcctcgagcgccgctagactaaccgtcgccgcagtgcaccaacctcctcatgcacctctaccggcctacaagtgagagagaagtaaaggggatgaggagcgcatgagagagtaagagagaggaaagtgaataaatgagactgaaagagagagggagagggagtaaatgggaaagaggatgaggatgtgaagcggaggagttgaggggataagaagaggagggtaagcttattaagagatccgcgtgcgaaaattgatttgcgttagtggatctgtactaaacaccatccaaatatattttttacaaatggatgttctttacgctcatccgtgatcgaattgggggtgtctgtaaaatttgttttattatagtggtttatggtgcagagaatactattattaacattgtatatagtgttttttatagcttgtacagcgtagtacattgtgtttttctgacatctaaaccaattttccatttcaaaatcagtcaaccattggtgatgagcaaaaaaggagacggtcgtctagactcatgtgcgtattctgtttaccaaaagttcagtgttttacaaccttaagtctacaaacagacatgcaatctgcagctgaaatttttacattttagttagttttaaacatttatttacaaatatattataagaatgaacctttttttttctcagagccaagttattggcacaaaggttcaatgtctcagagccaacgatactaacgttgacagcccttgcccatgtttatagcttaggcactggtgtaacggggtcattattaaagagactggcgtagataacataattgtaaattaatttcttaaaaaggtcaaacgtaaatgctttctatcaaataggcccttgacaccagcatgtgttgaggacctatttgtatgaaaagatatttacatttcaaccctttttagaattacttttacaaattggtccttggttgtcgactcctccacatattggctgctacagtgtcgagggtattggcaccgagacattggacgtaggcgccatgaaccttagcatccagaaaagggtatattccagtaataagcttttatatgggtctatctaccgaataagtttttgaaaagggctaaaatataaaaaaccagcaatctgcaggcatgtgcaaatttgtataatagtagcatacagagcatcatgcatatatatactagttcttaaacactagcatgtgccttcatctacatgttatatatatacatggcacagcagttggaagaacttcatctacatgttgttgaggcatactgaattattagtgaattatatacaccgtttatctatgcaacactataaaactaatcgctttggattgggaggtgtcaggatttctggtgctacatctgttagcactaatcttgttgcatatgattcttttattgttaattagttttgtctagagtgatcacgtcatgtgttagacgtgattacttggtgacgaacaataaaagaatcatatgcaacaagattagtgctaacaattgcccccctaatcttgttgtctttattttggaatacctagtaaacaatcttcacaggagcgttggctcgtcgtccgcggtagcgagcagcgcttcttctttcttcggtttgcgacattcgttagcataatgaccatgtatgccatagttgtagcactttaccttcttcctatcaaccttgcgctcgctactgttggagtcgctgccgtcttctcctttcttctccttgatatagagattctcccattgtgcacgtgtgagcaacaaatactcaacctccggttcgcggcgccgacccttcaaggattcctcgaacgccctcaagcgcccgattgcctccgccacggacatcttcgacacatcaccccattgctcgatggtgccaacaatgtgaagaaacttgtcgggaactgcactaaacaatttctccacaacaacactatcttttgttggcccaaaaccaactggtagaaagcctcgctacaccccaaaagctagctcaagaggtgaagggcttcccccacttttacttttaagttggttcaactccccctagattagcaatgttggactattcccaacaacatcgcgggttgttgctggaagaaaactagtttgagatgcgcacgtctacaggccaaccactgcactgctaggagtgatcctgtgtacaagtgatcctgctagaagagaattaaagcaaatcccttggtaaactactgtacgtacttcgtatcgttcgtagtaaacctttggtagatgcttcaaaagggtcagagagaagttcatgaaccgtgaatgaagggaatcccgtttgtgagcatttatatatatacatggcctcgatttcttttagtatgtatttcaatgaaattaagaatcgtttgttattataacagtgcaaaagtttggccttcagaaaatgccacttgttaatatctcaacttggttatatattatacagttctttaattagtaaggcatcggaggctttggaatgtactttttatttctattctcaacaacatgtatgatttgatgtctgttcagtactctnnnnnnnnnnnnnnnnnnnnnnnnnnnnnnnnnnnnnnnnnnnnnnnnnnnnnnnnnnnnnnnnnn

SEQ ID NO: 27095 - DNA, 18237 bp, Oryza sativa
ttaaagtactatgagtgataaaacaactcataacaaaataaattataattacgtaaattttttgaataagacgaatggtcaaacatttgagaaaaagtcaacggcgtcatctattaaaaaacggaggtagtatttgttagtcaagaattgtaacccattaagtgctgattagttcattagacattaagcctgttctaaaaaaatgcttggttaaaatacagttctttaatcagtaaggatttggaggcttttttgtttctattcttgacagcatctatatttcgatctctgttgaatactattttgtgtagattatattgatcatataataacttgtttacattgtatactgccaatgcgtatgcggccaacgctactagagaaaccaccatcactaacgggtgaaaacaactattattatattgttcacaacgaagaacactacgaaatggaggggggagaccaagaagaggaacattagcttatcgtaagaacaagtagtgttcattgttttttctttaatatgagatgtgtctgatttctaaagggctaaatatgtcataaacgtttaggaataaatttcttctttcgttgttaataatggaaacttagcctctttcataccatacatactgtctaagcaaagccccaataccactctatcttaatttgaagaactatattatattatacaagtttaattctttctatgaattggcaaatgccaagtaaaggttgagcataaatactactacctttgtcccaatatataacaacttttgactataaatttggacacacagttatctagatttatagctaaaaatacttatattttaggatggagggagtagctagcccctatgctgcaaggcactagatataaaaggttcccactgtttactacatcgatcctatctacacatgtaccagaaaagtaataactttatggttttgggaggagaggtcttgatcaagagctctaaccctagctgcgtattagctgctttgtaccagtctcatatttatattccgttctagatgtttgtaccagttatctccggttaggtggtcgatacatacggaagattgcctatgcatccgcttgagttttcgttccgtacgcaacttctatgaacttgacacttgcaccattgttgatacgcccctcttaagttctcatcatttctttctcttgcacccagaaaaggttaattacctgtttaattattaataattcaaaattggacaatatgataatgatagaaatggttgttctagaatgtacatgtttcagactatatacagatactccctatgtagaagtcgttttggacagcgacacggtctccaaaacataattttaacttcttgttactataaaaatatttattgaaaagtgatatatgtataattttataaaagtatttttcaagacatctattcctataatctttacattttcaaactcaacaacttgggagttattcatgatttatattttcaatgtttgacttaaatattattataaacgacatggaggtagtacatgtgttgtgtctgttccgtgcaagcacagactcgcaagcattgtttgtgtagaaagcaagcaataaatccaattaattgtaacaagaaatgttctggtcaacaattaataccagccatgttcatgttatttgttttcttacttctgttttcgtcaaaggtgttttgctgtttgctttgcccttcattgttttttttttttggaaatgtatcgtttcaaaagaatatctgaattttgtgaattataatacgtatttttgaaaatctttgttgttgttctggtattttcgaaaattgaaaaaaatgtaacattgatttttttttaggattcttatgaacttcaatgaattcattgagtctggcacttaattacaaattagttgagaattttgcaatatgtcttctgctgacggatgcagccaagcagtggcagcaacgtggatcgacgtcttatatatccacgaaagggcaaagagtaatgtaagtcaagtactactagagttctttctcctctctggtaaagccttgagacagaacccatgcatttggcagcattcctggccaaattatatcctccttgacattcaggccattattttataaggccaaaccccactataaatactagctagtatacctcttcatttctggtcgtctcaagcagtgtttggagagacagggaaagagttgaacttgcaatggttcacatttcaaatttaatctcctgaaagcctttagtttgggttttggaggcaccaggaactgcgttggcttcaactctccgaattccttctaagttttttgcaatcagcacagtgcagacttgtcattcagtacgagaataattgacgaggtgatttggctgcgcttggaactgaggagagtttagctctttgtttcctactcgcctagtttaaactatgctagactcaatatttgtactcggcagctgccactttcgtggggttatccaatagggccataacataacaaatttaataatatcaccagctgatatctgtaaaaaaggtagtcccacatgtcagcaagagatagctctaaatctctaatagctgatgcgtatgatagctagctgtccaactatgtgtacatccaaaaaaaagagtaaatctttaatctggtaagtttgcttctgtcccacctagtcaggctatatccgtgggggcgttacaaccatgtggggacagcagcagcagctaaacttcatttcagcagattagcagctaaacttcaacttactcgctttccattaacacatatttcaaattgttaaatggtgtttttttcgaaatcattttatatagaagatgtttaaaaaaatatataaaccaatttatcgagtttataatgattaattcttaatcaatcatatgctaattagttttctagtttacatgcgtggagaatgtctctttgaagtctgcggctaagactctctttcctctccagccatccttagaccctatttagatgtgactaaaactttttagtccctatcacatcggatgtttggacactaattataaatattaaacgtagactattaataaaacccattctataactctggactaattcgcgagacgaatctattgagcctaattaatccatgattagcctatgtgatgctacaggaaactacactaattaaggattaattaggcttaaaaaatttgtcacgcgaattacatcgtatttatgtaattagttttacaagtaggttatgtttaatactccaaattcatccgatatgacacggactaaagtttagtctctggatccaaacaccaccttagaactgatgtggcaatatcatcagcggctagcctatcctgctttacctgctcttaggatgactcgacctctatctgatgtgcaagcattgtaacttttatatggctgcttggaagttatttaaagaatacaactactcatgcaaataaacaacttttcattggaaagtagtgtttcaattctgtacaaaatgaaaaagcccacaagtaagccagagaactgcctagctatcagattttatttatcttttttgtctttcaccatggattgctcttctatcagacaagtgtgtcatttttatcgaataacccattcgctcatattaaattatcgacgtatacattgctattgttttttttctaaaaaaatgaattatttggtattattagaagaaactagaaaggtaacccgtgcacatgaacgtgcacctaatttaatatgtgtgaaattttattatgaatgtccatgtatgggtgacctagtattaaaatattatatctaaattataattgaacttatttaatgtgcttttaaaattagttatgattttgttctaaactaaaattactcgaaaccgtataattttcaatttatgagaaaatattatgtcgaaataatatatgcagttcctatgagaaaatttagggtatttcaaatccccacggggatatcttagcccgaacattttcccaaaaagtcaaaaaattgttacactctatttgaaattttagaatgagatttctcattctattagtcctgcaaaaatatttgaatatttctatttagaatgggttttgaacccaacaattatttaaaaattttacataaattttttaatccttttcatgtccatttttttaaaaaattggaaaactccactctatcaagcatatttgaaatgatttgatctaaatatcttcaattgagtaagaatattaaaatagaggtcatataataactacacatttctagattattctacgctaaatcttaggaatttaccatgtagcatagcaagttttaccaaaaagaataagtgaacatggtccttaattcttatatgaaattgacttaatatattggtaatgaaacctcatggttgtttcactgctaagatttctttctgcagcccacatgtttggtacaatcagtatgatcttcaaccgagcacgtttatagtttaaaaatgttgtctatgaaaaattaacactagaggggtacacattatgacataaaaatagatatcatttaaagatttttctcgaatttcttagtgaattcatagatcatatatataattttatctcctaaaagatcatttattgataaaagtaccgaaatcaaattgcataggtaaatagcccccatatacatgttgagataaattaattaagttcatagaaagttgttaggtgtctaatgggatataagtaatgggtctaccggtattattaaaaattaagatacgatattttgatttataatgacgaattttattttttatatttaatggaggcctcaagatggatgtggatccagaatgtaatttttatgatagcatttatatatagtcaatatggatattaaagtattgatttcatttaaaaaatataatagttcaaacagaacataagttgaatatagattttaagaagtgctagtaagagaagaaagagaagaaaagggacagtgggagagctagctagacaaaggagggcgggatctttttcttaaaaaatgattgatataatgacctaaaataatgtgttggatgtttttaagtcgaaaccgacggtcagatgttttgttctttttcataattttatacgatttttttaacttaagagagacatgtagtggcttagaaatatttataggatgtttaatgtactttaagtctttaacattgtagaggcggggcgggaggaaagaaggtttggtagcttttttttaaaaagtctaataacaatctaaatggtatgtccatcaatttaagtcgaaaccaatggttaaatgtattgttcttaaatttttatgattttctctaatttagaagtgtcacatagtggtttagaagtatttataaggatagttaatgggttttaacgccatatgggagcgtagaggaagtttgggattttttttccgtaagaaaaagaaatatctaataacctaaaataatgtaaaaagatggtcaaatgttttagtatttttatattttctctaactttagagtgcgatatgtttagaaatatttatatgatgtttaatgtacttattaggagacgctagctagtaggttgatgggcgttttagacccgtatttttttaatccttattattattatggatattaaaaaaaggaaaaagggaaacggatggatcatacgtacgttgctctaaaaatggatagtcgtacattgtggaggcgtacgtggatggagggagattttgttttctcgtgaagataaatctaactatcaaatttaatgggttcaccaatttaaataaaaattgatggttagattttttctattttattagagtgacatatggtgacttgagagcatttgtaggataccacatggcgacctaggagtgtttatagaaggtttaatgaacttttagtatataataatagatagatagataataggtagatagatagatatctcatgagttacgtgtttagaatttgcatatttttttatccatgacattaactaatcaacattagtaggaaataggaatagctagcctcttttacgttgtatatgatcggagcttaacatagcctctttttaagaactatataatatcaattttttgattgattgtattttattttttatatattttttcattcaaatagaactcgtaaaatgtttgaatttttctatttacagtgggttttaaatctagcaacatttgctcaatttccaattgtaaaagccgcctcaaggttatttcactgttaagattcctaggtgcaacccacatgcttattggtatgatgttcaactggccacacatttatttttaacctattgtctatattgctagatgaatacctattatgattagtgacttcatagatcatatgtgtaattgggatgctatgatcatctttcttatgaatatttatttatctcctaataagatcgttttaaaagtatcaagatcaatttgtataggtacatagccttcataggcatgttaagagaaattaattaagttagtagaaagtcgttagaagcctgacaggatataagtaatagatggaggtccatttgtgtctttttttacatatagataattttaatttcagttgataaggagataaaaaatagagagaaaagaatggcgtacgctgtacgcgagcagggaggaagggagatttcggatgttctttttctaaatgattaatctaacaaactaaaattatgtgtcagatgttcaagtcgaagctgatggtcgaatattttgttttcttgtcagaatttttacgattttctcttatttaagagaacgacgtaatatcttaagagcgtattttctccgatttaagagaacgacataatatcttagaagcatttataagatgcgcactttttactgtgttacaatgttggggtggggctatttttttaatattactcatagttctgttcattttacttttattagatataatttaactattatcaagttatatacgatgacaaaaatatatatcattaatttttatagttttaaaattgcttaaatgacacgcaaaagtcagaaaatgtagccccaattaatgtgacatttctctctttacaggtgaattaaagaggacatgagttttaaaatgtaaaatatctaaagacataagcaaatcaaatattagcattataatttagatgctgcatttgcttaattgtttggcatacaatttttgcttttctaaaagaatgaaaataggagaaaaaataggtgataaaaggggtgaaagaattagggggggattgagcagacgcaagtacgtatgtacatgcaattgccaacaacaggccgaggtgggcctacagataaggatatgtttttttctaataaatctaatggttacaaataatggtccataaaatttaataaaaatcaacagttatatgttgtgtcattttaagaatttctctaatttattagagtgccacgtggtggcttaggagcatttataggatgccacgtggaggcttaggagcgtttgtaggaagtttagtgttgattaattttttattataaatccttatgtggaagacttttaaggaaaaagtctgaattacacccttaaacaataagaatggtacgaattgtcctggttatatataatctgatctctcaccatctttcgcaaacacataagctaatatattttttgttttgttttttcttttattatacatctgatttagatatgtatgttcatgggtaatataggatggaataatctatattgtcaaaattatttgtcctaattattaacattatatagatgagaatgacataattaaaaagatataatgtggttctatgcggcattttcgatgatatgtgtatatgttttttctagcaaatactaagcacatattttttcctttttttggagacaaatattttttctcttagggcaggtgtgtgtatgtgtatttatatgatgggtgagcacacgtttatatatgcgctcgtgattgctttttttaaggaaacgtgattgccttatacatcattagtaaaaaaatacttttaaaaaatttagcgagatggcgtgaagcggtgctgcggccgcgtgaattctttgacaaactcgccaagggtggttgctacacatatgcacaatttgaggaaaatctcagagccacaaagaaagaaagaaaaaactactcgatggagctgatcttgtacacattcttcttttttttttcctttatgacatctcttgcgtagatatagatataaaataatggttgaaaataataaatccatgggttatgtataaataagttgctagattttgttttttatatataggatgacccttatatatatacagcatgtactcctgggtgtatagaaccatttttctatatattttttgttagataagcacgggatatgcaatatttgatacttaattaatcttacgctgatggcatgctttgtttcgcgtgtcctagataagctcatccaatgagatagaccgaatgaagcttaagagataaaagggcatccacatggtgtaaaaatatatatatggttgttaattttccaaaaaaaatatatgaatacagaaacatggaatatatgaaaatacattcttgataaatttaataatgtcatttggatatatcagtattacacgatagggagtgagtaaatttttaaaatgctactcaaaatttaaattgttttttaattataagtccaatttaattgtgatatacaatcatatagtctataatgttaattattaatatttttttatggatgtttcaatgagatgcgctatttagaataaaacttaaaataacatatatttttacaacttaaaacatatggttaacattaactttttagtttttcatctaatctaagtatataagaaggaaaaaagaaaaggacatagaggggatatgtacgtacatcggacataaggacgtacaggtccaggggacacggccgagtaacgtgggatttttttagatagattgatttgtttttttcttaaaataaagatctagtggttaaaaataatgggtccaccagattaaatgaaaaccgatggttggatgttaaagcgccacgtgccgatctaggagcgtttgtaggagcgccacgtggcggcttgagagcgtttgtagaaagtttaatggacttttagtatataatagaagatggaagttttattgaactcgaaaatctgagaacactcccgatctctgcataacaaagtgcacacataaaaaaaaaaagacactcctctgtttcctctgtttttccttgtttccaactgtaattaggagcaaattgcttcatatagtttgtgtccttgaaactcaatttcaaattaacaccatgaatagctgatattcagtttgagttcaatacctatctacaacgtacgaataacagttgaggtgaaaagttgaaagaaaaattctacctaggatagactgaagcaaagaaaaaaaaaggcaaacaaacaaacaacctgctggatgtatgggatggacatgttttaatgcaaccatattcaaaatcgaaccacaatgttgtgtacaaccatgcctattaaatgtgatcaaatgtgtggcttccacggttcttgcacttgaggtgtttgtttcatcagtacatcctactgtgaagtatacatgtatcaaagttgtctaaccttatagttttggattgggatgtctcaggagatctagccctacatagcagataatgcatactagggtaatatttgtagtcctagatgggcacatttgcataggtactggcaaaagatggtgattatctgtcaattactccgtagctttcaagtacagagtcagcatatgttcttgtgtgaagtgtaaaaagagctgatgtcctaattgatgtatacagaacacatgtggatctacgtatctgaagaggatgctatcagcgtcgaacatttgtgtcattcttcatagatcacactttcaatgtcaagtcgaatatgtttcctgttaacatatttctgttgtgaagtgcatgtgcattttatctcttaattagtagcggactttgttatatcctctgcgattctttcgtttttgcatcgtatactctaagacgtgttcagtccacgtaggttggcattgttggaggtaggatcgatcatgcccgtgtgtgtagaatctgcgtgtttatttctgctatataatgagaagagaaaacccaaaagctgcagaagttagggcagcaccaaacttgttgtttgtgttcctgcgctctgagtttccatgaaatcgtgtgcgtgtgtatttaggattagacaccaacgtttcctgcaatcttgaattgcctttgctccattgcccatatgcggcgatgagttttctgcttgcaatattttcaataccttgtttgtctgcacttccattatttcctagcaacccaatatttcagaaaaaaaaagacgtttgaaatttcaaaatggattgaaatatttttgaattttcttgtcgttgccgtgatatttgctgaaattgaaaacgcatcgtggaacttttactggatcgagtggaaatttaaagggtgaatagctaatatggtccctgaagtttcacttcgggctcagtttagttcttgagatttcaaatcgttcaaataagtcctccaaattaatactttgggtcaatatacccttatataccgtataaaaagaaaacaaatgtttcacacatgtatgatcgttttagaattgtcagcttacgattgctgcagccaagcactgatcgcataaattcctttgtcggccacccttcacaacaatgttgagcctgggttggtctttttttttgtattttcttttctatatggtatataagggtagaatgatcattttattcataccgctgcatgcgagacgactttggcatgtttacgtggtattttttgtgggtccaaagactatattagcccaaatgattaatttggaggacttgtttggacgatttaaaacctcaaggactaaactaagcccgcaacgaaacttcagggaccatattagctattcacccgaaacaatacatcatctgatgattttctcttaagaaatgcatcaaactgtgtaagagagaaaactgaagtgatgccagttacaaccgttcagtaccattggacacgatgcaactgtcactggtagctcgagaaatggcctttaccatgttgctatgttggcaccaaattgtattaccacaccttgattatgttatatgtgaccagtggcggcactcggagacacgccgtaacaagacaagatctcactgaacgatgacctaggagggacccatcactccatcagggtgaacgttcatcggttaattctagattcgacaggttaagtagaacatcctcaaatgcagaaatggcctttaccatgttgccgtgttggcaccaaattgtattaccacaccttgattatgttatatgtgactagtggcggcactcggagacacgccataacaaggcaagatctcactgaacgatgaactaggagggacccatcactctatcagggtgaacgttcatcggttaattctagattcgacaggtcaagtaggacatcctcaaataccttagagaccagagagatcgagcattgaagggtgaataaacatgggatacatcggaacaaataggaggaagatgtagaatattgaggaagtcgaggcatctcacgtatgccaacctaaaaaggcaaagagattttgtttagagaagggtattttttacctagcttctacatccaaccggatatatgcggccatttaaattaggaacttagccccgcaaataagccaatctaaaattcaatcatacggagatttgaactcagaaccttgggtactacttaggtcaatacaatcactaagctacgtaccttttcataagtcaaatggcgtattgcatcttgttatatatgacctgtgtacggttcatacgattgctatgacatgttgcatattacttcctccgtttcataatataagtcattctagcatttcccacattcatattgatgtatgtctaaattcattaacatcaatatgaatgtaagaaatgttaaaatgaattagcttgtgaaacggagggagtacctcatatttatgggtcattccctgcatctacatattcatgggctcctttatgagctattacagatgacccatcttatatgtctttatgtggcagtggtggaatctgtactatcatgaacctgggctcatgggctcatagatgtctacctattgctggaaaaagccagtaaatggggcaaacatattattttgggaagacagttgtatttgttggggggaggagggggggggggggaacctttgtcacaaaaatgtccacacttatatagaatcacagacacacacagcagataacactggccaggtaaaacgaaaaggatgaggaaggatgggggagcataactttcaggagaattttgtcaggtaacaagttgttggactggaataacataaaaaaaatattatgacaatataaaggatgaaataatttggggcttgaccaaaaatggagtttttagtatcaaatctttctacacagctatgaaaatgcaggaggcaagttcaatgataggggagatacataaaaaaatctggcacatcaaagtacctctaacaatcaggatttttttgtggttactgataaggaacagcgtgctaactaaaaattacctgaagaaaagagggtggagaaaaggaaatgaaacttgtcagttttgtgacaaaaaagaggcaatacaacatttgttctttgattggcccatgacaagatttacttggaatgtggtgtcctgtgcttttgatctgaaacctatgaagaatgtacaacacaccttgggtgcttggactcagaattgtgataaagttacaaaacaactattgctagtggcggtggcagcagttctgtggtccacttggaaagcaagaaacaaggtgtgctttgaacagattctaccacaggatcctactgacatcttatatagggctcgctcatggatgaatgactaggctgttttgcagaaaccggtggaaaaacaagaacgactacggtggggaatccagccgctaaagcaagtcacaagtgagatgttcaagtcacaatatggatggcgagcaagtatcagaagactcccctggcaactgaaaatggaatggcgccttttcttcctggaagtagccgatggatgttttttatttttattttttgttaactgccactctttagatgtgttttgcggcaagatgtcttttgttatactatgaacttggagtgcaagaacgtactccctgtgttctttatcttgtaatccctgtcatttctcttaatggaaatggagggattttgccctttgctaaaaaaataattatttattatcatcaattttcatctgctcgttgtcacaaatgtacgacttgagaagtctcagccacagaatgaatccaacaggtccatcataaaaacaaaagaaatcctgccagccataatatatatatatatactatgtgagtacatgggtatacatctatatgttgtgtatgtaccaactcttggctacaaaagggaaccaagtggtgatcggttcaaccagccaataccatctgatacacggccttgccaatcgttgtatccagcttgtacaaaagaaagttcagatcaaaccaatatcctttggtttgaatagaaaaggatcgaatagaaaaggatcgcattgctgtgtaagaaatactgttgaatgggtcacatccagtttcccatttgtcagaactacatgcaaaccgattgtttgtttatttttaggtttggtaggcaacagggaacaaatatgcaagtaagcagggcattactgcgagctttggagatccaaagaacagatttgagatgagttcaggagcattgtgcaaagcgtctcgccacctacatctacgtacgtagctcataccgcgaggcgcagcaggtaagcatgagtcatttgactatgaagaaaggtgatacgaaactatctagttgttcatgcaagtcagcttgggcaagctgctaatcataaacatacatcaaggctggtatatgtactactaagcacgtggatacgaacggttgcctgaactttcttatgtgttcatgatgataaagtattggcattatctgttgctagggtgactacctttgataaaatgacaccttaaatgatacgggtggcagcagtggggaatttcggacaaccagaggtttctgaacccgtggaactcttgttttgaggacggttgaaataagtaaagtgattcactaattaatccccaatggtttggaaaatcaagttctccagcaagcaaagaatcgtataaatgtataaaaggggggaaatatatgtggtaaacaccgtcgagtaagtaaaaatttgtgaaaatcatatttaaaaggtttatatataaattaatgaaaaaatacactagagtttggtatagccacaggggcggagctatagtaatagggccggtgtcaggtgacaccgacgactttcgacaaaacgtatagcaaaactgcttatccataagttataacaccatgatctaaccataattagtatactatgacaccgatagacacgttatgacaccaacgaatcaattttctagatccgccactgtatagccatgaaatatatttccatccaatcttaagcctaaaatcaaattcaattttagaaggaactaaagtgacagcctgtacttttcacctaaaatctacgcttttttcagaatttgtaattttttaattcatgttttcatgggttttcatttcattgaaggttataaatgtcatgttcagattgtagccaaaataaccttatcaaagtttggacgagattgacaagattttttatgtttttaccagagttttggtaaaaaaaactaaatagatgtatgtatttagcaattttactaaaaaaaatagtatagtttgaaatgaaatcaatctaacaatcctaaaagcccttcctcacatgattaggcagtcaccagctagctaccgctgcttgcagtaggtcgtcttgcgttgctactgtactgattacatcatttgactaggtcgttgcacgcgtcagccggtagtccggacagaatttcagtagcatcattggtgcatatgccaaccgtcgagaatgtcagggatgatcagccaacgtggcaaatatgctaatttgtgttagtaaactaataaaaagtacatggacaactaaccggacttcatactactagcaagtagtgtatatatcagtcttttgctaatacaatattctcggtcaacatgctgcatatcgacatcgtacagtctttacatacataatatccatggcaccagtttggcactctagaagaggccatattaaagcatatgcatccatgtacagctagaaaacaacatagattcacatggcaccattccaattccttgctaatagatacactgacaaagtggctttatccaaagcaaaaatccgttcaaaaccatggattatcctgatacaaccattaattcatgccttaatatataaggttttgtacatgtttcatttgagtaggacaacaatttggaaatgtttataccggaaaagaaccattcaaatgtgaattatttcacatgctactcatgctgagggtggtatatatatgtattggcagtgtgcactgaaatactcatccatgcatgcaaagaaagcctgaaactcccaagaaatatggaaggagaagaagagagtgaaagctggccgccgcagctcgcaccgccgtcgtcgccggcgagcgccgtgctctccgacgaggacctcctcggcgagatcctcctccgcctcgagtcccacgaccacctcgtcgccgtcgcgatcgtctgcaagcactggctccgcgtcgcctccggcgagctcttcctccgccgcttccgtgtcatccacccgccgcgcctcctcgggttctgcgtcgacgacggcggcggcggcgacgctgggcggcggccgcagttcaaggcactcccgcagcatccgggcgtcgccgcttccgccgcgcaccggacgcggcaccggttcttcggcgcgttcggccacctcgccggctaccaccgtccgtccatcgccgactgccgcgacggccgtgtcctcgtcgagtcccccgacagagcgccgcggcggctcggcatcaacacgccgtaccgctacaccgtgctccggccgccccacccgcgtgaatccgtgcaactcctccctccgctgccgccgccgccaggccgcggcgccgggaagcacgtcgtcgaacgcgtgttcctgcccgaggacggcggcggcggcggcggcgaccatggtatcacgctggtgtacgtgttgctggtcgagcggagagtgaccgcgcgagtgcacgttcttgactccggcggagcgtggggagcgccaaccaccgcggagacggagctcccggcgccgtcgtgcgacgacgccgtggacaccgttctgccgccgatcaacggcgatgtctacgtcgtgacgacctccggctacacgctaggtttgcgtctgggcaccacgcgcttcaccgtcgtcgagctcccggacgcggcgaggtcctccgccaacttcaggatggcatggtcacacgccgccgccgccgccgacgacgacgacgtcgctcgcggccggctctgcctcgtccacggcgacgggacgcggctcagcgtctggcaccggaaaacgacgaccacggaggacgacggcggcgcggccggagttgggtggcggctggccgacacgttctgcgtgcgcgaggcgtgcgagcggatcgagtggcttcccgacggctggtggaccggccgtgtcgcggtgatcgccgtcggcgacaacgccgagttcgcgctgctggacttggagaacgtcggcgtcgtgatctacgtgcacctgcagtggaggacggtgaagaaggtctacgagaggaaactcgccgacgccgacgatggcggcggcggcggcggtgaccgccagccgccggtgagggtgttcccgctgacgacagtctggccgccaacgttcccggagttggacaaaccacgacagaattgctgcgtcagaagcccggacggtctcgtcggaggcgtggtgatgacgtgccacgccggctggtcggcgacgtcgccgtcgtgctcccgccgggatggggacgacgacgacgacgacgacgaggacgtcggagcagtgctcccgggctgttcgtgggccggatggttcgatgacatggctgcaatggtggcccagctcgctgaatgggccgcgcagcccagaagcccaagaagatggcgttggtcttgtctctgatacgacccacacatgacacaccagatactgtggcagctagccgagcgcgaactagacactgcgaccctgtagatcaggtgcaagctggatgccactgggtgtactccacttgtgaaaatcaatttctaagagaaggtgaacttaattacgacaactgtctcattttattggacaatcaacttaagaatctatctataattattggacaatcaacttaagaatctatctataaaaaccgtttattatagtcaggtgtttgacgcatttgtatctgaaaattgattttaaaaaactggcacccgtaaaaaccgagctgagccgaccggtagtctcaaacggataaggcctagaggaggactcggactctccggtttcctcattctttcacgctcccccctccctctctctctcctgcgtgcgcttctctctctctattgtcctagtggtggctccgcggcggcggtgccctcccctgcccgtcgacggtggtgaattttttgtgttagtgttgatatttttgagttcttggatgcctactaattctatgaattaaatgttccatggaatcgggatgaaagggaacagcttgagctgttttttttccttgattcttgggacctcaaagggtctcttatctatgctggcttctaggtgccggttaggaaattccgaacctacgcagggttcaacca

SEQ ID NO: 27096 - DNA, 7912 bp, Oryza sativa
  unsure (1)..(7912): unsure at all n locations
nnnnnnnnnnnnnnnnnnnnnnnnnnnnnnnnnnnnnnnnnnnnnnnnnnnnnnnnnnttcgctgagaaaatattttgtcccaacaaactgtatgttctttcataataaacacaaaatgtatcagcaatatgtagcacttgtaccacataaatgctttaattaggtccgttatgggtggttgcattccaaatatagcgcacatgtgattggtcacttaaaaccagcacgatgcaaagaaagataggaaaaacgtgtctgcctcattaggtcaacaaatattgtgggaaaagattcatcttttggcatgagaacctatgggacaattaaataagtttcttgcttcaaatatttcatatggtacagcatgctgaattgacaaaaaaaataattttccttgcatttaagatttttcttgtgttgaacatagatcttttttaatttatccactcatatattgtttttctagtagctcattttctagataggaatttcattgtttattagcattaagctggtaatcagatgcaacaaatacatgaaccaagactagtttgtagggatctagaaaagggaaaagggataatatgattaaaaaaggaaatcggatgatgggatacaaaatagaaagcaatgatatattggaatgtaaataaaggagcgacaccctccaaaattgatagttgaccatggtttctctggcaaaatatcatctaagaaaaagtccacctttgccatgttggccaagtaggcaaatgataatgagtctcgcattacttgggtgggactgaaaattcctaattggcctatgagaatgctgcaacactgttgaaaggctaagccatgtcaccattggatccagcagtgccgcttacactgctaccttcgaactgattgtaccccattgagccagtgccccttgcaacatccatcagccatccctccctctggattggtacctccgtgctcgacaatgagacagatgcaggtatgaggccttgctcacggagcttcttgaggcggtcgttgacaatcttgaggcgtgaatttgccatccttccgaggctgataatctgctcgatggtgagaccatcgaggcttgggtggcggccattgatggcttcaatgaggagtagcttggtctcgctttcatcagcttcgcgtcccagcttgtgcaacttctccttgagcttgtcgatctgcttgttgaggatgccctctaggtctatcatcttcttgtatctgcccagctgcggcatggccttgaagtgctcgagaactctggtcgcctcccacaccgacggccaaaccttcgttgcttgcacctcaacctcaccgtacaccatgaggaacagtgttgcgaactcactaaccttcttcatcaagcccttcagatgcttcctaaatgtcacccgccgcttcacatcaatgacgatccgcagaagcttcatcttcttgcgagccatggcctttgcagttcaccactttctagcaagaatgcacctgtaaattgatgagagatggttagattgatgtgaaatcaaagaaaggggaatatggtggatttatagtgggagatcatattgcaacaatcgccatgatgtggaaagaaattattttgcaaatccaaaaatatcaaatgaatcaatgtaagttaatgctttcctgaaaaaaatgatcggttaatgtgtagctggcgagcatatcttcaacctttaatcgtgtccgtctttagaaacttccttgcaggcatgagctagcaatagccaatagatattactcgctagatgataatgagttcacaccaaagatacgttcatccccagttcatcatatatgtttgagttaatcctctttcatatgcgcaataggaattcaatttacaactacagaaatgattttcgctacattcaaagagttccaaggattgatcctgtcacgatagctgccatcggatgggccatatctgccacagaatggatgatttcccccatcactcataaacttgtgaacaagggagccgccttcatgctcgctcgctgtcccagcttgcatctgttaaaaagcatacatagttatcttgttaagaaagagaacactagataactcgcaaaccgtatttttatcaactctactattattggattatttatccatttattgcagttgagtggagagaacagtgaagctagctatgtaatttgaggctcctattaaagccccattggtctaaaatctcaacatatttgttgcaagtcatcaattatattattaaaatttagtaaagccacaatgctcagcaaaaagaactagcaaaacagtactatattccaagggaaaaaagaatttacatctttgatcatgtagaatttagattgtatcaatttagactattctaccacctccacaacatcaattggagaaaaacaagaaagattaacaccgctatgttcgatgggtccagattttctcactatactgcagtaaattggtctgcctcaaccgtgtaagaaatatactagtataactctattttacagcgaagatagcgtgaagacctcggctagttcgtaaaattttatcttatatctgttcatggttttcaggaaacacaaaagcacatatgaagttggcttgcaatttgcacaagaattacatttggcagtttccatgccgtaatcatttccttcagttcttggacagaagttgactttttatctaaccagatcaactttgcttgcatttgtaggatgttgttccaagtgtaattatgtccaaaaatagcttgaagaaaccgttggagaaaatagaaactaccaacgctgaagcgcataagattgttgacctgccaaacttgataagcaagaaaaaaaatgacaaccatagaccaaatgttttgccatatatacatccattccgttgcagatccaccacgctaggtaatcggatgaaatatggaatgtcggtagagaaaaaatgtgctcaatgacgatgacaacccaagtcctggtgttattatgaactggcatccatggtatccgtggatctagtaagataactctcgcacaacatttttgtgtcggatgcagaaaaagtccgctatttcgaacttgttatgtgggttcttgtttccaagaattttcatatagatacaagtttcacttagatgattgagcaagctacagggcaatcaattatttgaccagccaaatttgataagcaataacaaaaatgacaaccatagaccagatgtttttgccatatatgcgcccaataatgccactgcagatccaccacgctaggtaatcagacgagatgtggaacaccgacagagaaaaaaatgtgttcaatgataatgacaacccaagtcctggtgttcataaaatattattctgcaattggcatccatggtatccgtgggtaggaaaagataactctcgcacaacatgtttgtgtcaaatgaagaaaaagtccgctatttggaacttgttatgtggattcatgttttctagaactttcatatagataccattttcacttagatgattgagcaagctacagggcaatcatgtcgtcagttaccctcggtttaagagtctaactgctctaaaaaggagtctgaaggaagccttggatgaaaaacgtttcctcttgtacaaaactataatcgtggaggacccctttctccattgaaggttgataagactggcagcaagatcctagcaactagtccaaccagagatgcaatattattagctttgggtgttgtgacatccaagtcatcaagtgtattactcacttgatggtgcagagataggtgaacaagatcaaggagtattagagatgattggggctgaaactgccaaaaagttgaagagatcacctctagcaggcataacagtaggaggacagctatatatatgacaagacttttgagatatgtggatgcagccaattggggacctgcctttctgatgagttatttattcacctcacttgacctaggtcaccttgccaggtaacatggagtgcctcatgacgcttaaagatttgatgatcccctattagaggaactagtcgcacgggatattattattgtaatttttagtacataaaaatgttgaattataccagcttagactaattgagagtagagtctaaatcaatcataacttgctaaattctactttcaaaattaaattaatacactaaattaaaaatcgatgatagttacatcattgtagtattaactttgaattctacaattattaatttttggaaaatgaaaattaaagagtccatgctattttcgtcttgcatgttttatttaacacaaactggcaatacaatttacgatcatcgtaatacgcttttaacagccataccattttgagttataataagagcgtcaagataatgtccaattatataatataggcatgaaataagttgtgtatcaacatacacaaagcatctccaaccattaatattataccgcacggttcattaaaaaaatacactactttgcaatttatcttattgtttttgctaacgcagtagccacaagtataataccatgagcgaaagcaataaacccatataatacaccctatcaatttttctctcaatcacaattgcaatggaagtatatagattccataagaaatctgtatatgtcagaattatgattctttgatgaaagcgataaaaaaacacaattatcttgacctcaccgagccaagtgcatcatatatgtacctccttgtgcatggagacattatgtgataaacctacgattagtccttcaaaggatgcatgtacgaccatataaattaggaacaaatctaagaaccggtacctacaacttcctaattatatataggtgccggtttttttaagtagactggtacatataggtgtgttcacaagtactccactgacgactggatcaactataggtgccaacttttttaataaccggcatataaagtattggtgctagtttttgctagtaaccagtacccataatttatattagatgcaggtttcttttctgaacatttatatttaggccggtaccaatttggggtgagtacaatatggacagcgtggcaattcgttgtaaatttatacatcaagaaactgtagaaatttgtcataactgcaagtcgattaggcccggagatcgaggtagtacaacaattgtggtatgtttgatgtgatatggccatcatagtttgaataagacaatttcttcacctctaactaatttgatatttcataacaaaaagcacatcgttcaaatgtatggctaacattatcataatgttgaaccaagaagcgattgatattactattttaaatcaataagattaagcatgtagacaaatttgtgcttcaaaactagcattttaaattcgtgcactatactacacccatccgacaagtttgtgtatcaccaacacaatttacactttagtcaactttatttttattggattgtttacccaagtagactttattggattaattgtgtacctatggatatatgatggtgggtgctgtggggcttcccctactaagttctggtaaagaaattgatatgaagaggacattcctcatacatgttgaattgaacatcttctctagggccaaatacactaggattatcaagataactctagggaacaggttcccctagattaacccctacggaagacaccctaggggtcaattctaccggaaagacaaacttccttggagtttttcatgaataccttggggaagatatttgttccctagagttcgaaattctacagatagttgtacatgtggcatgttcatcctacgtgtaaagtacattcccctaggttttcagctacaaaatgaaatcttttattattttaattttttatacatgttgtattatcctcatttacctcaatgttcaaggaaaaaaatgattaattaacaacaatgttacttttattatgaacagaaaaaacttaacttgaactgaatcttcaatttgcatgcttttgtagtacagcaacaaagctggaaattaaactgggctaacatttcttcttacaaacacgctcacactttcaaaatatgctacctaattgaggctatcattccacagaactgtaacatacccgaactctagaccttaaaaattttctgtcaaaatagttggaagctaacttttctatttttgagagccaaaaatttccattttaaaacctaggtgaagttgatataactcttgcatgataaaattttagaacaaattaaaacctttgcatctctaacctaggacaaaaatataagtttatgtgtaagcatgcatattctcatagccatgtttgacttgagtccttcatatgcatttggattgcatttggattttcgatttgcatttcataataggtctcataaatattaactaagatctagataaacaactgaaccattagggcctagtgctagctagaggaagttaaaataggaaccatacatcttaaaatatatcaacaaggccaatgtcaagccccacaaaactatttggtcatccatctgaagactagtcatgaacctggaagtgaacaaataaattaactcatataggatatattccaccttagttacctttataagcattctcttaattaaatactagagtaaacttatgcataaatagttaaggagcttattacatgtgtaaggtaaactaaaattctaacatatcaacatcacctcaggttaagaagagtctaaatataaaagttttaaaaacatttacatacatttaggaaaggaaaataattcttgctaattatttaaaataatctgtgcaagataaaatcattgaaaaattcatgtaggctctaattaacatatacaacacacagtaatttcggtataatttaataactaaatttgatacctcaaataaataagttaaaccagacaaataatagactaattataactcctaattggctaaaaccataccttgttgaaaagtgcatttaactgcatggaagtgtataggggaaataatttattaaaatactaggttaattatcatgactaaatataatttttctagaatttatcttctctgtttaggtctcctaaaaatccaaactagtttccaaagaacccatattcctctaatttctgtgagtaatctatccataatttttgaggcaaccaaagaaaatggaatctaggtatcttcatctaccttcagaaaaatccacactaaattatcctacccacaaattaaataattgaattactaaagtgggagagagaaataatcctgaaaatcattcaaatcttttgttcacccacgtttctgcccaaccctctcaccctagcttagtttgccacgacctggacccacttggcagccactctggctcatcctcaccctgtgcaaatcttccagccgaccatagacagccgagagagagagagagagattggcgccggctgtgtacgacgcgtggcctcgacgtggcagcgccgaaccgaggcttcacctccacccagctgtgtcgccactcttcacccaccatcccagtgccgatccaaccgagggaggaagctccagctctccctctctacctctctttcgtcgccggccgccaagaagagggacattgccaaccgtcgtcgagccctctccatctctaactcatactcgttccattctcatatcgccatgccgaacaactttggttttgatcccattccatttcatcttctacagcagcgggaacgccgccatgtcatggtcgctctagagcgcgctctgtgcaccgccgcagcgacatcatcgccgttcccgcttatctggaccaannnnnnnnnnnnnnnnnnnnnnnnnnnnnnnnnnnnnnn

SEQ ID NO: 27097 - DNA, 4872 bp, Oryza sativa
cttcacctccggtcgccgtcgccattgtcgattccgcctcctccggtgagccattgtccgattcttcgcgtatacaccatccctggggcctcactaacctcatggacacacatacatgatagttcttggagctgattgagccatcgccgttcacccggaggttcttgccgccgccgagccgttacatgagccgccgtcatcaacctagctaccccagccatgtctagcatctcggtgagcacccttcagcctatagaacatacatgcatgcacccaattaaccaatacatgattgtagaagcacatgcatcaccacccgaaaacatcctcctttcggactcgccgccggcgttactccgatgtccactgaccaagaaaagtagaggaatggaatcgcaatatcatgatcttcattttgtcttttggtcgcacccccaaacgagccatcgtttgtcgccggtgagctcgagatcgagctcagccatggctgttctgcctctgtgcgtgagaaaagaagtcagggaccttgtttcgagaatttaaacaactataaggtttaatgtgcaacttttcaactcactgacatatgagcctaggtctgcgggttgattcttagaaaccgcagggatctttttgtatattgatctctcactgacagtggaccccttggaaacaaaaatctgaaattataaaagaaaagtacctaaaacctgtaaaatccatataaaattaaatatagctcattttaagatgattcaaatttctgtgaactcaccaaattgtgaactttgatgttatggaataaaaacttgcactcacagtacaaatttagcctctaaaatttatccaagttaaatcacacataaagcatgcacaaatttataaaatgcatacaaaattcatttcaactcattttagagcaaacttagtttctacagatccaccaacatgttctctaaaaataaagtaaaataaaacatataaacactttacatcaaatgcctctaaaactattatctttaaaataactagttttgcataagatgaactttagaagtttatataaaattcatcttagatcctttttgagtaaacccaagttctgtagaatcaccaaaacatatacttccaagttataaaataaagttatatacttactgtatgataaaagcctctaaattcttatgtaagtaataaccatcatagagcaaccttaaattgtaaaatttgtagaaaattcatctttagtctaaatgaagtgaaccaaatatctatagaaccagcaaacagtgggcttcaacatagtaaaataaaatatggaaccttctgtacaggttatagctatcgattgagcaatatgtatatatataaatgtatatagaaatacactctagctataatgaaacacaaataaaacctgttagaccagtgaatgcataatgcatagttccatccccatccaccaaaacttaaggcacttagctcatataataatttttaggttgatataataaattgctagcatggactagagctcccctagtttataaaatatgaaccatggtaataaagaccataagcctatgaactaaggttagattagttaactaaaatactcattttatacatcactagctagatgaggcaagttctggacctaaacctctaaagctatgaacctatagaacactatacacctataacacgttataacttgtaaaatacataaagaattcatattaactctaaaaattatgaaaccaaatgtgttggtcttagaaaacacatatcttcaccccagcaaacataaacttaacaagaatcaccttacaacagcatttcacaatagtacctaagtaaatcctacactataccgacgaaacttctaaaattcataattctcaaatgaaatgagataaaatataaattctttcacctaaattcattttagaccagtacctattcactgtgcacaaatcatccattttagagcattttggatttttcgcatatttcggtgtttaattgcataacgtgtactttgtttagatgattgcttaaacggtgaagaagtgatttaggtgctgacattttcctgattcaaggcaagtcccacctccctctctttgatcactttgaacctatgttttggaggttattgaaaatgtttgaacctatgttttggaggttattgaaaatgtttgcaaatcctgcatgtcgattgtacattaacaaattaaaattgtgttaaacttgttagacaaactcctattatttacattatcaccttaaccccacatatatccatatccatcattcctatccttaggaacaatatgactataccacgttatatatgaattttggagtcactaggttattataatgcttagccatgcttagaatggtcttccttgtcattatgggttcattacaaatatgaaaaattgattttgaaataatctggacagaactttaatacttgtgattttcataaataaaatgatggaaaacatggattttaggtttgggcctcaactggtgcacatatggtgattagttgtgtaccgatagggggagagtgcacccaaaccgacctaaggacttcactcaatgtcagttcatttcgtatacagtacaaccacatgtgctagtatgggatagctcaagcttagtaaattatttatggtttagccttacattctggtagaccggtgcgtatgaattcggataactcagaggaacttcctatttaccccgacgtggtagtttaggtcactaagtctgtccaatacaacggtattgtgccacgtgggtgggttcccgttgtgtccgccaccacggcgttaagtttaaggcgtgagcccgccacttaacggttctaggtcatataacgtgtatggcttaggatggagtaacacgtatcgtgctggtgtaaggctaaatcatgaattttggaaaagctttgttgcgggtaataaatcgggtacttatgtatcgcgtgccatgctcttgcatgattattatttcgcatcatgtgggtaaagtgtacaaactctgcagagttaaaactaatcgattcgttgtgctcgcggtcatgagcggcgtgtggatatctattgagtatagacttgtgtttattctcctaaatgctgaaatttacctttaaatcaatttaaagagatttgagaatgatctccttgctccttgctgccatggaaggcaatgaggtgcatatttatacatgattaatgcctattttgatgcccaatatgacaagtactagcttgttgaaatttatttgaaagtaaacctgatttggaaatgttttatgcaaataaaacttgctttatgctaaaaagaaccatattatgtcttccttgattatatgccttgcaagtagggtgttaggcttgtcttggtgcttgccctaataatgtactgactcttgctattgaattaatcttttgcttgcaggttttagacttagtctttgagtgatgcgggtaatcgactgcttcttctagtacttgaacttaatggggtaaacccctagtcggtgtgcttgtggattgggtagacaagcttccgctgttctatatatttatttggccggtcggccaatgtaactaaagtagatgtagtttataatcgctttcatcttatttgtgtttgctatgtataatcatgcttgagatgaaagtgtgaatctagtgcacatcctgtgaactagattcacatgagtatgagttaagaatatttgagatgttatagatctttagccatttttgttaagtctcctgaatgtgtaacacatctggtcactgccttcgagtggtttgacgggcgtatctcaggctgaagttgactggcaggttaaaggctcagcaatgtctccaatattcctctctcgaggcgtcggatattttattatgcttgtttgatgacttgaattattcatttcatctctcaattataatggaaggtccggagagcctatgacaagaacgaaacaaaattgaaaaaacaaatagcccaatttcttgaggactaaaaccactgaatagtactagcttgctgcaaaaatggaggaagtgcgcagtgagttgttctcggatgcttcctgccgatttcccttcaaaatcagacccaaatagcaattatgagtcaagataaattcgtgaatgagcacaaatgaaagaatttgaaattagcatgaaattgtttggctaaagaacagtacgagctaagttcaaatatgtacaaccatgtgttgttcggcatcaaaattaccaggcaacctgctggctgtggcgtgtacattggaggtgtaggggatgcgaccatttgctgttcgctagctgccggagcttgcccttgggacacaagctaagaaaagaaagagagtggaccggatgaactaaagaaccaagtaacatggatctggacaaatgattgagtggagaaaggggcgttgcggcaccgactgcagctatagctggatttgcagcacttggacgtgttaatactcaaatttggctctagaatataaaattgaaaacttttgctaaatttaaaaagaacctagacttgtcatacgaggccggtcggaccgatagcaggggccggtctgaccggcagcatgtgatcggttagactggtagagtccgactacaagtttgatttatcagttcttgggttttcttgctaaggcttgatatttgagagttctaattggtttctacagctaattgaacgtgagaaagaacctgggaagcaatttcaaccctcctatagatataagtgagctaaggcggattgaaacaaaacccatcaatcgttaaaatcaatttaataaccaaaccatctata

SEQ ID NO: 27098 - DNA, 7214 bp, Oryza sativa
  unsure (1)..(7214): unsure at all n locations
nnnnnnnnnnnnnnnnnnnnnnnnnnnnnnnnnnnnnnnnnntgccgatttcccttcaaaatcagacccaaatagcaattatgagtcaagataaattcgtgaatgagcacaaatgaaagaatttgaaattagcatgaaattgtttggctaaagaacagtacgagctaagttcaaatatgtacaaccatgtgttgttcggcatcaaaattaccaggcaacctgctggctgtagcgtgtacattggaggtgtaggggatgcgaccatttgctgttcgctagctgccggagcttgcccttgggacacaagctaagaaaagaaagagagtggaccggatgaactaaagaaccaagtaacatggatctggacaaatgattgagtggagaaaggggcgttgcggcaccgactgcagctatagctggatttgcagcacttggacgtgttaatactcaaatttggctctagaatataaaattgaaaacttttgctaaatttaaaaagaacctagacttgtcatacgaggccggtcggaccgatagcaggggccggtctgaccggcagcatgtgatcggttagactggtagagtccgactacaagtttgatttatcagttcttgggttttcttgctaaggcttgatatttgagagttctaattggtttctacagctaattgaacgtgagaaagaacctgggaagcaatttcaaccctcctatagatataagtgagctaaggcggattgaaacaaaaccaatcaatcgttaaaatcaatttaataaccaaaccatctatattttctatctcactttttcttgctacctatcccaagtatattctccttaaaccggacatcctagctggcctgttgagtctaggacaaaccggcgtgtgttcaccccgacggggtctctccgagtgctcgttcggcgacatctatccgcgccctataacggcgcgtctctgggtgccgcgccatgggttgcacataacgtgtgtggcggcagcacgattctacgtcaacagaacgctcacttgtagctggtgtacagagctcgagcctggttgatgcttggtagttaggagagggcaagcactggccaaccatggaagaagaaggggaagatgtagattagatgggcccaaaaactactgagcagtgaatttgattttcaaggcgcgttgttcttggcggggagagaaaaaaagggaatgctaatctggccatcctagtgctgatgtggcacaacttagtgtccttctcgtcagaagttccctaggaacatggacaaactcttgtaccaaaataaaaacttttattggattaattatgtagccatggatatatgatgatgctaagggctgtggggcctctcttacaaactcctggtaaaaaatgatatgacgaggacattactcatagagaaaatttcctatgtacccataaaagttcacctaatctcttatttgcttctgaattttgctcattctcttacatacccctgaattttagtttggatcgcttccacgcccttttctctagttgactgctaaattattatgaaaaagtccatttttccctttgctacgagaaacataataaattaatggagtacattgttggatgtagaaatttgttggatgagactattatatttatgagtttgttatgcaccatattaactgcgacaaatttagttttagatttgatataaaaatttaatatttatttattagttattgaatgtttttttatgtagcatattgttgacgaaaaatccgcactcggccagtggtgccgggtctgtgctggcgcaaactaagtcgacgaacataacggtctgggagatctgcttagctccagtgcaggtccaaaggttggtgaaatacaggcgtgtcagtcaggtttatcctgaaactaacaagatatacaaatagcaggtcaatgagcctatcggctgacgagccgatggagtagttccagtcgatgccgataccagccgatagtgatagggtttggagctatcggttatatatccaatttagattctgatacttgagacaatcggctgataataataaataacaataatataatccagtagaaaccaatcggctaacattgatatgatagaataagcactgatccgaaggttgaagaatacatcggttggagatccgatgtcataaaatccagaagattagattaaacagtgaaatctttgttatcatcgtctaaatccaacttatatgcaatccttgtaaaccgatgcaacatctagatacctcatcggctgaaaccctgatgaaacccttattggcagtccaaaagcaggctagagattatggttctaaacatgacttagtagatcaaacttaactgatgcagcactaagtttgaaaagaaacacaatatctagataatcaagccgttgactgatttttcgggtggtagaagccttagctaatctaatctagtaaaataatttagccgataccggcagaaaccctaaagcgagagacaaccgatagagctaaattgagaaactaagactagattaactaagacatatgataaatagccaagcaaatatatcaacatcccatagaaatccaagaagtcaaatgtactgatgcagccttgaacgacaccaatgtagccaatacaattgactaggccggtagaacattggacttaccccttcgccggagatcgaatagcgatgtagccccgcgtcaggtgtcaagttccaccgtgataaataaaataaagtagaaaaggtaaaaggtggcgatccaccgaattgtattgatcgtggagatattacaatgaccccgggtgtacatatttatacccatgggtagatactagtccttgtaggataagaaagagactttcctaaagatgaaaggaaaacataaagtccttataggacactaaacatactttcctaaagataaaaggaaactgacaaactattcctaattagtagataacttgccatggcgcatcctccttgaacacggtcactagtggataagcttcctttaatcgattaatttccttaaccgaatatagctggaatccaactatatgtgttttgatagtaatacaatagatagattgttgtataagacaaatatatttatatgcaacataaacaactttcaataagtaataattaagtattattttttatgtcatctctaaatgtatatttatcgcaaataatatggtgcataactaactcataaatataatagtcccatttaacaaatttttaccctccgataatacactctattaatttatatgcttcttcaaagcaaagggcaaaatgggcttttctcataagaatttaacggtcaactaatggaaaattcatagcctaaactcccaagtaggcaaaaggtggtgcggacccattctcatcctcttccttcctcaagctcccgcctcctccctacaggtcttcaaggttgagctctctccttgttaagataatattttgtcccatgttcgctaagataatattttgtcccaacaaactgtatgttctttcattaaaaacacaaaaatgtatcggcaatatgaagcacttgcaccacataaatgctttaatcaggtctgttatgggtggttgcattccaaatatagcttacatgtggttggtcacctaaaaccagcacgatgcaaaaaaagataggaaaaacgtgtctgcctcgttaggacaacaaatatcatgggaaaagattcatcttctggcataagatcctgtgggaaaattaaagttttactaagtttcatatttcaactatttcatatggtattgtaggctgaatcgacaaaaaaatcattttcctcgcacttaagatttttcttgtgttgaacatagatcttttttttaatttatccactcagatcttgtttttctagtagctcattttctagataggaatttcatcgtttataagcattaagctggtaatcagatgcaacaaatacatgaaccaagactagcttgtagggatctaaaaaagggaaaagcgaaattattattaaaaagggaaatgggatgatgggatacaaaatagaaaggaatgatatattgggatgtaaataaaggagtgattgacaccctccaaaatcgatagttgaccatgctttctctggcaaaatattatctcagaaaaagtccacctttgccatgttgtccaggcaatcaagtgataatgagtctcgcattacttgggtggcaaatgaaaattcctgattggcctgtgagaatcctgcaacactgttgaaaggctaagccatgtcaccattggatctagcagtgccgcttccgctgctacctccgaaccgattgtaccctattgagccaatgccccttgcaacatccaccagccatccctccctctggattggtacttccgtgctcgacaatgacacggatgcaggtatgaggccttcctcacggagcttcttgaggcggtcgttgacaatcttgaggtgtgcatttgccatccatccgaggctggtaatttgctcgatggtgagaccctcgaggctcgggcggtggccattgatggcttcaatgaggagtagcttggtctcgctttcatcagcatcacgtcccaccttgtgcaactgctctttgagcttgttgacctgctcgttgaggatgtcctctaggtctgtcatcttcttgtatctgaccagatgcggcatggccttgaagtgctcgagaactctggtcgcctcccacaccgacggccaaaccttcgttgcttgcacctcaacctcaccgtacaccatgaggaatagtgttgcgaactcactaaccttcttcgtcaagcccttgagactcttcatgaatgtcacccgctgcttcacatcaatgacgatcccctgaagcttcaccttcttgcgagccatggcctacgcagttcactactttctagcaagaatgcacctgtagattgaggagagatggttagattgatgtgaaatcaaggaaaggggaatatggtggatttatagtgggagatcggattgcaacaatcgccatgttgtggaaagaaattatttcgcaaatccaaaaatatcaaatgaatcaatgcaagttaatgctttcctgacaaaaatgctcggttaatgtgtagctggcaagcatatctgtcaacctttaatcgtgcctgtcaatagccaatagatattactcgctagatgataatgagttcacaccaaatatacattcatgcccagttcatcatatatgtttgagttaatcctctttgatatgtgcaattggaattcaatttacaactacagaaacgatttttgctacattcaaagagttccaaggattgatcctgtcacgatagctgccatcggatgggccatatccacagaatggatgatttcccccatcactcataaacttgtgaacaagggagccgccttcatgctccgctcgccatcacagcttgcatctgttaaaaagcacacatggctatcttgttaagaaagagaacactagattactcggaaaccatatttttatcaactctacatttattggattgtttatccatctatgcagttgagtggagagaacattgaagctagcaatgtaatattaggctcctattaaagcccctttggtccaaaattatctcgagatatttattgcaggtcatcaattatattattaaaatttagtaaagccacaatgctcagccaaaagaactagagaaacagtacaatattccgagggaaaaaagaatttacatctttgatcgtgcagaatttagattgtgtcaatttagactattctaccacatccataacatcaattggagaaaaacaagaaagattaacaccgctatgttcgatgggtacagattttctcactatattgattggtctgccccaaccataaaagaagtatactagtataactctattttacagtgaagattgcatgaaaacctcggctagttcgtaaaattttatcttgtatctgttcatggattttgggaagcacataagcacatataaagttggcttgcaaattgcacaagaattacatttgggagtttccgtgccgcgatcatttccttcagttcttggacagaaggtgacttttatacctaaccagatcaactttgcatgcatttgtaggatgttgttccaagtataattaagtccaaaaatagcttgaagaaacagttggagaaaatagaaactcccaacgctgaagcacagaagattgttgacctgccaaacttgataagcaataaaaaaatgacaaccatagacccgatgcttttgccctatatatatcgattccattgcagatccaccacgctaggtaatccgatgaagtatgaaacgtcggcagagaaaaaatgtgatcaatgacgatgacaacccaagtcccgctgttcataaatgttattatgaattggcatccatggtatctgtggatctggaaagataactctcgcacaacatgtttgtgtcggatgcagaaaaagtccgctatttcgaacttgttacgtgggttaatgtttccaagaattttcatatagataccattttcacttagatgattgagcaagctacagggcaatcatgtcgtcggttgccctcagtatacgagactaactgccctaaaaaggatattgaagaaagccctggatcataacttgctaaattctactttccaaattaaattaatacaacactaaattaaaaattgacgataattacggcatcatagtattaactttgaattctacaaatattaatttttggtaaatgacaattaaagggtccatgctatttttattttgcatgttttatttaacacaaacttgaaatacaatttacgatcatcataatacgattttagcagccatactttttttagttattataagatcatcaagataatgtccagttaatattggtatgggtacttagctgacacaaaataagttgtgaatcaacataatgtaagcatctccaaccattaatgtgtaggatagaacacaagtaaccaaggcatattgactatccatggtacatccggaaaataaaaaactttgcccggtatatgagatctattttttaaaaaataaaaacagagaagacannnnnnnnnnnnnnnnnnnnnnnnnnnnnnnnnnnnnnnnnnnnnnnnnnnnnnnnn

SEQ ID NO: 27099 - DNA, 10559 bp, Oryza sativa
  unsure (1)..(10559): unsure at all n locations
aggctcggcgggtggcaattgatggcttcaatgagaagtagcttggtctcgctttcatcagcatcacgtcccaccttgtgcaactgctctttgagcttgtcgacctgctcgttgaggatgccctctaggtctgtcatcttcttggatctaaccagatgcggcatggccttgaagtgctcgagaactctggtcgcctcccacaccgacggccaaaccttcgttgcttgcacctcaacctcaccgtacaccatgaggaatagtgttgcgaactcactaaccttcttcgtcaagcccttgagactcttcatgaatgtcacccgctgcttcacatcaatgacgatccgctgaagcttcaccttcttgcaagccatggccttcgcagttcactactttctagctagaatgcacctgtagattgaggagagatggttagattgatgtgaaatcaaggaaaggggaatatggtgggtttatagtgggagatcatatttgcaacaatcgccatgatgtggaaaggaattattttgcaaatccaaaaatatcaaatgaataaatgtaagttaatgctttcctgaaaaaaaatgcccggttaatgtgtagctggcgagcatatcttcaacctttaatcgtgtccgtctttagaaatttccttgcaggcatgagctagcaatagctaatagatattactcgctagatgataatgagttcacaccaaagatatgttcatccccagttcatcatatatgtttgagttaatcctctttcatatgcgcaaaaggaattcaatttacagctacagaaatgattttcgctacattcaaagagttccaaggattgacgatagctgccatcggatgggccatatccgccacagaatggatgatttcccccttcactaataaacttgtaaacaagggagccgccttcatgctcgctcaccatcccagcttgcatctgttaaaaagcatacatagttatcttgttaagaaagagaacactagattactcgcaaaccgtatttttatcaactctacttttgttggaatgtttatccatttattgcagttgagtggagagaacagtgaagctagctacgtaatttgaggctcctattaaagcccctttggtccaaaatctccacatatttattgcaggtcatcaattatataattaaattttagtaaagccacaatactcagctaaaagaactagagaaacagtacaatattccgatggaaaaaagaatttacatcattgatcgtgcataatttagattgtgtcaatttagactattctaccacctccacaacatcaattggagaaaaacaagaaagattaacaccgctatgttcgatgggtccatattttctcactatattgcagtaaattggtttgcctcaaacatataagaagaatactagtataactctattttacagcgaagattgcatgaaaacctcgactagttcgtaaaattttatctcaaatctgttagtggatttcaggaagcacagaagcacatataaagttggcttgcaatttacacaagaattacatttgggaatttccgtgccgcgatcatttccttcagttcttggacagaagatgacttttatacctaaccagatcaactttgcttgcatttgtaggatgttgttccaagtgtaattaagtccaaaatagcttgaagaaaccgttggagaaaatagaaactcccaacgctgaaggacagaagattgttgacctgacaaacttcataagcaataaaaaaatgaaaaccataaacccaatgtttttgcctaatatacatcgattctcagtatacgagactaactgccctaaaaaggagattgaaggaagccctggatcataacttgctaaattctactttccaaattaaattaatacaacactaaattaaaaattgacgataattacagcatcatagtattaactttgaattcaacaaatattaatttttggaaaatgacaaataaagagtccatgctattttcattttgcatgttttatttaacacaaacttgcaatacaatttacaatcatcataatacgattttagcagccatactttttttagttattataagaacatccagataatgtccggttaatattggtatcgatgcttatctgacacgaaataagttgtgtatcaacataatgtaagcatctctaaccattaatgtgtagaagagaacacaagtaaccaaggctacaagagggggatgaacgattaagtcagtggaagtcaaataatctaatcttgatagatctggcggtctatctgacctgttagggtcggtccaaccgaggcatggccggtctcttaatgtcaaatgtcaatttctcttatgccaaccgttggatcaagttgaaaagttgacaaaataaactagacaaaccaagaaacaactccaccggagggatatgtaaactaaaaaacggtttaagagaaaacaccctcgaaagtcagctgtctcggaatttcagcaaatctgaactaaacataaaacttaagcaaattcgaatcaagcacgaaccaacgaatgaaactttccagatctgatcaatgaagtattagaaaggttttcgatggactaaattgaacaaaatcgtagcaaaacgaacaatcacaagttaatgccaaaatcaaacataaacgcaaaacttacgaaactagaatagatcgtcgatgccttgatgattaaatatgatctttattgctcaagtattgtttataaagtgcagccacagcacccctcgcaagttttcacgaaaccctatctaatctctcaaacttggcttaccctcaaggcatagccttcctctctatttataccgaaaacctcctactcaaagtagaaatacaactcatattcccaataggactctattgctgaatttccaaaccaatctacaatttccaaattgtaaatatctcttccatataccgcagctgcagataatcctctatgcatatgctgcatgatacagtaccatcgctacagtacatcaagcactgtagaaaccatataatcctcaacagttttccttccgttttccttcacgaacaccaacgcttaatgtagaaacacctcgtgaagcccgttgcaaagatctctcccacacggtgtccatccactatgtgccatctcatatccaacttcgtcacccattatcactgaccgtttgcacctcaactgctcccttgtctagtcccgatcccacgttgaccgaagttgacctccaaaaatcctaactctagtcgctttctcacatggtatcccaaccgcactggacatctgctcctccctgagcatagtctcgatcctcaccattaaccaagactgaccataagttacctacacactatcagacaacacgaattgactcgcattagccaacttgcgcttcttgctttccatcttcggtgcttgtcctccaagcggatcgccttgtcgactagtttttggaagtcttcgtagtcaccagagatgagatggattgacaattcatcattcaacccttcaagatatttctcttgcttctcttcatcggtgcgaacgtcctcgggagcatagcgggccaacctattgaactcgtgcaaaaattcagtgacggtcctgccatcttgcttgagttcacggaattctttcttcctcagggctaaaactccagcaggtacgtgagctctgcgaaaagcaatagagaaacgagcccaagtaataacttgtccagctggttgggtggcctggaagtggtcccaccactcggaagcagtgccatgcagttggtgagcggcaaaagcgactttctcctcatcagtacactagataaggtccaacttcttgttaaccgcgtgcagccagtcatttgcttcgacggggttggttgtgtttgaaatagtgggaggccggacttggagaaattccgacagctttgattgtggtggagcgtgtatgggagcttgagcagcaggtgcttgcgggttttgcatttggtggagcaaagctgcgatgagatggttttgattggcgagcacttgtgctaagttggggtgatcatggattggtggaagtggcggtggtggtgcgtggccttggttctgattctggttctggttcttgttctgattctgattctgagctgagttcccagcacgagcattgttagtagcaatactccttgtgtttaccatctgtagtaaccaagatgagaggaaaagaaagaagggagatattaggacaagaacacgagctattaaaccaacttatttaaattttattgatgtgatgttggttacatagagttcaagttgcttaagcaccacaaaggtacagctatatcacaacgggtcgatatagtccataccaaaaagcacacaaggcaacaaactcaagtagaagataaatgataaaaatagacgcgtactaagactacgcgtctactcgtcctttgttgcgttgtcgtccactgtcggctctgactcatcatcaccgtcataggagttgtcgttggagtcatcttcattggcaagagccacagtcaatccccttcgctccaagtagttctggacaatcaccctggctgacgcttgagcatcgtgcaccatcggaggaaggccatctcgcttgcgtgtcgtgatcttcaaggacggtccaacacggcaacgcttagaccccacaacagagcttccttctccaacctgaccatgtccgagctcgaggttacgcaattcccgcttcaggctagccatctccaacttcacacacaggttcttcctccttagccgtagaatcctactagaagcttgaataaaacctctcttcgccatcttgtagtagtcgacacgagcatcatcatacgcctgcaccatcttggccaggtgatcgatcgtggtgtcgttctcgtgctcggcatccctgaaggtggcatagtcctccgccaaactgcgagtaggatgatagcggaatggagtgtgttgcagacgtgtccagtgtcgttgaagcagcctgccaatgcccagaagcaccacttcttggcatgcgtcgatgaaggtgtcagtccctcccgttagctccaatgattccaagctagggttggtggagagcaaggtggccttgactgaccatcggggggatgccaactctttttctccttcgtctggcacagtggtaccaacaaactggacttcttcggtgtagcccagctcaacgatcaagtggcgaagctgcagaactaaccccttaagtgagacgccattgtaggggccaaggctggtcatctatttttcaaaaaaacagaacaaagaattagtaaacaattttgcaaagcaagagagggtgaagatagaataaaaaaagtttccacaattaaagaactattttctaaaaaaaaaatatcatcctaaggcttagaccacttgctcatcctacggtcaaggtggctctgataccaacttgtcacgcccggaaatatacaccatttccaaacgctcagtgcattaatcctcgtcccagaaggcgaggtacacatagacattgttgattattacaagccacacttgcggaaatgtaaagcaagtactttattacatgggcgacttaggccctcacactcaaagataaacaaataaaacagcggaagactacagaacaggcacttgatggcggagcgaactagagatccaagccttcatcttcctcaggtccatcctctggattatttttgtgagcaagactgagtaccaccaccgtactcagcaagtcacaccggaaatgcaacaataatgcatagggtaaacaaggaaatggcctaatagggtttattttgcataaagccatagtttaaacattttaatcaggttaaagctcattctaaaacacgatcctgttctaagccaatattttcatatcatcaaggtcgcatgagcctgcgaacctgtcttaacccaggctaatctccacatgactacaccatcatgatttcaccctcccaaggttttataaaacaaaactaactttgggtacattgctcagcttgcccataaccgagggcgcggctattcgaataatttttaactctgatcagaggtgtacaactttacccacaagacacaacctcaacacacgttaccacgcaccgggtactatcacagtactcgaatagaggtcgtgacaagactatccatctaggtctacccaaaacaggagaacccgctgaggtttcgccgcccgccggtccccgacaaggtaaaggatgccggatcccccaggacgagacaggtccccccttgcaccgagtgaaaattggccttaatccaggccccacacgcttccaaccaatggtctttgttttgagaagatctaaacttctagtcaggccttacccactagacttgtggttgcacgaagatgccttgcaacagaggcccgaagaccggtccttatattagccggggtgtgactaccaaaataacctgcttgcaccccaagcccagcccaaaaatatgttttagttgtacaaagcattttatcacccatctattgacaaaccagtcaatagtccataactaatccagttttagttgttaaccaccatagtctagtttatccaaaagttctacttcctccgtttcacaatgtaagactttctagcattgcccacgtttatttagatgttaatgaatttagacatatgtatgtgtgtagattcattaacatctatatgtatgtgggcaatgctagaaagacatacattgtgaaacggagggagtaggttggaactaagcatgactaagcatttacctaaaacaactagttagtccatcatgtaggatactagactagtcaagttataattttactagggttcacaatgatcatggatatcaaatcaacatcatggccataacaaagagcataggaataactaataaaacaatattaataatgaacggtataatctataaagcaatgcaatataagtaaaaccacataattttcacaatatgggattcaacatgttcaaggtagatatgacttgccttcgctcacaaagtcttcggcgtcaacggcgatgaagagctgatcttccggaacagcgggatctacacgaccaacacgaagaaatataaaaaggctaataaaaaccacatgaacagaagcgacaaagcacataaatgggttctactcatttttaaggggaaactagagatttgaacgggtcgattctgagttcaaacggtcaagatatggccatttgaagtttagttgttatttaaatggaaatttacaattttgtgaattatttttctaaaggaaaacttgaattattgagagagagcgcacgcggaccggtccacgagcgggtcccacttgccagccgctcgatccaccgtgagccgagcacaccgagggcggctcacggcacaccgacgcacaggcacgacagcaaccgagccaggcggctcgccggcgacggccaacggcgcggcggcggtgcgacggactacaggaaagggaaaaacgaaaagaggaggaggtgacggttctcaccgagcagacacggcggcgagaggtcgacggtgttgctggcggcgagggagaaacgacgaggaacttcgggttgtcggcgtcgtcgtcgttcccgcggtcctcgtgctcgacggaggggtggacggggaagaggaggaagcgaagaagcggatggtggcgacgccgggctccgacgaggtccggaccaccggcgaggggcgaccggagctgtgacggcggcggcacaagaagagagcggcgcggcggccgcgaagagaggagggacagagcggcggtgtgtggggagggaggagggagtcgagggtcccttttataggccagaggggagggataagggtgccggggagggagatcgacgccggccatggtggagctcaccattgatgaacaccatcaaaatccaccgcaaataatgcgggatcgagtgtgaaattatgggggaattggacaggatgaggtggaaattaattcccctcaattaatttgatgaaacggcgagtggaggaggcgaatctgaggttgccgtcggtaggaattcggccggagagagagaggatggctggaggttagggatgacgggtgggacccacctgtcatcgagagggagcacacctgtctctgactgggcgcgcgaaggaggaatgatggacttagtccgagggagaaggaatgagctgggctggcccaaggagagggagggggaggggggaataagttcaccttgggctgggccaagagagggagagatgggctggaagcagcccaagaggaggaaggggttttcttttagcttttcctttttataaaattcctttaattgtttttgttgccttaaaattatttaggatgctctgaaaattcaagtaaaaattggttacacattttgaagcatggggaacttattaaaaatacccactagccaacttgacataaatcttggtgaattttaattgttggaggctcttttaggctttttaaatttctagaaatgcattaaagcacaatttaaacttagagcgattttcagggcgttacacaggcccaggaagccaatcccggagcccacgagtcaccctcagcctggcctctcctttcatccgcgtcgctggcccacgctgccgtcgatggggaccgactcagcccacgccctacgctgaggcatagccgccgctgaacttccacaagccgcgcaaggagaaccggtgtcgtccttccttaaattggtgttatgcatcgccctaacactaacctctccctctatagataccgccggtcgtcgccccttttcctccccttttttcctgctatttccactgtcgccgtgccaccgacttcgcctctgcctcctcctaccgacaccgcagctagccagtgcctcggtgcgccgtcgccacagaacgatgttgtcaatgccgttgtgccggagcgtgcccatggagccatggctgctcttcctcctccgttgtgtagctgatctgtgggtcccgcgacaaaaaatccccaaataatcacagccatccaaacccttgattcaatctcaaccattggatctatttaaccctagatccatccctgtcagcgccacatcattgccctgtatcacctcatgtccatacgcatcagctgagtccacatacaccgagtccaccatactccataacactgtcagtgggccccacacatattttcttgtcagaaaaaattcaatccccgaaattaagtatccaaagaatattcccggaatattacttttttcttttaccctcagattttctctgaattcaaacttctgaaggctataaattttccattcgaactctgattcaatccattcttccaccttaagtcctctaaaatcgagctctacgtcctggtttaatttgttgtttcattttatgttctttagttagatttttcttttgtttatttgtttttcgtttgcgatcgtatagacattggagcagaagagcagtttgtttcagaagatgtcgtgcaagactgggatcaacgcaagtgcactctttgaacatattgatcccatttttatcaattgttttgttttgaatacatgcattattttatttacgaactaatgatgggtagcgtaacctaattttcattatatcctaccttgataacttttgattacccatgataccttgtcaccctagtctttgtgagttgaacattaggctcaacaggatgcaatgtcgtacaccccgtaaaatagtgaatgctgtacaattggaaactttttttttcttgttgtgcattagcttaaattgattaacgtaaattattattactccgttatgctctatagatagtagcaatatgaaataactgcatacatatatttgtattaactactcaattatagttgtctcatttatttctttcagaggataccatgaaatgcaaccctacaaaagcatagtgctaccaatgatatatatgtttgggcttcaaggatagaaactatatcaaggcggcaatatattactatttattcgctcttacagttttataacatcggattgggaaaaccatttcatgaaaaaaagtttcctgcacatggagaccaaggtgttgccctcaagtatattaggaacccaaccgccgctttattggatttaggagttggttccattgtgcaacatgtgtgctagtaggggtgaaaacggtacggaaaccatctttatcgttttcgtttcaattttttttcggaatcggaaacgctggatacaaaaacggaatcgaatattatcgaaaccgaaaacagagtgaaaacgaaccggcgcgaatacggtaacgaaaatttattagaatacaaaaacccatcaaactgataaattcaattctcaagtctcaacggtcaacaatttattataaaacacaatcatataagtccaattgnnnnnnnnnnnnnnnnnnnnnnnnnnnnnnnnnnnnnnnnnnnnnnnnnnnnnnnnnnnnnnnnnn

SEQ ID NO: 27100 - DNA, 2153 bp, Oryza sativa
  unsure (1)..(2153): unsure at all n locations
nnnnnnnnnnnnnnnnnnnnnnnnnnnnnnnnnncccatttttatcaattgttttgttttgaatacatgcattattttatttacgaactaatgatgggtagcgtaacctaattttcattatatcctaccttgataacttttgattacccatgataccttgtcaccctagtctttgtgagttgaacattaggctcaacaggatgcaatgtcgtacaccccgtaaaatagtgaatgctgtacaattggaaactttttttttcttgttgtgcattagcttaaattgattaacgtaaattattattactccgttatgctctatagatagtagcaatatgaaataactgcatacatatatttgtattaactactcaattatagttgtctcatttatttctttcagaggataccatgaaatgcaaccctacaaaagcatagtgctaccaatgatatatatgtttgggcttcaaggatagaaactatatcaaggcggcaatatattactatttattcgctcttacagttttataacatcggattgggaaaaccatttcatgaaaaaaagtttcctgcacatggagaccaaggtgttgccctcaagtatattaggaacccaaccgccgctttattggatttaggagttggttccattgtgcaacatgtgtgctagtaggggtgaaaacggtacggaaaccatctttatcgttttcgtttcaattttttttcggaatcggaaacgctggatacaaaaacggaatcgaatattatcgaaaccgaaaacagagtgaaaacgaaccggcgcgaatacggtaacgaaaatttattagaatacaaaaacccatcaaactgataaattcaattctcaagtctcaacggtcaacaatttattataaaacacaatcatataagtccaattgttaagtctcaacagtacatcacaaaacacaaatctatggaataaattatctatatttaagagagtaatgttgttgataaatcccaatgcagaaaaaatatattcttatgtaacttcaaatttgcataacaaatattttttttaaaaaaataaaagccaaacaccgtggtagatttgcataacaaatatttttttttaaataaaaaagccaaacaccatggtattcactattcagtgctaaaaaaaatccagggtattccgagaaaatttccagaaagtttccgactgattccacgttccgacaaaactgcccttatcattttcgattctgtttctgagaaaatatttccgaattcgtttccatttccgaaaaaattccaaccaacagattccgttttggaaataagtccggaatccggaaagtttccgtaccgttttcacccctatgtgctagtggcgtcttgtgcttgcttaggttgatttctgacctggtcatatcttatttcatattctgtaaattgctagcatgcaaatatatttcgagcatggggagcagctctccaacccctgggaaaaccggttgatgcaattaagtgaagttacatgcttttagactcaagtcttaaacagtatggtgatgttatgaggttgtgtctttttaataagaaatgttatgtcagtttacaatataatcgcataaattgatatggatctgcactccaagacgctgtttgtgctaaaatacttaattaatataataaaatcatagtacttttgtacatatagaaacagcagaatagaagaaaatttctcataaatattagccatataaatttcagctctttccagtgggaatatacaagagtgcagtatatcggagatattaaagaggaccatagaatgctcgcaccacagcgattctgcggtttttcggctggcgtgttcgcttcccgtgatgtccacgctgggcgctggagctggcaatcttgcaaaaaagtccttgattaacttgataatcattcttaagtccctcactgtatgtttctgtattttgtattcttttgtaaaagccctcaatgtcttggtatatcctacgtgaaggagacgaaattccaaatataggaccgcgctctgaaaaaaggaaagtaagggtgttttctgcaaaacagaacatccctnnnnnnnnnnnnnnnnnnnnnnnnnnnnnnnnnnnnnnnnnnnnnnnnnnnnnnnnnnnnnn

SEQ ID NO: 27101 - DNA, 1232 bp, Oryza sativa
  unsure (1)..(1232): unsure at all n locations
ctcggtaccccactatcagacaacacgaattgactcgcattagccaacttgcgcttcttgctttccatcttcggtgcttgtcctccaagcggatcgccttgtcgactagtttttggaagtcttcgtagtcaccagagatgagatggattgacaattcatcattcaacccttcaagatatttctcttgcttctcttcatcggtgcgaacgtcctcgggagcatagcgggccaacctattgaactcgtgcaaaaattcagtgacggtcctgccatcttgcttgagttcacggaattctttcttcctcagggctaaaactccagcaggtacgtgagctctgcgaaaagcaatagagaaacgagcccaagtaataacttgtccagctggttgggtggcctggaagtggtcccaccactcggaagcagtgccatgcagttggtgagcggcaaaagcgactttctcctcatcagtacactagataaggtccaacttcttgttaaccgcgtgcagccagtcatttgcttcgacggggttggttgtgtttgaaatagtgggaggccggacttggagaaattccgacagctttgattgtggtggagcgtgtatgggagcttgagcagcaggtgcttgcgggttttgcatttggtggagcaaagctgcgatgagatggttttgattggcgagcacttgtgctaagttggggtgatcatggattggtgaaggtggcggtggtggtgcgtggccttggttctgattctggttctggttcttgttctgattctgattctgagctgagttcccagcacgagcattgttagtagcaatactccttgtgtttaccatctgtagtaaccaagatgagaggaaaagaaagaagggagatattaggacaagaacacgagctattaaaccaacttatttaaattttattgatgtgatgttggttacatagagttcaagttgcttaagcaccacaaaggtacagctatatcacaacgggtcgatatagtccataccaaaaagcacacaaggcaacaaactcaagtagaagataaatgataaaaatagacgcgtactaagactacgcgtctactcgtcctttgttgcgttgtcgtccactgtcggctctgactcatcatcaccgtcataggagttgtcgttggagtcatcttcattggcaagagccacagtcaatnnnnnnnnnnnnnnnnnnnnnnnnnnnnnnnnnnnnnnn

SEQ ID NO: 27102 - DNA, 748 bp, Oryza sativa
  unsure (1)..(748): unsure at all n locations
ctccaatgattccaagctagggttggtggagagcaaggtggccttgactgaccatcgggggaatgccaactctttttctccttcgtctggcacagtggtaccaacaaactggacttcttcggtgtagcccagctcaacgatcaagtggcgaagctgcagaactaaccccttaagtgagacgccattgtaggggccaaggctggtcatctatttttcaaaaaaacagaacaaagaattagtaaacaattttgcaaagcaagagagggtgaagatagaataaaaaaagtttccacaattaaagaactattttctaaaaaaaaaatatcatcctaaggcttagaccacttgctcatcctacggtcaaggtggctctgataccaacttgtcacgcccggaaatatacaccatttccaaacgctcagtgcattaatcctcgtcccagaaggcgaggtacacatagacattgttgattattacaagccacacttgcggaaatgtaaagcaagtactttattacatgggcgacttaggccctcacactcaaagataaacaaataaaacagcggaagactacagaacaggcacttgatggcggagcgaactagagatccaagccttcatcttcctcaggtccatcctctggattatttttgtgagcaagactgagtaccaccaccgtactcannnnnnnnnnnnnnnnnnnnnnnnnnnnnnnnnnnnnnnnnnnnnnnnnnnnnnnnnnnnnnnn

SEQ ID NO: 27103 - DNA, 706 bp, Oryza sativa
acgatctccacactggtagcaccatccttcgagattcttaagggaaaatgaaaagaggtcgagccgaagacgctggcgcgacagcttggtccggcttggtccagataagcgggaacggcgatgatgtcgctgcgccggtgcacagagcgcgctctagagcgaccatgacatggcggcgttcccgctgctgtagaagatgaaatggaatgggatcaaaaccaaagttgttcggcatggcgatatgagaatggaacgagtatgagttagagatggagagggctcgacgacggttggcaatgtccctcttcttggcggccggcgacgaaagagaggtagagagggagagctggagcttcctccctcggttggatcggcactgggatggtgggtgaagagtggcgacacagctgggtggaggtgaagcctcggttcggcgctgccacgtcgaggccacgcgtcgtacacagccggcgccaatctctctctctctctctcggctgtctatggtcggctggaagatttgcacagggtgaggatgagccagagtggctgccaagtgggtccaggtcgtggcaaactaagctagggtgagagggttgggcagaaacgtgggtgaacaaaagatttgaatgattttcaggattatttctctctcccactttagtaattcaattatttaatttgtgggtaggataatttagtgggg

SEQ ID NO: 27104 - DNA, 696 bp, Oryza sativa
tacatacccctgaattttagtttggatcgcttccacgcccttttctctagttgactgctaaattattatgaaaaagtccatttttccctttgctacgagaaacataataaattaatggagtacattgttggatgtagaaatttgttggatgagactattatatttatgagtttgttatgcaccatattaactgcgacaaatttagttttagatttgatataaaaatttaatatttatttattagttattgaatgtttttttatgtagcatattgttgacgaaaaatccgcactcggccagtggtgccgggtctgtgctggcgcaaactaagtcgacgaacataacggtctgggagatctgcttagctccagtgcaggtccaaaggttggtgaaatacaggcgtgtcagtcaggtttatcctgaaactaacaagatatacaaatagcaggtcaatgagcctatcggctgacgagccgatggagtagttccagtcgatgccgataccagccgatagtgatagggtttggagctatcggttatatatccaatttagattctgatacttgagacaatcggctgataataataaataccaataatataatccagtagaaaccaatcggctacattgatatgatagaatagcactgatccgaaggttgaagaatacatcggttggagatccgatgtcataaa

SEQ ID NO: 27105 - DNA, 587 bp, Oryza sativa
tacccactagccaacttgacataaatcttggtgaattttaattgttggaggctcttttaggctttttaaatttctagaaatgcattaaagcacaatttaaacttagagcgattttcagggcgttacacaggcccaggaagccaatcccggagcccacgagtcaccctcagcctggcctctcctttcatccgcgtcgctggcccacgctgccgtcgatggggaccgactcagcccacgccctacgctgaggcatagccgccgctgaacttccacaagccgcgcaaggagaaccggtgtcgtccttccttaaattggtgttatgcatcgccctaacactaacctctccctctatagataccgccggtcgtcgccccttttcctccccttttttcctgctatttccactgtcgccgtgccaccgacttcgcctctgcctcctcctaccgacaccgcagctagccagtgcctcggtgcgccgtcgccacagaacgatgttgtcaatgccgttgtgcccgagcgtgcccatggagccatggctgctctttctcctccgttgtgtagctgatctgggggtcccgcgacaaaaa

SEQ ID NO: 27106 - DNA, 757 bp, Oryza sativa
  unsure (1)..(757): unsure at all n locations
ttatgataatgttagccatacatttgaacgatgtgctttttgttatgaaatatcaaattagttagaggtgaagaaattgtcttattcaaactatgatggccatatcacatcaaacataccacaattgttgtactacctcgatctccgggcctaatcgacttgcagttatgacaaatttctacagtttcttgatgtataaatttacaacgaattgccacgctgtccatattgtactcaccccaaattggtaccggcctaaatataaatgttcagaaaagaaacctgcatctaatataaattatgggtactggttactagcaaaaactagcaccaatactttatatgccggttattaaaaaagttggcacctatagttgatccagtcgtcagtggagtacttgtgaacacacctatatgtaccagtctacttaaaaaaaccggcacctatatataattaggaagttgtaggtaccggttcttagatttgttcctaatttatatggtcgtacatgcatcctttgaaggactaatcgtaggtttatcacataatgtctccatgcacaaggaggtacatatatgatgcacttggctcggtgaggtcaagataattgtgtttttttatcgctttcatcaaagaatcataattctgacatatacagatttcttatggaatctatatacttccattgcaattgtgattgagagaannnnnnnnnnnnnnnnnnnnnnnnnnnnnnnnnnnnnnnnnnnnnnnnnn

SEQ ID NO: 27107 - DNA, 1137 bp, Oryza sativa
  unsure (1)..(1137): unsure at all n locations
caacgtacgaataacagttgaggtgaaaagttaaaagaaaatttctacctaggatagactgaagcaaagaaaaaaaaaagcaaacaaccaaccaacctgctggatgtatgggatggacatgttttaatgcaaccatattcaaaatcgaaccacaatgttgtgtacaaccatgcctattaaatgtgatcaaatgtgtggcttccacggttcttgcacttgaggtgtttgtttcatcagtacatcctactgtgaagtatacatgtatcaaagttgtctaaccttatagttttggattgggatgtctcaggagatctagccctacatagcagataatgcatactagggtaatatttgtagtcctagatgggcacatttgcataggtactggcaaaagatggtgattatctgtcaattactccgtagctttcaagtacagagtcagcatatgttcttgtgtgaagtgtagaaggagctgatgtcctaattgatgtatacagaacacatgtgaatctacgtatctgaagaggatgctatcagcgtcgaacatttgtgtcattcttcatagatcacactttcaatgtcaagtcgaatatgtttcctgttagcatatttctgttgtgaagtgcatgtgcattttatctcttaattagtagcggactttgttatatcctctgcgattctttcgtttttgcatcgactgcaggctgcaagacgtgttcagtccacgtaggttggcattgttggaggtaggatcgatcatgcccgtgtgtgtagaatctgcgtgtttatttctgctatataatgagaagagaaaacccaaaagctgcagaagttagggcagcaccaaacttgttgtttgtgttcctgcgctctgagtttccatgaaatcgtgtgcgtgtgtatttaggattagacaccaacgtttcctgcaatcttgaattgcctttgctccattgcccatatgcggcgatgagttttctgcttgcaatattttcaataccttgtttgtctgcacttccattatttcctagcaacccaatatttcagaaaaaaaaagacgtttgaaatttnnnnnnnnnnnnnnnnnnnnnnnnnnnnnnnnnnnnnnnnnnnnnnnnnnnnnnnnnnnnnnnnnnn

SEQ ID NO: 27108 - DNA, 1063 bp, Oryza sativa
  unsure (1)..(1063): unsure at all n locations
gcgagcggagcatgaaggcggctcccttgttcacaagtttatgagtgatgggggaaatcatccattctgtggatatggcccatccgatggcagctatcgtgacaggatcaatccttggaactctttgaatgtagcaaaaatcgtttctgtagttgtaaattgaattccaattgcacatatcaaagaggattaactcaaacatatatgatgaactgggcatgaatgtatatttggtgtgaactcattatcatctagcgagtaatatctattggctattgacaggcacgattaaaggttgacagatatgcttgccagctacacattaaccgagcatttttgtcaggaaagcattaacttgcattgattcatttgatatttttggatttgcgaaataatttctttccacaacatggcgattgttgcaatccgatctcccactataaatccaccatattcccctttccttgatttcacatcaatctaaccatctctcctcaatctacaggtgcattcttgctagaaagtagtgaactgcgtaggccatggctcgcaagaaggtgaagcttcaggggatcgtcattgatgtgaagcagcgggtgacattcatgaagagtctcaagggcttgacgaagaaggttagtgagttcgcaacactattcctcatggtgtacggtgaggttgaggtgcaagcaacgaaggtttggccgtcggtgtgggaggcgaccagagttctcgagcacttcaaggccatgccgcatctggtcagatacaagaagatgacagacctagaggacatcctcaacgagcaggtcaacaagctcaaagagcagttgcacaaggtgggacgtgatgctgatgaaagcgagaccaagctactcctcattgaagccattaatggccaccgcccgagcctcgagggtctcaccatcgagcaaattaccagcctcggatggatggcaaatgcacacctcaagaatgtcaacgaccggctcaagaagctncgtgaggaaggcctcatacctgcatccgtgtcattgtcgagcacggaagtaccaaatccaga

SEQ ID NO: 27109 - DNA, 1269 bp, Oryza sativa
  unsure (1)..(1269): unsure at all n locations
atctattaaaaaacggagggagtaaggtgtaactgaaagcctggttgagcactctttgcttgtgaggtagtctttacctaagctatgtgccaccttgttcgtagaccgatagacccgaacaactttaacttcctggaaagcactgcacttgtttatgatcacctggataattgacccatacaccgacttgttataattgtgatccctcatcatattagccacctctagacaatcgatcatgataattagtatagaaaactcaaagatatagtcgtattggctttgctagcttagagagcatgtacaatctgaaagaggctaagtttctaatattaacaatgcaagtagaaattgattcttaaaaacttatgagatatttagcccatcagagatagacacatctcatatcaagaaaacaataaacaatacttgttttcatgataagctaatgttcctctaaaagttaatatggtggtttctaagtgttggccgcattggtagcaaacgttataaacaagttattatattatcaatataatatagccaaaagagtactgaacagacatcaaatcatacatgttgttgagaatagaaataaaaagtacattccaaagcctccgatgccttactaattaaagaactgtataatatataaccaagttgagatattaacaagtggcattttctgaaggccaaacttttgcactgttataataacaaacgattcttaatttcattgaaatacatactaaaagaaatcgaggccatgtatatatataaatgctcacaaacgggattcccttcattcacggttcatgaacttctctctgacccttttgaagcatctaccaaaggtttactacgaacgatacgaagtacgtacagtagtttaccaagggatttgctttaattctcttctagcaggatcacttgtacacaggatcactcctagcagtgcagtggttggcctgtagacgtgcgcatctcaaactagttttcttccagcaacaacccgcgatgttgttgggaatagtccaacattgctaatctagggggagttgaaccaacttaaaagtaaaagtgggggaagcccttcacctcttgagctagcttttggggtgtagcgaggctttctaccagttggttttgggccaacaaaagatagtgttgttgtggagaaattgtttagtgcagttnnnnnnnnnnnnnnnnnnnnnnnnnnnnnnnnnnnnnnnnnnnnnnnnnnnnnnnnnnnnnnnnnnnnnnnnn

SEQ ID NO: 27110 - DNA, 1182 bp, Oryza sativa
  unsure (1)..(1182): unsure at all n locations
caaccctctcaccctagcttagtttgccacgacctggacccacttggcagccactctggctcatcctcaccctgtgcaaatcttccagccgaccatagacagccgagagagagagagagagattggcgccggctgtgtacgacgcgtggcctcgacgtggcagcgccgaaccgaggcttcacctccacccagctgtgtcgccactcttcacccaccatcccagtgccgatccaaccgagggaggaagctccagctctccctctctacctctctttcgtcgccggccgccaagaagagggacattgccaaccgtcgtcgagccctctccatctctaactcatactcgttccattctcatatcgccatgccgaacaactttggttttgatcccattccatttcatcttctacagcagcgggaacgccgccatgtcatggtcgctctagagcgcgctctgtgcaccgccgcagcgacatcatcgccgttcccgcttatctggaccaagccggaccaagctgtcgcgccagcgtcttcgcctcgacctcctctccatttcccctcaagaatctcgaaggatggtgctacgagtgtggagatcgtccaccgtcttcttcacctccggtcgccgtcgccattgtcgattccgcctcctccggtgagccattgtccgattcttcgcgtatacaccatccctggggcctcactaacctcatggacacacatacatgatagttcttggagctgattgagccatcgccgttcacccggaggttcttgccgccgccgagccgttacatgagccgccgtcatcaacctagctaccccagccatgtctagcatctcggtgagcacccttcagcctatagaacatacatgcatgcacccaattaaccaatacatgattgtagaagcacatgcatcaccacccgaaaacatcctcctttcggactcgccgccggcgttactccgatgtccactgaccaagaaaagtagaggaatggaatcgcaatatcatgatcttcattttgtcttttggtcgcacccccaaacgagccatcgtttgtcgccggtgagctcgagatcgagctcagccatggctgttctgcctctgtgcgtgagaaaagannnnnnnnnnnnnnnnnnnnnnnnnnnnnnnnnnnnnnnnnnnnnnnnnnnnnnnnn

SEQ ID NO: 27111 - DNA, 1345 bp, Oryza sativa
gtcgtcggttgccctcagtatacgagactaactgccctaaaaaggatattgaagaaagccctggatcataacttgctaaattctactttccaaattaaattaatacaacactaaattaaaaattgacgataattacggcatcatagtattaactttgaattctacaaatattaatttttggtaaatgacaattaaagggtccatgctatttttattttgcatgttttatttaacacaaacttgaaatacaatttacgatcatcataatacgattttagcagccatactttttttagttattataagatcatcaagataatgtccagttaatattggtatgggtacttagctgacacaaaataagttgtgaatcaacataatgtaagcatctccaaccattaatgtgtaggatagaacacaagtaaccaaggcatattgactatccatggtacatccggaaaataaaaaactttgcccggtatatgagatctattttttaaaaaataaaaacagagaagacaatggagaatgctaattggaaggaatcaatataatatggcccaagcagcatggaattcaaggattaagtgtgttggggattatttcattcctaggtaatatttttagaattatataaattgtgtaacatgacaccaaatgtacatgtgcaatgactaaaattccccaaaactatatggctgcaaagcacctcaaaaaaagcctaaacccccaaatgggcaaaaggtggggcaaacccattctcaaccgctccacactaccacattttccttcctcaagctcccgcctcgtccctacaggtcttcgatcaaggttgagctctctccttgtctcccatggagggagcacttgccatgttcgctgagataatattttgtcccaacaaactgtatgttctttcattaaaaacacaaaaatgtatcggcaatatgaggcacttgcaccacataaatgctttaatcatgtctgttatgggtggttgcattccaaatatagcttacatgtggttggtcacctaaaaccagcacgatgcaaaaaaagataggaaaaacgtgtctgcctcgttaggacaacaaatatcacgggaaaagattcatcttctggcataagatcctgtgggaaaattaaagttttactaagtttcatgtttcaactatttcatatggtattgtaggctgaatcgacaaaaaaatcattttcctcgcacttaagatttttcttgtgttgaacataaatctttttttttaaatttattcactcagatctttgcttttctagatgctcattttctaaaaaggaatttcaaccgttataaacattaagctgg

SEQ ID NO: 27112 - DNA, 828 bp, Oryza sativa
  unsure (1)..(828): unsure at all n locations
ccccacagcaatatgtcgacgcacacacgatatgacagccggtgctcatcgatgctgcatgtactgctcctccttgtcggcgtatccttgtcagccccaatagccacgacgctgcatgttgcattgccccactagctatgccgatgaagctggaatcccttaccatagttggcctcggagaacttgctcgggtgacggagtccaagaagcgcaagagctggagactggttcagccccgttcttcacacaggggcctggaccgggttaacacgcaagatagcaggagtgagcagtttcgttcctgtccgcactgcacccttgcaaaccctagattttacaaacattgtttttttcttggtgtatgtggagctaggacaaatactgcacaacaagcgtactagtattcctaaagcttcccactcctgaatggcggtgagaaatctaaggtgactacagtgcatgatatggcctcttgtcttgggagcttcacattttctttttgcgtgctgcagcaaaaactgaaacaggactgcctttttatagtgatcatgtatgcatgaggtatataattatactgtaagtaaagcagggctgccttttttttatagttatgtatatctcatctttttatttataactaattattataagtaaaacatcttattaatgacaaaaaataatttaatagaaaataatttgcatgtaaaacttttatatgtgtgtcctttagtaatttttttaaaaaaatatgggaaaacaaactacaacgatgaaaacctgaaatcaactnnnnnnnnnnnnnnnnnnnnnnnnnnnnnnnnnnnnnnn

SEQ ID NO: 27113 - DNA, 699 bp, Oryza sativa
aaggggtcctccacgattatagttttgtacaagaggaaacgtttttcatccaaggcttccttcagactcctttttagagcagttagactcttaaaccgagggtaactgacgacatgattgccctgtagcttgctcaatcatctaagtgaaaatggtatctatatgaaagttctagaaaacatgaatccacataacaagttccaaatagcggactttttcttcatttgacacaaacatgttgtgcgagagttatcttttcctacccacggataccatggatgccaattgcagaataatattttatgaacaccaggacttgggttgtcattatcattgaacacatttttttctctgtcggtgttccacatctcgtctgattacctagcgtggtggatctgcagtggcattattgggcgcatatatggcaaaaacatctggtctatggttgtcatttttgttattgcttatcaaatttggctggtcaaataattgattgccctgtagcttgctcaatcatctaagtgaaacttgtatctatatgaaaattcttggaaacaagaacccacataacaagttcgaaatagcggactttttctgcatccgacacaaaaatgttgtgcgagagttatcttactagatccacggataccatggatgccagttcataataacaccagggacttgggttgtcatcgtcat

SEQ ID NO: 27114 - DNA, 1028 bp, Oryza sativa
  unsure (1)..(1028): unsure at all n locations
acagtcgtagattttttttttggaaatgtttttttaggtggacggttttataagtgggaagaggttttcacgtatgaaaaatgagagggggagtggcaagacaaaagaccccatttatgtagtagagagctataactgaacttgagatatgtcgaaactactcccgagtatagcaaactgctataaatacaaatctttgtagtagaattacccctacattttggtttctctgagtcgatcagcatatggagataaaatatgacctcaactatcgttgattacgctatatgtaatttcaagaatttcgggaatttgaggcactaggaactgcaatgagtttagtttcaaaatgttgttataggtttagccaaaccgcaacacctcggggctgaaattaagacaggaggatagccatgccatttcgggtctttgggatgagagagtggtgaattttggttgtacgatgcgcttagctgacataagttttatgtcgaaattcactttcatcaaaggttttaagtgtcatgcttgtgttcaaacgaaacaatgtcgcaaggctcacaacacatttgaggcaagaaatttggcaacgctagaacttattcatttcgatatgtgcaaaatgaatggggaaagaaatacttcgtgatacttatagataattgcactagattctgttcaggattgggagacattgggaatcttagagataccgaatagtttattccgctatgggacacaagcgattttgctggtttagctggtggagactataacatgggcgattagggtagcgttagttgttacgattgtttacaatgtagtctgaggccctgtttagatcctccaaaatggcaaaagttttgtcattctgaagcactttttgccattttggatctaaacactagtagcaaaatttggcaatttggcatttgacattagctagtccatagtagcaaattgtgccaaaannnnnnnnnnnnnnnnnnnnnnnnnnnnnnnnnnnnnnnnnnnnnnnnnnnnnnnnn

SEQ ID NO: 27115 - DNA, 930 bp, Oryza sativa
attcacatgggtagcgtcaaagtgtgcaagtggcgttgacaacgatgccggcaagcttagcagtggtggatctagtggccacagccccggaaaagcggaattcgccgttgttggccttgggtgcggccagtggcggagccacgttgagtttgggtggtgcacaggaaccccctaaacttacaatgtctcacttaaaaacactagaatatgcagctttgcatcgaaatttttatagattttcaatggttagtgcaccacccttactttgatgttagctctgcccgtgggagtggcggggtctcaacaaagatgatagtggtagcggactgcatagacgatggtggcggcaagggcggatttgagctagggttttgcctatttgaatttttatttttgttgtgattttcgttcttgcaaacggatggcataactgaccttatgtgaaaattaccatctgcatggggttttgctactcgtatgggaaaatgttgatttttacatttttatagataaactcggggggcaagcgcttgcattgcccgcttgcaaaaatccgttgtagccttttgcagaaatgtaggctgtagcatcatttggtttaggcaaagaaagtacaaggaatagaactctataacttttcccaaggatcctccatctgaatttctttccctgcttgggtaccccaggaggcgcaggcagccctttcaaaaaaatcaaagaggccaagccggctcggcaatcatgtggacagtgttgcagttatggtctaccgtgatcggccataacgtcgatagaatttgcaaaactaaacttgaaccagttcctggcacctcccgattccaaaactcatcatcaactgatggctggtaggagatgaaagttgagagctgaaccaatagaagttggagccttccactgtttctatccaag

SEQ ID NO: 27116 - DNA, 591 bp, Oryza sativa
  unsure (1)..(591): unsure at all n locations
atggtatccgacggatatagagtgtccggtaaattatacgggtattacccggtaaactacccgtacattacccagattgctggcaccaccactccatcatgttaacaaccaaaagcagccagggagggggcaagcagtcaccgtctcatcgagggtgccgcacgccggcacgccgcgcgcgtgcacaaccactcgccactcacgagcngccgccagcaccggccgtgacggtacgatgccgatggcgccgcacatatgctagccgctagtggctacgctgncgcgcacccgcgttcggcgggcactgtctcgcacatcgccgcgtggatgcgcgacggccgtcgtacccgcgccgaccaccgncggactactttgatactgctgtaatagcactggtacttatggtgatgtacagtagtagtttactactgatatgcagctatggtgaacaacagtctacagcattgagtctctaagagcccactactagctncaattcatctatagccgatctaatagctaaattatataaatagtgcttactatactattaatatatactcccacatatcatacacacgttgtgtctta

SEQ ID NO: 27117 - DNA, 938 bp, Oryza sativa
  unsure (1)..(938): unsure at all n locations
aatagtttgtcagtttccttttatctttaggaaagtatgtttagtgtcctataaggactttatgttttcctttcatctttaggaaagtctctttcttatcctacaaggactagtatctacccatgggtataaatatgtacacccggggtcattgtaatatctccacgatcaatacaattcggtggatcgccaccttttaccttttctactttattttatttatcacggtggaacttgacacctgacgcggggctacatcgctattcgatctccggcgaaggggtaagtccaatgttctaccggcctagtcaattgtattggctacattggtgtcgttcaaggctgcatcagtacatttgacttcttggatttctatgggatgttgatatatttgcttggctatttatcatatgtcttagttaatctagtcttagtttctcaatttagctctatcggttgtctctcgctttagggtttctgccggtatcggctaaattattttactagattagattagctaaggcttctaccacccgaaaaatcagtcaacggcttgattatctagatattgtgtttcttttcaaacttagtgctgcatcagttaagtttgatctactaagtcatgtttagaaccataatctctagcctgcttttggactgccaataagggtttcatcagggtttcagccgatgaggtatctagatgttgcatcggtttacaaggattgcatataagttggatttagacgatgataacaaagatttcactgtttaatctaatcttctggattttatgacatcggatctccaaccgatgtattcttcaaccttcggatcagtgcttattcaatcatatcaatgttagccgattggtttctannnnnnnnnnnnnnnnnnnnnnnnnnnnnnnnnnnnnnnnnnnnnnnnnnnnnnnnnnn

SEQ ID NO: 27118 - DNA, 814 bp, Oryza sativa
  unsure (1)..(814): unsure at all n locations
aattacaagacacaatgcatgtgctgcgcatacattggaggtgtagaggatgcgaccattgcttgttcgcaagctgccgaagcttgcacttgggacacaagctaagaaaagaaagagagtggggaagaactaatgaacggagaaacatggatctggacaatggacacatgattatgtgaagaaaaaggtgttgtggcaccgacggtagctccatcgtctacagctcggcggccactccggaagctatcgctggatttgcagcacttggacatgttaatacgcacatttagctcttaaagtatgaaatagaaaactatagttaaatttaaaaagaacccaccctaggccgatctgaccacagctatcgggctgatctgatcggcggcatgtggtcagtcagactagcagagtccgattccaagttcgatttattggttcttggggcttcttgctaagacatgagattttagatttctaattggatatgaaatatatacgggaaagcaagtccaccactcctataaatataagggagcaaagaccgattgaaacaacaaccaatcaatcatcaaaatcaatttaatatcccaaccctctatatcctatatctctctccttttgtttacctatgccaagtctattctcctcaaaccatccaattgtttgtcgtctttcatctctatggtgttagacgacgtcctagccggcatgccgagtctaggacaaaccggtgtgtgttcactttgaagggannnnnnnnnnnnnnnnnnnnnnnnnnnnnnnnnnnnnnnnnnnnnnnnnnnnnnnnnnnnnn

SEQ ID NO: 27119 - DNA, 351 bp, Oryza sativa
  unsure (1)..(351): unsure at all n locations
nnnnnnnnnnnnnnnnnnnnnnnnnnnnnnnnnnnnnnnnnnnnnnnnnnnnnnnnnnnnnnaagctggccgccgcagctcgcaccgccgtcgtcgccggcgagcgccgtgctctccgacgaggacctcctcggcgagatcctcctccgcctcgagtcccacgaccacctcgtcgccgccgcgatcgtctgcaagcactggctccgcgtcgcctccggcgagctcttcctccgccgtttccgtgtcatccacccgccgcgcctcctcggcttctgcgtcgacgacggcggcggcggcgacgctgggcggcggccgcagttcaaggcactcccgcagcatcccgggcgtcgc

SEQ ID NO: 27120 - DNA, 356 bp, Oryza sativa
  unsure (1)..(356): unsure at all n locations
gaatgtcaagaagaatataatttggccaggaatgctgccaaatgcatgggttttgtctcaaggctttaccagagaggagaaagacctctagtagtacttgacttacattactctttgccctttcgtggatatataagacgtcgatccacgttgctgccactgcttggctgcatccgtcagcagaagacatattgcaaaattcccaactaatttgtaattaagtgccagactcaatgaattcattaaagttcataagaatcctaaaaaaaaatcaatgttacatttttatcaattttcgaaaataccagaacaacaannnnnnnnnnnnnnnnnnnnnnnnnnnnnnnnnnnnnnnn

SEQ ID NO: 27121 - DNA, 722 bp, Oryza sativa
  unsure (1)..(722): unsure at all n locations
nnnnnnnnnnnnnnnnnnnnnnnnnnnnnnnnnnnnnnnnnnnnnnnnnnnnnnnnntagatgattgagcaagctacagggcaatcaattatttgaccagccaaatttgataagcaataacaaaaatgacaaccatagaccagatgtttttgccatatatgcgcccaataatgccactgcagatccaccacgctaggtaatcagacgagatgtggaacaccgacagagaaaaaaatgtgttcaatgataatgacaacccaagtcctggtgttcataaaatattattctgcaattggcatccatggtatccgtgggtaggaaaagataactctcgcacaacatgtttgtgtcaaatgaagaaaaagtccgctatttggaacttgttatgtggattcatgttttctagaactttcatatagataccattttcacttagatgattgagcaagctacagggcaatcatgtcgtcagttaccctcggtttaagagtctaactgctctaaaaaggagtctgaaggaagccttggatgaaaaacgtttcctcttgtacaaaactataatcgtggaggacccctttctccattgaaggttgataagactggcagcaagatcctagcaactagtccaaccagagatgcaatattattagctttgggtgttgtgacatccaagtcatcaagtgtattactcacttgatggtgcagagataggtgaacaagat

SEQ ID NO: 27122 - DNA, 1119 bp, Oryza sativa
  unsure (1)..(1119): unsure at all n locations
nnnnnnnnnnnnnnnnnnnnnnnnnnnnnnnnnnnnnnnnnnnnnnnnnccatccctgtgtgttgattgtgctgtgtggtagcagctgtgtgtgctgctgctgtgtggcagggatggtataggagatcggcgacgagcagcagggcgcgcgccgagagatcggccagcggcgtaggggcagggagcacgcagtggagggatctgccggcggcgttggggaagtgaaaaaacggaaatatctgttggtaagagaagagcccacttttagttttggggattaaatcttgattatctgttggagggaggagttttttcacttcctattttcagtttaggaaacccaaaaatatttttttgggagattataggaggactgctggtgaggctccaagggagagcgagtggattagctggtttatttctaaacataatagatcaaacaaattaattagtgggtccacatgttaatagaaatcaacggttgagattttttcagaatatttaggatttttctaatttattaaagtgccatgtgatggcttatgaacgtttacataaatttctcgtggcagcttaagagcgtttataggaaatataatagatatttagtatataatatataaaatataaatagattagggattgacagctattggaaaactatccaatcaactacgtggcgcaaataaaaccaatcgtttgcgccatgcatctctttccataatgtagctgcagaggagatgcaaaacgcaagactacataaagcacataacatagctgcttgattagttggtggaatattataatactccctccgtttcaaaatgtttgacaccgttgacttttttagtacgtatttgaccattcgtcttattcaaaaaaatttaagtaattatttattcttttcatatcatttgattcattattaaatatattttcatgtacacatatagttttacatatttcataatttttttaataagacgaatggttaaatacgtgctaaaaagttaagggccgttaaacatttttgaaatgaagggagtattgatctgcgatctaacaagtcatacaatgttaagcactctcaccattcacgctgagagttttatccttaca

SEQ ID NO: 27123 - DNA, 742 bp, Oryza sativa
  unsure (1)..(742): unsure at all n locations
nnnnnnnnnnnnnnnnnnnnnnnnnnnnnnnnnnnnnnnnnnnnnnnnnnnnnnnnnaaaaaaaatccagggtattccgagaaaatttccagaaagtttccgactgattccacgttccgacaaaactgcccttatcattttcgattctgtttctgagaaaatatttccgaattcgtttccatttccgaaaaaattccaaccaacagattccgttttggaaataagtccggaatccggaaagtttccgtaccgttttcacccctatgtgctagtggcgtcttgtgcttgcttaggttgatttctgacctggtcatatcttatttcatattctgtaaattgctagcatgcaaatatatttcgagcatggggagcagctctccaacccctgggaaaaccggttgatgcaattaagtgaagttacatgcttttagactcaagtcttaaacagtatggtgatgttatgaggttgtgtctttttaataagaaatgttatgtcagtttacaatataatcgcataaattgatatggatctgcactccaagacgctgtttgtgctaaaatacttaattaatataataaaatcatagtacttttgtccatatagaaacagcagaatagaagaaaatttctcataaatattagccatataaatttcagctctttccagtgggaatatacaagagtgcagtatatcggagatttaaagaggaccatagaatgctcgcaccacagcgattctgcg

SEQ ID NO: 27124 - DNA, 921 bp, Oryza sativa
  unsure (1)..(921): unsure at all n locations
nnnnnnnnnnnnnnnnnnnnnnnnnnnnnnnnnnnnnnnnnnnacgcctcgagagaggaatattggagacattgctgagcctttaacctgccagtcaacttcagcctgagatacgcccgtcaaaccactcgaaggcagtgaccagatgtgttacacattcaggagacttaacaaaaatggctaaagatctataacatctcaaatattcttaactcatactcatgtgaatctagttcacaggatgtgcactagattcacactttcatctcaagcatgattatacatagcaaacacaaataagatgaaagcgattataaactacatctactttagttacattggccgaccggccaaataaatatatagaacagcggaagcttgtctacccaatccacaagcacaccgactaggggtttaccccattaagttcaagtactagaagaagcagtcgattacccgcatcactcaaagactaagtctaaaacctgcaagcaaaagattaattcaatagcaagagtcagtacattattagggcaagcaccaagacaagcctaacaccctacttgcaaggcatataatcaaggaagacataatatggttctttttagcataaagcaagttttatttgcataaaacatttccaaatcaggtttactttcaaataaatttcaacaagctagtacttgtcatattgggcatcaaaataggcattaatcatgtataaatatgcacctcattgccttccatggcagcaaggagcaaggagatcattctcaaatctctttaaattgatttaaaggtaaatttcagcatttaggagaataaacacaagtctatactcaatagatatccacacgccgctcatgannnnnnnnnnnnnnnnnnnnnnnnnnnnnnnnnnnnnnnnnnnnnnnnnnnnnn

SEQ ID NO: 27125 - DNA, 1655 bp, Oryza sativa
  unsure (1)..(1655): unsure at all n locations
nnnnnnnnnnnnnnnnnnnnnnnnnnnnnnnnnnnnnnnnnnnnnnnnnnnnnnnnnnnnnnnnnnnnnntgcgtcacaaatttcagaaaaaaaaatgagaatatatagttgaaggtggcaaattaatactcaagtgaatataaaaaaagctttaaaattttaacacatacctacaaaataaaaaaatggaaataaaaataaggcaaaagtaagaattacgattccaatcaagtttaatacatgccttgatgttagtttatggtcatgattagaagctgatagcctcagctggctagaataactagtttcatcatgctcatgtctcttttagcagatcatcacctttcttcatattcttacatagggatctcgggctcccactcctgcctcatagagatgatactgatctagatggggccgtcgatatgccctatctcattctaggtggcagattttgaagagtgctactaagttcaccccaaatctgtactatgcatctctagagctcgcaataatcctctgctatcttacatttctgcttcctgcgtagcgagcagatgttcctgatgcctatcaaacctatgataaataataaaaccttatatatatatatatatatatatacacacacagacacacacatattatgtacagcagagctaccattttctattcaataactcagacaagtctgaccaaatggtggcaagggtggcatattcaagttttctgggacagcagagctaccgttttctattgaattggaagaaaaaatattggtactgtaactgttgaagtatagtctgaatattttaatttgttcaacctagctagacagaacgctggaactcacccctgcagatcgatgtgttggactggtggtatatatactggtataaggctttgatatgctagacatgtgtcagatgttggtattgggtactgcaaccgactacaactatcggtatatgcaccaatgtagtcacactcacacatattcattgtcatgctatttagtgttgtatactccctctttccacaaatataacggattttcatttcttttaagagcttaaggctagaaaaaacatgatgtccctgatgaatgatatataattgaggatagggagatatatatgatttgatgaaaactaaagttatatattcacggtatactactcaaaagggcgtacgatctatctagagtcaaagacaataaaaggttacatttatcatttagcactaggtgaaaccccgcacattgctgcgggagtttagcatgataacaataagtaaaaataatatgtaatacagctagacaacataagattatgtaaagttaacgtggtttatgataatttaaatttaaatagtatatagaatgatgattcaaatgtaaaagtaaggtgatatgactttatgaaagaagaaaagtatcgagatagtttggaccgtagattaatcatctaaaggttaaaaataattgaggtgatatggattaattagagaagaaaaggagagagataatttggaccatagattaatcatttaagcactaaaatattgatgtgatatgtcttaacgagagaagtgagaaatagcattaactagctaagactactaagtgaggatgaactaggtacatagcatatta

SEQ ID NO: 27126 - DNA, 9067 bp, Oryza sativa
  unsure (1)..(9067): unsure at all n locations
nnnnnnnnnnnnnnnnnnnnnnnnnnnnnnnnnnnnnnnnnnnnnnnnnnnnnnnnnnnnnnnttgttagtggatgatgatggtgcatcttgttaatacatgatgatgggacatcttgttagtacatgatgatttggcatgtttgcatgttaagccttagtaacataggatttgacacagacaactgcggattgctaaagaaatttgtttatcataattaattctctcttgctataaagttatagcccactaattcctaaagcttaacaagcaatggtgttccatcattatcatctaacaattattacatttaagcatcatgcaagcatgctatattatatataatttaataatttattaaattttagagatttaaaatgtaagcatgttaaatcatcccaccattcacataatatttcaatgtatctctctatcaatttttataatatcatatatacgtttatagttcatcttcatttagttcaatttttttcttttttctcattaagttatatcacatcaattgtttttagttcttagatgattaatgtatggtgcaaattatctctcttatattggaacagtcaagccatccaaacgtccgttgcatttctctttatgtagtatgtgactctaaggtgctagcatgtaaaaaccatctacccatgaataaaggcatgtacctggtcctgcaaagctagtgtttggaagcttaaatgcctacactaatgtgcttaaccatataattaaataattaattggaggtcctaacaggaaatgcatcattgttggatagtgcttaacctggtcatacacgcaattttgttagcttcgtaaaaatgttactcttttcgtttcattcgtttcatattataaggctaagacacttttatcaatgaatagaagacatatcagcaaatccactccgttgtcgagtctaggttatctgtaagtggtgaaatgatgtatgctattttagctgaaggtagaaaagtttagagaggttcaaatgatggacatctccagaataatttaattatgaaagtaaaaaacctagataagatgaatgtaccttaatttgttactcgaccgtgggcatgcaccagccccaaatcatatacagtagctatttcagcttgtcctggtggtagcttagggttagtttgagaagagggggattgagaagatacgcaaaacgaggtgaaccattagcgcatgattaattgagtattaactattttaaattttaaaaatagattaatatgattttttaaagcaatttttttatagaaaatttttgtaaaaaatacaccgtttagtagtttgggaagcgtgcacgtggaatacgatgtccttttctcacccaacctcccagaactcatcacaacgaacgcagccttaattaattaattaggatactatttcaagtttctgacaatagtcacgttgtcacatgcagtatatgctcttgcatttgctttcttatgcacgctatgtgtctaaacccactcataccatatcattcacagagcaatggccagaagctcggcactattctcaccacagccgtcgcgtttagggttggaaagcattgggaattttattttgtccatttctgaagattggactcgaattctaagctaattttgatcacaacccgaaccacatagtatgggggagaaattattttttctaccttcggtgcggtgaacttcggagctaatttggaaaacaagagataaatgcaaaaagttttctgctcctgaagtagcttcaacgtacgctcttcttccaaagaaccaaagacagaatgttgacctacatattagcagaagcatcttctataatccatattgtaatacttggaatcttaagacaagccaaaaaaaaaatttgtgtcaggggcttacggccatttttattttattttatttgtctatcctcatgctaatacagaaatcacatcgacaaataatatatcggttcaaattgaacatcacttatataaatattttttctgacatctcttctctcttataattaattaactaaccacttagaacacggtaaagaaagaaaataataaatataattaacacacatatttttttctgacatctcttctctcttataattaattaacttaccacctagtacacggtgaagatagaaaataaatataacttactatcgaatcaactccacggcgcaaacaaagccaatcgttttcgccacgcgtttctcttctcataatgtagctgcagaggagatgcaaaacacgccaacatgaagaattttatatattaactagatgctattataaagactaaataaagcacgtaagatggctacttggtaagttgttttaatattctaatattgttctgccatccaatgagtcatagaatgttaaccgttactatcatttacgaccctgagagtattatccttacatgacagaaggtgtaaaaacatgacggatatttctcgcccgcctgcccgaccgtattaatctgggataaattcggatacccgagtccttacacggatattggatacaaatacggatattttctggcagatatgagatcgggtttggaaggatggtatccgacggatatagagtgtccggtaaattatacgggtattacccggtaaactacccgtacattacccagattgctgccaccaccactccatcatgtcaacaaccaaaggcagccagggagggggcaagcagtcaccgtctcatcgagggtgccgcacgccggcacgccgcgcgcgtgcacaaccactcgccactcacgagcgccgcccagcaccggccgtgacggtacgatgccgatggcgccgcacatatgctagccgctagtggctacgctgccgcgcacccgcgtccgccggccactgtctcgcacatcgccgcgtggatgcgcgacggccgtcgtaccgccgccgaccaccgtcgtactactttgatactgctgtaatagcactgttacttatggtgatgtacagtagtagttttactactgatatgcagctatggtgaacaacagtctacagcattgagtctctaagagcccactactagctccaattcatctatagccgatctaatagctaatttatataatagttgcttactatactattaatatatactcccacatatcatacacacgttgtgtcttagagtccgtgcttgaccgttgctcttctctctcatattttatctcattaaaatatatttatagctggctaatagtcttctattgtacgtgctcaaatatattcatattatacatatatggaatggttgaacggctattatctatatgatatatatggtcgttgctttgatttgatgtccgaataaatattcgcaatcgatagagttcgtatccgtattggtgcgtattcgttccgtatttattcccgagattattcgggtctgtatttgtacccgataatattcatgtctgatccgatcccgattataaaatatgggttaggaatgggaaggatgagaaccaaccgaaccagacccgttttcacccttgcatgacagcaacacctcgtggatgatccgatcaaggttggtgtccccgggcccacttggcatcgttactcgtacggccttctccttccactctttgagcctcgccagcagcgcgaggaggtggccgaggcagttcgtcatggtagactggcacagcgcggggatgtcctgcgtggcgtcctcgtcctcggcaccgggcgtcgccaacgggaaaattaaacttgtacaagttgcaacaaaaagagcaaattaaactgaaaatagttatcgtatattcgcagctatatttgttatttttgttacaacatgtagaagttgaatttaaacttacatgtttgtggagtgatatatttcatattaatctatgttgctaattttttttaaaatattttgatgaatatttaggtgacatgcacgaaacgaggggatatcccctcaagggatgaaatcaccttcccgctttaatggtgctgttagctagaatctgttgctgctgctgttgctggaatgatattgctactgctgaagattggtgctgttgcttctggaaattctgtggcatctggaaattatgttgctgctccaggaatttgtgctgctgcttctgaagctcatataatgcaagaatttgtgctgatgctgatgctggaacgatggaatgatgctgctgttgctgctattttttttttgtgctgctgaaactgcagtgctgctgctgctaaactgcactgaaattgctgctaattaatgctgctgagatagcttctgttgctgtgctagctgctccttctgctgaaactgctgcttggactgctgaaaatataagcagtttcagctgaaaattagctgctgattctggaatatatgaaaattagctgctgcaggaggaattttgctgctgttgctggaatgtaactgctgctgctggaaaatgctctgttcttgctggaaatgctgctgctattcttgctggaatgttgctcctactgatgcataaactgctgctgataaaattgttgttgctggcttgctgctgtgagtgctgattgtgcttctgctgctgaaaattgatcacgaaaatgcagacatgtgtgttgattgtgctgtgtggtagcagctgtgtgtgctgctgctgtgtggcagggatggtataggagatcggcgacgagcagcagggcgcgcgccgagagatcggccagcggcgtaggggcagggagcacgcagtggagggatctgccggcggcgttggggaagtgaaaaaacggaaatatctgttggtaagagaagagcccacttttagttttggggattaaatcttgattatctgttggagggaggagttttttcacttcctattttcagtttaggaaacccaaaaatatttttttgggagattataggaggactgctggtgaggctccaagggagagcgagtggattagctggtttatttctaaacataatagatcaaacaaattaattagtgggtccacatgttaatagaaatcaacggttgagattttttcagaatatttaggatttttctaatttattaaagtgccatgtgatggcttatgaacgcttgcatgccttccggtcgactctcgtggatccccttaagagcgtttataggaaatataatagatatttagtatataatatataaaatataaatagattagggattgacagctattggaaaactatccaatcaactacgtggcgcaaataaaaccaatcgtttgcgccatgcatctctttccataatgtagctgcagaggagatgcaaaacgcaagactacataaagcacataacatagctgcttgattagttggtggaatattataatactccctccgtttcaaaatgtttgacaccgttgacttttttagtacgtatttgaccattcgtcttattcaaaaaaatttaagtaattatttattcttttcatatcatttgattcattattaaatatattttcatgtacacatatagttttacatatttcataatttttttaataagacgaatggttaaatacgtgctaaaaagttaaggccgttaaacattttgaaatgaagggagtattgatctgcgatctaacaagtcatacaatgttaagcactctcaccattcacgctgagagttttatccttacatgacagcagcacctcgtggatgactcggtcaaggttggtgtcccagggcccacctagcagcgtcacttgtacagccttctgcttccactcttctgcacgctgccgcatctcacgccccttctccccttccatggcctccagtgtcatggccgccacctctcctcgccacgcctcgccgccgatctccatcgcgacgccccactctgtctgcttgtaccggcagttcgtctgctgctccgcgaagaacagccagctcagcatcagcacgccggaggcggggctctccagcgtcgagttccacccggagtgcgtcaggaacacacccacagcgtcgtgctcgaggaccttatcctgcgggcaccacgcccggaggacgccactgcccacgacgcatattttgcatgctgcttttcttcactattttgcatacatagatccaccacaaaaagaggggtttaaaatcataaaaaaatacatagcaagagtggaaaggcatgtatctaaccaatgtagaaaaatctcccgaagatttcgagttcaaaacctttccccctatattttgttgttttcggagagaaacttcggttgaaatgaacagttctcagggaggaagaagactataagaaaatgtttttgcaggcggaccatataaggtttcgcccgtgaaacaatctttgcaggcagaccatatattacgtccacctgcaaagatcctaattatcgcaggcagacgtattatacggttcgcctgcgaagatagttttcgtaggtggcaccttatgtggtctgcctgcaataagtttttttttaggtggacggctagcatgatcttggttgctattatcgtaggcggccctttttctccgagggcaatgcccgcttgggaaaaaaatccccacgttgggaagaacgatttttctagtagtgctggtggtagcttaactgattaggctgcaatttctagtttataatagtcacgttgtcacatgtagcatatgctcttgcaagtgctttcatatgctgtgcgtctgtaccctctcatatcgtatatgtcattcacagacatggccagaagccctgtactattgtcacctcacccatcgcgcttagggttgggaagcattggaaatattattgtgtccgtttcggaccatttgattcgaatccttagatcattttgatcataacccagaccagtcgaacttaggggtgagaagcatctggaatattattgtgtctgtttcggaccatttgattcgaatcctaagataatttttccagaccacatagtatgggggagaaattgttttttcatccttcggtatggtgaaattcgaagatttggcaaacacgttttcttctgtttatatacgctcttcttcaacaaaagcaaagacggaatgtggacctacatattagcataagcatcttttatagtcgcagcttaagacacaagccaaataaattgtgccaggggattacgaccatttagtttttattttatttgtctatcctcacgcaaataaagaaaccacttcgacaaataatatatcggttcaaattgaacatcactaagataaataatttttctgacatctcttctctattatgagtaattgatttaccacctagtcctcgttataaagataaaaaataaatataattatcaaatatgtttttaataatcaggggttgacagcaattagaaaactatccaatcaactccatggggcaaacaaaaccaaacgtattcaccatgcatttctcttccgataatgtagccgctgaggaaatgcaaaacagaaaaaggcatcccgtgaagacgggataagtggataaccttccattcttatccgttctctttctgtgtctctctctctccccgatcctcgcttcatcgtcatccaccgccccaccctccctctgtaacttctcttttcgttcctagcagggggttgggacatgattcccatggcaagccctttaacaagattggaattgtccagcgctcgctatgctaatgtcacgtcgccggtggtggccatggggctctcgtatgctagggtccgggaagagatgcaacgagttcaaggtgggaggtgagttgaggtgtgtcgcaaacgatgtctgcgaccatcacacttgtgtgggtgtcgaggatcagggcagcgacgctccgaatcaaggatggcaacgagaatgaatggcatccctccacctctaaggaagtagccatctcattttcgcgcttgctttttccttatttcctttctcctcatggctctcatcggtgtgaagacatggtactcacagtatttaatgtctgggtatcatgttcttgatacctaggtatcaagtaactggtacccagattatccggattagtaccatatgtaacaggcctgatacctcaggtatcaggtaccaggtacctagatcagtctaacacccataggtaccagacctagtactggtatcgggtacctaggtatcaagtacttggtatctagatcggtctgatacctgtaggtaccaggtacctagatcggtctgatacccataggtaccagacttagtacttgtaacatcctgaaaatttccaacaataaaaatcactaaaatttcaaactttttaaaacttttgcatcatgctggttgttatgattcctattgcttgccaaaccgtaaatgatcaccaagaaggtaaagaaaagaactacatttaagcaatagatatgatttatgagaatataatattgttaaccctacaaataattacgcacaagaaaataaagccagacaaacggaaggttaattactaatttaaattagggattaaatactaaatacgtgaaccatgtgttgcgtgctatgacgtctaaatacacatgaaatgatgaccatttataatggaactctatctataacatagtttcactaggagtaattaatgggatattactaaactctaatggtctatataaaggtaaaccaattcacatgaaataatggtcatgtaaacaaattaagctttatacataaataagaatgcgttggtgtttaactaaacaattagattaatagtgtaccgagtctaaatttgctatttgtagaataaatagattaaaaatatccgtgtaaaatataatgctacacaaagaaactcgaccaatatgccattgaattaataaggacacatcgttatattaattccgatattacccgaaagtcttcaaaaatatataagttcactttagggcgaataatctagattaatnnnnnnnnnnnnnnnnnnnnnnnnnnnnnnnnnnnnnnnnnnnnnnnnnnnnnnnnnnnnnnnnnnnn

SEQ ID NO: 27127 - DNA, 2254 bp, Oryza sativa
cccattcccctcttcctctcctccttcccctcttcgtcccgtccaccgagccgagccgctgccttagtgcctccgctccgtgcgccgtcgtcgcgccgccctcgcgccgccgcaccgccgccttcgtgccgccgcgccgtgcgccgacgtcgtgccgccgtcgccatcgccggtaagccgccgtcccttccctcgttccgtcgccgtcgccgcccgggtggaaaggagccgagagagagagggaggaaggagccgggagtaggatgagagaaaagaaaagaaaagagagagaaagaaaggaagaggaaaagagaggccgacagagagagaaagagagaagaaaggaaaaagggagagaaagaaaaagaaaggaaaagggaaaagagaaaagaaaagaaaagaaagagagggagagaaaagagagaaaaagaaggaaaggagaaaatagaagggaaattgggggagaaattaggaggatttaggaaataaaaatggtcggggttaataatagattatttttggaaattcctcgagcgtaatggtatttcgatcgaaattccgagttaattataaatatatgtttcttgatcagattagattaaaattggtagtaatttagatataattaataaccaaacaattagatgaattcttatagattattatagattatttttggtaatctctataagtcatcggttcatggtagaaattcggattcaattactaggaatcttagccgtgtattatatttaatcgtttagtcatagactaaattaaattgtataatatttctaagatttcgtccgatatttagctcgtaatagaaatttctaacctgttatatggatataatgctcgggatgagtaaattaaaaacttatgacaacaaaatatttatacccgcaaaatagtttaaatcgaaattgggtttgccgtagttcgcagatagtaaagttaataaaaagtaatcgactttcgcattcgacttttactcggatttaagtgaaacttgaacctaaattcatctaaattcataagctttccaatgatatataattcactatttaacaaaatatatttataattataaattaattaatatcaaatgattagataatagttaacctaaatagtgtgccaatgaataaaaatggatattgtacagtagcataattatctttaacatgtattgtatagcttacagtaaaaagcaactactcaaatatatgatccaataataagatattgttgcttacacatatactatacatcccattatagtggtacggtatagtattaatttgcgtgttgcataaattaaattaagagggagagtatgacaaacatgtatattagataaatactagttataaatcttgacctcatataattataattatagttcaactgtaaattaggattattcattgtaaaattatgtgatgggataatctgtacccataatatgattaacctgaacaactctaacatacaaagcatggataattattaaccttttataatttattgtgacaagtaaaatatgttcataattaaagtaaagcttccatcaataaaataataatacaaatgattcactataactatttgattgatcctaaatccatctaacaacagaacctctagtaaataaccgtcctatgtagatagatgcatgcttagccataatccttccatagccacttgatagactaaaccactgattagccaaatatatatgtatcccataaatgctatgtaggttaactcctaaataggccacgatgacaatagaaagattaagaaactttagccttagcatgattgggatccattagcaaacacgaatagtacattttgttgcgcatatttgattgttgtttgaatattggtttttctcgcgtattatagaccttgtgtatcggttagtcgtgaggcaacgtctgcaacttccaggaggtgaagggtgatcaagattatatcaataataaggattatcctgagcaaggcaagtcatcactattctttgaacatgttgatcccaattgcgaaattattttgtttaccaataaaattgcatgcaatgatgaacatcctacttgtgattataccatgccttgattattgttcacctttaaatctttgtaaccatagatacgtacgagtccctagtcaactatgacacttgcttagaaatgctattttagattcatgcatactcatatttatcaaatgctatatgcttgggcaa

SEQ ID NO: 27128 - DNA, 18337 bp, Oryza sativa
  unsure (1)..(18337): unsure at all n locations
nnnnnnnnnnnnnnnnnnnnnnnnnnnnnnnnnnnnnnnnnnnnnnnnnnnnnnnnnnnnnnnnnnnnntaacatacaaagcatggataattattaaccttttataatttattgtgacaagtaaaatatgttcataattaaagtaaagcttccatcaataaaataataatacaaatgattcactataactatttgattgatcctaaatccatctaacaacagaacctctagtaaataaccgtcctatgtagatagatgcatgcttagccataatccttccatagccacttgatagactaaaccactgattagccaaatatatatgtatcccataaatgctatgtaggttaactcctaaataggccacgatgacaatagaaagattaagaaactttagccttagcatgattgggatccattagcaaacacgaatagtacattttgttgcgcatatttgattgttgtttgaatattggtttttctcgcgtattatagaccttgtgtatcggttagtcgtgaggcaacgtctgcaacttccaggaggtgaaggttgatcaagattatatcaataataaggattatcctgagcaaggcaagtcatcactattctttgaacatgttgatcccaattgcgaaattattttgtttaccaataaaattgcatgcaatgatgaacatcctacttgtgattataccatgccttgattattgttcacctttaaatctttgtaaccatagatacgtacgagtccctagtcaactatgacacttgcttagaaatgctattttagattcatgcatactcatatttatcaaatgctatatgcttgggcaattacctttgggaaggtaattgagatgcggcatgtggagacatgagcgccacattgccatgatattgatgacatgatttgtgaaaggaaaataaagtaaaacaactgttttcgactggggcggctggaggacttgggtggtgtccggaaaaggctagtgccgtccctggtcaattaaggaccgagccatgaagttaagcatgaaacgaccctcgtacaaccgtacttctcgaatgggtatagacctagcggattagatagctgagcggaggcagtatccatgcatagtggtttcttgatgtgtgaggcaggggctctacggtggggcagccattggtagaaccgcgaggcgggtgtctacagtggtgtcgtcattggtaggactgccatgtgagaatctaaaacataactataacttaatgcatgtgtgagtcttcccttcccgggtgcgccagaactcctctcactgctagaaaccgtgtacgcctagagtgcatgaggatgaaaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacttgtgggggatgggatattgcatgatgaattttatgctgatggagccacttcccgagaggagggaaggtggacatcctcagaaaaccatgacgattcaatggcgggaagctatccttgggatcacaatggatggtggacagaatcgtcgttgtttaaagtgaacactggtactaaaatttgatcagtctatgctaggttttaggcttgtgaaaagaattgtaaaattagctttatgcaaaagaacctgaagccattctttgaaataccctctatcatatgcattgttgttgtggtggcttgctgagtacggttggtactcacccttgctatttatatatcttttaggagagtgttgaagagaagcccttgtcggtacgcttgcgtatcccacaagatgatcggagtgcggtcttgttctaggtctcgttccccagtcgactgcctgtggcatgttaaccgggcccttatattattttgtcttccgctgttgttctctgatagttgttggcctacctgtccctaatgtaagtatttaactcttttagcctaaattcattcgtgatatgttgtgatccaactatgtatgtgtgtaccaactgctgatccagggattggtacggataaacacagaagatttccgatttccaaaatcgggggtctacagtactggtatcgagtacctaggtatcaagtacttggtatctagatcggtctgatacctgtaggtaccaggtacctagatcggtgtgatacccataggtaccagacttagtactggtatcgggtacctaggtatcaagtacttggtatctagatcggtctgatatccatatgtatcaggccttgtactaggtatcgggtacctgatacctagaccaatctagtactcaaattggccctggtgttagcatcataacaatcgaaacaggtgcgttgtgtctctagtgagaaaatgtgcactgacgtgtggtcccttgtgaggacacgaagagacgtgggctgacaaatgaaccctcacatggggtgaagttgataaaataataggagagagtagttagtccgaaaatacttgtatccggtcgaccggcgcggggggagccggatcgggcgctccccccgcgcactcctccccacgtgcgtacctggtccgcccacttcccctcctattttcccataaaaaatgtttcacctagtatacttataatgtttcactatttataggtctaatgttgcagtgaattaaaatattcttttgcaagaaaaaacccacatattttggaaactctctattaagaggatttggtttattttttgttccatcaaaaatgtttcacataatgtattcacaatatttcactatgtataaatttaatgttgtagtgaacaaaatattctattgcaacaaaaaaacccacatattttgaaaatcccctattaagagaatttggtttatttttttgttccaccgaaaaatgtttcacctagtgtgcacataatgtttcactatgtataaatcagatgttgcagtgaactgaaacattcttttgctatttgctgaaacattgtttttatataaggtgaaacaacgcccgatttaaacgagtgaaacattttcgatctacttagtgaaacaattccgatatacctagtgaaatatcgtgcaacatttaaaaaaaattcaataataagctaaattttttttcgtcggaatatatccatgtgtactcaatgcaaaacgcaagaagaattttatattcgaattagatgctcttattaagactaaataaaccacatgacatggctacttggttagtaggttgaatattataatattgatctgcgatctaacaagtcatacactctcaccattcaccctgctaattttatccttacacgacagcaacacgtcgtggatgactcggtcaaggttggtgtccccgggcccacctggcagcgtcactcgtacagccttctctttccactcttgtgcacgccgccgtatctcacgccccttcttcccctccatggcctcccgtatcatcgccgccacctcccctcgccgcgcgttaccgccgatctccatcccgatgccccactccgtcctcttgtaccggcagttcgtctgctgctccgcgaagaagggccagctcagcatcggcacgccggcggctaggctctccagtgtcgagttccacccggagtgcgtcaggaacacgcccacggcgtcgtgctcgaggaccttctcctgcgggcaccacgccgggaggacgccacggccctcgacggcggcgtggaactccggcggcagcgcggcggcgtcgccctctccccccttgacgaggtctgggcggacgacccacacgaaggcgtagccgctgtcggcgagcccccacgcgaactccagcagctgctcgctcgtcatcaccgcgatgctgccgtagctcacgtacacgacggagctgggccggtggccgtcgagccactcgaggaggccgtcctgctccttccagaggttggaacccacgccgtgcagcgggcttccggtggggacggcgcggcggacgtggaggtggagcgggccgacggcgtagaccggcggcgggaggacggcgcgcatggcgtccagcgccggccgctcgaggtcgtcgaaggtgttgaggatgacggcgtcggggagggacagccgctcggcctcgcgcatgatgaagttgagcatcacgtcgccgaggtccgtggtgcggatgaagctggggtagtcgcgcagctggacgccgtcgcacatgccgcgggcggcggcgccgtcgaccaccgtgtcgaggtacccgtcggtgagctgcgccgcgtcccggagcggcaccaggccacggtcgatgagctcgcggtagaggcgacaccccacgaagccgcaggcgctggccgtccacagcgcggcgcacggcacgccgatcaccctggcggcgtcgtacgcgaacgacatgaggccgtcggcgacgaggcaggtgaccggcggcgaccccgacgccggctcattgagcctcgacagcagcgcaaggaggtggccgaggcagttcgtcatggtggactggcacagcgcggggatgtcctgcgtggcgtcctcgtcctcgccagacatcgccggtagcccgtcggggatggcggcgaagacgaagcccggcacgccgtcgagcgcggcggcgccacgggaggcgaggaggcggcggtggttgaactcggtgttgacgaaggtgacgtggaagccccgggcgtggagcagcttggcgaggtgcagcgtcggcgtgatgtcaccctgcgacgggtacggcacgcacacggcgtgcggcggcttgtcgccggtggcgcccatcgccgatgccattctatgcccgttaattagtttgcagcagagaaagagagatcgctagctgttcgtctggtaatggggagattacattggagtctgttttatagtcaactgagacgtgttaaagttggggtgtggctaaggagagatggatcgcttggagcgatcaccccttgtccccctatacgctcatcccctttcttctccgcttcttctcttcctactgcaccataaattttaaaaaaaataaaaataaaattgaaaaaaattatgtatagaaatactatatgtaaaaaatatttgaattcaaattcaaatttaaaacgaatatgtaaacttttaacttataaacattgggtctataaattaatatttgaattcaaattaaaatttgaatcgggcatgtaaacttttgacttataaactttgggtctataaactttaggtttataaacattagtacagaaatactatattaaaaaatatttgaattcaaattcaaagttgaatcggatatataaacttgttgacttataaactttgggtctctaaactttatatgtgtaaacttgagctgcataaatctatctatctatcaatctatctattattatatatactaaaagtccattaaacttcctacaaacgttactaagccgccacatggcatttctataaatgtttctaggccgccaagtggcgctctaataaaagtccaagaaaaaataaaaatattccattttcatttaatctggtgaacctatattttttaaccgttagatctaactaaaaaaataccaaatagaattatatttagaaagcaccacgttctacgtcgatccatcccatacgtgtacgtgcatgtacgtgcatacttcgtacgtggccccttcccttcctttcttttttttctttttttttcactctcatgagataaaaaccaaattaataatttcagccaatagttgtaaaaatatatgttattccgagttgtattctatcacaagttcattaaacttcctacgaacacacttaagtcatcatgtgacaccctatatactctcctgaaccatcgcgtggcactctaataaattagaaaaatcttaaaaattatgagaaaaaagaaaaaaatatctgaccatccattataacttataaaccggtgaacctattatttctaaccattagatatatcttaattatctgtttccaataaaagaaatctcctctctctatatatgtactcctccctcagtggtatgtacgtgaatttcctattttatagctagcaaccccatataaaaacttaagtgaccataattgttagtaagttatataacaaaccacaacgatgcagagaaatcaaaatattgaataggttttcaacgtgcgtgctgcttgctttaatttggttatccaaataggctaacctattcttgctaggattatcaatgcaatgagcattaggtctacaaatgagggtgtgcatgcacgtgttttcatcctcctaagctctactagttttatcttttactggctaaacaacaagcaccctaaataatcagcaaatttgcgaacacatctaaatttagatccatggtgcctttaaaaaaattaatgattcaaccgtggtaaacttctacggaaaaaaataatttctagggcacgtcatcctaattaccatttaaatatatatatatttagatgttcattaaacttcatacaaacacacctatactaccacatgctacgcatataaacattactaaactgccacgtggtattatagtaaatcagtgaaccatatattttcaactattagatttatcttttttttttcttaaaaaaaccaatatccacatccctcggctctatcccaccagcacaactctcctctccccactggcccacccttcccaccaccccatgcacgtacgtatacatacatacactttttccgtctccaataattctttctctcatcttcctattttataaataataattttaattataaaaatattatgaagaaaacaaatctaaccatcaatttttaattaaattggcagacttataatttcatcaattttcattcaaatcagtcgagttataagtttaacaattagatttaaagacataaatatttcaaactgatgaacgcattaaatatacctcaataaaaacaaagtatccttgccaaataacaatgaaacattgaaaaacatgaaaacatatattatatattcttgaatcgttttacatagtaaagatcgattaaacgtgctctatagcactctcaagtcaccacgtatgatattttaaaaatttgaaattcaaagagaaaataaattatatatctatccatcggttttcacttaatttgatgtcccattatttttaactattagattgcttttctctttataaaaaaaactttaagccaccacatgtcatgtcttaaagatccttagaatgagaaaacaacaaatcataggttcgcacttagattgtttacaaagattttctttttaaaaaaacaatgtaccgtccacttcccctccctgtccaatcatatgcacataacactattgcattgtgaaccctttctaatatctgatttgagttctacgctattcgtttctctccagtctcctccctattttcagctacaaaactaaagagagaaacaaatattaaaaagagcataattttaagctacactgataattttattttatatatcatgtaatcgattttagatgatggtttcttttttacataaagtcgccacctattaccccataaatcctcctaggccttttaaaccgataagcccattatttccaaccattagttctatctcatcttaaaagacaagtgtgtattcataatacatcatcttccaaaataatatattgcacaaccatatttcttcatccaatattatttgcgctaggttgcatggagtctcacacactctctacatggaacgttcgcatatggattctttctcaaattaaacaataatataaacccatgcatttagtggagcctcatatcccacccaattcatccatcaataaacaatgacaacctatattcaattaaaaaatatcttacttttgattttacacataattttctatacatgttttctaacacaaaatatgtctacctacttagtagatgatgaagaatattataaatatttgcttgtagggattaattaaatatgatatgttataaagataactaatagtttggttagacaattataaaagcaatgctaatgaaaacaatttatggagaaatcatatattgtagatgttcaaacatagcgtacgacacatgcccgcgcgaatacgtggtctatcttcttagtttattaaaataggaaagtaatgcgatgccaaaaaaagaaaccacgtggaggagggggtttgatcgctccaggcgatcgatcgcctgttagccttttcattaaagttgtgcgcgtcaatatttttccctgtgcctgacaatttgagaggggaagtttagtgaagattaagaagatatacaaaacgagataaattattaacgtatgattaattttttaaaaatttaacactcgatcaatataaatttttaagcaactctgatataatttttttaaaaaacgcaccgtttagtagatcggaaaacgtgcgcgtgaaaaacgagcgattttttctatcaatcttctagggccaaacacattggaaacaaaaaaagccttaaaattcgagcttcattaatagcttgaaacaaaagttatctaaatggcactgtttgagctcaagtttgagccacaagagtgcaacacaacaaacgcccaaaacaccttacgctatcgaagaacaactcatagttacataacaaactcatactgcaactgggggataataacaaagaaattgatggccaagcagttgttgcatatgcagctctaatttctcatctggatttttccggtcacttcatgctccgcagtaattgcagcttgacaatgagcaactgaacaagtcattgaaagcatccacctcctccgtgtcaccttcagtatggccaacgcctctcactgccgacacagtaattttacactgagtagagccgcacccgttattggtacgtgggtgaaatagttagagaaaaaattactgtaaaacaatttggtaacatcatctaggataacatatattaatctatattcaaaagtccaacactaaattaagtgtgaaaaataatgtctgccctcattgtggcaagctcaaagtagaccacccatatatatcttattaaacagaacacagtagagaagacctccgcggttaacaagtgttgcaattggaaagaaaattacgaatacgtgatccaatcttttacaatatctgtctctatcattgaaaggacagtaccttacaaggacgttgtacaacattacaaagcatcatacttgtggacggaaatgcttaaatttatagataaacttaaaatatgcttcacatacttatatatattttttctggacggagagaatactgatgtacttccgtttgggtgagcataaaagaaattcttcatggcacggttcctaggactaaattgcagagcgtgatcgagcctgcatgtggctaaacgaacaaaagaaaaacaaactttaaaaatgagagagagagagagagatcaggaaggcaaaggaaagcgagttgggggagaggttgttttagtatctcaacaactatgcacgactacgtcactgatgtttaaagaactaggaaggtagcgcatcagcgcgggcatcttatttagtggtgtttgaaattttggtacgaatgtttatgtatatgattttttttaaaaaaatattttttctcttctaaatatgtgtatatcaataatttgtttgggattgttttaaaagttagtttcgatcactggacgtacagacgtgcaaagagggaatatgtttctgggcatttaatttatctatacatatgttggaccgatgggtacgtcaggtcttttgagggggtgtctgtgacatcctagttcgattagatatggcttatgttttatttaaaggatgtgatttgtgttgtgtgcacttcagtagtactatcttgctagttaagcaagagtgcaactaacttgtaaggcattgtccctctaaccatatcattttcgtgttgactattttacatgaagcgacaacgaaagtgtaagtggggtgatatctgtaagtgagtgccggttaaataggctgtgatgtgttgttctagagaacggattgttacaaattgtaaactaaaattacatgaatcatgtcatcttaaatttatgagaaaaaaatgtcgcaacagtggatatggttcatatgaaactatcatttatactatatatgtttcttttttgaaaaaaattagcatcttaatttaaacttttaagtaatactttttcttgtatactaaagatgcatttatagattttaggatatattaatttaagaaatttcctattaagaatatggtaatatggcttctttatctaattaaagacataatcacatacttctatttgcttgtactacctccatccataaattaaaggattcaaattttatacattttaatactactcatcccatcgaaccatccattattcattttttatccaataatactctaaccatcttctaactctgcacataccacatatttaatgagccttatttagagaggggaatcttagtatatttttacattctttcttaattcctataaaattgtaggattcattataggacagacatagtaattaaaaagagcttcattcatagatggatttacagatttatttgtacgtttgtagattgatttagctttacatatttatataggtaaatagacctcatatacatgttgagagatataattaagttagtagaagttgttagatgtctaatggtataaagtaatgtgcctaccatttttgttaaattctttttaggattttcttttattcagttgttaacttaattgtcgtaaggaagaaaaaagaggcgaaagctagtgggttcgtctcatccgtgaggagggaagtggatatgtgaattgtacatatggattttgacagcctgatcgatcggtaggttttatttttaagatatagatctaacattttaaaataaggtccaccggtttgggtaagattttttttctcaaaattttttatataaagatatattagagcgtcatgtggtgatttaggaacgtttatgggaagccacgtggtagcttgagagaatttgtaggatatctaacggatctttagtatataataatagataattcatgtcatattaattaacatatcactcagtaattaaataatttgtatgtgtagtgtccctgataatatccaagtgatgtcccgattttttttctgagttcacccctgaaaattaagggtatatacatccaagtgacgtattataatttttatatagaaatatatgtaccaagagattatttagctatctaattaatttttatactacacgtatttggtgttagccaaaaaaataggaaatatggaaggggagggttagagggggagagagggagtacgtacatacatgtgcacattttttttcgttttaaaacgtattaagtgaacttgtgattggagtgggggaacgtacagattttttttttggaagataagatttagtggtgaaaattaataatctaatgatttaaaatgttgggtccaccggtttataggaaagtgccacgtggcggtataggagcatttgtaggaataccatatggcggtttaggagcatttataggaaatttattagacttttagtatataatgataatgatgctcaaatttctaagaatttttttctaatttttaaatgtgataagttcgatgaatctttattgcgtagaatgatttaagatgacactaatattttaatgtttcgtggttgtttggttgttgccagtatgttcaaatgatgtatttaaatttttatagagcaaaatagtaatatagatgttgatttacttaattaattacaaataaaattactgtttaaataaattaaaaaccggattctgttttgatgcgatatgatcaaataatgtattttagtttttgtacatagtaaaatatgggtgatatggattttaaattattagttatttttctattgaaaaaattagttaaaaaaagagttgggagaaggagtaagacgtaagtacatactatatacgcacgtacggctggaggggtgggaggatagtttgtttgttttgatagatttaattagttttgtgttatctataacagatctaatggcataaataataagcccactgatttaagtgaaaatcaatggtgggttatttttagaaatttttgatattttttaatttattaaaataccacatgccacatggcggcttgagagcatttataggatgtccatgtggtagcttgagagtatttgtaggaagttttatgaactggtgagcaacaagcctgatgggagaaaaaaccaagcaaattggattggcatactctgtttattgcgttcttcacttgctcgcaactgttacaattatgcgttcggcagcagctgactcattctccacatgcatactttttgaactactaaacgatgaatttaaataaaaccagctgcccctcctctcccctttattggcaccagctgccagataaaataaaaaacaactttttttttctccccgacctcctctctgccacccaggctgcctcaccgccacaccgtcctcctgcagggcaccgccgcggccaaagctgaacctgctctctagccgactggcgcacaactccaccctggcctcgacccttctggtaaagctcgcctttttttcttttctgttgggcttttgtcactagttgtgcgacttgatttcttgttagagtgagcatgctgtttttttttttaaagtgtaccactcataggtaccggcatccatgttaccatgtcatcagtgttgtctaacgggcgcttgttttaaatttggcacctaaggatggtttctaaccggtaccaaagtcgatttctgtagtagtggtccgagccacagacatgctaaatagcgtccacgacttatcagctagtactttcattttctggtttctccaggaacgtacctgacctcatcaagatgatcacatatccacgagatccgaagacagaccccctcctatgttattactcttactgtttctggggttagaatgcatatgtgatcatctttagctagaacttcacgagaacaactgatgccgtatgtagggcgactgctcttggatcctcccagtccaaatccttatggtcgagtatagttgtctgatacatgtatatatctctgaaaattgtaataacatactacctccgtttcaggtaataagatattttaactttgacatactacctccttttgatatattatcatatttatttataaaattagtcaaatttaaagtagtttaactttaatcaaagtcgaaacgtcttgtaacctgtgcaaaccactcaagtacaagaacagtagtctatagaagttccagtatctgctgtgcctcgtagcatactttgtgataagagagatcgcagtccaacatatcaccttgctgatatttcaaagagcacacaacatataaatatagaggaaaaagtgtgcccgattgcccatccaattacgatattctctccgatcagactgttttgctcacaggataacattcttttaaacattacctgaaatactcgtccataggttttgagaaattactgacttactcgttctttataatatattttaacttgcttgtaaggtttgtgtcgttcctgcaacagcgaagggcgttgccgctgctgaagctgacagaggggactgatgctttcatcgacatgtccctgtaaaactgcaacgattaagaagccgtacgtgacttgaaatatgataaatgcagatgaggaatctggaaagaactgcttccttcgctatattttctagtttccggccgtgtttagttttcctctatttttaactttccatcacattatatcacatcaaaaacttttatatatacataaacttctaactttttttccaaactcccaactttctttaaatttttaacttttttcaggaactaaacacacccggagtatgtgagtctgaattagttctctgaaagtggtcggtgttttggcatgttctgttctgtcactaaaaaatgtaagctctaatggcgccttttacgccaactttggtttcttattagttcctttcaatctagttgcccagcatagacccaatcaaagccgggcatcattttcactaaaaatgtcgaagggagacaatcgtgggatcgaagatcaactagaatgtactcaaccaagtagcgatgttatttatttaatcttcattagtgatccctttgagttttccacgagagcatgtagttgagatataaaatatcttcatcttggggacttgcatatcctctgcggctacatgattgcaagagaaatccatggccaacatatggagaaaacgctgtgtaatagatactataaaaaccaatattaattttatcttagctttattaattgttatctctgttgcgatgtaactaatttcagtaacacaaaagagaaagggaaaagagaaacatcgttggtacgtatgatatcagctcagcgtcaactcttagtatctatcttatataagtccattaaacttcctacaaacgctctcaagccgccacgtgggattcctataaacactcctaaatcgccacgtggctctctaataaattataaggaaaaaatccaaacaataatttccacttaatcacggtggacccatgcattattttttaccattagatttatctaacaatataaaaacataaaaagcccactttccatcccttcacgtgacgtacgtgtatcaacctccacgtgtagatacgtacgtatctttcctcccccctcacatcctctccttttccccccctaaaactgacaacgttatatattataaaaaaattacatagcttaacaattataatttttaaagttcttttagttgttcttttatttataattcaataaataattcaagtttcatattatctatattttattttactatataaaattgaaatacatcatttggacattatatggaaaccaaacaagaataagacattataaaaagaatttgatgatatgcttcattttatcttaagtcaatccagatgatcaaaattgatcaaacttcctatagagcgctttttaagtaaccatatatcacgtctacggggaaaaaataatttggtggttcaattagctttaaccattagatttatctaaaaaacttaccaattaaatttatctgtaaatagctccacatctataatgtgtacgtgcaggtaagtagttacatacgtactaaaaatagtactacgtacatgcatacttacgcacaccaagccccacatctttatttctttttccctttctcacttaaattagatgaaaaaccaaactaataattcaatgagcacgtgtgtcatcaagcacctaagataagaaataatactaaataggcaatcatcaacaaatgataagtagaggttgccaccaagccacaacaaataatagttgactacaaatagattgcgagtatgactaatagggttcctacaatcctaagaagccacgtaacgctttgataaataacacaaaatctaagaataaaagtaaaacaccttgccatcaatttacacttaaaccggtggatccattatattcaaccattatattagatctatcgaagtaatgccttgctcctaaaaacaattaatccctccctatatacgtacatacacgagagatgtaaaaagaaaaaaaagagagtgtatataccatttcgcatgtatggtagattttttttcagcgttaactcctagcgatgttgtcgaggaagcaatgtcgtcttggcaccacttgtatttttttataatgatgtaaaaaacagttgggcgctcatataaacacatgcatacccatcctgtgaatacacatacacacattatcccctacaaggggaaaatatttgtaaaaaaccaagaaaaaatatatagatccgagagactactattcaccatgaaaaacatacctacttacgtaggtacgtgcgtgcgttcgtacgtacgtacatacatacatgttacatacatgcgtacgatcgaaaatggcacgtggaaccacattatatctctttatatttagggaatcatcttaatagtgttaataattagcataataaattttgacaatataaattattctttcgtatattacccatgaaaatgcataagtgaattagatgtatagtaaaagaaaaaaaaacccaaaacacatattaactagtatgttcatatgtttgtgaaggatggtgataataaagtgatttttgtttgaatataataggcattatcatatagtatatcaaagtttatggtctatattacagaataaatatttttttattataaggtaatgattctcatagtgaatatggcgagatatcttttagtactctttttataaacaataagtgaattgcccgcacatctgcgtgggcttccttcctagtttattaaaaaaaatactacatgggatgaaaaaaaagaaaaaaatatgatgaaagaatatttgggggaattaatagctaagagaacatatgtgtcgacatctttctagcaaacctgaaaatattttaccttagttttattgatggttatctttgttgccgcgtaagcaattttaatgtaaaagaaaaaggaaaaagagaaacattattattgatacgtatgacatcggctcaatgtcaactcttagtatttattaaaaaaaaattactacatggggtgaaaaaaaagaaggatggattaatacatataagagaacataaataaatgtgtcgacatctttgtgttacatccgaaaatattttacccttgctgtattcatggttatctctgttctgttgccgtgtaagcaattttggtaacataagatagaaaggggagaaaaaaaagaaacatcattcatacgcacgatatattagctcaacatcaactcttagcattttaaaaggaaaatttactgcattggatggataaaattaagaaaagaacgataataaaatattattttggtaaattaatagctaacagttcttgtcttatattgtaaaagggtagttttcttagtgacaaccatttactaagggctccaacgagattctagtaaagcttaggttttgttcgtttaaaactaattagctcgtaattaattaaatattaattattgtaacttaaaaatagatttatttgaactttttataaaacaacttctatataaattatatttaaaatatgcaccgtttagctgggaagcgtactaatggaaatggaaaccaaggaagatttgtggaagtgatttctgtaacttagggcatccacaatgtagtctaagggtgtgtttgaggagaaggggattgaggagattgggaagatacgcaaaacgaggtgagctattagtgcatgattaattgagtattaactattttaaattttaaaaatagattaatatgattttttaaaacaactttcctatagaaaatttttgcaaaaaacgtaccgtttagtagtttgggaaacgtgcgcgcggaaaacgaaacaaacaaactcactctctcaccctctcgaacgctgcctaaaactagtcaataagcaataaaatattccattcagccacctaaccacattgtgtaactagtccatagcaagaaaatagcaaaagccacccataagcatatgggctgcccatatagaataaaatatattatttgtctctattttctctctcctcctaatactagttgctatccatatacattgtgaagataacattagttatagtctatatatgtgggtcccatctatatggattacttttgttatatacattggtgttacccttagccggaaagctgccattaattaattattacaggagagaaggcttagcatgtgggtagaccaaaaaaacaaaaagtgaattgagattctttatttgggttgtctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 27129 - DNA, 529 bp, Oryza sativa
gtttgccagacatacctatgactttctatggtagtctgtataaatgcctgcagttgatcaaacttcacacaaccaagagtgaacatgtttggtagtctgtgccttgaggaaagaaattcagttccagtttaactggacagcacaagataatcaactttgttttcagtggtttgcgagtggataggtcgtgcgtgatcaggatcaaatgatcaaatctcacttttatatcacagcaaatttgcaaccagtggcatcacctcatgcatatgcctccagacatggacgtttattagagccagagaaacagctaacatgtaacagacaattcagataatatatgctggctatcaagttctcttacaaaaaagatgtagctaaataataatcaacatgcagcagacgatgaagctacatgcactaagatcagtttttgttttcaccataagaaaagcataactgcaaagatgctctgcgttcttgcaaaacacaaacaatgcctagagcatccataagatcacttcttgttttc

SEQ ID NO: 27130 - DNA, 248 bp, Oryza sativa
ggggtcccagaccaacaacaggttaggtcccataccatactgtgccaggaagcccaggggtgctccccgacactaccccggcgaatccacatgtctgtcggcatcaaggctcccctgataagctagttactcagccaggggtgtcccattccacccatgtggtcgtacttgtcttatgttcggatgaaattccaaggaaacgggcctttagggcaagagcgggaaaccgtacaccccgtacgttcccc

SEQ ID NO: 27131 - DNA, 315 bp, Oryza sativa
ggcgttggacgtctgcccagcgctactctgcgcgttgggaataccaggcattcttccatggtcagcattcctttgcctgtgctgatcttctatggcacgcaaggggtcctgctaaatacacgttcttcctttggaatgcattctaacagcgctgctggacggctgatctcctccataagtgtagcatcgatagtcacttggcataccttttttgtgcttaggatcttgagacggcgaaccacatcctccttgactgtgtgtttgcctcggcaggtttggctccgtgtgctgtcacctcctggtgggctgccctct

SEQ ID NO: 27132 - DNA, 333 bp, Oryza sativa
gtaaccaatgggactcatagtgtttttttcctttttgaagtttgtagcttctcccgaaaagactacgcgtcaggctcgggagccctttgtctctccccaccccatctattaagggcattcacagtgcactgaggtggcattctgccccaaccatccacgtcagatattccttcccatatatgtgcgtggcgttcccaaccgaagtccgcggagccaaactaagttacccgttcttcgtcataacttgcagcgagggtggagcggcgcgttgggagaggccgtagccccatgcgatgcccccacatcccgtgcgaagtggcgacggtcgccggc

SEQ ID NO: 27133 - DNA, 628 bp, Oryza sativa
atgaagataaaaaaaaagaaatattaagaaacaaatcaatatttaagcactttgacactaaaaggagattcatatcaatactcagaagtagatcctaggaacacaaagaagttaacataacctaaaaaaattcaaaaatatttttcaggtctctgctaagagtctctgactactgatctaaaactttatcttctggacagtagatattatgaaggcaatggagaatggctagcttggattttctatagatgaaaaacatggatccgcattctattacaaatggttgcagtgtatagcctttcaaacaaaggcttctgcgaatgagagaatgagagaattagggccaattgctaccagataaaagatacataacgttttaaaaaaaataaaaaaggaaataacaggatctagttaccacatgatgcctcttaacaccaaaatggaaattatattagttcattttaactttgaagtatactaggacaataaaagagacaaatgaaatgtacctccacatactgatgccattgatgttgaaccatcagaagccatgacttctgaatttacccgaactgtatatggaaattcacgcttctgggggaagcacagcgagcaatgctttctccgc

SEQ ID NO: 27134 - DNA, 661 bp, Oryza sativa
  unsure (1)..(661): unsure at all n locations
ggcgaattcgagctcggtacccaaatgattaatttggaggacttgtttggacgatttaaaacctcaaggactaaactaagcccgcaacgaaacttcagggaccatattagctattcacccgaaacaatacatcatctgatgattttctcttaagaaatgcatcaaactgtgtaagagagaaaactgaagtgatgccagttacaaccgttcagtaccattggacacgatgcaactgtcactggtagctcgagaaatggcctttaccatgttgctatgttggcaccaaattgtattaccacaccttgattatgttatatgtgaccagtggcggcactcggagacacgccgtaacaagacaagatctcactgaacgatgacctaggagggacccatcactccatcagggtgaacgttcatcggttaattctagattcgacaggttaagtagaacatcctcaaatgcagaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 27135 - DNA, 795 bp, Oryza sativa
  unsure (1)..(795): unsure at all n locations
nnnnnnnnnnnnnnnnnnnnnnnnnnnnnnnnnnnnnnnnnnnnnnnnnnnnnnnnnnnnnnnnnncacaggatcttatgccagaagatgaatctttttccgtgatatttgttgtcctaacgaggcagacacgtttttcctatctttttttgcatcgtgctggttttaggtgaccaaccacatgtaagctatatttggaatgcaaccacccataacagacatgattaaagcatttatgtggtgcaagtgcctcatattgccgatacatttttgtgtttttaatgaaagaacatacagtttgttgggacaaaatattatctcagcgaacatggcaagtgctccctccatgggagacaaggagagagctcaaccttgatcgaagacctgtagggacgaggcgggagcttgaggaaggaaaatgtggtagtgtggagcggttgagaatgggtttgccccaccttttgcccatttgggggtttaggctttttttgaggtgctttgcagccatatagttttggggaattttagtcattgcacatgtacatttggtgtcatgttacacaatttatataattctaaaaatattacctaggaatgaaataatccccaacacacttaatccttgaattccatgctgcttgggccatattatattgattccttccaattagcattctccattgtcttctctgtttttattttttaaaaaatagatctcatataccgggcaaagttttttattttnnnnnnnnnnnnnnnnnnnnnnnnnnnnnnnnnnnnnnnnnnnnnnnnnnn

SEQ ID NO: 27136 - DNA, 712 bp, Oryza sativa
  unsure (1)..(712): unsure at all n locations
nnnnnnnnnnnnnnnnnnnnnnnnnnnnnnnnnnnnnnnnnnnnnnnnnnnnnnntatttctgtactaatgtttataaacctaaagtttatagacccaaagtttataagtcaaaagtttacatgcccgattcaaattttaatttgaattcaaatattaatttatagacccaatgtttataagttaaaagtttacatattcgttttaaatttgaatttgaattcaaatattttttacatatagtatttctatacataatttttttcaattttatttttattttttttaaaatttatggtgcagtaggaagagaagaagcggagaagaaaggggatgagcgtatagggggacaaggggtgatcgctccaagcgatccatctctccttagccacaccccaactttaacacgtctcagttgactataaaacagactccaatgtaatctccccattaccagacgaacagctagcgatctctctttctctgctgcaaactaattaacgggcatagaatggcatcggcgatgggcgccaccggcgacaagccgccgcacgccgtgtgcgtgccgtacccgtcgcagggtgacattacgccgacgctgcacctcggcaagctggtccacgcccggggcttccacgtgaccttcgtcaacaccgagttcaaacaccgnncgcttctcgccttccgtggggccgacgcgctcgacggcgtgc

SEQ ID NO: 27137 - DNA, 690 bp, Oryza sativa
ctatagggcgaattcgagctcggtacccctttgcaacgggcttcacgaggtgtttctacattaagcgttggtgttcgtgaaggaaaacggaaggaaaactgttgaggattatatggtttctacagtgcttgatgtactgtagcgatggtactgtatcatgcagcatatgcatagaggattatctgcagctgcggtatatggaagagatatttacaatttggaaattgtagattggtttggaaattcagcaatagagtcctattgggaatatgagttgtatttctactttgagtaggaggttttcggtataaatagagaggaaggctatgccttgagggtaagccaagtttgagagattagatagggtttcgtgaaaacttgcgaggggtgctgtggctgcactttataaacaatacttgagcaataaagatcatatttaatcatcaaggcatcgacgatctattctagtttcgtaagttttgcgtttatgtttgattttggcatcatagttgactagggactcgtacgtatctatgggtacaaagatttaaaggtgaacaataatcaaggcatggtataatcacaagtaggatgttcatcattgcatgcattttattggtaaacaaaataatttcgcattgggatcaacatgttcaaagaataatgatgacttgcttgctcaggataatc

SEQ ID NO: 27138 - DNA, 792 bp, Oryza sativa
  unsure (1)..(792): unsure at all n locations
ctcggtacccaatcttaatttcaacgaccacgcttgcactccctaaccactcctcgtttaatatttaaaattacggtcatatatcctcactatatatctcaataaaagacaaacaatattatttggtatttgtggacaggaggaggaaattacaagctggcatgactactacacactattgtttacatataccatcccatggaggatcataacaaatgtcgttgctatagcataaaatagcaatcagagctgctgttttgtccattcatgctaggagacacaactgatagatgaacttctatatatagttttttaggccggtgtgtcctgcactgcatatatccatagccttacggttttggcttgggaggactcaggagttgtagtgatacgatttcttgctctcctgtagcactcgttagttcgagatgggcatgtttacaggttaacagcaagcactgatcaaagagtagtaataccttattagggtgatcatctagagatgatcccgtagggtagattcaaataaccatgtccctgtatcgaagtggacacagctcgaaatgggcgaagctagctgtggtgagctgatatgtgctagtatcaagatgatttcttagcgctacgagcttcacaatggtcaccgtgtcctgaaaagaagggatctggagttttgacgaattaaaggctataaacacatcaagaaagaaatattaatgcattatcaatagcagaaactgcgaatnnnnnnnnnnnnnnnnnnnnnnnnnnnnnnnnnnnnnnnnnnnnnnn

SEQ ID NO: 27139 - DNA, 750 bp, Oryza sativa
  unsure (1)..(750): unsure at all n locations
nnnnnnnnnnnnnnnnnnnnnnnnnnnnnnnnnnnnnnnnnnnnnnnnnnnnnacgttcataagccatcacatggcactttaataaattagaaaaatcctaaatattctgaaaaaatctcaaccgttgatttctattaacatgtggacccactaattaatttgtttgatctattatgtttagaaataaaccagctaatccactcgctctcccttggagcctcaccagcagtcctcctataatctcccaaaaaaatatttttgggtttcctaaactgaaaataggaagtgaaaaaactcctccctccaacagataatcaagatttaatccccaaaactaaaagtgggctcttctcttaccaacagatatttccgttttttcacttccccaacgccgccggcagatccctccactgcgtgctccctgcccctacgccgctggccgatctctcggcgcgcgccctgctgctcgtcgccgatctcctataccatccctgccacacagcagcagcacacacagctgctaccacacagcacaatcaacacacatgtctgcattttcgtgatcaattttcagcagcagaagcacaatcagcactcacagcagcaagccagcaacaacaattttatcagcagcagtttatgcatcagtaggagcaacattccagcaagaatagcagcagcattttcagcaagaacagagcattttccagcagcagcagttacattccaagcacagcagcaaaattcct

SEQ ID NO: 27140 - DNA, 713 bp, Oryza sativa
  unsure (1)..(713): unsure at all n locations
nnnnnnnnnnnnnnnnnnnnnnnnnnnnnnnnnnnnnnnnnnnnnnnnnnnnnnnnnnnnnctagttcttaaacactagcatgtgccttcatctacatgttatatatatacatggcacagcagttggaagaacttcatctacatgttgttgaggcatactgaattattagtgaattatatacaccgtttatctatgcaacactataaaactaatcgctttggattgggaggtgtcaggatttctggtgctacatctgttagcactaatcttgttgcatatgattcttttattgttaattagttttgtctagagtgatcacgtcatgtgttagacgtgattacttggtgacgaacaataaaagaatcatatgcaacaagattagtgctaacaattgcccccctaatcttgttgtctttattttggaatacctagtaaacaatcttcacaggagcgttggctcgtcgtccgcggtagcgagcagcgcttcttctttcttcggtttgcgacattcgttagcataatgaccatgtatgccatagttgtagcactttaccttcttgctatcaaccttgcgctcgctactgttggagtcgctgccgtcttctcctttcttctccttgatatagagattctcccattgtgcacgtgtgagcaacaaatacttaacctccggttcgcggcgccgacccttcaagatttctcgaaacgccct

SEQ ID NO: 27141 - DNA, 716 bp, Oryza sativa
ccatacatattgtctaagcaaagccccaataccactctatctttattttgaagaactatattatattatacaagtttaattctttctatgaattggcaaatgccaagtaaaggttgagcataaatactactacctttgtcccaatatataacaacttttgactataaatttgaacacacagttatctagatttatagctaaaaatacttatattttaggatggagggagtagctagcccctatgctgcaaggcactagatataaaaggttcccactgtttactacatcgatcctatctacacatgtaccagaaaagtaataactttatggttttgggaggagaggtcttgatcaagagctctaaccctagctgcgtattagctgctttgtaccagtctcatatttatattccgttctagatgtttgtaccagttatctccggttaggtggtcgatacatacggaagattgcctatgcatccgcttgagttttcgttccgtacgcaacttctatgaacttgacacttgcaccattgttgatacgcccctcttaagttctcatcatttctttctcttgcacccagaaaaggttaattacctgtttaattattaataattcaaaattggacaatatgataatgatagaaatggttgttctagaatgtacatgtttcagactatatacagatactccctatgtagaagtcgttttggaca

SEQ ID NO: 27142 - DNA, 708 bp, Oryza sativa
  unsure (1)..(708): unsure at all n locations
nnnnnnnnnnnnnnnnnnnnnnnnnnnnnnnnnnnnnnnnnnnnnnnnnnnnnttccagaatcagcagctaattttcagctgaaactgcttatattttcagcagtccaagcagcagtttcagcagaaggagcagctagcacagcaacagaagctatctcagcagcattaattagcagcaatttcagtgcagtttagcagcagcagcactgcagtttcagcagcacaaaaaaaaaatagcagcaacagcagcatcattccatcgttccagcatcagcatcagcacaaattcttgcattatatgagcttcagaagcagcagcacaaattcctggagcagcaacataatttccagatgccacagaatttccagaagcaacagcaccaatcttcagcagtagcaatatcattccagcaacagcagcagcaacagattctagctaacagcaccattaaagcgggaaggtgatttcatcccttgaggggatatcccctcgtttcgtgcatgtcacctaaatattcatcaaaatattttaaaaaaaattagcaacatagattaatatgaaatatatcactccacaaacatgtaagtttaaattcaacttctacatgttgtaacaaaaataacaaatatagctgcgaatatacgataactattttcaagttaaatttgctcttttttgttgcaacttgtacaagtttaattttccc

SEQ ID NO: 27143 - DNA, 754 bp, Oryza sativa
  unsure (1)..(754): unsure at all n locations
nnnnnnnnnnnnnnnnnnnnnnnnnnnnnnnnnnnnnnnnnnnnnnnnnnnnnnnttgtagctcggtcttattttccgggggcttaattttctggattgcattaatgctcctctgagttacctcaatccctctttcatgaacaagaaatcccaagaactggccagccgatacaccaaaagcacattttgtcggattcatcttcaagccatacttcctggttctctcaaaaacttttcttagatcggctatgtgatcatcaagttctttggatttaacaaccacatcgtcaatataaacttcaaccaacgagccgatcaaatcgtgatatatatagttcatggccctttgatatgttgcccgagcactctttaagccaaaagtcatgacaacccactcaaataaaccgattgcaccaggacacctaaaagccgttttatagatatcctcttcagccataaatatctagttataacctgcgttcccatccataaaactcaaaatcttgttccctgacgcggcatcgactagctgatcggctaccggcattggatattcgtccttcggtgtcgctttatttaaatctcgaaaatcaatgcacaccctaaccttgccattcttcttaataactggaactatgctagaaacccattcagcatatcggcagggacgaataaaaccagcatcatacaatcgtttaatttcagccttaacagattcaagcatatcggctttgcatcttctcggaggttgctg

SEQ ID NO: 27144 - DNA, 584 bp, Oryza sativa
ggtacctaaccgatcagttatcatttataggtttaactacggttcttttgtctttatttcttgttgattgcaggatcaaatcaactggcacgctcatacatccgaaggcaagttttggacctgcactggagttaagcaaatctcccaggcctcgtgttttctgtcaacagattgttttttaggtgatagatacactaaacaatctaacaaagagcaatctaaacgatatcggcttattcaacgcgaatcaaccgataaggataaataacactatttaacttagattaaatagcgtatatgataaattagcacttgtatcgactggtttagagtgtcgaacttaaccgatggaaaccctagccctgccgatacaagcaactacagacggaactcatctcttgtcagagatcgaacttaattgatgcagcccaactcaaagacaagaactcatcgagaaaaatccttaccaacacaactcaaacttcccttaaggataaagcaaaaattacaagcacagtcggactatacaaaaaaagaaaaataactgactccacctaattaatagataaatcaccttgccatat

SEQ ID NO: 27145 - DNA, 1465 bp, Oryza sativa
agtgtcattacttgcaagtaacaactattgaagaaggtagataaatcagggctagctttcttggttaaagagacaagtttcttatgactgaaaataaatgaaaaaaatatgttgagaagtcttcgcagttcacataatagaattaaccacaagctatcaaatctcactagatacggagatcgtttatgcttctggtgtaataataattgtaccctcatttccattgtgagtgaagaatcgtctttgtattaattagtttaccttaagaaacacttcaaaacatgtcttatattgtatttatatgagtcgataagttatgtatctacgtttctcagagcatatcttaacaccataccttcaaatttttatctaagatgtcaaccaacatctaaagggttattcggattaatgccattttaaaccataccattttttggtgaagttgtcaaatatatgcatctatttagttcctcaccgaactctaataaatacataagaaatcctacgaaagcttggtgataccgttaaattgtcaaaattttggctacaccaaaattatttgttaagatttattttagttataatttgaataggtcctaacaccgggagtaacactataaagagtttaagacattcggtttcaaaaaaaggaaaagaataaagagagattccgatatgcccagctaaagcaacggattccagaaaaccagcttcttttcatctagaagtatcacgagatacttggcaccctgtttccaaaggggcaaaacggtcaagccacatagtgtcacggatgcttcgcagcagcttctccagaaaattccgagagcgcatgaaaaaaaaaagaaaaagaaaaaagaaaggcgaaaccgatatatatgcacattggatggacatcgtcatggccttatcaatcgatgatatcgtgacgttgataataccgagtcagaggttcaggactttgaataataggaacgaaaaaaaaaagaataaaagaaacataagatttgtatagaaatataattgcaaacacaggagaaaaaatatataggaatgaccgtttgattgaaccacaagaaaaacaaaaggatttgaggagagataaagatttttaaataattattttcatgaggttctaacttatgttagtgtgtagccgccgggggtactatttggggacaacttgcatgaagaagcctccaaaacttatatgggaagagacattccataagaaatttataggttttattcctttgattcaaagggttatgtaaaaaaaattctatagaaataaaatcctctaaaatttataggttttattcctttgattcaaagggttatgtaaaaaaattctatagaaataaaatcctctaaaattcttatgattttccattaaatcaatggggccctctcggtaggcataactagaaaaagtaaaagtataaaaaaaattcgaatgttgatt

SEQ ID NO: 27146 - DNA, 928 bp, Oryza sativa
gaagtaatgtaatttgaaactcatcattccttaaatctttggtttcgaatacatgacatcaagtccctccattgtcatgcagatgctttggttaagcatgcagagtggaaccgacaaaagttaggagcaaactggaccagcatatagaagctcatgcaacatctgttcggggtacaaaactggctgaactaaaggctaattatgaggttatttttcatactcagtgcacggtttattattgcaatttcagcatgttcctagaattccccatttcatgagttcttacggtggatttttaaaaaaaccatcctcatgcttggaccttttgttgccgcaatgttcagaaaaaactcttggatacacttgctggacctgtacagtcaatcttggaaactggtgaaaaggactcttgggcatgtattagaagactttacaggcatgcgactgaaagtgctattttggcattctcagcttccctctccgagtttgaactagaccagacaactatccgtaagatggtcatggaattaagagaacatgcaagaagtatagtagaagagaaagctagagaagaagctgggaacgttctgatgcgtatgaaagaaaggtagaatctgctactattatttttggaggaaaacttagcaaacatatcttgacttttcagggatcacacttaccatttttggaacatttatcttatctctacctgtttaattggactctaggttttccactgtgttgagccgtgataaggattccatgcctaggacatggaaaggaaatgaagatatacgtgcaatcactagagaagcacgcttagcggtatattctttcctgttgatcaatattgcactcatttatcctgatctatgctggaaaaacatgatctatgtattacctttcccactggaggctttaaaactta

SEQ ID NO: 27147 - DNA, 629 bp, Oryza sativa
gtgcgcggccgtcgctccggtcgtcgtcgctgctcgggaaggtcaccgtcgtggtcaccaagccgtcgccgatctcgtccacccctccgtcgtcgccgtaggttgccgtcgtcgtcaagccgaaggtcgccgccgcttcttcctcgacgccgtcgccgtccgttgatcttctgccgctgttttggtcaccggtgagttcgccacgtcgccctctacgtgttggtgtcctccattcgcggcgtcgcgtcgtcgttcgccggcgagcttgcgcgcccgagccgccgccggtgatgacgtcatcaccgatgtcatcggtgccgtccgtcgtagaccggtcgtagaccgttaaatcttggccgttcgttgtggataggatcgatctcggccgttcgtttccgtgagccgccgccgtgcacccggtccaccgcgaaccctaaccgctgacgcaataatttccttttccttttaaaaaataattcattattgcgtcatcattcaattaaaacccatataagtgttttaatccgatttaatctataaaaattcataactaattcatcttagctcggatttagttggttcaagtctctaattttttctaaaattgagatcggggatcctctagagtc

SEQ ID NO: 27148 - DNA, 1721 bp, Oryza sativa
  unsure (1)..(1721): unsure at all n locations
cgattcggatcgatctctctcctccgaaccctaaaccttccatcgcgtcgccggtcgccgtgggccttcgccgccgcctcctagcccctataaaaggacccccggtgtctccgttatccgtcgccaccctcgccattgcctgccgccgtctgtagcgccctagcaccgtgcagccgtgcgccgccgtcgccgccgtcgccgccgcagctccagccatgcgccgccgtcgctctggtcgtcgtcgctgctcgaggaggtcaccgtcgtggtcaccaagccgtcgtcgatctcgtccacccctccgtcgtcgccgtaggttgccggagcactgccgtcgtcgtcaagccgaaggtcgccgccgcttcttcctcgacgccgtcgccgtccgttgatcttccgccgctgttttggtcaccggtgagttcgccgcgtcgccctctacgtgttggtgtcctccgttcgtgtcgtcgcgccgtcgttcgccggcgagcttgtgcgcccgagccgccgccggtgatgacgtcatcgttgccgtccgtcgtagaccggtcgtagaccgttagatcttggccgtccgttgtggataggatcgatctcggccgttcgtttccgtgagccaccgccgtgcacccgatccaccgcgaaccctagccgctgacgcaataatacccttttccttttcaaaaataatgcattattgcgtcataattcaattaaaatccatataaatgatttaatctgatttaatcattgaaaattcataactaattcatcttagctcggatttagttggttcaagtctctaaatttttctaaaattgagatctacatgttaaaaatatccacatgtactgttcatgcttgtttatgtgctgttttggtgatttagctcttttctctttagattccgacgttcctggagagtctgagtttgcaggagaagattttgaagagttccaaggccagcaaggcaagtcacacagatcccaaacaaccttttgagcatgttgatcccatttaaagctattgtttctattcaactattgcatttattttcgaatgtcatggggtggaattaacctattgtttgttatagcccttttgttcttgattactttattccttgaaaccttgggttattataacttgactagttgagctttatatattggttcagctagatattagatatgattgcttagccatgcttacaacattagcacactattgggataactatgactccgccttatttatttaaatgatggcttaatgatagctcatgatggttaatcatgatgggttaattaattaattggccaactaaaacctgataatggtgggttgtgagcacatggttttgatggtcgtgctcatgacaattaaggaccggttcatgagtttcggttgtgagatattaaccgtgccaaccccaagccagcgtgggcaacagctttaccttttgtatagcatggttcattgcggggcaccagattgaaaagtggcggagataagcccccgggggtcgttggggagtccatgccttgtttataagggggtgattatgatccaggaatggtgcgctgtggtggattgtgttgtgcgaggggtactgtcacagctccctttttgaggtaccgtggtggtattaagaagcatggtgacatgttgtggggctgtgtnnnnnnnnnnnnnnnnnnnnnnnnnnnnnnnnnnnnnnn

SEQ ID NO: 27149 - DNA, 455 bp, Oryza sativa
caccttctcgccaagaattccccaaatcacgccccctcgtcgccgccaagaactcgccgtcaaaatcatcttctccctccaccaccatctcgccagtaactcccgcaattccgctctcttcttgccaccaaaaactcgcgcttccatcttcttcctccaccaagaactcgccaagaactccgccgccaacacaggaacccgccgcggcgcctccgctgtttctgcctcgacgcggcaagaagcaagaaacgcccgtgggttcctctcgcggctcggctggttcctgcgccggcgaccgcgggtccacgcgcgccaacctttcccgcgggcgacacgtgcgacgcccggagctcggctgagccaagaaccgtcggggaagacgacgccgcctctgccaccgggagctcccctggccaagaacccgccggcgatcgcgggtgcgcgcgtgcgcgcca

SEQ ID NO: 27150 - DNA, 492 bp, Oryza sativa
gggttaaatcctctagtggagtctgcagagacaataaaaaaaaaaacctcatcccagttaaggatgtctgcccaaaaaatgggaggaacatattttgtaaattttatttggttttctctgagactgtccaaaccttggttttatcgcgaataacaagtagcaacgttgttttgcgtgggctgaataaacgcatcaatacctcaaatagaaagagaaaaacgaatagattaaaatatgtaactgagacaaaagtcatgattagtgtcactgagacggatgctacctcaaatattgttttcaacagaggcctattagctgcatgttctcgtcctatatcatgacaccacctataaaaggcatattcaccaagccacataagaaggttgagaaaagcaaaatgaagttctcccgactcattaacgttatattcgccaataatgaagtatcaaacgatatagaaacttacaaatttatcataacaatatctgatac

SEQ ID NO: 27151 - DNA, 876 bp, Oryza sativa
atgattttaaaagcctagacgagaagatctattttttttaaataataaatcccaatataaaattgggccagataaaattttattaaatactttacttgattctatagttcctagatttttctgggatttatttgagccaagaaagtatttttaataaatggaattgcatttcatgaataatttaaattggaaaaagttttaaaaatctctcttttggctttgggccgaaagtcggcccaaacctctctctctctcctccccggcccaggttggcccgcagccgagcgccgcccgcgcgggcgcgtccgcccgctgacaggtggggcccgcctgttagtcttcgtctacctcgcgccgctgccgcatccgaaccctaaccaagccgcgccgccgtctccttccaaattcggacgcgcctttccttctctggtgaaatcaatagaggggaaatgattcccgggatctcctctacctttttccttttggaatcgatcgccaattcggtttggaaatccgtggattcgagttcgattcggatcgatctctctcctccgaaccctaaaccttccatcgcgtcgccggtcgccgtgggccttcgccgccgtctcctagcccctataaaaggacccccggtgtctccgttatccgtcgccaccctctccattgcctgccgccgtctgtagcgccctagcaccgtgcagccgtgcgccaccgttgccgccgtcgccggcgcagcttcagccatgcgccgccgtcgctctggtcgtcgtcgctgctcgaggaggtcaccgtcgtggtcaccaaagccggcgtcgatctcgtccaccccttcgtcgtcgccgtaggttgccggagcactgccgtcgtcgtcaagcc

SEQ ID NO: 27152 - DNA, 633 bp, Oryza sativa
ccattgattcttcctagtcccttcatcttcttgaccatgatcttgactcatcggacccaatctttgatgaacaggaagtcttgtctgtcttggccgatcaccctgattatgtggtcggcttgagctctcaatgacgtcactgcacccaggacagttttcaatagatggcaacctcattccttcgttgcagaagaatctaaagaactcacaatcccaatgaggatcgaaaccattgttgttctcttcataacgcctcgcctgctgcttatcatacttcctttgatacttgttaataatcttagctccaccggctgcttgactagctgtatgtaccatgttgtcgggaaaaggatttccatcgaccttcatcggcttcttggaatcgtcaaacttaatcttccccccttcgatggctacctggatttgctatctaaagaccttgcaatcattagtagaatgagacccagaattatgccatttacaatatctcctcttgcctaataacttcagccgatgggatcatatggctaggaggagctgaatctgcttctctgggagtagcaaatcgaaaatcttatcggctttggtgatatcgaagtcatacttttccttcttcccaggacttttcaccca

SEQ ID NO: 27153 - DNA, 734 bp, Oryza sativa
  unsure (1)..(734): unsure at all n locations
tgttttatgaggcttcaggattcgtcatcgctgttggagcccaccgaagaggatgatgccagtgaacttggagcctgatactgcacctgagcctgagactgttgctgcgcctggttcctgaagctttaagaatgaagcgggggacgatgtcgaggcgggtgcgaggagctcttctggttgtgactcatgttgatgactgctgttatgatgtccattattgtggggagaaacccagatgtaatagtcagaagacctgagagctgcatatgaaagaacatccttgagatttagtttgaatacatgccgtgtaattcagttgaactgaaatgcactagatagaaatttaagagcagtttggctctgtatatccacttgtggatatagaggccggatttttatccattatctaaaataaaaattaagagcagaattctgcctgatgaaaccagannnnnnntaaggtgatccagcccctttactcctttctagcaacagcgactttgataaaaaagcactgggatgtaatttatgcgaaacgcgttctgtagaatattaccgtgccatggcgaaaataggctgtgatgtcatattgcaaccatgcagcataggatactacgaaggcgacgaagagccccagcagatataaagggttcctgtccaagagttcataaacagagagaagatgctggttagtggttacatatgttaaccgtcaagttcggatttctcagttt

SEQ ID NO: 27154 - DNA, 1009 bp, Oryza sativa
  unsure (1)..(1009): unsure at all n locations
agcttcctccagctagccatgggtgtaaagtggaaaggtggtggcgcgctcctcctgctcgccgccgggctgctcctggtgcccgtgccggcgtcgccgncgaagaaggagggtcgncgggacccaaaggagaagctccggtggtgcaaaaaccagtgccggtgggaggccgggcaggaccagcggcagttgagggagtgcgaggagcagtgtctccagcgccagcaggaggacgacgacgacgacgagaacacgcacggcggcggcggcaaggagtgccgccgcgagtgccgtggctaccgcgacgagccgtggcggaagcaggagtgcatgaggcagtgcgagtggcgccgccacgagcagcaccaccacggcggcggccatggcggatccaggccggactgccgtgagcagtgcgagcaccagcaggactggtgggagaagcagcgctgcctcatggactgccgccaccggcgacaggaggtcgacgccgacgacgacaaccaccatggcagagacccctgctacaagcagtgccgccaccaccacgaccagtggaagaagcaacaatgcatggaggagtgcagatcccccaagggccaacaagacgccgccgtcgacgtcgacgaggaagacgacaaccacggcggcgatcgctgccgcaagcagtgccagcaccaccatgaccagtggaagaagcagcagtgcatccaagattgcaggtaccatcaccgccaagaagacgacgtcgtcgaggaagaagacggccatggcgatcagcaatgccgcaagcagtgccaacaccaccatgaccaatggaagaagcaacaatgcatgcaagactgcaggcagtggcggcgccaggaggaggaagaggccgccgtcgacgaggaagaagaccacaactacggcggcgagagagagcaacactgccgcaagcgatgccagcaccaccacgaccaatggaagaggcagcaatgcatgcaggactgcaggtacaggcgccagg

SEQ ID NO: 27155 - DNA, 216 bp, Oryza sativa
ggaaacgatgggtgaacaaacgataaaaaacaatttatcaatcataaaagacatgagatttaacgtggaaaacccttccaaaacaggagagaaaaaaccacgggcgtcagccggtaaaatatcttcactatatctaaggtgaggttacatcgctgcacggcggcttacaagaggtatatatagtggaaccctaaaaaggatgatgatccgtaccgc

SEQ ID NO: 27156 - DNA, 18846 bp, Oryza sativa
tcttccacgtcttctgcgtcttctgcgatgcgtacaccaacatccggtgaacataacaccagttcgcctcaacctcgccggcgagcagtggtacatacaacaccctcacctcttcttctttcccttaacggaattgctaaaaaaacttttttttatccttgaattgtctcttggggccgttttggattaaaggcaaaacatgccataccaaaattttggtaacttaaataggaaatgtgctagtttggattgatgtcaaataattggtagtgtacatattcaatttggctatattctagaatcttcttcaccatcctactaaaatttggctttacattggtaccaaaccaaacatagctagctaactttgctctaccaaaaaaaataggtagtgctaaaatttacttagattttggcactaccaattaattggtagggtagagaatcaaataggcccttgattcttttttccattgccaaggagtcgaactcctgatcatacagtagaaagctcaaagcatttaaatttagggacaattgcgttcttaccctcactttcaattctaattatgattttacccctattttttagggtttgtgattttaccccagcttttttgaaacaaatcagccgtttgcctctactttggatggcagttaggtgggcccataattattgagtaaaaatatagaaaagagagcagaaaaaattatttatgaaatatgaaatgtccttcctacccctgagaagtaatcatctggagtctggctagccgtccggcccgtcccaactattccccatccccaaacctacgggaggcgagcaggcggcggcggcggctgcctgtagcgatcggaggcggcgacgcttattgcgagccgaagaggtgcgacgcgagcaggcgacgacgacgcagtgagctgggaggcagcgacaagccgacgactgcagcaggcggaggcgtcggaggctcggagcgtcacggtgatgcaaagcagccggtggcggctgaagcgagcgaaggcggcgtggccgcttcaacgagcagctggtaactgtggtgtcccctgccatgattacttcgttaaaccagtggcaaatttcctcgtataaataagttcagagcagattaatcccccccccccccctcttcctgtacacggggtctttttagtgagtattttatcaattgtgcatgtgagcttgggtccaaatgtctaatgtaatcccgtcagtttcgaggatgtgatagcgttatttctttgctccaatgataaacaaatgtagagtttcagaagcacaattctatatcgtgattcgtaaagatatccagatttcctttgcaatggtgattgtttgtgatgtttgctacaaattattgttgaaattttgtcgaaatcctgtcaattttttttctgaaattctatcggaattctgtaaaagtcattgctgaattcatgtcatatttgtcaaactttctgaaagttcgtaaaaaatttaggacggatttgaaataagcaaaattccattttgaaacatgtccagagtctatgcaagcatggctcctgtcgtaaaagtagtaggcgcatatatgcaagggtatacttgtcttcttaccacatatttaacaccgttaaccgaagctaacagaacaggggcaatcgattggttcatttcaaaaaagtagggataaaatcacaaaccctaaaaaataggggtaaaatcactattagaactgaaagtaggggtaagaatgcaattgccccttaaatttatgaccgttggattgcatcaagattcgtatgagagggaaaaaaactcaaaatttttaaatttgtgatccttggattgcatccagattcgtgtgagaggaaaattttttttcacagagatgcactagtggggaatagaactcccgatcacgtagtcaaaagctaatgatgctagtcaattaaacacaaatatgtttttacacaattgtatatgggtagtagttacaatgtaattacactccttttttttgcggggacaatgtaattacactccaactattattgtagtcacatttgaaagtttctcacccaaaaaacttgtggcaatttttaggtagtcccatttcttaaacagcatgctcacttttcatttgcacaatatatcattgcatgagattctaatctaaattacatgcattttagatggttggaggtgagctggtttctgcattcttagtcgatctgcacgcggactactgcgagaaatcaagtttgagtggccaattagtttgccactactgctactttcaaaattatgtcacaaaaaatctgtctgctagagaggaatggtggtgcttaaattttcctttaacattacattgctgcatttgttttcggaagaactaattatgcttgctgatttgcatttcagatgttgctccactggcataggaagcaccctaaagcagatcggatcccatgtaatcagaggaattgcggggtgatagtaagctctccccgtgagttagagctacacgtccacttctcccacgtccagcctgcgggttggtgggtagagtgatcaactgaaagttcggcatgtttttggattggttccttgctaactattggattagttccttgcttactattcttatgttaacaccgatatctgtaaccccttaatcataatatcataatttgatttgattgcgtactctaaatgtgttgaatgacatgcgcgtgtgactaaagtgattactgattagtatctcagcataaatatgtttgcacattccagtagtagccttaatatctgtatgggaatgggatcctctgacgtgaagtcagagggacgtggtgactaacatgtgggccccactgctcacgggcccacctgttagtgaccatgtcacgtggcagttcacgtttgaggaaccgcctccatctgtatgagaaataaagcaccaactaagcatcatttggcaacaaccaagattgtagcaacatggctgaatggaagtcacagaacagaatatagaatatacacaatgtgtatattacacaccatcagaatttatttgagtttgagtacccccgccacgccctgcttgttctgcttgttcagaattttggagttggagatgatagggcacacccgcccagcttgttctgttctgccctggcacacaagatcttttttcttttggacgaccatcgcatcaaatgcacgcaagtagcactcgtcatgaatcgactgtgttgatcatttttcagcatggtgggtttcaattggcaaggcaattaacctgtattttgtacaaattccatagacttcacggaagaatctcagccctcaaacacccttctagtctttgcagttgaagcaaaactttctcaactgaccagtctaaatgaaaggggcaagcttcccaatgaacagcagacgccagacagcttctctgatattttccttacacaaaacaaatcagccgaagcattggtaaccttaggagcatagtcaaacacctttatttttgcaattatctcatcaagcttcagaaggatgctatcatttcctgaatgttttccagctccagctgcaaaatggtgaacactgccattcagctccatccaactgcatcctttctccttcaacgtcccctggacttacattactctcctcacctccttaagaccttaacataattctagttgccatatttgataagagcacatgcgctctgccacgatgaaacaagagcaaaatcatgcttgatgaaacaagctaagatggtccatccttaactcctttctgcaaaaaaggactttcgctcagagaacaggagaataatctgggatgtgttatttaaactgataaacatggaacaatgggtgcacaataactgaagttataagctgttgctggttcgattttagccaatacagtgtaatgtgcataaaacttgtttagaagtttagaaaattacctatgaaaactgaagcttgagcataaggtttagccaatggataatatcttatgcaggccctaattctcagttaaggaatgggtccatctacagttagcaagggcacacactagcacaagcagatatgatgcgtagcactaaactaatacatcgattgcatatgtgtacatgagatgagttagtgtttgcacctgaacatcattgcaagtaaatcggaagtgtattagtgctaggaatcaaaactagccccattacagatttttgcccgttagcagcatgtaaagttaaaacgtaatttagtcaagatcaaatggtgaaaagaacacaaactggatcttgacgtggaaagactatgagaacctacctccttgaggactagtgaatcttaaagaccacgaaacaacttctgttcaagcttttttgttttctcactgtccgcaagctccaattccttctcataatccttcctagacagaccctgcgattgttatctagaatgaattaagtacgttggaacagaaggcttggtctctcataattcaaaataaaaatagatggcagctagaacacagtccatacctctcaatcttctatccctgtagttgtaaaatatgaagtacatggtgtccttcaagatactaaaaaacatgcttccacaaggcttctccaaattagcccaggcatcctgccgattgcagtcagagtctcagagttaagttattttagactctaagaagcacttacagctttgccattttctaataacattggtcacattagccttgtatattccactaattccctagaaagtggctatcacacaagacctgctgtttgcccttaagacggtagaaatttaaataaacataagaaaggtcggtacaaataaacaaatatggagcaacctaaccttctcattcacctttcagttctccaatcataattttacatataaattgtacagaacaagaagaaatatacacaactattatatccataaacaagaaaacttaaaagtgcttcttctaggcgaagttcaactttgtgaaactaggtgtaatccaaacaggagcgggaaagttggaccaaagctgaggagacacgagttcctctctgctgttatgtttcaaatcaaataatccaatatcacgacgcttattcttgaatccaaataaccaagcttcgtcatcatcagtaaaataggtataattttccttgagatgtggatattgttccgtgctgagacaaagtgattggttatgaccaagaaacaacacatgaccatccaggttattgatctctacatgttttttccccatagtatcaacactatatattttaatttccctagtataccgcacaaatgttgcatggtcagcaggcaagtcagcctcgtaatcctcctcaatgtcctcaactgacctccaaactagcagaagaccaccccatggagcttgcacaatgtacctactgtaagacaaacttccaattatcatcttcatcgtgatcgtggggccactgagatcaagtgtatggatttctccctgtgcagtcagtgcatacagtagaccatcaatgtagatgcagtcagaatagtgagagtgtgatggatgccatgtccacttatcatccccaacccttgcaaatgaaatttgaccagctggctcgtggatcagaaccacaatgcatccccctgtgaaagtatcagtaaacacaaaagccttactatatatgtaatcccgcagctcgccaagggcaaaaattgatggctctgcataactaaccctcgttgcagtgtgcagtgagaactcatacttgtggagagcaccagactcattgaagatgggattcacatgctccattgtggtaacagaagggagagctatctgttcccctgtgatcggattgaccaggtgcatctcggataagtcatcagctgtaatcaaccaaccaagtgaggacccaatcagaaacctactgcgtatgggtggctccgggagagtaatcttgtactccctcttctcgacaagactatagagacacacgacgctatcgccagcagattcagaggtgtatagcaggcacggcgtctgggacagtttatagatacctaggctgcgcaattcgttgtaggccgagagccaggagttacagaccgatcctgcacgcacgaggtcagggatctccaggagggcaaatatctccattaagatgtcctgagacagctctggtaaatttgccacaacactctctgccattgatggctgatcaccatcatctttttgcacttccttcagtaaactactgtgaaggggcgctaggagcttggattgtactactctgaagagtaggttgcacaaattcttgggacatctcgctagatcccctaagttcataatcctggctatagtactacagggcgccattggataattggagcagatcgagcccctcttgcaaggtgaaattcgtcgcctgcttgaatacttgcagagttggaacatgtgatgaagcaagagacgcaaggtatatacctgaagttacccaaggaaaactgaaacggaatttgttgtcctcaaaagagaaatccgactccggatcagacttgttcccgggaatccactctgaatcatactggctcacacggatccatattccgaatcgaggtcagcaaggaaaacatgtggagaactcaccgtcaagcgctgccgccgtgcatggtggggggcgggagtggatttgtgcgcggaggagaagcagccaccgtcaggccgccgtgcggtggagcacaggaaatccggcggtcgattttggccgccgtagcacagccaccgggggccgccacgcgctgccgtatctccgaggacaggacggccggcggttgaagcggcgacgactccgggccagcgtgctcgtcggcggagaggatgcggcttcgcgccgccgttgtcggcgacggcggcgggtgggcagccacgcgagtgtttccttctttctttttttctcaggttttctattttgcaagcgcctgcaaaattttaacaattttgctatatattttgcgataaattttctcaaaaaaattgacatatgtaaattaaagtataatcgtagtgtaattataatataacttgtatgtaacttttaaatatctcttcgtaatctccgtaacatgttatttcggtaaaataaaggtcatgagaacaaatcctctcacatatctctactgtaattttttttctttcttaccagaacaaatcttgtaaaagatctaacgattcaaaattacgtgaaacttatatacaagttacacggtattcacatttaagttataatataattacactacgattatattataattatatctattaaatttttagaagaaaatttgtcgataaaatatacaggtgatcccaaattttaatccatcagtcgattttgtcagccgttggatttgcttggctggtggatgcacattctggtaacttggttgtattttggcaggcccgttaacccgtgggcttgcattgctccacattttgccttctgttaaaatgtgtgtattcagatgcaattcggcataggtttccttgccgaatcgtagttagtctgtcttctcaggtacttgtattacatatggggtgttaggacgctaataaaaaaaaattacagaatccgttagtaaaccgtgagaaaaatttattaagtctaattaatccatcattagcaaatatttactgtagcaccatattgttaaatcaggagcaattatgcttaaaagattcgtctcgtaaattagtcgcaatctgtgcaattagttattttttagcctatatttaatacttcatgcatgtattcaaacattcgatgtgacagggtgaaaaattttgaaatgggatctaaaaagggtctaggttacacttatattagaacagaaagagtgatgtatagttaggggtggccatcgcgattcgcgaaagaggtggacggggagctcgtcgagttggctggagaaggcactcttgaatgtttcctagccaaacaggtcgagtggttgtatgtatggtgtagttgagcgatctaagccgtccaatcagttttgaacggtccagaatcgagaataattcaaagttgtttgatcagtttttttcaagtacaaacacggctcttcggtggcatccaaatgcatttgtttccaaaaatgaatcggaaaaattatagggggcctaagatcttgatatgtatggggtggcttgatctttcggtgagttgagataactacgatttaggagaaatattgacgatccgactacaaccgtacgagacgttgttatgttgtgccttagcgatcaatacacatctccgagagtttgttgatcttgctggtgcagatcaaccctattcctgcaagcaatcgagaacaagtaagaacaagatagaaagcaactgaattgctagatagacaagacgcacaaagatgaattgatatacgataaagtggggttccgaacaagcagacggacggtctagccgacacgcgtgctacaagcgaagtagcaatagctaaacttacaattaatcaaaacccaactaaccctgaaggggttactagctatttaaaggatagaggaggtcataagggcgtcctccctctgtttagggcacagccccccttggaccagggtcccagacgaagttacagacctataggcccattacagacaatgcagccccttgttttttcaattgccgatgactcggatggaatttgacaatgaggttggattcgttggaaagaggattccgagagctttccataaagtactcgtgggcccaaaacgtaggccatatggagatttggcgaccgtttgaattcagcactatcttaggaggccgaattggattccagaacgctgtcacgcccggaatttctatccaaaattctaaacgcttacatgtgtgtgaaccctcgtttaggaatcagccgaggcacacaataacaaattgataatagagtacaattattactctaattaataagcgaataaaatgtcattacagaggtagatagttcctctcaatcaataaagatctaagcagcggaaaaataagataaacggcgcagacgactccactccacaggcagcttgaccagggctacacctaatcctccacaccatcagcatcactgtagaactcctcctctgatgaatgattgcaaggtgagtatatgacatactcagcaagccatgcagcaaatatgcaagtgcacaggataacaaaggatggcatagtagggtttcatttgcataaacagcatttaataaacatttcagaatttaataaaatagttaagtagtaattaaacaatattaatccaacgctatacaacataccctgttgcataggcccaaccattctgaacaactatcccggctgcacagttctatctccaaaccaggaatataccattccaaaccaggagctaatcaaattattaccagttatagcatcttttattatggtgagaagtgtgaaactaatcacgaaagacattgttagacccgcccataaccgcgggcacggctattcgaatagttttactctggtcagaggtgtaccactgtacccacaagacacagccccacaacatgtcaccatgcgcctcaataccaccacggtacctcagaaaggagctgtgacagtacccctcgcacaacacaatccaccacagcgcaccattcctggatcataatcacccccttataaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcatgaccatcaaaaccatgtgctcacaacccaccattatcaggttttagttggcaaattaattaattaaccaatcatgattaaccatcatgagctatcattaagccatcattaaataatagtgagtcaaaagttatcccaatagtgtgctaatgtttctaagcatggctaagcaatcatatctaatatctagctgaaccaatatataaagcccaactagtcaagttataataacccaaggtatcaaggaataaagtaatcaagaacaaaaaggctataacaaacaataggttaattccacccaacgacattcgaaaataaatgcaatagttgaatagaaacaatagctttaaacgggatcaacatgctcaaagggttgtttgggatctgtgtgacttgccttgctggccttggaactcttcaaaatcttctcctgcaaactcagactctccggaaacgtcggaatctaaagagaaaagagcaaaatcaccaaaacagcacataaacaagcatgaacagtacatgtggatatttttaacatgtagatctcaattttagaaaaaattagagacttgaaccaactaaatccgagctaagatgaattagttatgaatttttatagattaaatcggattaaaacacttatatgggttttaattgaatgatgacgcaataatgaattattttttaaaaggaaaaggaaattattgcgtcagcggttagggttcgcggtggaccgggtgcacggcggcggctcacggaaacgaacggccgagatcgatcctatccacaacgaacggccaagatttaacggtctacgaccggtctacgacggacggcaccgatgacatcggtgatgacgtcatcaccggcggcggctcgggcgcgcaagctcgccggcgaacgacgacgcgacgccgcgaatggaggacaccaacacgtagagggcgacgtggcgaactcaccggtgaccaaaacagcggcagaagatcaacggacggcgacggcgtcgaggaagaagcggcggcgaccttcggcttgacgacgacggcaacctacggcgacgacggaggggtggacgagatcggcgacggcttggtgaccacgacggtgacctccccgagcagcgacgacgaccggagcgacggccgcgcacggctggagctgcggcggcgacggcagcgcacagctgcacggtgctagggcgctacagacggcggcgggcaatggcgagggtggcgacggatagcggagacaccgggggtccttttataggggcaaggaggcggcggcgaaggcccacggcgaccggcgacgcgatggaaggtttagggttcggaggagagagatcgatccgaatcgaactcgaattcacggatttccaaaccgaattggcgatcgattccaaaaggaaaaaaggtagagaagattccggggagcatttcccctcaaacgatttcaccggatcgggaaagatgcggccgaattggaaaggtggcggcggcgcggcgcggctagggtttcggtgcgaggaggacgacgagtccgacaggtgggacccacctgtcagcgaccgagcgcgcgcgcgcgggcggctgcgggctgactaggccaaagaggagagagagggaaggttttgggccgactttcggcccaaagccaaaagaggacttttaaaatattttccaatttaaattattcatgaaatgcaattccatttattaaaaatacttccttggctcaaataaatcccagaaaactctaggaactatagaatcaagcaaagtatttaatgaaattttatctggccccattttatattggaatttattatttaaaattagatcttctcttctaggcttttaaaatcatttctaataattccaattaaacaacaattcatctccatctctgcatgcaccatggccatcgtgtttatcttccatatgtagccccaaataagtggattggtcatgaacatataaacgcatacattatgaggtagtgtcgtattcttgattagattaatttggcacttgttatgaaacgagaccacctgtgggtatatgatatgatcaatggttatatccgtcgtaggcatggtcacattagatcttcaatatgctgagttgatagaagggaatctaatatgataattatggattgcttcttatatgaaatacagataaaacttgatgaatggatcgatcagtttgttagataataaaataaaatcccgacgtttagtttataaggaagaattaaatttttatatattactagcataaatgctcgtgcgttgcaacgggtgaaaacaattttaattgtgcatattaaatggtccgtttttaaagttttgtgcccgtcaaagaattaaacagctagtaaacacatgataaaacaggaccgacaaaagatactttggcaaatacgtactgtcaacacagatgagtagtaagatatattgggttccatgcatgagctatatattatacggagttgctagaaatatggcgccatatgctacagtcgactttttttcagccacttacgcagtagttacacctcatttacacctcacttatatatgtaattagtatgtaattttcaaatttacattacatatgtaattttaagacttacattgtaaatacactaaaattacatatgtaatttagggacttacaatgtaaatacatgccgactatttttttataaaaaatatagcaccataaatatagctacacccaataaaaattgatatatggttggtaaaggtcgataaatacaattgatatatggttgtacactaacgcacgcggccccatgctggacctgcagccggagcttggcgatcgaggcctggtcctaacataacatgcggaagttgagcaggaaacaagcgcgcggacgtagatatatcctactccctccgttttaaaatgtttgacaccgttgactttctagcacatgtttgaccgttcgtcttattaaaaaaattatgaaatatgtaaaactatatatgtacatgagaatcaaatgatatgaaaagaataaataatttcttaaattttttgaataagacgaatagctaaacacatacttaaaaatttaatggtgtcaaatattttaaaacagagggagtatatgcggcctgcgggacagcgggagttgaagcagcgcgcgcggacgtgaaggagagaggtcgatcatcaaaccgctccagcgggtcgtcgaagccgtactgcatggaaagcatctccgtcgtgttcgccggcccccgccaccgtatagtggccgtcgtacgatgtggcctgggtgacatcgatcgaggacggacggcgatgatgacgtatgaggcgtgtcgatcggtcgcgtcgcgtcgcgccggcactggctgtgatgacgcgctcgactatcttaattttgatcgatgccgctagcccacagccattgtctctacccaccagatgctagccttcatatatatatatatatatatatatatatatatatatatatatatatatatatatatatatatatatatatataggggcggagctagagtatactagggggtgtccaggaacccggtcaagaaaattttttagctatagatcatctattttcaccatgtatgtatcctctcaatacaaacttaggcacccgcatcagcttaaattcgatctagagtagaataatttaagtaagtggcaccaccatccatttcgttctagctccgccctgttaatatatgcgatcgcaaccgcagagcgtcagcgtacatcctaccacgccttcaccgacatgaacaccatcaccatcaaccagccatcgctgccgttgccttcttaccacacccatcaagaccttaattctctctgcttctcgatctatatagatctattcgtggcagcgggtgcatacgtacgtacatacaaaggagatattgttggtggaggtggagttggaagaaaaaacgatctgtgtcaggctcgtcctagaatcacaatcgatgtgtgagagcgcgtggctcgcgggaaatcgggaaccgctgctcgtatcggctgtaagcctcacctatacaggctgttgaaagaaaggggagaacgcgaccaagtgggcttagggtctgacgtgatttattccgatagatggaaaaaaattaaactatatcggcaagtttgcgattttttgtgtccgacacgatctcgcggtgacgtacgaaaagcctcgacaaaaacatcttaaatttttataatagtagagataaacaagtgctgtaaaaaatactgacatagcaacttttttttagagaaattgtaattatttaaaagtgtggtaggaataatccgcaatctccgcccgataatattagaatacaatatggctttaatgcttaataccacaatgtaaaatattttatttctattgacagcgcatagcacgacagtagcacgagctagtacacgttccgtgttacttagtacttcatttgacaatgtgtatgtccatgcatgttgcagaatatacatatactaatattagcatggatatatcagtatatgccaataatccaatatctacttgtcctttaacaacgtgatatatatgttggtcttgtataccaaagttactccatcttgacttttagatatgttgaaatccctcctttggtaacatttattcttttctcatatatactgcatgaattaaaaagcacttgtcattataaacaaaacagctcccctaaaaaaaatataaacaaaacagctgaattatatgagtagttactgtagaaatttagcatggttataggctcttttgtggaaataattttgtggttgacgacggtttacctcaggcagatggagccgggcaagagtagagaggcggcacaccacctacacacaagtcaatcatgatatgtacattagttaattagcactactcaacgttgcacttttaaaacatataaatctataaataaacaaagtcctagttagaactgagattttaaacttgatcatttggacattcgtttggccccgggctttgtacttccaaaatggacaaaaaaaatcgggtgtatcaaaattcagaaatttcgaacgaaacattttgaaatttaaacacattttgactgaattcaactaattttaaccagattcataaatatttttaaaaatctaaaaattttggatgaaatagttgcatgagaggggaggatcctaaattcccaaattttggaattttcggaagttttggaccgaaattttaaaccctgtattgggcctatgcctatctcttggattttaaacaagagagggagcccagcgcgcggcaaaacaaaaattcagaaattgagaatttaatttacggagacgagtgttatattattacagacgtagagtcaacttagatgattcgaaaaccgtctgcattggacttctgcacacgccacgccacgccacggcgcggcgcgttgattgattttacctttctcgttggcgcaggtggagatgatgtccgccggcggcgagaggcggcagacgtcgcggaggagggcgaaggcgcggtcgacggggatgtcgacgccgatggcgcgctccagggtgtggttcacgatgtggcacaggcacaccgcctcccccttcacgatggacgacagccccgcgcagcacccctccggcgccgccgtcgccgccttgtccttgaagaacggcaggcacgggctcagctccagcagcgacgccacgcacgtcgtcgccgccgcctttgcgccgccgcccgccgccgcgacgagcaggacgaggaggacgccggcggcggctgtggacttggacggcgccattctagctaaatgtggattagagcttgagctagcttaattagctttggttaattggagtgatgggagtgtgtgtagatgaggctaattgcttgtgtctatttataatggctgtgattaggacttttgctagctaagagtgttctaagctgttgtagtgaagtttgagctggatcaaacatgaaaatggtgtgaatgatcagaaaagtttgtaattagcaatgcttaatttccactgtttttgttttgctgttatgtcttcctgtttttttttttctgtgcctgccctgaccaaatttattaagattgagagaaggtaaaacattttcaacaaacatactccctccgtttctaaatatttgataccattgactttttagcacatgtttaacctttcgtcatattcaaaaacttttgtgaaatatgtaaaactatatgtatacatataagtatatttaacaataaatcaaatgatagaaaaataattaataattacttaaatttttttaaataagacgaacattcaaacatatttaaaaaaagtcaatgacgtcaaatatttagaaacggatggagtagttattaatattacatctcttcctatggataaacagcactttacatcgaacaaatggaagcatacacgccgggttggctgccggcattgcaattaaagttatttcttcagtttgagatatttgtaaatgttaatttgcaggaactaattaaataagtttgttggagcttctagaatgtagattaattgtggctatgtgatcgaaatattctctacgaaatcgatctaaaatgtggtgcatgcattgtgcgtgtgtgctgatttaagggattgtatcgtgggagcacaaaacaaatgccgttcgttggtttcgctacaacccaacttaatttgcatctattaagatagtgaccaacctaaactgattaactgccatcattgtttttatatgatacctttattgtggattttttttttgccgcgccgggacaaagatgcaagcggaattttgtaaaaagaaatttgaactgaaccaaggcggcacaacaattataatgttatcgaaagatgtatgttccctccgttacaaaataagctaaccttgtacagtgtaggtaacattgaagatatattcacaccgtacgagtttggtttatttttggacaaagagacgagtaggtaacaacatttcagaaattttagtgactgacccgtagtgtcactcagtgtatttggaactcatttgtgtggcaaaaacatttccgaatgattcagggttttaacccttgtgaccacttttcaatccaagtgcaaagacaatagaaaggtggctggtatgggtgtacctattcagtgatcgtctgtcacctttatttctagtggacgaccctttcattggatgccatgtgtcatggctaaaatattgaactgtcatttaaattattaagtattaaacttctgttaattgaaaatatactgaggccccgtttggctaatgggaaagggaaatcatttcccacccactaaaagacatctttaaattttaaccatttattctccttcttccatttaatcctaacccttcgttcatttcccaatcccaattccaccacatatttcccattatccaaatacaacctgagggttttaaccaaaattcactttgaactgtgtaaaaaaaagaattcactttgaactttgagattgtcaatctcaacttttcaactcggaaatgaatcaaatgattcgcgtttctactcaaaattgcaaacttgacttttcaactcagaaaatgcttcaacttcctactcgaaattgcaaccttaacctcaaagcccagatgtgtccaacgtgaaaacccaaccatattattctcaacacaaaaaccaaaaaatagaacacctaatccaagggccgactcatcgttgataatcgtaataagtatacttaaggttcctcatctttccatcaagtttaaatatcatatccctacacacaatactaaaatcctaaccccaacttacgaaactggactaaattaggtcctatgacactataggtggttggttttactgacgtggcatcctagttagcaaaaataaataaaaaaccatggggcccacgtggcaatgcctgcttcattcttctctcctggaccctggtgatggggaggcggtcgggaagaagcgcaagacgtagggagagcgcattcacgaaggcggggacagatgaggcggtcaaggtgcgggctgtcgccctgaggggtggctgagggagtcggaggcgggagaggaatggagaggtggtcggcgagcccatccaagctcaagctcgcccggcctccatgcgagggaggtggacggaggagcgtgagaggtagtcgaggcgcgagctactaccacgctaggctgccatagagggtagtcgagggaggggaaggcggtcagcaagctcgtctgagctcgtgctagcttggcctccgtgcaagagaggtggaaacgagtaagggagggggttgcgcttgcgcggttaaggagcaatcggacgatggaggtattgtgccagagtgcatgctgaccacggcaaccggttgggtccccgtgggctctgcccccctccccccccttcccccctcctcctatctcgaatcgaccgagcctatgacaatgtcgccggctatctcccacatggcgaagatgagggaacggaagagaagaaaagaggagaggtgaagtagaagacggcgtgtccacttcaagttaccagccctgatccaacggagcacgtcgaagcccagcgcagcacaccagatcagttaccagccaacaaataaggcccattttgacccaagaaataaagcccaattttgcccggcccatgcatgcacccccagcttccacgtagacccatggctgccaccacacccatatccacgtgcatatatgcttgccagctcgtcccttccccggcatccaaatcctcgtacacgccatcccctcgccatggatggcatggccaagaaaccgacgagctccacctactcccc

SEQ ID NO: 27157 - DNA, 17237 bp, Oryza sativa
acaagacgccgccgtcgacgtcgacgaggaagacgacaaccacggcggcgatcgctgccgcaagcagtgccagcaccaccatgaccagtggaagaagcagcagtgcatccaagattgcaggtaccatcaccgccaagaagacgacgtcgtcgaggaagaagacggccatggcgatcagcaatgccgcaagcagtgccaacaccaccatgaccaatggaagaagcaacaatgcatgcaagactgcaggcagtggcggcgccaggaggaggaagaggccgccgtcgacgaggaagaagaccacaactacggcggcgagagagagcaacactgccgcaagcgatgccagcaccaccacgaccaatggaagaggcagcaatgcatgcaggactgcaggtacaggcgccaggaggaagacgacgtcgtcgacgatgacaaccaccacggcggcggcggcggccatggcggcgaccactgccggaggcaatgccagcaccaccgcgagtggcacgagaggcagcggtgcatgcgagactgccacgagcgccgccatggatgggccacggtggccgccgaagccatcctccaggcagtgtaattaaaggtaacgtaattaagatactgcttcgccgggtgtagggtatagctagctagggtttccatggtcgatcgacctagagctagtgctgtgctgctcgcgcgcgtgcacacacgaatgtgtacgcgagggaggggagaggaataaattgagcaggagatagatggccatggctctctccgataggagagcttctatatatctgggggagacttggaagctatatatactagctagtgtctactatgtctatgtatccggttgttgcagtacacttgtgcttggaagaggtgtatgtatgagataaataaagtggcgttcgcgaaaaagaagagataaataaagtgagagccctttgagtaaggtatttgtttgatttagattaggaagtggattttgatccctcgagtggatatactctcgttgtttgtatgtcacttaaatggttatgaaaaaaaattgaaaaaattcgagaaaatgtattaacatgtaacatatcactccataaacatgcaagtaaaaattcaactttcacatctcgcaacgaaaaaaacaaatttgactctgaatatacgttaactagctgcggttcaatttgtttttttttcattacgaaatgtagaagttaaatttgaacgaggggatatcctctcgagggattaaaatagtttccctttagattattgagcgaattattttcgtaaattattacatattttgaaaataacatatagctaaaaaagagtggtctaagtgatgcggtggaataaagtagttttaaaaaagggtttgttggaatcatgccaccctaatatgtactttttttataccgtgtaaagcaaataatttgttttaagaaaatggtagataagctgtataaaaatgatagggctatgtgtaagctagcgctggagagatgacggaatgaatctggaatttccaatgttgtgagaaattacttttactctgcttgagaaaatgcattgctttgttctccgccaagttcctgttaatcctgaattatgatcattccagaagtccagatcaagctagcgtgacaacatcactgtacagtattattaattggggctagcagcagacataagatgttgcatgatctctgttgattctgataatttcctgtcctgcaaggctgcaacatgctgaaactgacggcaattttacagtaactgcaacggcacacatgtccatgtaaccaggaaaacgaaattgtacaggtagataattagtagtattagagtactaattaactcgtctgctaactagaaggcatctcaagtcagcaatttatcttgggaaagctctatgcctctgttaatgttaacatagaacagaacaatacatttgaaaggtttgtcagtgtcagtttcaggccatatgatgcggtagtttcttactgcttaatgcaaagaaattaaattacagtaactttgggtaaagtgagacatttcattgaacatatttagccaatgtatctatattaattagaggggtgcttggaagggttgacttctgcagcagctgcagcagaatttgtgctgctggtgcatagctgcaggcacaagcgagcaagtttataactctatccagttctgttactgtatcaatccgtttaacacaccagtaaagatccttgcatgcatcagtaattcagtataacagtagtgaagttttctcctatcaaactgaactgactgaatgatgtagggatgcggcattgcgtgtggtggaagaagatgctcctgtgaatcgagttagtttggttctatggagtcattgtgatgtatatgcaggtcatggcatggacagacatttttattttcagaaagagaatgcatgaactcagagacaaacccaaggctgtaattaagtaaccagtaagaagaaatttactattactccggtatttagttcgacatctagttcatttccatccatcatctctacacatactgacatacagttggtttatccaggaacttatgctgctcagctaatcagctatcaccaactctgctcacagctatgcacacagtgtatgtagtacattacacatcaagttttcttcttttttttttcctttttcttttatacaaagtccttcctggagactggaacgtgtcttctacagggatgttttatgaggcttcaggattcgtcatcgctgttggagcccaccgaagaggatgatgacagtgaacttggagcctgatactgcacctgagcctgagactgttgctgcgcctggttcctgaagctttgaggatgaagcgggggacgatgtcgaggcgggtgcgaggagctcttctggttgtgactcatgttgatgactgctgttatgatgtccattattgtggggagaaacccagatgtaatagtcagaagacctgagagctgcatatgaaagaacatccttgagatttagtttgaatacatgccgtgtaattcagttgaactgaaatgcactagatagaaatttaagagcagtttggctctgtatatccacttgtggatatagaggccggatttttatccattatctaaaataaaaattaagagcagaattctgcctgatgaaaccagctaaggtgatccagcccctttactcctttctagcaacagcgactttgataaaaaagcactgggatgtaatttatgcgaaacgcgttctgtagaatattaccgtgccatggcgaaaataggctgtgatgtcatattgcaaccatgcagcataggatactacgaaggcgacgaagagccccagcagatataaagggttcctgtccaagagttcataaacagagagaagatgctggttagtggttacatatgttaaccgtcaagttcggatttctcagtttatgcgtttataaggataagaaagctacttcattgagatgattaccttagaaggaatataaattcgttgtaacctaaaattgcgagaagcaaaacagtccatgcaggtggcagccaattattgctacgtctgtgtgcttcctggtggaagaaaatttggtaagcacagagcaccaacaatcagatagaaatatcataaatggagtttcacataatggacaaaaagaacatatttcatgaaaagcttatcacttcttttagtatttttttaagggcattgaagacccgcctctgaaattagcaggccagggttcatggttcactcttcataataagaaaacaacaaattcagttatgttttacctatccatttgatcaaaataaatcagtgttatgcaatatactggataagcacttgagcagaaatggcccacttgaacagaaatggcccagaaatatacctgcatagaaattgcttgtgcaacagcatactctgtctctgcattgaattgcctccagatggatttacactgcactggtgtgatcagcgtattcttttctgacacctgtacagacttaaaaatgttaacgacttattcatcacatttgcccttctaaatcataaatttctaaatctaagtgtcagcacctcctcccatgtgcttgaagcaagaggatcagatgtgaattcaatactccttttctgtgaaagcggtcctccatctaaaagagcagtcgttagagcccgatctattttatctggtttatcgtccaaacgtacagctgccattaccgacataagtcttaaagcctgcagtgggaaggtgatacatagatcatgtttctacagcatagatcaggataaatgagtgcaatattgatcaacaggaaagaatataccgctaagcgtgcttctctagtgattgcacgtatatcttcatttcctttccatgtcctaggcatggaatccttatcacggctcaacacagtggaaaacctagagtccaattaaacaggtagagataagataaatgttccaaaaatggtaagtgtgatccctgaaaagtcaagatatgtttgctaagttttcctccaaaaataatagtagcagattctacctttctttcatacgcatcagaacgttcccagcttcttctctagctttctcttctactatacttcttgcatgttctcttaattccatgaccatcttacggatagttgtctggtctagttcaaactcggagagggaagctgagaatgccaaaatagcactttcagtcgcatgcctgtaaagtcttctaatacatgcccaagagtccttttcaccagtttccaagattgactgtacaggtcaagcaagtgtatccaagagttttttctgaacattgcggcaacaaaaggtccaagcatgaggatggtttttttaaaaatccaccgtaagaactcatgaaatggggaattctaggaacatgctgaaattgcaataataaaccgtgcactgagtatgaaaaataacctcataattagcctttagttcagccagttttgtaccccgaacagatgttgcatgagcttctatatgctgctccagtttgctcctaacttttgtcgtgtcccactctgcatgcttaaccaaagcatctgcatgacaatggagggacttgatgtcatgtatcgtaaaccaaagatttaaggaatgatgagtttcaaatcacattacttcaaactactaggaatttacttatgttgaacattgccgtatttctagtataatctgaatgaataaactattatttgaaaaacatacacaatatggttggcaggagcaagcacaagaggcttaaaacaagatcaagaagcaaaggctcatagtactagtcgacgtatggtttagacattcattgacaataaaactatcaaatgagcaccaaactatggagatttggcttttgcagcattggatttgcaggacaaaaaaatgacagcagaaagaggtcagcatgcatgtcacatttgacaaatggctaaatattttagtcccaataaatcttagccgtggtttgtttacctctcaatccagcatcaaattccgccattgatgactgcacacaataacgagctgatgctgcaaatccctcaccgctccttaatgattgttctagatcacttttgaatttgttcagaaccacatgatgcaggtgttctaacattttcttgaaagcatcatatgtgtgctgcaaaacccaagatttatgagaccagttgatcaaataaggacaaataaaacagtcgatttacatttttctgacagatgtcatcctctctaattagtaagagccaaatttttatattataatagtcatatatgcaattatcactgtaattatccagagtgcctaaaatatttataggacctttcttcgaatgtatgtgtgcatattagcaatccattatttgaaatgtcatgaacaagcaagaattattaagaaaaacaaacattttcctacattgactagtgtaatcttcataaccaaacaccatcatctggttaaactactttctctaagccataactggaattagtaacatagaaatgagtaactcacttttaggatttcagattctaactgttggcgtttagcggttctcacatcctcatcaaagtacatggcttctgtgtcatacctgcaggaaaatgttaagttaagactgtcagaactccgaataaaaataaatgaacatttgttacatgtgcaatctaagaactctatatttttactttgtggcatccatgaccccaaacatagtctatttactagaaaaagaaaactccaaaaccattggaagaagaaacataaataagaacaacaaaggaatatccattctttcagattaccattaaaatatacattgtcaatggacatgctgcagataggataattagtcatagatagcagaaaataaaactaacaggtcaatggacatgttaagcaagaacagaaacactttaatacttgaaaacattgtaaggataattagtcatatcactcactcagatagataaaaatcaagaatagcattaagcttctttccaaagcctggtactagaccagaatttgcagctgtttctagctccaaccagccctgcagagatgaatagttaattctcatggtaccaattaaataaaataatgtatagatacaacaatgagaacacgctaccttatcagatatgaaacttctgagcttttcatccgcaatctcttcacaccgaacagtagcaaccatgatctacagaatatatggaacagataaaatataatatatgatttgcaactaagttcatggagtggtgaattggtaatgattataatgcaagtatttagttgttcacaatcaaaagcaccaaaaaggcacaaaaaaccttgtgagcgggaaggttgagatccttgttttcccgtattactttccagatctggagtgcactaagacaaaaacctgaagcaggaatcacacctcttctatcagctgctagaccacctggagcgattgaatgaataaatctctgcctgagttgcccaacctgtagcaatagaagtaagtaacaatacaatatgtctccattgaagtgacacgcttgcaagttgtaagtttcattctgcggtgaatgtgattatgcaattagtagaaagaacattctgtggtacaggataaaaaataagtattttacctgctccttaaatagattttctttctcttcgtaacttgacagagcagtaacctccacctttatataacaaaatatatatatatatcagtttatatatgcaacttccacttcagaaaacctaagcactgacattgaagaattcacttagtgcagcttccttgtaaacttctggtttgcgaacagcattccatatctgtaagaacagaagaagtggtaaaacctttagtgtggcaatgaggaaaggcagctgagcaaaacataagacataaacaccttctggatatcctccttcagagcttgggttagatactctagtggagtctgcagagacaataaaaaaaaaaaactcataccagttaaggatgtctgcccaagaaatgggaggaacatattttgtaaattttatttggttttctctgagactgtccaaaccttggttttatcgcgaataacaagtagcaacgttgttttgcgtgggctgaataaacgcatcaatacctcaaatagaaagagaaaaacgaatagattaaaatatgtaactgagacaaaagtcatgattagtgtcactgagacggatgctacctcaaatattgttttcaacagaggcctattagctgcatgttctcgtcctatatcatgacaccacctataaaaggcatattcaccaagccacataagaaggttgagaaaagcaaaatgaagttctcccgactcattaacgttatattcgccaataatgaagtatcaaacgatatagaaacttacaaatttatcataacaatatctgatactgccagagcaaaaagggcactctgcttctcgaaggctgtatcatcctgcaagcataacagatggaatttggatgaggaccgaatgcgatgtagcttcacaaatgaacggttcacagagattgatagactgaaagtgaaagatatagagcatcactttaacaaaagagatgtcacaatttactgtaaaaatgacagcggcagatattcagagttgatgctagaaatcacagctaaaagtattgaacaggaatgcgtagagaattagtatgaatgcatgacttccttgcatttctaatagatgctcccatgaatcagctgtacagggtgattaagtaattgtactacaacaacaataacagcatttacagctcattgcaggccgagttctaatgacacccactacatggcaactattttggaaataaggccctaaggtcctagcaaaaaacttattaagggagacaacgccacatgtggataaagcaagtactagaaaagcaacctttttgttttccacagcctaaatactcaggtacacaggactactgctactaattaaccacaagataaaacatcaaatattttacgcagttagaaatggcatggaagagttgtactcagaatcttacaaaaggaaacatggtatggaaggttttttattcgtataaacattattataataaaagcacataacactcaacctctcctctttccctgccgtccgtgccctccaaatccattacaacagtaaacggctcaatgcctacagccttggcaatccaaattcccttggtagtctggctcctgacaacaaccaaacaaacaaaacaggaacagaatccatcatcttagctccaaatgtgagacaaccgattgaatgcaatcgaagagcaaacaagaaaagcagcgcgcatgcatttcggtgggcagcagcaatgtaaatgtttacctccctttcaaggcatccatctccgtgaagcttgtcccgaagagttggttgagcagggtgcttttccctagccagagtaacaaggcaaagcatcagcatcagagatgttcccgacatcaatttcaactaccatattattatccaaatcaccaaaacaaacatgtccagtaaaaaatcggtgcaaaaaaaaattaaaaacacttccgcaacagaatatgctactagcgtcatccaatctcgatatcccatcaaccacacaacaagcatcaagtactaacagactactctgctctctacatggagatggaggggtggtgaactggtgatcgtgggaggaggaggagggagggggtaaggttctctcaccgctgccctggggcccgacgatggagacgacggcgtaggagaggccacggcccaggagccccgcccccgccgcgaaccgcgccatcgcctccccgtccatctccccgtccgcccccaccacctgcgccgcgtggcagaacctctcccctccgccgccgccggagatggggacctccatggccacagccgccgcgggcgcgaggagggaagccgacagctcgcgacgaacgcctccgccgcgcggcgaagagagagagagagagagagagagagagagagaggagggagagcgatacgtggcagcgcgagggggagagggggggttttgtacgtgggggaggaaaaggatggcgtgtcgaggacgaggtaacggctggcggagtcgcgagggggttccattccaatccaacggtggatccacacgtgagagggttctgttttttttttttttttttttttttttggcgaggtggcaaaccaacggggaaagaaaattggtgaaggtgacaagagaaataagatattgcagtttttttcctttcttcaagcgtttcttagtccaactgtgttttagggtctgtttaatagagctctaacttctaactttagcttcagaaattaggtctgtagtgaagttgtggagttgtctaaatccaccttcacatctctctagtttattttatgcgagtgctccactcagctccgcttccattttaggtggagctgaaactgtttagctgagctccagctatgtgctaaacaggtccttagctctacctgaaatgagggaggagttgggtggagctctctcacaaaatgatctagagaggtgaagctgggtttatgctgctccacaactccactctagtcccaactcttcaacctaaatttaggagttcaatctctaccaaacattcccttcctaaggtattgcggtttggagtgtgctatttatgtctcctcgtggatggttgagagggttttgggtattttactagtttgactttaaatgttaattgtgttatatgcttgagaggagataaaaggagaaaattgaccagttaggtaaaacaatgtgatccatgagcgcacataattaattaagtattaatcatattgaacttaaaatatggattaatatgattgtttaaaaaatgctatataaaaacctttttgcaaaaaacacacattatttattagattagaaagcatcaatctgctattgccgaaagcagcctaagctacggtggataaataaaggaaaaattggaaccatgccattataattttataaaatttgagatataccatcctgacccacatgtcaatgtcattgactcatgtggatcctacatgtcattgagataccgatggcatatctcaaactttgcaaaattataatggcatggttccaaattacccaataaagaaatgagacggtgggaaggttgtataggtttatcaaatcaacagaaatccttttatctaataagtttaacgtgtaagtgaaataggtgaccacatatacttggtttattttgtatacttggattaattttttaaagatttagggggtgtaaatactactccctccgtcccggtctatccaaattcgttgtctaggatatatcacatccacccaaaatctcttatattataagacggagggagtaaataaggaatggtgctactgacttaccgcaccacacatttgtccccaaaactattgatcgaaaaacaattatagagaggacacttaatttcttggatacgataccaatcaattttgaaatctatgagttttgcaacaaccttatagtattttaatttatactaaaatcatattgcaatcctacaaggaaatacatggacatgttttcgttttcgtgtttcgtggagcacgagcacatataggctgtgttcttacctaggttttccaactcatctccctcgttttttgcccgcacgcttttcaaactgttaaacgatatacgatacgtttttttgcaaaaagtttctgtacaaaagttccttaaaaaaatcatattgatccattcttaaaaaaaattagctaatacttaattaatcacgtgctgctaatgaaccgttccgttttccgtgcgcattgttctagttgggaacatgctacagcgaacacagccataatcctccacataacacacacatatgcgcagactacacaaggaataaaccaaataacatatttgcaaacgaaacataatttgtaaataaaacattcatatacgtgtttttagcgacttaaaagcaaaggctgaaaaataaactttgatgaaaaaaatcaaaatcagctccaaatttaatgttaaaaatttaaattttagctaataagcataaacataagcgaaaagataacgcgcttgttaccatgatctaaacatcggaggtcaacatttaattttccgttttaagttttggtaagcattctttatttccttaatttcttcagtgatgaagtgtacgtaggtacggtattgaagagagggaattagcatatcgccatttaaaattacggcccattactaattttgggctctgacagacggcctgcgatcgtgccatatatatgggctgttatacggatcgccataattaaggaggtctcgccaatttctactctctaattaatataataagacccctaattacacaatgaagtgcatgtttaatcagcgtaaatgatcttttcagcggtatgtaaattaaatgacaatcaagtcgatatcagtacgtactcttatctgtgtgactgtgtgcactgtgcaccgtgtttaatgaattaattcttggtttaacaataaatcatactatacctccatctcaaaaatataatgagttttgatcgtatatcttatgtccaaaatcataacttaagttgttatattaattttgagaaagaggtagtacaattttaacttctgtccaaaattttcatgtgcttttgtactgacttgcattgtctacgcatagattcatttcatattgatgtggtggcctaataggccaagtaaacatttaattttgagactctgaatgaatcagctcggccattatatcttagataatctattgctcaaaaccttgaagctttcacatcgatccatcgagagtttacacggaagttcacatatctcagcatcataaatccataagatgccaattagatatgagacagtgacatggcgatggagacccaatggtccatggttaggacaaataacgaaaccaccgagtaattaactgcagttagcctataccactagtacaagagccatgatagatgccggttgggaaccgactataggtgccggttttccaaccgacacctattggttggcaccaataaaaacaaccggcacctataccaaaatagagccggcacctataggtttgcacgagcaaaaaaaaaaaaagagccggctcgaatcaagccggaactcacaatcgtagtcattgcgccatccccaaaccctcacaaatcacagatcgaaacatattcagaaacaaaatcatccccagatcacagaaacatctaaaagaactacaaaatcattcaaaaatccatcgggcgctactggcgccaccgcctccgccggaccgccgcccgaccgtccccgacgtccatcgcctcccttccatccggatccagcggaggggagggcgcggccgccgccagccgctgctgccgcctccgctgaggtccgctgccagccgctgtgccgcctccgtcgcctcctctccggctggatctcgcggaggggagggcgcggccaccgccaccgcctccaccggaccaccgcccggccgtccccaaggtccaccacctcccctccaaccggatccagcggaggggagggcgcgccgccgccagccactgccgcgcttacctcgatggggctgccgcctcccccgggccaccgccgtgcctacctcgacgggccaccgccattgctgcctccatcgggccgccggtgccacagagagagagagagcgatggagggaggcgagagagcaagagcgagagagagacaggagcgaccgagcgactaataaaaggacaggcggatggataaggccggctcgccggctcggctccatataggtgccggttttttatacaaaaccgccattataataaattctaggtggcgattttgaataaaaaactgatacggtgttggtttttctttaaaactgacacctataattactcaaggtgtcggttttatgtgtttttaacttgtagggaagggaaaagtattataggtgccggttttaactgctccggcacctataatgccaatctctgtgagcttttttttttagtgtacacactctgtcttaaaaaataaattgtttcttttttatttttatgtatgaaagttgatatgtccatgttcgtgcataagagttactaccgaagtaatttattttaggatagaggcacatagagtgatagatatatcagattgagtatagggtcaactgcaaatggatgaagaaaaaaaaatattctcttcatctcaaaatatagcaacctatgatcaaattagatatatcatattgagtcattgagtgatctaaaattttagagaccatttgagcttgtcaaatttattttagaggccatttgaatttggctctaaggagtggaatgtctttttttttaagaactcattatattatattatattatattactccctccgtctcataatatagcaacctaggatgggatgagacctatcctaggactacgaatctggatatgaggtcccatcctaggttgctatattatgggacggagggagtatagatgaaagacagggttcagaggatatgaaatccccgatacaatgtctacaaccaaagatgttagggtgcgtttggttgcaaggatgggataggatgagatgggacgaacccacttttggggttgtttggttgaggggtgagtgggatgggttggtccctggagaggaatatccctctcagatccaggaccaaccgatccgggaaaatctggcggatgaactcgtcccagttgggacgagcgaacggcatgacgacgcgttgctcgagctcagggccggcctgcgcgctcgccctactcgccctcaggagcagcggcagacaccggcgggctcagcgacggcgaccgcggcatgctcggcgacggcgaccgcggctgcggccacgggggcttggcgacggcggccgcgggaggcttgatgacggcgaccgcgaggggctcagcgaccgcggggggcttggcaacggcggatttagtggtggggatggcggtggaggcggatccgcgtcctctacctactcgccgccagcttgctccttcgcccgcgcgacagccgtcgcgctcctccgcctgcttggccatcgtcgtgctcctccaactgcacccctgctcgcccatccgtgctcctcctctgtctgtccgcctgctcgcaatcttgcgccactccttctcgccgctagccatcgtcgcactcatccgcccacccgctgagctcccacaaggctgtcgtcacacatctctgctcactctcctctttctcgctgatggtgatagcaaacggcgcccatcccatctctcgctcatcccttcaaccaaacaaaaaaattaggattgtcctatcctacaaaccaaacaagtaaatggaatcatcccaaccccaaaatcagggatggttttatcccatcccacctaatcccgaaaacaaacacatgcttacagaacaaaaccatccctttagaagaaagtaagggtggtagaactaaaaaaacaatcctgcaaatgaaatcatacaacattaatggatgagatcgacggcattgccacaacgacaacatccacatggctctactactgacgtgcacgccgcttgacataccagtaaccccttcgactgccttcacgggaatgacactatactggccgtacaacatcataaatctattattaacatcaattcatcaaaatttcatgcgaaataataatatttgacaacgatggtagtaatgagagaaacacttaatccaaaaacatatatatgtgttacttaatagttaaacacttaaacataattcaaatcgactaaagccatattcggtagaaggatcacttattgtagaacaacaagtcgtataccggtatgtcaatttcgatctcactccggtcagtaccggcccaatatatggcatagacaaaaataacttcgtagctaaacatagttaaggaattgattaaaccatagttctaaaaaactgattaaaccaaattcgacgacggaatcctatcttactgtaaagttatccctcactaactccttaagctcaacatgtaaagataccacatcatcatccactaacaagatgacacatcatcatccactaacaatcatcacatttaaacatcatgcaaacatgctatatctttatagtttttataatttaagagcttttcaaatacaaacatgttaaattattatccaatataattcacataatgtttcaatgtatatctttattatgttttataatatcctatatacttatatggttcatcctcagttagtgcttaaataattaatctatggtccaaattatctttatcattttttcctctaattaagtcatatcacattaattgtttttagcctttagatgattaatctacggtccaaactatctcactacttttcttctttcataaagtcataccaccttactttttacgtttaaatcaccattctacatactatttaaatttaaattatcataaaccacattaatttacttaatctgatgttatctagctattttacacgttattttttttattgctatcatactaaatttccgcagcaatgcgcggggtttcacctagttggttagaagaatggtaccagatcgatcaagtgacatcaatttcagccattccggtcaatagacttgattggaacaaccgaaattaatcgggaaccagccgataccatacataagtaagaagagtctcaccggctacctgtattccctaataaatactccctccgcttcaaaatatttgacaccgttgacttcttagtacgtgtttgaccattcgtcttattcaaaaaatttaagtaattatttattattttcatatcatttgattcattgttaaatatacttttatatacacatataattttacatatttcacaaatttttttaataagacgaacggtcaaacatgtgctaaaaagtcaacggtgtcaaatattttgaaacagagggagtacaatttataggtaaaacttttatgtatttgttcgtaacaactcaaaagttaatgttaaaaaaattacgttaaaattttcttagaatcaacattcgaattttttttatacttttactttaactagttatgccaaccgagaaggccccattgatttaatggaaaatcataagaattttagaggattttatttctatagaattttttttacataaccctttgaatcaaaggaataaaacctataaattttagaggattttatttctatagaattttttttacataaccctttgaatcaaaggaataaaacctataaatttcttatggaatgtctcttcccatataagttttggaggcttcttcatgcaagttgtccccaaatagtacccccggcggctacacactaacataagttagaacctcatgaaaataattatttaaaaatctttatctctcctcaaatccttttgtttttcttgtggttcaatcaaacggtcattcctatatattttttctcctgtgtttgcaattatatttcaaaaaaaatcttatgtttcttttattcttttttggggatcctctagagtcg

SEQ ID NO: 27158 - DNA, 50379 bp, Oryza sativa
  unsure (1)..(50379): unsure at all n locations
nnnnnnnnnnnnnnnnnnnnnnnnnnnnnnnnnnnnnnnatattaaaaaaaaaacatgtataagctactagcaacaaacctatgcatggatggataatcatggaggatatatcatgccaagggcgaaaaggtaatttcaccaccccaacctcaaggtccccaagtaaccctgctgcttcctagcagcttccaagaccccacgtcacgtcgtcgtcgtctttctcgtcgccgtcgcggaatttcctccgccatcgcgcgccctcggtataaatcgccgggagaaatttctccgagctctctcccacccaccaaccccccatcgaggagacgacgacgaggaggagatgcttccgggggtggagctggcgaggcggcggcgggtgcactaccacggcgacggggcggcggcgggggcagggtttggggagcaccaccacgggcactacaactacttccaccagcagcaccaccgtcaggcggtggcgagcgcggaggcgggggcgggcgcagggggcgaggtgagccccgcggtggcggcgcgcatccggctcgaggagaagctgcggggcgccgcggccgcgccctcgtcgtctctctcgaggtgaatgaatccccctcatccgtgccctcttttccctgttcatttctgttccccttttctttgtgttgagatccagccatggactcgtggaaaaaaagatcgcgttctacatggctaatatattttacttctgctcgaattgggggagaggatcggtcggttcttgaattcgatggcaagaagggagccaagatctgattgtttcatcaaccagtttcttggattcaactagaagctatatattatcacataggagtaattccatatgaacagtgtatcaggctttgcttaatttcagcattcagctattccacaatacttcagacatagaatacttttaattccatgtgtactagcaaaattcagacatagaatacttttagttccttaaaaaaaagatataggaacacctttgtttttttttcccaagacaagatacgaggctattgagaatcacctagtttttttaagcttcctgcaaacccactgataacgacgtcttttatgattaatccatgtgggtgatcttattttgtatagccataagccaaactagttggatggcaccatctgatgtctctgctttctgaaaactaccacatgttagatcaagccacacaatgatatgcacagggaatttgccgatgtatgccttacgccatcactgtttcagtttgattgttttgggtactatccagaaattaggccaacggctgcacacgcatgcgaaaggcgtgtgccctttttcccgcgtatttgtgatttagacgtcacagcgtctgcatgggttctggattgttcagtaaatagaatcatccttcagtacatcatggcttcttgcttgtgcagcttggcttaaaattgacaaaactaccggtgaaagatccgacctggtcttcattaaccaaacaaccaattatgggtatagtcacaaattatagtaatcaattcagcatataaaatgtagtaactatcttgttactagtttttgggattaccactggcatgaatggtaaacctgtcacaagtgattggttttggttaattgatttgggtagcttttgttatcagatgtttgaaattgaaaatgcatatagaataatatagctgttatcagatttgggtagcattggttctcaattgatttggttaattccgcatatactttttacctaaataagaacactaaccagacatctccattttccagaggagggttcagggatttttttgcaatacccttttttctactacttgcctgaattctttttgaaagatttggcattttctcatccatcatcaatgtgttctcttcataaacatcttcctgcttcgatatggagtagcaaaacgacaaaaactgaatatcgatattcctgtgagctaacaatcagttacgtacgcaggtggggcaggcgatttcgcgaacgagatgggagcacaacctccagacaacagaacaaccagcaagagcagcagattcagctgcccactgaacccaggcctactcccaaacattcgatgaccatgctggaggcgccatcaacaagaaaagccccccgccgcgagatgaggaggacactttccaaggccgatctctgcgctgtgtgcctcgacgaagtgcgggagcgacaccagcgggtcaccaggctaccctgctcccacaagtaccactcggagtgcgtcctcccctggctggccatccaaccagactgcccctgctgcaggacgcaggtcccttcggtggactccctctttgtagcttgatcagcttgctggaagatttggcatcttcttcctctgcacagtttccgaaagaaaggaacaaaaagaaagggttttcattgtcttcagcagaacatgaactgacatagacaccatgacaaagttttgttcttcagttttctcttcttttaggttctgtgatattgtgtgttttatcccggtttgtttatatgggctgcgggagctgaaatatgttgggaagtttgttgtaggggattggtgataaaatgcaattgcaaatgatatggttttgaaaaaaaaaggtattgtttcttttttccaactttaagggaaagatgggtccggacaactgacacatctgaatgtatttttttggtgtacttgagactatgcagcctgggcttggtctgtagttggtcatctggttatggcttggtctgtagtcacacttgtggcaactgacaagattccttgttcatcatgcaagtctttattaattttgttagccaaattttagacaagtttagaacataataactacacccaaatgttctgttcggtacactacacacagccgaggccgacatgtgagaaagagaatctaaggaatttatttattttaaaaaaactactaaaccttactatttcccgatctaaatcttttactccctccgtcccacaataaaagtgattttcagtttttgcttgtaacgtttggccactcgtcttatttaattttttttttgcaaatctaaaaaacgaaaagttgtgtttaaagaactgtagataataaagtaagtcacaaataaaataattaataatttcagaaaatattgaataagacgagtgatcaaacgttgtaagtaaaaactcaaaatcccttatatcttatattatgagacggagggagtagcgataacattgttttggttgggtggtaaaataaaactgtcacgtcacaggtggtgttgaagaaaagagtttagattttggaattaggttttgaagggtttgttttcaaaataaaaattaaaatatttcaaaaataaataaaaattcgaagctaagcctcggtgaaaagcccaacactgaaaatactgttttatcatatactcgtacaatcataatacggaaaaaaagatttaaagtttttttagacatgatttagtaggtgcatgaaaaagtccctacacaaaggttgactctaagcttcaagcctttcaaccttcgagaagcaaagaacacacgccacatcattgcaccagcaacagcatcaacagcagccaggtattatatttcagcaagcaccaagccaccaaatgttggtccattcaatgaaccagaaaaagaaaagttcagttatctgtatttctcggtcattatttccacacggaagaaagaaattccaggccggcactggcctggagtgaatgcaaaactagagcaattaataattaatcaagtatggacatcaattgacctaagacagtttcatccatacatttcacacagattattgctcctacgtctccatgttctggaagaaacaagcaaggagaggacgcatatgttgcccaattaattagggtgatgaccattttttttctctgtcaaatctgacggtataacttgaggtgcagtcttcttttttagtcttaatttagttccaagcgccattgcgatcgacatcacgccaaaaatatataagtcgccactacatcctcctatcttcctgcaaacaaagcttaccttccttctctctctctctctctctctgaactctctgaaattagagacgatgaagtgcagcagagtcagattagttcttgtgatggtttctctgcaggccatgatcgccatgctgccagatggagcaggagcacaaagtgagcagctgaatgcctgaatagtactgcaagctagctaattgagtgcatgatcgatgggtgttcctctctccttttcttgtctgaattttttggtggttgaattgctgcttggttgcatggttggttgcagatggagatgggagtaggtgcagcaaggtgaggtgcgggatggggagctgcagcgagtcgagcgactacgtgttcgggttcgcgtgcaggtgcaaccccgggtggagccgctaccacctcggcaacctgcagttccccttcctcccatgtgtcatacccaactgtaatttcatttcatctcttctcaagatttacttacctatatttgttgatttcccaattaatctctttgatgatttgtgtgtgcgatggtattgggctgaaaaaaagtttcttttattttttttccgaaacgacccgcaccatagtgcgaagttttatatcaggggaaaaatgttataacactgaagattataaccaggaaaatatttggttaattaactgaatttcgtggtaacggttggttcgggatttaggtcatatttgaatagttaaccacgtgaacatcgattgtgcagaggtgttcgcttaggtttaatgcaaacaccacggccatcggctactaaaaactgtccatataatactaggttttgtcaagttacattttgtttggacgtagaggtcacgtggttttaattaatccattatctgaaattaataaaaacctactgatagctaataaaagctcatcatagcttaacgttgtcattagcttctccaccatcgactatcctagctttacaattaacgctccttttataggcatcgatgtttcagacatagcacctttttatgtcccaagtgacagaatagaatgtacctaatttttttaaagtaaattgcacttgcggttcttaaacttgtaagcaggtttcatttagatccacaaacttacaaagcatgtatcgaggtccctaaacttgatttattatattatcccggtccaaagtctcatttgaccgtggtcttgtccatttgacatgacatgtagatgacgacatggcacattattattattattcctttttttctctcttcttcctctttcatttctctcttcttcggcctctttgacacgggggagctcgaggtagctctagtggaggaagaagataaaagaataggaggaaaaagaaaaagagaaagaaaaaaaaacaccatgtcatcgtccacgtggcgtgccacgtaggtaagaccactgtcaaacgacgctttggatcgaaatgatacaataaaccaagtttagagatctcgatgtgcgctttaagcctcaagttcaatggtgtagttctacgtgtacttcaaataggaaataataagatgcttaaacttttagcttaaatgtgtatgattaacttatggcttttaaaaaacaaatataaaaatgttagcttgctaagtactaggagtatgtgggaagattcctctaacatacggcttgtttagttggcgaaaataaaatttgtgtgtgtcacatcgaacgtttgaccggatgtcggaaggggttgcagtcacgaatgaaaaaactagtttcataactcgtctgaaaaccacgagatgaatttattaagcctaattaatccgttattagcaaatgtgagttatcgtatcacttatggctaattatgaactaattaggcttaaaaggttcgtctcacgatttcctttcaaacttgcaattaattttttttaatttatatttaatgcactatgcatgtgtttaaagattcgatttgatgtttttgggaaaaatattttgggaagtaaacgaggccatagtcaaacccattgaatggacacttcaacttgtgttgttattggtcaaacggcgtgcaacaaaggtccaaactgcatctgtggactttgccaccacatgtttggattaagttgctcatgaaacatgagttaaatttcaccttttttcttgaaagaacaaacgagttactccctccgtttcacaatgtaagtcattctagtattgcccatatttatattgatattaataaatctagatatagatttattaacatcaatatgaatgtgactaatagtagaataacttacatcgtgtaacggaggaagtagtaagttgtaacgttattatagtacgtgcctacggtaatcttatcgtgtcaagaagtccaaattccagaagcagagtacaagctgttaattgctttactgctcggttaaccccaaagtcaaagtgaaagtcacaaagagttgccacgtgtacgtagttacgcacgctggactgacttgtagtgccacgtaggcagaacagtgattacccagagaagagtttgaccgttgactcttcctcctcgcaggcaccatcaactactcgtgccagaacgggtcgtcgtcgccgtcgccgtcgccgccaccgccacctcctccgccgccggcgatgccgtcgctgacgaacctctccatctacgaccgtaataatctctcaactactgcactcaaaacccacaagattaatcaccaccatcatgtcgtcaaattaaactgttcttagctttagctgatcatggcgttaattaattctcgccgtcgttgattgttgcctgaatgaatgcagcttgcctcctccagtactgcggcgacggcggcagctgcgagaggtcgtcggagttcggccaccgctgcgcctgccacgacggcttccagaaccttctcaacgacacctcctacccttgctaccggcagtgtaagcatcagctttaatttgcaatacttccttcgttttgggagtagatgatatatatttttgactcacgtttcatcgttcatcttattttaaaaaaatgatgtaaatgtataagatataaatcatgcttaaaataattttaacaataaaacatttcgcaacgaaataaatgctaattgcacaaatatttagtactctcttcgtctctaaatatttaacgccgtttactttttaaacatgtatttaacgccgtttactttttaaacatgtttgattgtttgccttattcaaaaacttttataaatcttatcctgcggccggccggctggatgaatgccgggcctagctcgtcgccggcgactgatgtttttcttcttctccggtggcaggttcgcttgggtcggactgctccggcctggggatcagcatgttcaacgggtcgcagccggggacggcgccgccggcgccgttctcgttcaccgtcaagaagtccggcgccgccgcctcctcccttctgccggccggcggcggcgtgctgctccacctcctcctcgtgctggtctcctccttcatgataggatgaacagcagagcacagctagtagcaataatagagagacaggcagagatttcttttcccatattgaggagacgttttctttttcctatttacacccctttttcagtaggaattttgtttcattcatgtgatcatcagtgtatgttaataatttcatagaaataaaatacttagcagtagaagatcttgtgcacatcagtagataataatgctgcgctaactatcacaccaggcaccagccatactcttcaaaagatctgaccaccatcagcagcagcaagccagtaacagcttcagaagttctgtccacagaccacagtgatgcatcatgcaaagactgattggcaagatgcaagagcaacaagcacaccaacaaaacatgatagatgcttgcttgatcatggcccagattaaatcaagtgatttgtgagaaattaacatctccattgaagtttttcgctccactgattagatctaaaccgatgtagtgcagatcactgcaaacatgtctcaaaggtaccagaatatatctatcgtgctatcagcgcaacgacagtgcaacatagctagagatgattaagtaattacaggtccagagtctccagctctgcaagacttctcgctgcatatatagtagtgtaggatatggtaggtaaggtaaatgtaactaagtttcttcagctgtaagaaccaccatgtactggacaaccgttgaagggcgtaagaacaggcgtgccacttagatggagaacgagagctgagccatgaagaggttgatgacgtcgaggtacagcgagatggcggcgatgacgtactcgttgtaggtgtggcgcttgatcagctgattggtgtcgaagacgatgaaggcggagaacagcacggtggcgaggcagccgtagatcgtcatgccagccctccccagagggaaacagatctgccgggtcacggtgaattgcacaatgagttagacagcacttgagaagaaaagaaaaacggagcaggttgagcagggaagaagaagataacctgaatgatgaggtatgccagaagcaccagaaggctggcggccaggaagggatacatgaaggtgaaatcatggcccctgtgggctgcccagaatgtgaaaatggtgaggccgatgacagcaaccgccgttaggattgctgcttgcagaaccactttacctgttagcattgagcaaagaaatgtgaacttcaattgaggatacacaaatcattctgaaggagtatttgaatcttgtttgcaagtaacaggaagtaacaagaaactctctgaggtgtcaaggaaatcatccatgtaatctagctcagatctaaagaacaagttctgtgttttgggggttgcagtctttgaaatctacaatcactcaaaatgagaagccatgtgttgtgcccagggtttacattaccgtcggtaaccgcgtggttaccggccttaccacgggggtacggtaatagaaaaaccgcggtaacctccttaaatttaaaaaataatttgattttttgataaattttgcacggtttcgtaagatttttcacggttaccgcgcggtaaccgtgcttaccgcccagggcgcggtaacctcggccccggcggtttgggaaaccctggttgtgccataacaaaaatggtgttcaattgccaataaagacagaagatagaaaaggttggcagttcaatctcaatatatgatataaaacatagcgaccaagcactcaacgcagtgaagcccagcggaggtttctgcaagtagatctggaggagccacttgctccatcacaaacacagagtaaaaaaaaaaaacagagatgatgcaaaaggggtcaggggacttaatcttgacaaaggaaacttagcatcctactagtgctaccacaacaaatttgttgactgaatagtagcacactaattagccagaattttcaaggcatggaagcatttaaacagggcagggtatacagaccatcctttaataatatagtatgaatatgaaacatgtgatggctaaatgatacaacagacaagaaagaaaacagtaattgaaaataaattcagcacacaatatgtagttccaacagttacatgcaaaacttatagaggttgtccaaaaaaaaaaaaacaaaattgagaattccgcttaacaaacacttttgtatggtatttttgagggaaaaagcatcttgtatggtgttggcacatcagggtttgttttttatcccaaaaaaagctgaccctaagatcatccccaccaccgccaacactatcattatctaatcaggacctcggtcagtcagtcacagcaaccaaaatatgcaacatagttaagattcctgacacctaacagcaacatagtcatatatcataatctcccaggtaataggaactaggaagtggtccaggtcataatggtcctacccatacaacaatatgcaacactacaaccaatatatactccacatcagaataacctcaaaagtcaaatgtttccttcccaccagaaaacacaacacaaatctgctttgttcaataatgcactaccaactactccctccgtcccaaaataagcgcagccatgagtttccgtgtccaactttaatcgttcgtcttatttgaatttgtttgaaaaaaactaaaaaacataagtcacgcgtaaagtacttttcatgttttatagcctaataacaataaaaattctaatcataaaataatttcaaataagacggacggtcaaaattggacacggaaactcatggttgcgcttattttgggacggaggaagtacatcccctgcaaggctgcaaccatgcaagagagagagcaacaaatttgttgactgaacagtagtacactgattagccagaatctaagaaatggaagtgtataaactggttagtgcatacagaattacagactaacctttaataatacatagtgtgtatgaaaatgtgatggttaagtgatacagcagacaagaaagaaaacagtaattgaaaatgtacttagaattcaacaggtagttgcaagcagttagatgggcagcttgtagaggttgtccagaaaaaccaagatagaaaattcttcttaacaaactgaacactatagatatccaagaatggtgatcttgtaaggtagtattttatatgggaaaaggcatcgtgtatggtgtttccaagcagtgcgtgcgttttataataaagaaagttgaccaccaagatcatccccacccccaccactaaccccacttataaaacatgtgtcaagactataaaaatctaatcagggtctcgatcagaaacaaccacaatataatgcacagccaacattctggagtagtcaacagccaacattcataattaaaattctgacacctgatagcaacaaatatcataatctcccaggtaataggaacagcaagtggtccagatcctgatggtcctacccatacaacagtacgcaacactacaaccaaatacactccacagcaaaacaacctcgaacttttccatctaatcacaaaacacgacatctgatctgttcaataatgcacgagcagctacatccctgcaacaatgctactgagagagaaaaagaaagaactcctgggaatcgccaatcccaccaaaagtccagaaccaaatcacacggagacaatcaattggcccaagaaccagccataaaatttacccatccgaacccaactgcatctcaaatcagtcaatcacccacgtttagagcatcacaattcccccccccccaaaaaaaaaaaaaaacggagacctttttcttcggagaaagaaaaatggagacattttggggaggagagaaatggagagcgcatttggcgtgtataccgaggaaggtcgaggagcagacggcgatggtgaggctctcgcagagcgtgaagaggcccagcagcagcaggttcacggggtgcttctccctgtacttgagcatcggccacagcactgcgcaaaccccaaaaccccaatcagataccaccatggaagaaagaaagagagatcgaggaaccaagcaagggaagggaggaggaggaggaggaggcctcacagaccgatgaaggggcagaggaggatggcgaggtagacgagccacgaggcgagggagcccgccgcgaaaaagcgcgggatggggcggacggcccacgccacgacggcgatcgccgccgtgacggcgaactgcagcgccaggatacagtacacctttccgcacgaacgcccaccgcagccgcgggtcctcctcctccgccgctaccttcctcctcgccggtgccttctccgcaaccacctccttctcccccgcgactcccatctccgggtcgggcttggcggcgtcgccggcggcggcggcctcggccttcgacattccggcgacggctagggttttcgtcgtcgcgggttttggggggaaaacggcggcgagaggtagacgaagcaaaagcaactgcacagcggaagccatggcgcggatatatcgagcaaggcccagtcactgacatgtggggccaatttgtcagtgtaatggagcgtcttcgactgatcggttagagattctctggacacgtgtctaggggtggttggaggattgtggcgagttgggctcacgctcatttttgggcacacggagttggagtacctacacagatttttaatttttaattaaaatctaataaatacagtaaaatataaaagcaattaaaaaaataccataatagacactaaattaccatatctgcaagaaaaagaccatatccaatataaattttaaaacttacatgtgaagattaaaaaattacactgtaacttacaagaaaacacactgtaaatttgagtgagagataagaaaaaatctttcgagtgagatatagcgaaatcgttgggcatatatgctggttggtggctttgtaataataaactcaatataaaattgttactgtgctgtatgtgggttaattttgttgatgaaatacctctaataaatatccttataccctccttctctgaaataaaaaaatcaaccttttaggatatatctgaacaagtgtttatccaaattcaccttagaaattgtgcttgttcaaattcactttacaatcgaaacaagacactgtattattatagaatatatgcctcgtggctaacacgtatcaccaactacttattactccacaagtaaagaggatccgctacaataacttatgtagttattagagcgaatcctcataggaagtaacctgtacgctctcttgtgaaccgctcttacacctatttccaatgcatcttaagttacgattagcatgacaaattttagctcaaaattcatcttatatttcacatgcttagccaacattttagcctggaattcattcatcaagaattttagacctacaacgcctctattgtttggggaaaggtaataatttgttcaagataccaataagtagtactagtaccagggaattttacaatgtgagatcaattactactggtttatatttaagtgatgacatttctctattttttttaaaaaaaattatacacgagaatcatgatttgttggggtgtttttggaaaagctagggtcaaccgatcccatagattaagcatgaatccgccactgactaatgctacttatatatactatacttaggccctctttgtttaggtttataggtttgttggattaaacttttaagtcagcttattggcttatatgatttatgccggtggatttattgtcctaagtcaaataagtcaaaaaagcttctccaacctagcttttggcttaaaagtgttagattgtcttatggcttcaaaaaagccaaatgaaaaaagccacttgtttgtttaggcttagacttttcggattataagttggcttataaatctaaacaaagagggccttaatagaggaagtatgtgcaggtgtaagaaataaaacaatagcaaattgtgtagatatttagggtgtgttttgaaaggaggtgaaaaagagaatattatgaagatatgcaagataaggtgtaaccattagcggatgattaattgatattaagcattctaaacttgtaaatggatcggtataattatttttaaattaacatttctatgaaaaacgtacgcataaaaaatgagctatatttatcctttgtgcttcaaacggacgcatcctcactcctcagtactaacaactttgttttgtgtcatccttgttgtatgccacattgccatgacctcaccatgcaagaccaaagtgtagtatttatgctttttcctcatttgctcaaagtttttccatctgcccacctccaatcacctcttcttcaacatcttcccctagtcttgagctacatggttcctgatttacgcggcgaacccaactaacctctcgctctcaccgctgactcatatccaatgatcattcaacaaccaaaaaaaaaaactctgagatcacacacaaacttgaaaggaactggtacaagaaaacaagaaggaaaatgaattaaattttccataaccctaaatctaggtaggcagagggtggtttaacttgttcaaaaattttgccgtgcacattgctgtgtaacatttcacggaatttcccctgccgtgtcatgtcactccccccaaatttgggtgcaacaattttgcaaccttttcttcctctccggtgtaactgcgtgcaatctcgttcaactcgttttcccatttttatggtataaatatacatgcaggtgttgtaactagcttttgttcacttttttgttttgaccaggaaagctagcttggccacttcacacggcagcatcctctgcctttgcagatcacgtcttgccactttggtactccggtgcaggttcacagttccgacgaaaaccggtcgaatttcgtgaaatttcgatgtttcaacatggctcgaaattaagttttgatcaaaatttcgaaggttaaacagtaaattcagttaaaatttatcaaaaatcataatactaatagggctcgaaatttagtagaggtaatgtaaaccctttttccgcgacggcgatgtcactggcgatggtggactccttcgccgcagccaccgtgcaagccagccacgtacgtcccgatgctgggccacgtggcaagggcttttcgtgagggagttcagagaagaaaacaaaagcccatgaagctctttttatactcccctccgttttacaatgtaagtcattatagcatttcttaatgttaatgaatctagacatatatatctatttagattcattaacatcaatataaatgtgggaaattttagaatgacttacattgtgaaacggaggaagtatgttcttttaaaacaggatacaattttgaactaaattcatctcacctctacatgttgcaagtttggactaatttcatctcacgaagaaccaaccaaacattgacacaaaagaatcaatcgaacacatactgatactgaaaagagagcggataaattaaggagaaggaattggaattcaacttctcaattaacgaaccagatggttctcaaaaaaaaaaacaattaacgaaccagatgatgatcacacacactcgtggcaaggagaagtatgcggaggtcggcgacgtcgtgatcagaggcatctctacactgcacagacgatagaaataatatgggactgcctattcatttgtcgggccggccagcccattcatgttcgtctgttacaagaaacagcccatagattggcccatttgaccgtgcaaaaataaggacagttttcagaggcctctctccatttctatgatgtaggcttgccttgccactgcagctttaaacttctggcaaattgtccaaccaaatattcaaaactgaaagtcgagaaagttaatcttcgatgtttcagacggggagacatatgccctttattttacagaaaatttaacgatctgccactccctagatcgtcccttgccaccccatgagaaataacaccaaagatcatttcagttagtgagacgtgagtcaggataacaaattatcatcacgtcttttttgtttaccagaaacttcagtctcctctcagtaccatcagagatttgactgccaaaattcactgtgcattcacattctactctttccgttccaaaataaattaacatttagagtttaaattttgtcctccaaactatactaccttttctatctattattggtttgcagatcgataaattttatgccttcaatacccccacctactcattcatgaatacaactttcctacttaagggtattttatttattttcttatatactcattgtgatgttatgatttgatttttattaggatggatggagcatgtttataggaaacataaatttagctagataacaaagtttttttcttacagatgcgccattgactaattaactagcaccaataatttagatatataggatcgaattggcgttcaccgcgtccgtagtttatatgtaaggattggcgacagataccagctgatggcacgtgatgatcgattgatctccatacatgcaagcagccattgaacttatttttctttgaatcctggcattatttatcactcgcatgttcaggaattgagctaatctattgaaccactccgtatcgagccctactctatttacatgttcagtagcgcatctaattcggttaaacgatggtggtgactgaactgatcaaataaaattcaattagttagcagttgagatcgaactactaattaaccgaatttttcggttttgatcttttcagtctatttaaccgttcttttctcattaagatacaaactttacctcagttttcgttagcaagtttttcaaactactaaacggtgcgtttgtacgaaaactttttatatagaagttagttttagcgtttgtacgaaaactttttatatagaagttagtttaaaatataaaatatatccatttaatcaagtgctaatagctttctcgtttacgtgcgcaaaaaatctttcatcttcatcagtttcatcatgtgccgaaaaatatgtcttgatcttttagtttcagcccattttgcctgttaaatatgttatctgaattttggcccataatatattcggattagttttttaataggactctgcattataggattaattgcctattaggacggctagatttctccgatatatatttcttgtaagctgcacgaaaaaggtgcgacaacccaatatatccccagcggtatccatctgtatctctttgtctcgtgtgtctgtgagaaagttagtagtggcacacagtatctctcacaagtatcaatatgcacagtatctcacaagtatcaatatgcatgtgtgtgcctccttttcacaaggacggtacggctgcagggcaagtaccctgtacccttgaacctcacatgacaaacaacaaaaagatatactgtactcctttacttgtagtagtatggagaagaaaatgtagaatacaaatatatttcctccgtttcacaatgtaagtcattctagcattgcccacattcatatagatgttaatgaatctagacacacatatatatctagatttattaacattaatatgaatgtggaaaatgtcatttctaaaatgacttacattgtgaaactgaggaagtacactggtacttcagaaatgacaaaactattttgatattttttttccaaagatgctgctagccaaacaaccccctcgatcttgttggagtctgtggggttgggttgctgacctatgctatgccatgggcgaacactatttttcaacccctctaatcctctccttatgatattactcctatctgaatagtgaatgatctttcattcagaaagacaggagtaccatgatgatgatcagatgcatgccatcttatactactactagtattgcagtaacatggagcagctgatcatcggacagctcctgcctcctgttttggcagtgaccattttggaatcagtgtgagacatagccagtctaccaggttgaaatgggatgttgtaaagctagctggtagtatatctgttcaaggatgttgaagttttcgacactgcatgcagttcagcagtttcaggttagagcaagtataatagtaggctataagccggctaaatgctgatgtggagaagagaagagaggagagagaggataaacgggctgtaaacttacagccggctcagacacaataaccaaaaaactctatgagagaggcaagtgggccatatattaattgtaaagagctaactattatatggtaggctgagagaatgctacaaagaaccttatagctaacaggtcggctgtattattaaccttgctattagggaggagtattgcaggggtacagttgacaggttgttattatgtgcatcctgcagcatcattccatccctacttacagttgatagcgagtgttcgcattaattcagatggtagaatatgtgcagaattccaaatataatatctagcggctatcttataatcttgtacacatgactattcagcaacctctagaaaatagcttagttttgtattcaagtgccttctatgaaattctctatcgtctatatataataacaaatatgttactgttacttaactctttttctgtgttctagcaaccaattaaagcgtcatgcaagagtcttcgatagtattgtaacaaatgtgttgaattttcgtgcggttacttaaacaattctatgtgttatagcaaccaactagagtgtcgcccaagagccaattttcgacaatttatttggtgtgcgtgtatgcgtacatagcctattatattatgctaccagtagagagtatcgtagcgagactatactatatatgcactgctcacatataattgatgaatctcacaggagatatcctaaagttgtacacctatagcactttcacattcgaagcaaccacacatgagtgcacggtttttatggatagcgtgttgtgtttgcatcggccgatcatacatatgcacgcatgcatgaaatgggaggagaaatcgatctgcacgccttgtctcttctttgctcaagaatttagagtttttttttttgatcagtacacccatctcctgtttcagtttactcgtctacaggggtgtgtatagtgtgtgacactgtggatatatagctagctatagctatagctgccacaacaagcctcttgcatataaaatctctgagattatttatatctgtgcaaacatggatggaacagaaaggccaaaaagatatagccattggagcagctaggcacagatcagagagactcatgggatggcaacatgataagtaatagggcgacgctccgatgctttttacttgtagtatatactacaagtataattaatctgaaccgtttatttttaagggtagattagtaaagttggagtaaattagtttggggtagatttggcacttatttcttcaggtgggtcccatagtcaagcctgctccttctcttcgcaattaggccgtggcgttctgggccggacggacgtgttgatgaggggcgcacacatgtacgtgactacacgtccggtaaaaaaaataaaaaaaatgtgtcgaattaaaaaaaataaaaagaacgtgtctgtggcgtaggataaggtaggctacaacgacaagaaaactggtttaaagtttttaaactcaatgaaactcggtttcaatttgagacgaaatttatactataacagaactactatatattttaggacacatcgtattttatatccggaattcatctgggaatgtccgaaccaagttggaaaaaaacacatggttttttttgtcatatacacatagaataaaggagaaatattattttaaaacaaaattggttatgtccggaatccgtccagtctgtctggatcgggtcgattaaaaaacacgtggttttccgtccagtctgtcttgtagacaaagaacaaatgagaaatgctattttaggacaaatttggttacaacatgcgaaatccatccggtctatccggactgggtcaattaaaaaacacgtggtttttcgctcgtgcgcatatagaataaaggagaaatattattttaggataaaattggttacgctcggaatctgtctggtatgtccggaccggatcgattaaaaattaagtgttttttagttttgcgcacataaaacaaaggagaaatactattttaggaattggtcacaatgctcggaatccgtccgcttctgtccggaccctcgagtcgattaaaaaacatgtggtttttgcttgtgtgtatatagaataaaggagaaatattattttaggacaaaattagttacgctcggaatcggtccgatctgtccgaaccgggtcgattaataaaactcgtggtttttacgtattgtaaacatagaacaaaggggaaatactattttagcacaataatggttacaactcttggaattcgtccagtttgtccggatccacgggttgaccaaaaacacgtggtttcttgcttgtgcgcagaaatattattttatgacaaaactggttacaccagaatccgtccagcctatccggaccgggtggattaaaaaaatactccctctgtttcaggttacaagacgttttgactttggtcaaagttaaattgttttaagtttaactaagtttatagataaatataataataataattttttttagataatggaataaacatcccagcctttgctaaagagagctacagatatttgtaatactaaattatttatattttcataataattttgtcttgggttaaaaatgttgctactttttctatgaatataaagttggtccaacttaaaacagtttgacttcaaccacaacttataacctgaaacggaaggagtacatggtttttgttttttggaccaaccatattattcctgtcagaatctatccgtatgtcaaccgggactttccgtttttcatctatgttgttttctctattttctcttttttttccgtacgtacgagatccattttcttttttcgttcgtacgagatccattttctccgtttccactgcagtttctttcccctattaccccgtttccacccattatcgatccgtccgtttccatctattatcccgtcaatttatcctgttttaacgtgatttgttttctccgtttgcacttgctgtttctttcccgtactatcccgtttacaattggtgcggtttatatttttaatcgtatcgagttctttaccgctatggaattaatgttattaattccagtgaattcccaatctgaacatataccatgcggcggagcaggcgaggtcgtccgaggcggcgatgacggcggaggaaggagctgcgaggttctcttcgcctcggcttaggttagggatggcgttggctctggaacgagacaggagaaagtgcagctaaggttaaagaataaaaaggacgaaaatacccatccgtaaatattttttcctggacaaatatacccctctacgattctactaccgttaaatgtagttggagtagaaatagatttgaaccctccgatcaaataagatcaacggttcagattattttctactacgagtagaaagcaccggagtggggctctaagtaatatagtcagctgctttcatcatgtttgtcttgaaatgtgtaatttggatacgacccatcataagagtcctctgaaacatagttttttttaattagattttaattatgtttttgaatttgttatgtaatctcctgctatccaaaaaaagtccttagttttatagccaaaaggtgttagccatattgtggttactcttgcagtttgtgtgctctataacttcaattttaacttcatcattttctgttagcacgcttttcaaactgttaacagaaaattcaaataaattcatttttttgattttataataattaatacgtaattaaattattttttaatacgtaattcttcatccttttataaatggtttctatgtagaagccatttaaaaaattcaaataaattcattttttttgattttataataattaatacgtaattaaattatttgctaataagctttctcgttttacgtgcgttgaaaacctctctcaagtaagaaatcgaacgggcctgagacatcagaatttcataggatatggattggccgcagaaatctaagtcataaaacttatttttcgatgggaggggagcgatggtttgtttgttggagtctattttttagctttgtcttttaaatatctagtagtagtagtataaaggttttactccctccattccaaaatataacgctcaaccacccttaacccaaatatcaacaaataattattatcacctcataattttgatcacccaaataaatataatgcatacacaatagaattaacgatcttaagtatggaggatttaaaaaataaatttagtgggaaaaaagttctagttaataatatacattcatgcataccttatattatgaaacattaaaaaatagtgtacggagagagtacatgttaattattttgtataactttgcttatttttcatgtctcgttagcggtagctcaatcaatcagagtcattactgtgtgattttataaaattaatccggtgaataacaaggatgcaaggaagcaggtgttgaacattatatttggtcggtgagtgagagtagtgaaagaagatagaaaagtaagaaaaggaagagaggaataaagtgtagagatgtggcttggactggggaggagtactcttgcagggttacaggggccagctttgaacccgggtcccggtcctggccatgcatagacgtcaaatcctggagaagactatggagttcattccaagccaaaatttttaatcatgagcaaacagacaagcttttgtattttccttgcttggttgtttctccatttaccagtcaaacagcgcggggtaacaattgtaaccaaaccattgatattattgccctctctatcatatataatatagaatattcgtaccaaaatataagaaatactggtcatatatttggaccaagaactagacaagtacaataaagtagaatgtacatggtactgtatttgaccaaactatgcattggattggcggatccaccgcccagcgaccctattgtcgtctgagctcgttagaaagatactccatccgtccctaaatataaagaattttagttagatataacgtatcctagtactaagatacattacatccaaccaaaatcccttatatttagggatggaaagagtatacaatagaatttgaatgttttcggaagatttggagacaattttcattgcaaatactccctccgtcctataatataagggattttgactttttacttacaatgtttgaccattcgtcttatttaaaaaaatttggaattattatttattttatttgtgacttactttattatccaaagtactttgcacaacttttcgttttttatatttgtacaaattttttaaataagatgagtgggcaaaacagtgttaaaaaagtcaaaatcccttatattatgggacggagggagcataacaagatttgctcagactctgaaagactgaggctgtgtttagatgcaaagtttaaatccaaacttcagtccttttccatcacattaacttgtcatacacacacaactttttaatcacattatctccaatttcaaccaaaatccaaactttagatccaactaaacatagcctgaaactctgttggattcgccgctaatgcaagctgaacttcatatgaccatgcatcgatctatgcatagaaaatgaaaaaaagaaagtccatgcatatactttctccacaactaaatataaatttttttattagatgtgacacattctaatataatgaatctgaatatgagagagttctatgcatgatcgatgctgaagtacgggtagtaggcactgtactcctagtatcatggggttatgtagcctgaagtttcaggataacatcgtcctgacattttagtactccgtgcatccatgtgatgatgtgatctatcagagtgagtgacctcaccagacttctaacagctgagaattgctttcacgttgtcagtccaaatagacttgtaactactccctcggtcctatctttacttacactgtttgaccactcgtcttatccaaaatattttagaattattatttattttttacttactttattatttaaaagtactttaagcacaacttctcattttttatatttgcacaaattttttaaataagacgagtggtcaaacagtacaaacaaaaacttaaaatcccttatattatgggacggaggaagtagatagtataatattctacttcctccttttttatattaattataagtcttttttattatttttttaattaaacctttttgagttcgacaaagttataagaaatatagtagttttttcgaaacaaaacaaacataatattaaaatatattgaatgctagatttaataaaactaatttggtattttagctctatgatgagctcctgcaacatgttaatgtaatactctctccgttccataaaaaaacaaacccacgataggatgtgacacatcctaacattacgaatctagacatcctataataatctactaaaactaatttggtgttttagctaaaatcttttttactagaaaaaaatcaaagtgatttataatatgatgaaatggagggagtatactgtaaatttagctaggttggtttatttattagtaaaatctcagtgtatatatattttgtaatacttgttattcgtcgaactattctgtttttttaagtacaactgtcaatttaggacggcttatgctgtgtttagttcacattgaagtttggaagtttggttgaaattggtacgatgtgatagaaaagttgtgtgtgtgtaaaaaaggtttaatgtgatggaaagttgaaagtttggaaaaaaaaactttagaactaaacatggccttatatgctttaagattcgtgctgaacccctagttaattattctctcttcaattctcacccacttttagacggctaggaaactcttgcctagtccaatatcatgagaaaatcgcgtgatgtaagagcacaagacagataattgtccatcttaatttgcaattacaatgacacagtataacccctacaacctgaagaatgcaaagtgaaaaattacctaagcaaaagaactagtcgaaaaagggaaatcagataaatcaaaaagaagaacatacacggtaaaatccagatcttaaatttcacatttacagacattaccggcatcatcaactcgatcagtacaccatcttaagattaagatcgacctagttgattaattaactagtttataatcaccacaaaataaccttttaacttaaattactttctcctccccctcttttacacactactacacccctttcaaaactatgctactgatcgatcgatccacgcagccatggctggcgccgccgccgccgccgcgctacgtggttcgccggcggcgagacggcggcggtcacggcatgaagagcttatcgccgcacttgcagcgccacacctccgggtagtactcccactgggcgccgacgcccggctggatcgccacgtgcaccggccggcacggcgcgcaccgcccgcaccgcgcccggcacgtcggcggcgacgacccgggcccgatcagccgccgccgccggacgtcgccgttgtcgccgccgccggccgccgcgttggtcctcctcgctagcatcagcgacgacgacgagtctagtctcctcacgtgcgccgctgctgctgctggtctccgtagtacacggattggcctccttgcagcagcggcaactgtagcatgcatacatgtatatatggttaattgttagtataaactttactgaaagcatatataactatattgatatatttttttaatgttcttttttacaatgaacagtggatcatcgatgaatccgtacgtagaaaaccaacctatgaatttttttttgctcgatcagtttgtactatttaatctataaaaaatataaccatatataaaatagttatattttttaaatagtacctactaatataatacacgacctactaatataatgcaagtacgttcttttcaactacttcaccaccagattattacctcgaattattagctccacgcctaaaaatacgactctttttacggcatgaatgatatccggtcatatcacttatctcaactagcaaagctctagactttgtgttttagtatttttataggatgtataaatgtatcgatgtatatatatatgttatttccagatttaataaataataaatacttcagaattaatacaacaagagacatctgcctctcaatacagcaaaaagaacccttgaaaaatctcctaattacatactctacattaatcattcgtggtgaccattgctaattagaatgggtagttagctagctaggatctcaaggagattggagcatatggtcggcgtcctaaacgttaagcaggtgagaccaaaaatgtatttgtggctagctagctgattaattgggctgtggattgtacgtgtattggccttgcatgggctgttctcttgcagaatctttcttcttctctccctgtactaaagctgatgtcgtgtattatattagtaggtcgatcgtgttatatattattttctggaccagagcgtgcagtgccatcgtgtgggcaccagcacactacactgctgggagaaaaaggctctagttggtgaagaccaaatgagaatatgagactatgagagagagagagagagagagagagagagagagagagagagagagagagagagagagagagagagagagagagtgtgtgtgtgtgttaagaagcaaattaatataggtttgcatcttgaaaatgtgtggagatatgattgagtgtacagcttaatgagaaagttaagagatcctgaccttggtggctttctttcactagctagctaggatgttgcaagtgtgaggaaactaaagatcaatggcatgcaacaaggaaattgaaattgttaattatattgcaatttaattagcttttgggctaattacactttagtctctgaggaggtgccttatattagtgtatttgctaggtgatgggacgaaaagtaattagcagagagaagggtgtagaatgtatatatggaccttaatttgcaagcatgcaagaactacaccaaaacttttcatcaagagagaagggaagcaaataaaaatgttaccatttgagagataagcctctcgatatttgtattcggtacatgaagagagtagagacggcatgctaatcaaccacaagaatttctaagaaaaaaaactaaccactagagaagaacacttaatttaattaaggttcagtttttaagattgtttaaggtagtttccttgagagagaagacctggccagagatagctaccactctaatgttatatgtaaagtagtaaaacattgtagctagattaattaatcaacctgcatgcagttaacaagcttctgatgaacctaatcaaagatccggttaatttggtcttcagacaaaaagaaaagcaccaaaaaggtgaaggaaaaagagagagctagagcaagtaatcactgattatatgcagaagatcaaaagactagacgctcagattaaaaagtgcacgcatgaaaagaagagctggcaagagagctagctcgcctctgccatctctgcactcaccagctgccgcggcgaagacgacgacgacggcgagggcgagggcggcggcgcgtcgccgccaactccctctccggcagcagctcacggcgcccaccaccaccatctcgccggcggacaagagaggaagactggccagctagcagctagcagcagccaagcacacgccggagaagtctagctacgctagagagcttgagcagacagcaatggcgagctctcctcactccaggagctagaggaagcaaggaggcagctgcagccggccagggggctcgatctggtctctgatttgcaggtcggagcacacacgcacaggcgcccgctcgtgcgtgccagcagacagtccgtcgtcagtcacaggctcacaggcacacacgcttttgaaagagagagatagagagagaggatgtgattgctgggagtagtagtagtctagtagtagtgtgactgtgtgagagtgagtctggctgctatgctgcagctgcagctggctgcagtgtgtgggagtgagtgagtgagtgaatgaggtagctacaaataggtggaagcaatggtgtgatggtgtcccaattgactatacccaatgtatagcaagcacctgttgtaattttgtttctgtctttttttcttttcaatgtaggagtagttataatgtgtagataaaacatatatgaaaagaataaataattaattaatttttttaataagacgaatggtcaaatacgtactaaaaaagtcaacggtgtcaaacattttgagacggagggagtaatgtggccttgtggttttattggttgcctgcatgactgtgttcatggctgtatatattgaccaagagggcaaagggacgaggaaaacattaatgaagatatgtccccgttaaaagaatttcaaaatacaccttataggatgaacagagtggagtaagtactagtgatggttgttcttctcatacatcccatagtagcagggtctgcatggttggccattgttatatggtcgagaattttccgtgtttgtctatattacaaatcatatatattcaactacgaagattttctctagtgttgagctttatatgtttcacaacttacatattagcagcagatcgaatttagtttacggtaaaaatacattgatatatatatatatatatatatatatatatatatatatatatatatatatatatatatatatatatatagcacactgtagtctttgcgaaacttaaagcattgtcaattgacccaatgggttatatgggtttatagaaatataatataggggagtttctataaagctacatgaattacactattacaaaataggctcagtgaatggctggtgcgtgatgttggatttgatctaacggctttaaaaaagcttacgatagtaaggtaacctttttcgaaaagaaaaaaaaaagggcctgacagtgtttggcaacatgtggcaacaaaccaattagttgacaaaatactttttaatgtaaacataaataggtaaaattgttctaggtgagactcttcaccaaacttactttgaaacgaccagtgagtgctacctatccctgccctaaaacctagagtttggaagctatatatgtactcctatatacttggttccaacatgatcgaccaaatcgatgtacgtttcatcaaccaaaaattaacttgctatcgagactgatcctacctatcaatcgatcgcagatatcaaacattgtatcctatcttattataaagttataaaccactaactccttaaacttaacatgcaaaaatgccacatcatcatccactaacaatcatcacatttaaacatcatgcaaacatgctatattatctataattttatagtttttgtaatttaagagctttttaaatgcaagcatgttaaattatcatcccacataatttacataatatttcaatgtatatctttattatgttttatgatatcctatatacttatatagttcatcatcacttacttagtgcttaaatgattaatttatggttcaaattaactttctcttttttctctaattaagccataccaccttaattgtttttgtctttagatgattaatatacggttcaaactatctccctacttttcttctttaataaagtcataccactttacttttttatatttaaatcatcattctacatgctatttaaatttaaattatcatgaaccacattaacttatttaatctgatgttatcatcttacacgtattttttttattgttatcatactaaattttcgtagcaatgcgcgggatttcagctagttatattaacgatcgatcacatcgatctctcagtactattgccgtcgccggctgatttaattaattgctttttgcccggatttgcatgcatgttaactcttcaacaaaccctacttgcagtagtatcatcacttggagtagttcaataatggaaacgaccagtcgatggattgagcttgagtagctagctaggtatctagcttgctagggttttatggttcatgcaaatgtcgagtagctgagaggtcgcttttgagcatagcttcatacgtgtatccagttcaaacccaggattaatttattttggacgcaagtacgtaagaagtagcccactaagagcaaccacaatgtgggaataaagcaggtaataaacaatcaatgctggagtagtttcttacctggtaagccaatacaactttaacaacatgggtgacggtagggaaggaacgacggcgaactcactggagaagaaatctaaggctgtgtacggacgcccccttttccaacttctctctcgttttccgcgcgcacgcttttcaaactgctaaacggtgtgcttttttcaaaaaagtttctatacgaaagttgttttaaaaaaatcaaattaatccatattttttaaaaaaattagcaaatacttaattaatcacacgctaatggactgctccgttttccatgatcactgttcctgatgggaacttcttctagctaacacagcctaacatgcatgacacgaatcttggagcaaaatcgaaggtaatagcatgttttttctccccttaatagttgaatggctgaatgatcgaatgattttgtgataactatttgaggatatagacgaatgagtttactattataaagttgaaattttgatttaatgcagttttctaagaaattgatatatacaaagtttttgtaaaaatcatactgtttacaagtatggatagtgtgcatttcttagaaaagaacacaaagaaattgagttcaaatgcagattgatttttaagttgagaacgcacaaatttcatccaagtggtgtcaattagctagtagagctgtagaggttaatttattctcatcttcttaattagttagtactgtacatgcaagcgtacattgtttcagctggaaaacaacatctctctctccccgggaacatgcatggaaaacaacatctctctcccccatcgtcgtcgttttgctacctcgatcaaatgatgacgcgtgcagagacaattccatgaaaagcatacgcatttggatccatctatgcatgttgtgtcgtagaatatattatggtttttactccctactccctcaaatattttatattttgggacagagatatagctaccagggtttgaaatttcggtaatttcgcccccactggcatgctcacatctcgcccgaaatttttcctttttttatattttttgaatttagtcaaattttattcaaattcattcaaaatcagtcaaaatttcaaataatttctgccaaaaatttccgaaattaccgaaattttggccccctagcaaataatccaatttcaaaattaaaaaccctggtagctactacatgtatagtgtttgcatcatacaagattcccgtgcttttttgttaatattttgtttctataattcttcttaatcgataatttgatatctcgccttaatttgagcattttgcgcggctttttcataattagtacgccatcttaattagatccttgaataatttagcacaccgtatcgcatggctaaatcctcttttaatttttggtcatgtaattaataacaaactaaaccaactaatgatttatatttttacaacgtcttaataataatcgcatcacaaaatccacatggtaattaccactagcttgttcgattaaaatccaaaaatgtatctggcgcataaaccaattgtgcaagggggaattgattttgccaacaccaaactctgaactcatgcattaattgcaagaggtgtgtaaatctgagtgtaatattatccaaggaattagaccatgcgttcttatccttattggaaggacatactgacggtgctatatgatcccttaaactatactgcatggaccatatgagatttaatttttaatacacttatgaatgaatgcatgcatgcaatcctatcatttcttctacatcatgcatgcatgcatgcatgcagtgttctttgctgtacatacacttgtacaagtacacgtctagtcatctctactactaactcaattgaaaagattatcatttcttctcctcacacctgctcctcccctcctctagaatggcatttctcctgcctctcttcctccagacacatgggggccatacatctcactgattgtgcccatggtctaaggtgagagaagatgatcatgcacaaagaggagctatagctaggaagaaaggaatcttacaaatgaaaaattcttggtcatcaaaatcagctacactacacctttctttactggaggaccctaccacatgggtgtagtcctcctgagttttgttaacttgtgtctacagtgaatttcaggggtagggcccatgcatatactatatggaacatggtcatggtggttggccaacacattgccctagctagtgttaggaattatactggccatagcttttgtgtagcttcactgttcatgtcagaaagccaattcagagtcaggctaataatacacccaactgctgattgtatagatctttatagtatatctctcagctcactcatatagtggttagttcttcactataaatatatggtccacctgtctgtcttatatattttcttagttcctgtgtctaagccggctgtaagcttacaacctacttctcatctctctcctctcatatcttatccacctcatcatttactcgtttagtcttcttatagcttgctattattcttgctctaattaagctatcctttatttgcacattgccattctatagctgcagatagatagatgcagctttatatttagggtgttagctcaagggtccatgtaagatgagcacctcatttttgacaggccagatcaatgaacagctagcatcatattaacctgtactatataatgtagcaggtattggatcaatttaatttttggattatatactatttatttaattaattaaacagtagtttttactgtggccgcagcatgcatgaagcaattgggggcgaagggcgcctttgaccgtgtaataactagagcaagattttgttcatgtggtgtgaatctgtacgtgggccatgcatgacctgtacgcgaacattatatgcaggacacgtttctgaaaatcattcagtgctacatggattacgtgatcgatcgagctgcataaatatcctattgctgcaaattgcaaaaaatgaagtacaaataaattcgtcttatattgcaatgtacagacagtacagtaaccaacacgacaggaaatatatgtagtacatgtcatgcatctagtcggcattttgtgcagatatgttcgtactactgcctccgtttcaggttatataacgttttgattttggtcaaagtcaaattgctttataactaagtttgtagaaaaaataataatgcttttaacccaaaataaacttattatgaaaatatattcaattatttatttaattaaattaatttggtattataagtattattatatttatttataaacttagtcatacttgaagtggcttgactttgaccaaagtcaaaacgtctttataacctgaaacggaggaagtaccaaactagctacctagaagattggtactccctccgtcccataatataagagattttgactttttgtttgcactgtttgatcactcgttttattaaaaaaaattgtgtaaatattaaaaacgaagtgcttaaaatactttgaataataaagtaagtcacaaataaaataaataaaaatttcaaacaaattttaataaaacaaatggtcaaacagtacaagtaaaaagtcaaaatcccttatattatgggacggagggagtagctaggtagagctagcaatgctacgtgtgtgtgtgtgtgtgtgtatatatatatatatatatatatatatatatatatatatatatatatatatatatatatatatatatatatatatatgctaccatcaaacatcgtacatgatgcattgctgttagataattaagtagctagtgaaagcatctatgggaaaaggacgacatggatgggtctagcatcttaattagagcatctccaacaggggagcgtatcttatacacacaggccctcgcgtgtacacatcgtgtacaccaactaaaaattatcataaaaaattctaggaaaattcatacatgtactttcaatagtattacatctacgtgcaaagtcgcatcttcaaattcattctacatagagaataacaaaaaagataaaattctgacaaaattgcaaccttaaaattgtcagattttttgttttttttgttacggctaaaatataatgaatttgacgttaagattttaactctaggtgtaatacaattaaaagtatgtgtatgattttttctagattttttggtgacattttttagttggtgtgcacgtgtgtacacgtgagggcctgtgtgcataggatatgttgccctccaacagtctcttcaaatatatatttagctaactctccatttaatttagcaagtcaaattcattgttttctctaacagcctctccattcatcctctctattctgagtctatgacagcgggacccatatgtcagcctctataccactttctttctcattatcctgctccctctcttccccaatcccctttttgcttgcggcagtgtggccgcacgcggcgacggcggggtagcagtcttcgggcgcagcgacggttgccgtgcgcagcgacgacggggcggcggcggctagcgatggtggcggcagcggctcgcgacgacgaccacgcgagacaggcgtgttttctttccccttctcgagctttcttcttccttcccctctctccaatcctctccctcgtcgaggccggtggtggacggagtgatgaggcgaggctggtggcagatcgagatgtggatagcatcagcgctccttggctcgggggatgacggccgcggaggaaggagggggaagacggcggcgctcctcccggtgtaaggagacgacgatgacgctcctcccataggcgacgatggcaacatggagagacggcacaacgatgccgttgacggagaggcggcgccgcggtgaccctgacgacaaaaatgtggcgtggcagtggagctagagggagaggagagaagcacgagtagaggagagctggagagatagctagactaggaggctggccaatattggccagtgggtgggcttggatggagaggcagttggcttggagagttgaatggagagtctgttggaggagtgtatttggttcatttgccaaatttttagcttggagagttgagtagatagtgttggaatataaagtggattgcccaccttagttaagcttttgggttgaactggtcggtgcatgcaactcaatagagaggctgttggagatgctcttatgtgcatgttcatgtgggtagccaggggtataagcatgagtacatacacaaagtaaatttggagaaatttttggaggaaaatagatgagggaaggagctaaccgcgttggtgatgacccccccttcccccccccccccccaaaaaaaaaagaaaacatcctcatagctctgtcgctactgccatgaggagaaggaattggggctgtgtttagttcacacaaaaattagaagtttagttgaaattggaacgatgtgacggagaagttataagtttgtgtttgtaggaaagttttgatgtgataaaaaagttggaagtttgaagaattattttggaactaaacacggcctgggtgtaggaatcttcaagcaattaatcactttcgatttagccctatttagtggggtatgcatgtgttctagagtatgtagtgaatcccatgcagtagccatatacgatcgaatgccttggctcgagccaacatgacgcgcatgcatgcatgctacaacatcattattttggtggtgttgccgtgtatttacaatatgttttgaccgtgtacgtccgtttcgtgaatacggagaccggatttggaaaaataatttacaatgtgttttacgtgatcaagctctaaagtgaacaaagcgttgtgggcacagtatttttaagggtttgttggaatcatgccaccctatatttgtaaaatttaagatatgccacccgtatctcaatgatatgtaggacccacataagtcaatgatacgtggatcaggtggcatatcacaaattttgtaaaatttatgtggcatggttcaaattgtccttatttttaatgccaaaggggaatgattttcctgcccacaaaaagaagtaggagcaattaactttgaatcgttatcatttttttgttttttttttctgcctcctcatttcatctttaacctgttgatcattcatactactcctacgtactccccccgttttacaaacacaaacatgtatctaacaccaaatataacggatgtaacacatatagcgacagtggaggagtcgtcgcaatgagtgcgcgcgcggtacggccggtgcagtcgcagtgccagtcgctgcctccctgctgctacccgctcgtgcgtgcaggtgccttctctctctctctcactcactcggacactatagctacctgtcttttgtggccgagtggacttgtttagatgggattaaaacttttaaatccctatcacatcggatatgtttagatattaataataaatattaaatatagactattaataaaacctatctataatcttggactaattcgcgttacgaatctattgagcctaattaatccataattagcctaagtgatgctacagtaaacattatctaattatagattaattaggcttaaaaaatttgtctcacaaattagctttcatttatctaattagttttataagtagtctatatttaatactctaaattagtgtctaaatacagagactaaagttaagtccctggatccaaacaccacctgatcgatcgagagcagctgagctgagctagcccaaacgcagccggccaggtgtacttaattcgtggggttgtacacacgcatatcgaagggatcgatggcaatgcgactccatgggctggctatatcgtggccggcgatgtgtttaggagtgtagggtgtgtttgctcttgcttgctcgtagttcatttctctaatccaggtcgagtttgatccaacaaaggatatatacatgtagttgtttgtatagaagatgatggatgtatagaaaactttgtttggctggtggtatgtatgaactctaagggcgttttcattcgctagagattgagagaagatttatgttgtttttcgtgcgcacgaatttcaaactcctaaaaatgtattgtttgcaaaaaaaaatctatagaaaagttacttttagaaaaatcatattaatctaatattcaggtttaaaataattagtactacctccgtttcgtattataagttagaacgttgcatcggctaattaagattggtaaagcagtatcggctggagtacatcagttgcaagctagattacggaggtagctgacggaagatggacaatggtcagaagtcgatttctagtcagacttggttggggaaagtttgtcatattgtgtcaaggagaggctgagttcgaggagaatatggcaaggtgatttatctattaattaggtggagtcagttatttttctttttttgtatagttcgactgtgcttgtaatttttgctttatccttaagggaagtttgagttgtgttggtaaggatttttctcgatgagttcttgtctttgagttgggctgcatcaattaagttcgatctctgacaagagatgagttccgtctgtagttgcttgtatcggcagggctagggtttccatcggttaagttcgacactctaaaccagtcgatacaagtgctaatttatcatatacgctatttaatctaagttaaatagtgttatttatccttatcggttgattcgcgttgaataagccgatatcgtttagattgctctttgttagattgtttagtgtatctatcacctaaaaaacaatctgttgacagaaaacacgaggcctgggagatttgcttaactccagtgcaggtccaaaacttgccttcggatgtatgagcgtgccagttgatttgatcctgcaatcaacaagaaataaagacaaaagaaccgtagttaaacctataaatgatagctgatcggttaggtaccgatgacatatcatttatatctgagccaatgtcatctgtgcattgatcgacaatcgtgaataaataaggaagaaaactaaacctacttgatcagctgtagatgttagcgatatatactccttatatcgatatatacttaaatcaagtgactgggatagatcggtcgccatgccgagacagtatgaatcacttagaccgaaatatatattaataacaagactatataagcttacagcatagccgatcatatagatctagcatgtatcagcaaataccccgatactaccttatgtcaggatattaaaacaggcatagaatatcaagcaaacgcctaatatattcaaatacagcaatatcttggcataaagggcaaatttaacatatcagtgaagcaaattgaaataattatagttaaatcagatacgatcggctgaaactccgatgctattctaatcgacaactaggtggcaggctggagatcaatattctaagcacgactcaatagatcaaactcaattgatgcagcattaagtatgaaaagaagaatgatatctagacaatcaagccactagaagattcatagaatggtagatatcttatataatctagatcaatgtcaacatttaacccaatcggttgccgtctgttaatatatgttagccgattgtgggttagatagcgatattgctagagattatataagatatatgataactcggcgaattatataaacgagattagaatgtcatgaagatggaagcactaatccctaagaacataattcgccacgacgagttttacctcttgttgaagatcgaaaccggtgcagctcaacctgaaagcaagaactcgtcgaaataaaactaaagcaaaaggtggcgatgcgccggaattgtattggatgtgtgttgtgtttttttttacatagggctcggggtctatttatatccgaggaatacaagatatgtccatattgaacacgactcttatctctaacaaactctaagatattgtaagtctttgcggcagacttttgcccgaacatatctctaaggaatttacataaaatatcctaattaatagatacaattgccttctcaggactctatctatgcgtggcaatcatcttgaagcacatcaactcaaacccaatgtcgcacatgggtcatattgtcggaatcggctgtatcacttaaccagtccaactcagattagccgatcccagtcatagccgatccggactccagccgattcttactctgttttcggaaaaacccctatcttcgattctccttcgatttcatcttcatctccgatactgatattaccaaatttggtcgttaacacatgccccccaagtccgggatatttggtaatgttccggatttgccgtgtatcgactccgaacaagtttcgcactctaacattttcccgattgttactctagtgcttcaaatactaaccgttatccccgagatctcacaccgtgacttccgttttccccgcttaagcaaaacttttaccctctctctctccggcgatccctccgacgcgcaaggcaatccctaggcgacttcatctccggccagatctccgcctacgacgatgtcgatctccgccagtccatccgccgcaccatcagccgaatacgctgaggtaagttaccatcagctagatcccctttttcatcattggatcagttttctctcgcctcttactgctttcttttctcggttactttgaacttgtagcatctctccaatttggtcgcaattcccaccttgtcgcatgaaaaccactactttctcggcctagtcggcaacctcgaccccactgagttcatcatcggtgagaccaataggattcctttcagactatccaatccagatctaggtcattggaagaatacctttaaatcttggccatctctagaaaaaacttcacccgagaaaagttggattacatggttcaagcgcatatcggctagcaaaagagttcattgggacgaaattggaatcggccaagcacttaacctaaccatagcaaactcagccaaggatgaacctctaatggcagccgcctcctatttctggtccaacaccatcaacgccttcttattcaaccaagaaccgatgaccccaactctcatagacatcattatgatcacgggtctggatgtcacttcatcggctaaccccatgagtctgaacacaaaaaaccaatatgactttaagaccaagagtataggaggttggtcaggctatgtaacagcatacatgggtcagggttctgtcacccctcgagaacatgtggcctttttgctcatgtggctagagaaatttctcttttgtagattaagctgtggtcctacaaccaactggcagtttgtagccgaagctttggaagcaaagaaacaatttcctttaggcaaaatcctcctcggctacttgtaccaaatgctgaacaatgcttcggctaagttagctgtcggctcaatagtcatagcaggtggaccatggtggctgctgcagacttggttgaatctaatagtcatgaaagtcgtcaatcggctatccgtcacagaagctgaatttccaagattagagccgatcatagaggacaacaaagaacgcactcatcgccgatgtacgttatatggagaatacgcatccacaccggccgatgctggagcaaagttatcagccgaactgctcaaagattggttttgcagcttctatgaaggctttcaaaaagatgctcgagtttggtttccctatgaagattcagcagacctcgagcttccatcagatttcagattagaagacattaatcatgaaagattccaaacatccagagaagtcttcacagctgcaatcagcccatgcattcttccagtcggcgtccatcaaggaagaaacatccaagccccttacgaattctatcacctgatgagttcagctagatagcttggaatgggccaactcccaatcggcttattctttgctgacaagatccaatgccgaggagaaatttcatcaaccttgatgatggatcggctgctcaaccttccaggaccccctctaggcagcattgaaaacatagaactagcaatgttcaggagcaaaaactttgatagatggtggggtgaatggaagttgcatctattccaccaaccagcttcaatgtacatgatagacctctttccagatgttgtccctcaagtaagtctttaactttacttgatttcatttgaatgaccgcttagccgatttatcttaactaattgtttctttaatttgtaggcaacagaatcctcccctcctcatcaaagcaacgtggcagggatatcacctacgccccaggcttaattcctaatggaggtgggccatctcctcctgtcatcggctatgatgcccccaagacttcagctcttcttcaagggcttatcagagaaccagccgatgccggtaagaaaaggaaaaccagatcatcggctgtagatgctttagccccggctccaaagaagaagatcaaaaagaaagctaaaccagctgatgatctgcctgccctagatccatccattgaacaagctctggatgaagaagaaatcggagaagatgttgatcaagccgcagccgaggtaagcgatattgaaagaacaccatcggcttcacctaagcaggcccctccaactccttctgctccaactcattttacaatagtaagcaaccttctctaatcacttttgtaatcatatcactttatggccgattgctcacatactcggtaactgcagaaaaggaaggctgctgtgaagaagaaatcggctccaatgacatctgagccagccccaccggtacaataatcttatttctttcattagttaatctcgaccgattttatataacacctatctatttttagcctccttcccctcctattcaacaagcatcaagcgatcggaccccatcagctgtaggatgtcgtcatgttgaagaagaagaacaactagccgctcttgctatcccagtaagtttctcctaataagcatccaaatcggctataattgtttaacctctaactgcttctaaattgtcaccacaggtcctagccgatcttttctcttttgacatcaaagactatcttgacgaaggagaagaagatgtcacaagcaaagcattggctcctttatctgatgatgtcaagaaaactctaagaagtatcttggatcggctagaagcatcatcgctagatagcttggtagtcgactatggtccaatcagggctcggctgcatgaaatccaagccttaatcccagatgaattagccgatgtccttactccagctgtttaccttgagcagcaccaattcaagttggagaaagccaaattaagactggccgaacagcgagaacgtaaggacatcgagggcactatccaagccaaccgtcaacttgtgcatgaagaaaaatccaagctcgatcaattatctgaaggtccaatcaaatctaacattgatcggcttgaagctcgcaagattgatctcttagcacaacttgaagaatgcaacgctgagctggatatggaacgcaagaagctagccgatctcccccagtccattgaagagcagaaagctaggctcaaataggctattaagcatgttgctgaactgaccaagtccttaaaagttattcctgcaaccgatgcgcaagatgctcaagccatagaggaagtagagcagattaggcagaaagctatatcggctatccagcaatacttatcgcagtaatcttactgtaataggacttagagcttctgcaatcggctaaacattcttcatcccttaacatccttctgtgccgattagtatgactgtgagatttgctcaaaaaattttgcactatatttactgcattgtaacagatctatgccccctagttttacaatgtcaacagcattgataaaactataaaacaactaagggcgatataacaatatcggccattgtcaattggcaaacctcagccgattacattataaaacaactaagggcgatataataatatcggccatcacaaggcgatgtacacacatcggctatcatgtatcgacattagtagccgatcacgagttaatccatacactcgagtaatatttcttcaagtatttacaattaagagctcggccataaacttcaccatcaagcccttgcagcatatatgctcccttagaaacaaccttttgaatctagaacggtcctccccaatttggcgaccacttgtcgaatttattatcacgagtaccaatcagcaaaatcaacttccagacaagttctccttccgaaaaatccttaggcacaactttcttattataatgccgagcaacacgttccttatccttagtaaccttcgcaagggctcgcaatcgggactgaaccaaatcctccctctcatcggccataagattgtaatactcgtcggctgtcaaatcattttgcaactccgtttgtcgagagccgattctaacttcccatggtaaaacagcctcatgtccataaacaagtttgtaaggaggaacttggatcgatccatgacaagccatcctataagaccagaatgcttcggccaatcgagtatgccattgccgaggataatcggaaatcttccgcttgatcaacttaatcaaactcttattagacgcctcggcttgcccattagcttgtgcataataaggtgaagaattcaacagcttgatacccatgctatcggcaaactgaacaaattcatcggacacaaatattgaaccctgatccatagtaatagtcctgagaaagaccaaatcgataaattatatgctcttaacaaactgaatagcatcccccgaatcaactttcttcaaaggaatcgcctctacccatttggtgaaataatcagtcgccaccaatatatatttatgccctttacttgatggtgggtttatcatgccgatcatatcaattccccaacctctgaacggccatggtttaattataggattcatagccgacgccggtgctcgctgaattgctccaaacttctgacaatcttgacaacccttataatatcggaaacaatcctccagcatcgtcagccaaaagtatcctgtacgtcgaagcaaccacttcatcttgtgagccgattgatgagtaccacaaatcccctcatgaacttcaccgattgcaaccttagcctgatcggcactcaagcacttaagtaataccccatcaatcgtccgataatagagctcatcacccagcaacgtatacttcaacgccttatatcgcaattttctggaagccgattgagacggattgctcaaatactgatgcacatcatacctccagtcatcggctgacattgccgcaatttcaactttaacatctttgatcatcggcttataccccgagccccttgagccaaatcattagcttcaagattttgttctcgagatacatgcttcaaagtcaccagccgaaactctttcattaattccaggcacttctcattataaacgatcaatgtatcattcttgcattcatattcgcctgccaactggctgattactagcaaagaatcccccatgatttcaatagtatcggcttcaacttccttgagtaattgcaaccccttaagcactgcctcacattcagcttgattattagtcgcatatggtttaatagtataagcaaactcaaaacatgcccccctaggggaaattatagctaagtcgatgccacaaccatcagtgcgtaccgatccgtcaaagaataaagtccacggtgctatctcaaccgagccgattgaatcatcatgatgttccacaataaaatcggctatagcttgtcccttaatcgccttcggtgattcataccgaagatcaaactcagtcaaagaaaatatccactttccaattcatccctttaatattggagtcgacagcatatatctgactacatcggctttgcatataacagtgcactcattagataatagataatgcctcaacctcgtacacgaaaaataaaggcacaagcataacttctccataggggaataccgagtctcagcatccaagagccgtcgactaagataaaacacaactcgctccttcccttccaattcttgaatcagaactgagccgattgacttttcaccagccgataaatacaacctaaatggtattcctttccgtgtgggaatcaaaacaggaggagaactgagatattccttaatattgtccaaagctttttgttgctctgcccccaagtgaattcttgatcggctttcaaccgctataagggtgtaaaaggttccaaccttccagataatttagagataaacctcctaacaaaatttatcttgccgatcatctcttgtagctcggtcttattttccgggggcttaattttctggattgcattaatgctcctctgagttacctcaatccctctttcatgaacaagaaatcccaagaactggccagccgatacaccaaaagcacattttgtcggattcatcttcaagccatacttcctggttctctcaaaaacttttcttagatcggctatgtgatcatcaagttctttggatttaacaaccacatcgtcaatataaacttcaaccaacgagccgatcaaatcgtgatatatatagttcatggccctttgatatgttgcccgagcactctttaagccaaaagtcatgacaacccactcaaataaaccgattgcaccaggacacctaaaagccgttttatagatatcctcttcagccataaatatctagttataacctgcgttcccatccataaaactcaaaatcttgttccctgacgcggcatcgactagctgatcggctaccggcattggatattcgtccttcggtgtcgctttatttaaatctcgaaaatcaatgcacaccctaaccttgccattcttcttaataactggaactatgctagaaacccattcagcatatcggcagggacgaataaaaccagcatcatacaatcgtttaatttcagccttaacagattcaagcatatcggctttgcatctcctcggaggttgctgatgtggtctaactcccgttttgataggtaaccgatgttcgacgatcgatcggctgagtccaggcatttcataatactcccaagcgaagcaatctctaaactcttttaggagctctatcagcttggttctaaactccgaagacaaacctttgctaatgaatgtcggccttggctgatcacctgggcctatatcaatttcttccaaatcatcatccgacataaaaccttgaccctgcttgtcatcgagatcatctactgtatccttagcgtaaacatctgaaccctccacaacgccctcaaagtaatagcttgggttctccatcttcgattggctgtatatcagaatcggatacttttagaaaatctccatcccagacttttccagataaacaatcaaggtcatccatctcccaaagagctaaatcggcattagcaacattaactgacctgtcggctggcacaacctctatcttgtcaccttgccactgaatcaagcactgatgcatagttgaagggatgcaacaattggcatgaatccaatatcttccaagcaacaaactgtatgaacccttcccatcaatgacaaaaaacgtggtaggaatagttttactgccgactgtcagctccacatttaaaacacctttggtctccgatggattaccaccaaaatctttgagcaccatatttgtcttgataagatcctcagcattcctacccagcttcctgaacgtagcataaggcatcaaattcaccgcagccccaccatcgaccatcattttagacatcggctttccattgacgtagccgtttacatacaatggtttaatatgccgattctccgttccctcgggcttttcgaataccgcttgctctggtgacaggaccaacttggccgattcctcctctacttcatcaacatcggcctgattgattccaaattcggctggtagcgtaaagaccatgttgattggtgctgtaacaacactctttccttttgccaacctcttcgcttcatcggctgcagcatcatcggctgtaggagcttgattcttaacacgccacacctgccttggtcttggtttcctcagccgatgattgattccctcttcaacctcttgaaaacgttccctgctcctcaatctctggaccctccttttctgattttttgtgtaaataccagagggacaccattgattcttcctagtcccttcatcttcttgaccatgatcttgactcatcggacccaatctttgatgaacaggaagtcttgtctgtcttggccgatcaccctgattatgtggtcggcttgagctctcaatgacgtcactgcacccaggacagttttcaatagatggcaacctcattccttcgttgcagaagaatctaaagaactcacaatcccaatgaggatcgaaaccattgttgttctcttcataacgcctcgcctgctgcttatcatacttcctttgatacttgttaataatcttagctccaccggctgcttgactagctgtatgtaccatgttgtcgggaaaaggatttccatcgaccttcatcggcttcttggaatcgtcaaacttaatcttccccccttcgatggctacctggatttgctatctaaagaccttgcaatcattagtagaatgagacccagaattatgccatttacaatatctcctcttgcctaataacttcagccgatgggatcatatggctaggagggagctgaatctgcttctctcggagtagcaaatcgaaaatcttatcggctttggtgatatcgaagtcatacttttcctccttcccaggacttttcacccattgacatggtataacctttttgctcctcacccattcgactgcagctatctcagaatcatcgtcttcatcgtccgatccatacgtatacgggcaaacgtgattaaccttcctggagcttctcctgacgtcagccgacctatgctcatgcaaggttaccttttgtatcagatgcgacaaactattgaagtcttcggacgagaatttctccctgatcggaggaatcataccctggaaggctagatcggctaactgggcatcggtcaaactcaagctaaagcacttgttcctcacctctctgaacctctggatatactcgtgtacgggttcatcatacctttgcttgatcgccgttaagtcagacaacttcatctcgtggaccccgttgtagaaatagctgtggaattgcttctctaaatcggcccaactattgaccgacccatatggcaaagatgaaaaccaagtaaaagctgacccggataatgataatcggaacatcctaactctcaaggcgtccacagccgatgcttcaccacactgagcaaggtatcggctgatgtgctcataagtcgacacgccctcttgtcctgagaacttggagaaatcagggattttaaaccgattaggaagaggaaccctttcaaaccactcgggataaggctgccgatacaaactcccagtctcttttggtctcagcccaaattgctccctcattacatcagcaatgacatcagcccatggtcgttgctgagctgctccttgtggttgctgctgcatgggctcgaactgaccaaactgatgagcgaattgttgctgggccgatcccgctggttgatattgggcttgcggggatggaggctgatactgatagctcaagttacccccttggtagttatgcagattcggctgaatgttgcgcaccaagtgctcaggaaccatctgaggtaccacggtgccatccgattgtgcatgatgaaccaaatgctctgggataacttgattcacaaactgctgcacaggttgccccccatgtgctgcaaatccagccgatgcattggccgaccccaggtgctgaatcggctgaacgacctgctgtcgtatcggagtctgttggatcggctgaagccgttgccttggcggtgtctgctagattggttggagatgctactgcgttgatggtgcttgctgaactggctgcacgacctgttgttggatcggctgtaccaccggctgaattagtggtatcgttttattcatgttcgacattgtattgactaagaccccggattgattgatcaaagcatgatgcaccgcgtaatcaacccaatcttgaaagttgttgaaaaaatcttgtgctagctcaatattctgattaagatttcctccttgcggcccttgagcagcatcacctggagctccgtgcacttcttgagggttatcgccttgatttcctatagaacccccggtagcacccttgttgttcggctgagctgagccatctggagcttgtttcacttctctatctttggaagaaccggttccagggctatcagcaaccagttttaacttgtacttctgaactagcgttcccttgcgggtttgcatgaacgagctcagatactgatcccgtgcttgctgcatcattgcttcaaactcctgcttgttgtcaggcgtaaatttctcgggatcgatcggcaggacattgtcatcaatgatgtcagtcaatcccggcttcggtaatttgcctttaacagagcctgggcttgatggtagtggtgcttgtttctcggccatgaggaagaactaacgcctgacttctaatcaggtcccactgggcgtgccaaaagcgtgttgacaaaaaacacgaggcctgggagatctgcttaactccagtgcaggtccaaaacttgccttcggatgtatgagcgtgccagttgatttcatcctacaatcaacaagaaataaagacaaaagaaccatagttaaacctataaatgatagccgatcggtttggtaccgatgacatatcatttatatctgagccgatgtcatctgtgcatcgatcgacaatcgtgaataaataaggaagaaaactaaacctacttgatcggctgtagatgttagcgatatatactccttatctcgatatatacttaaatcaagtgactgggatagatcgtcgccatgccgagacagattgaatcacttagtccgaaatatatactaatatcaagactatataagcttacagcatagccgatcatatagatctagca

SEQ ID NO: 27159 - DNA, 1772 bp, Oryza sativa
ttaacacaatcaaaagcatgtttggaccctataatttcaattataacttggttttgcatcaattaagtttgacctactaatttgtagttgaagttgtaagaattaacatgctcattgattgtcggtaggggtaatatcgagtttcagctgatcttacctgtataattgttttgctttaagattgcaagttgtctttcgcttaatgtgttatatctgtcatcttatataagtttatcaaacctttaaatctattaaacttgccatcaattccgtgcggtctcagttaggtctgatctattgggattacagcttgttaaatagatttaacctaaattttatattctttaatctaaatttgattatcttcaatcacctaagttacttcaccggctatgatataaatccatataattattaatttgtctgatcttggctatcagcaattaatattgtgtcgattatgtccgatctatcatagttgcttgtatttaagagaaagattaaattagtaattacaagtcatttatctctacagtcgattgtagttatgttgggcctagtttataaatatatgtccatcggctagctatttaggttatataattgtataataaatgacttcaatcttatgctacatcgattaggttcgacctatgagattggtcctgttaaagaaaagctgtttacagttatattcaatctaaagctagtctatgagtagcatcctattcacctatacccgattcattcgtgcatcggctgatacgatactgtaacagccctaaattttgacaactttttaaaaccgatttaattttctttggttctctaaaattataaccgtcgagttagtagtttatttaaaatattattttccatgtttgtttctagtgtttatttcttgtttaattcggttgcaatgtgcatctcaccttccgaacaattctttttgatccaaattcaattctatcccgagtagaaaaccatttaaagcctacaacaattcaaatactatttattttaattttccccatattttctttttctctaattttaccttaattctctttttccatctattttattttcttttctattctttcctttttctttcccctctctctctgttttcttttccttcttctcttctcctgctgcctcgcgccaaacccgtgccgccttgcgcccagctcgtgccagcccacgcatgatgccacacactcgcacgcgcacacacgaggacgaacgacagaagaatgccgccgtgacacctccagtttcccgcctccgtatctccttcgtccctccactaaaaggctcaagacctgtcacaccctaaaaatcctaaatatataaattgttgtttaaatggaattattagaaatgattttaaaagcctagacgagaagatctattttttttaaataataaatcccaatataaaattgggccagataaaattttattaaatactttacttgattctatagttcctagatttttctgggatttatttgagccaagaaagtatttttaataaatggaattgcatttcatgaataatttaaattggaaaaagttttaaaaatctctcttttggctttgggccgaaagtcggcccaaacctctctctctctcctccccggcccaggttggcccgcagccgagcgccgcccgcgcgggcgcgtccgcccgctgacaggtggggcccgcctgttagtcttcgtctacctcgcgccgctgccgcatccgaaccctaaccaagccgcgcc

SEQ ID NO: 27160 - DNA, 18618 bp, Oryza sativa
  unsure (1)..(18618): unsure at all n locations
nnnnnnnnnnnnnnnnnnnnnnnnnnnnnnnnnnnnnnnncgtgggcaacggctttaccttttgtatagcatggttcattgcggagcaccagactgagaagtggcggagataagcccacgggggtcgctggggagtccatgccttgttttataagggggcgattatgatccaggaacagtgcgctgtggtggattgtgttgtgcgaggggtactgtcacagctcctttccgaggtaccgtggtggtattgaggcgcatggtgacatgtcgtggggctgtgtcttgtgggtatagtggtacatttctggccagtgtaaaactattcgaatagccgtgcccgcggttatggacgggtctaacaatgtctttcgtgattagtctcacacttccaatcataataaaagattctataactggtaataatttgattagctcctggtttggaatggttaattcctggtttggagatagaactgtgcagccgggattggttgttcagaatggttgggcctatgcaacagggtatgttgtataacgttgaattaatattgtttaattatcatttaactgttttattaaattctaaaatatttattaaatgttgtttatgcaaatgggactatactatgccatcctttgttatcctgtgcacttgcatatttgctgcgtggcttgctgagtatgtcatatactcaccttgcaatcattcatcagaggaggagttctacagtgatgttgatggtgtggaagattaggtgtagccctggtcaagctgcctgtggagtggagtcgtctgcgcagtttatcttttttttccgctgcttagatctttattgattgagagcaactatctacctctgtaatgacattttattcgcttattaattagagtgataattgtactctattatcaatttgttattgtgtgcctcggctgattcctggacgagggttcacacacatgtaagcgtttggaattttggatagaaattccgggtgtgacaagaccggaggcaaaagaaccgcaatttcaacctctttcacctcctcgaatccgccccaactcccgcggactcaatcgtcgggggaaaaaatccccgaaaccctaatccggcgccattaaaagaatctccgaaattcgtcgcatacatcgccaaccctctgaaattgatggtaaaaatggaatctccatgatgagtactccctttcccctctcttttccccctcagcccgtcgccggagtgccgccggcgctgcctcccggagtcaccgccctgttcgcccgccgccggctgcattgctcgcgctgctccaggccaccctagcttcggccgtcgccaccctgagactcatctcactccattgatgctcaccaggcccgccgcccaccccggagttcgccggagtcgccgccgccgcctccagctcctggccgccgtcgccagcctcgccatcgccgaccacgggaacggagtcgccgcaccctggagaccgcaaaaccggcgcccccttgtccaaaaccagccatcttcaccgccggcgccagggagatgccggccagttcctgtgcagagcgagagaagaaaagaaaattagattatcctattgaaaaataaatcagaaaataccctttttcttttcctattatgttgaccatccgtttgacctcaaaatcaaaatccgagacctgttttaaactcatagaattatcccgaatccatccgtgtcagtttcgttgcaatctgagcaaccgttgacgcgaccctaattttacccctagggttcgtcgttcaccgaaattccaaaaatccctaaaattaaatctttaaaatcctttccacccatcgttgcactttatgataccatttgttatgtttaactttgtttttctattatttattgtgatggtgattgttgcataaatagaaaacgctaacattggtcctacgactacatcgagcccgaaggttgcaagacatgcaccctcccttgaacaatttaatcccagtagttagtgagttattttggtaccgtacttgtcctttggagtatgatagactgcacgaatgcttctaaattatattgctattattgcattatattttctgttgctattatggacacattaaagagccttagagtctaaaacgcttaggataaaatttgaggagcacttaacaaactgttaattatttagcatgctattggtttaatatggatattattatcgcatatgaaaacatgcttatggaattgttaatagctatatgctaagaactgttgacaccgcttgtgagtgggtggtacacatgatagagttcatgtgtttggttttatggacctgtttatggtcgtgttgaatatatggatatatttatggttatttcttatttaaaattgatataataatcagcccccttgtgtcaataagaatgacatagtttcgcccatccacacgatcaatttgtcgaacctagccgtatattgctccaattgattgaacttctataggcctttcggtgtactggccattagatttcaagtgtgaagcaaagtgacatggtttatgtttatatgatttatatatgtgggcttgatgggcccgagagtttagaactgccctatgggcccatgaagttctgggctgtccacccagtaacgaacaatggtaagtggatgcggaggtaggttggtacacacctcggaccggatcactccgagtaacgacccgagcatcctttaacttactaagcagaaaagagagatatatggagcaatattacaccttgttacttttcagcctgtggatatcgtgtgggtaaagctgggcagacgctgcagagtcgtagagtattcgaatacgacgtgctcccagttaatggagatgtgtctatgggtataccagattgtggccacaagttaaactaaatggctattaattaatatggtcaacttatttattacttgatgttctattcaagttatttataagtaacatttatatttttatgcccgttattatttttaagattaaatgttcaatagtgttgtttatatcaaatgataattaagataggctctatgaaataattgttaaggttagggtttaaaccttcctgctcttaatatggcatgttttatattgcaattattgtatttgctatcataagcatgtcttgttgagtaccttttgtattcataaatgggttcagatcatgaggaggaagatgcttgtggagatcccgttgacttgttagatgggacagctatggtttctaggtcattctatgatcaggcagttcctgtggtggagtctagtagtttatctgtttgtagaaataaggatttataggccatatatgtaatggtttgtatttatgttgtgttgtgaactaagtgacttaagtaatgtataatcgaagtttatgcttttatatcatttcatgcataattgaacatcctaggcggttacgtattcgtgggggcaccatgactttatcgggtgtccccacagatacaacatcagctgattggctatcatcttctaatgtttgctatagtctatcttattggttgcaggatcaaatcaactggcatgccctgaacctgaagctttggacctacactgaagttaagcaaatcttcgaggccatcgtgttttcgcatcaacagatactcatgatccaagataggtctgaaaggttgaaagctaaccttccaaagagtggatggaaacatttaaatacttgacctaccgcgaaattagtcattactcacatatttgaatatcataggttttgattagattgatcagaactttaatccacacttcgcatattgtgagaaaggggattgaaacttccgatcaatcctctgtcctggcgaggagcactgatcagaacttccaatgatctccaccgggactttccatcgtccctccacaataggcatagagctatgattggagattccaatttcaactatcagaagttccaatatggaagctataagaaccccatctttcccatgtgggtgttgcgcaacgtctctctctaaagatcaaagtaacattgagcagacacaaaagtcagcgttgactcgaacacctctccatagtgtggcatttcctatgactcgaattcaaaataaaaaataatgtaaatgccttgagagttttaaccttgctttcatttgtaggggtcgtcatgcattatcaatatcacaatagggactaatacaatccaaaactcattagagacttagatatactttcacccatatcttttagtatactacataatccataacacaactatctcagtgtgctacacatgctctagaacaatcttcaaagatatttaagaataataaaagtctaaaacctcccaaaaatatcatacaacctataagccagtataaatatatccaataggtagcggcatatgcattattttagccggtgtggttataacatagctatatcatactacattaaaagatgcaagtggggtgggcaagcttattttttttcgcttatcacaattctataaattagcaagtgggaataaatgtggtttttatacgtgtagcgggatttcccacttatatcgctactactagggctagtgtgataaatcagtgacaatcaattgatatttagatagattgacgctaaatacatgcataaatcatttgagcggaatgtcaggtagacaaaaagtcaatacgtcgtgcctacataatacaaacatctgacactgctaacaatgatcctgaaaaaaacgaccttaatcatatattagcaacacaaccccaccagccacacctataaatgtaactcgacggctaatccaagcatgacgaacaatacgatattaatttttaatgttgctttcatttgtagatgtcgttatacattatcagaatcacaatagggactaatacattcacttatcctcaataaacctatcaatccattaattggtcttgtcgtcaacaatccaaaactcattagagacctatatgtacttttacccatatctgttagtgtactctattaatccataacacaactaagatatactcctcagtgtgctagacatgctctctagaaccctcttcaaagatatttaagaataatataagtctagaacctcccaaaaatatcatgcaacctataagccaatataaatatatccagtaggtagcggcatatgcatttttttagccggtgtggttataacatagctataccatactacattaaaagatgtaagtgggtgggcaagcttatttcttccgcttatcacaattctataaattagcaagtgggaataaatatggattttatgcgtgtagcggaatttcccacttatattgctactactagggcagtgtgataaatcactgacaatcaagtgatacttagataggttgatgctaaatacatgtctaaatcatttgagcggaatgtcaggcagacaaaaagtcaatacgtcgtgtctacataatagaaacatctagtgacactgccataatagaaacatctagtgacactgctaacaataatcataaaaaaaatgaccttaatcatagattagcaacacaaccccaccagccacacctagaaatgtaattcggcggctaatccaagcatgatgaacaatacaatgttaatttttatgataaagaaactcagggcccctttgatttgaaggaaaaacataggaattttagaggatttgaatcctacaggaaaatttccaatgaagccatttgaaacaaaggattgaatcctatcatatcctttaaaattcctatggaatgggcaatcctatagagattttgtggaggaaaattagcaagagcttcaacctcttgaaaacattcgaattcctgcatttttcctgcggttcaatcaaacggtcattcctgtttttcctgcgttttgcaatcctctgttttgcatttacattcctgttagaatacgtttttcctattcctctattttttcattcatacgattcaaaggggccctaaaggtgtgctagaatacaatgtaatgtagtaatagcaattctcatatttatttagcacttgcttggataattttgttaaagaaaatatagtaataggtacttttcaacatagacataagacaatgcagaatttaggaaaatgcagctagagggaaacaaaacttcaacctgaacaaagatagaaaaaaaacataacggcacaatgctggaaaaggccagaaaacgaaatcctacctaatcatcttcttgttttctgcataacagtcattatggcatggtacgtatagaaaatcaaaactactattaaagagagcacttaagacatgtcgacttaagtattctggcatgtcatggcatgttcccacggcacgaacacgtcgacttatgtaggaaaatgcaagatgaatagatagaacacgtcgacttatgcaggaaaatgcaagatgaatagacagaatgacacaattttgcagaaaaaaaaaggcaagaaaatacaacaatagttagtattcgatcctgcaagtggtatcagagctcgttttcttctttagatttttaccgatctaaagtttttgcaatggctaataagtttataagtaagccccatgttttcgatggaacggatttttgttattggtgtagtaagatgcaatcttacattatgatcttaatatttggagaaaagtttctaatccttatgtaattcctaatcaaattaatactgttgttttaaaaaatgaatttgaaaataattgcaaagctcacaattttcttttgagtgggatgaatctgatagtaatgtaaattaatgtggatggatctaattgtgatagtgaagaaaagcttagttatgatcaattagaacatattgctttcaaatttgctgagaaacttaaaacatgttctaatatgcttgatgagagggattgcactattgagattctgaatgctgacattgatagattaaaatcttcgattcctaatgatgatgattgcaaatcttgtgaagttttattttctgaaattaatgcattgcgagatgtcaattctattaattgcaagaaattggaatatgaaattgaaaaatctaaaaaaaaatggagtcttcttttggtcttggatttgctttgcatgcttgtgttgttgatgaattggttttgacaaagaacattttgacaaaatacaaagttactttttctgcaagttctttgttcaatgttttaggtgcaaaaaggattaaacaaaacaaagatgttttggtttctcaaaattgttcaaagtgttttttgaatgagatgaaattgaaagatgttttaggactggttgagcatatggaaaatattgtgaaatctgatgaagtgctttcttgccccaaatgttgtaaaagcaaaagtataatggtagattgtgaaaattgtgctaatttggaaaaagaagtttcttatttgaaaagttctttgcaaagattttctgatggtaagaaacagctcaacatgattttggatcaatctaaggtgactagttacaataggggtgttggttttgatgttcataactatttcaccaaaaatcatcccaatgttttgagtgtgactgaacatggtgaaattttgagaaaaccaagtgctaagaaaacagtttttaagtctgctggaattttgccctctctttctagaactttaaaagaaacaaaaacaaatctttcaaaaccatctactttacaaacttgttgtgagaattatatttgttctttttgtggaaaagatgcacatttggttagtttttgttttcgacttgcccgtaaacagaaaaaggaaagagaaattgcttttgcaaaacgacgatggcaaaaatcgggttttggttcgaggagcacggttagaccgacactgactagtcggtcagaccggccagcggtcagatcgcagttgaaccggtggtcagactagatgccaggcccggtcagaccgcagggacaacggtggtcaaaccggcttccgggcgattttgcacgtaattcaaatcggacttttgtgaaacgacaaggtaagttttcaggtaagtttagttctgattttgttagtgcatatgtacctattggttctactggtcgtgtgactcagtgttggattccaaaattttttatttctaaccccaacatggaggcctcgacattttcttgttcgtaggtattttggtggcatactccctatgtgcgttcaacgttgagatggtgagtgcttttcaaggtaatatcaagataattttggattgacataattttgttctactttcttgattattaggttttcatatgctagtgtttgagatagtagtttttgttaatacaagtggatacatgtcaattcatgagaaccttggtgatatcattggcaattggatgtctttttcaaaatctttgatttcttcttgatttttcttcggggagaattagaggttaatttgaggtggagtttatgctttttcgtgcattcatgtttatttttatgcattgcttttaattctgaaaataaataaaaataaaaaaaagaagagctttgttttatacctctagtatattcttgtgcatgctagcaaaataattgaggtatatttgttgcaatgttagcttgtatgcgttttagtctttatataaggcttagatattgcttttaagtgagatgatgcatgatactaattcttttacttgaattaataaaatatgcaatattgatgatagcatatggattgatttataaatgcttatgtatatgctttattgaattgttattcctcaaatagcttttatttgctcattgtgcaagagaataaaaaatatctatgaaagaaaaaaaaagaataccgaatccttggaaatagtcatgacgataaatacatattcgatgtgagcaaaaataatgagtgccgaatccttggaaacagtcttgacgacaaggacatacccggaataattgagagaaaaaaagtgagcaaaaaggctcaaaaaaaagtttaaaaattctcttgattgttttgtactaaagttaatttgagaaagagtgataaatgtaataggtatatatgtatagtgtttatttttcaatctatgtgcttgtgaatatattgcattataaatcatttgaaattatgaatccttattgctaatttaagcttaattgtaatatctttgattcatgtttatattatgatgcatgcttgctaactggctaattaatttatcttctttgtcttgcaacacacgatcatggattgcttttggtgcacttcaaagctctcgaaaaaaattagaaaatagaaaagaaaaaattggttatttcaagtgacaatcatgacatcattgcatttgtactttattgtttattattttttttcttttgcattcttgatgaaatcattgtcaaagggggagaaatatgcaaaatgaatgctttttgaaagggggagaattgaattgttttgattgtaaaaatagtcgattttgtgctttgattataaattgatgggagaaattctttcttttaaaaagggggagagtttttcttttcacttttgtgatttttgtttttatttttcaaaaatacaaaattgcattttggtgatgttgccaatatgttcatcaagggggagattgtgaaatcattgtcatgtttaatattttatgatgaataaattggctttacaaatgatttaatcaatgaattgattttgaaaagatgtgtggatgttggtgtgagtgcgtgtgactaatgtgggtcaggttgtgatatctgtacccagaaacgattgttttatctgattatgtgcacgtgacttgaggtcagccttggtcaatggtgaggaccgggactatgctcagagaggagtagaggtctagtgcggtcggaataccatatgagaaggtgactagagtcaggattcttagaggtcgatcaactttggtcaacggtggggatcaggactaaactcagggaggagttgaggtccagacggtcaaggataccgaataacgaagttggatacgatatagtatacggtggatggacatcgtgtgggagaaatcttcgtaataggcttcacgaggtgtgcatgcaagtgtcggtgttcgcgaaggaaattggttgaggaaattcggagtatatggttgctacagtactcatggtactgtagcgtggtgcatatgcatgtctcgttgcatgcatgtgctgcgtacttgcgtgtgctatactgttgtgttggcgtcggcttgtgctggaacaaccgacccaggaggaggcccagacgagcgacggcctgcttggtgatttgctggcccattggaagaagggtcagcgcgtggaggagatggcccatgcgtgaagcttcagtagaggaggcgcacgtgtgttgacaggaaacggagatcgacgggcagtcggtttcgcgcaggagtttgattggtttataagcagtccggctgtagtttcggaaaatgtataggtttggaaattaagggattgagtcctattgttaataaaagttttacaagtttttatataaatagatgaggggttgagacgaagaaaaaaagttagggtttacttcaaggtttcaatcatagtttgttagttgagagggattacttcgaggtttcaatcatagttcgttagttgagagaggagtgctttaggtgcacttagttgagagaggagtgctttagatgcactttgtttcgtcgatacgtgttttttggatcccgacggtttgaccagatatttcacaccctaaacttttaaaaccacttttaaaaccggacgaattaccccctactcaatatagaatggttttcatcctacgtgtacacgtggcagatcggaatggttttgtcctacatggtatatatgtacacgtggcagatcggaacagttttgtcctacatggtatacatgtagcgctaacgtggcaatccaataaaaaataaaaaattaaaaattaacatgggccccacatgtcatatggagtagtactaaactctctctccttccctccggcatcgtgggcgcggcgtggcgcggagccaaacgtggcggagacgacagggatggcaggtggagccgtgctcgctggcgaacaccaaggaggagctgtgcgccggcggatgtggaggaggagccatgcgcgccgcacggaatcgaggactcctcgccacgtcgccatagccccctgccttggcagttggcagttggcagcgtctgccgcctccaccgtcctcaacgcggcccaccgttgtgagttcgggttgaatctaagcttcctgcaattctgcatgctcttgcacaaatcctacgaattccagaatctcgttgctcaaatccaaggcttaagggagaaatttgattaaacctgttgttccatgagaattttcagattataccacctagtacgcactgctttcaggatttatcacccaatttacactacttttagaatataccaatggagtgtgaattttcttcgttccgggccactccatcccctagcgtcagtcacaccatcatcctccgtcctcccggcgccaccgtcatcagtccgccaccgctcgcgcttgcgttaaccgcgccgtcgcccgtccgtcgcgtcagcctcgccattgcccgtccatcgccgcccgcgtcagccgcgccgtcgctggttcgtcgccgtcattggcgtacgtggtggtgggccggaggagaagggagcagcggtggagggcagaggccagagggcgtcgagctccggtggcaaagctctatacgagctcgaggctgcggtggcggagattggaccggcgatggctcggggcgtggtggcagcagcccggtgcggcagcggttgagcttggggacgatacgagcgagctcgccagaggtcaccctcgtgctgctacttcgtgccgtccgcgcgcatatatggcgccgtccgcatggaggaggaggagctttgctggtgtggggaggacgagctcgccgacagccaaacagcgcgcgcgtgggggaggaggagctcgccggtgtgagagaggacgagctcgccggcggccagatgcgtgtgggcaacggcgcgagtgggatgaactgacgatgtgtagctttggttagacagagtggcccggaatgaagaaaattcacactccagtagtgtattctgaaagtagtgtgaattgggtgataaatccggaaaacagtgcgtattgggtggtatatcctgaaaattctaaaattctagttgttccatataatcacaattctgtttattcctggtacagaggcgagaaatctcaccggagaagcagacaagctaccaatgccagtgctcgtttcttgaggtgagtactgagtactgactcatctgcgtgttcttaattgaactgaaaagtgcatctagatgtgaattttttttctgaatttagttaatttaacaaggtttctatatctgacatgatgcaaattttgctcaatgctttccaggtatataatgagtagattaatgacctgttggatccatctcagcgtaactttaggtatattctaatcctgtatatggtgtttgctaatggattgcattaaacttattcagctccattattctagataagagagaatgcttgcaatggtgtccatgttgagaacttgaccgatgagtatgagtcaacggttgaggacgtcaatcagatcttgatgaaggtataatcaaaatgaccttcaattcattgcattgtcagtgtactttgtagccagtgatgctttacagctttggtcaggaagtggctgcactaatctgcaagtttctgtcagaaaatagcaaggagagttcgcaaaacaataaataaataaagcaaacatagcaaggcatttgtcaagttgttcagaaaatcttctttatccttttatggcacggagtaatccaacaaaaccagcccgaaaatttttttttcctctataggcacatcagtgggacaattttgatcaataagagtagcagaaagaaattgtcctttcggttttgcttttaaaactagggtttctttgcttttcaatttcacctctgcatggatgaggatcacaaccaggacctctgcttgatctaccctgtagtcacaaagacctttgtcttgataacaagctgtatttttgttaagatcgcatatattactacttgtatcatgctctttcgaaactatttgtttcatgttgtccttctaataactgagtcactgccttctcctctatagagattaaaatctgaattgaagcctaccattgctcaagcgttattgatagcttgtctgagcttgtttttcttacagggccttccaaacagaaaagttggcaccaccagtatgaacttgaaaagttcacgttctcatataatattcacttgtgtcattgaagcatggagcaaggtaaattaaacctctggtatttcttctgttgtttggagacctcataaccagctatatttaacttctcttattgcaatagttatgtcagtattatcatttaaaaaatcagtatgctctttagtcaattcaattctattagtttccactaactgatcagcaaatatatatacatgctgtcattatcttgtgaatttactttgttcaaccaaattacagggttgctcatcaaatggcttcagcagctcacagactagcagaattacctttgttgatcttgttggtcctgataatgatgaacttgatggtggcagcaagcactgtacaagagaataaagataagcagtcaaaatcttgggtatgtaaatttatatgatggcttgtttgggcggaaatttttatgatgtcatgaaaatttcatcactaaaaggaaaaagtacgaattaccctctaaactattgcgacggtacgaattactcccctaaaccacaaaaccggacatattaaacctcgaactattgataccgaacgaattaccccccatacaatcctgagcagtttttatcctacgtggcatatacgtggcgccgacgtggaaatccaatcagaaaaagaaattaaaaaaatatggcccacatgtcattaccccttttcccctctaccccccctctctctctctctctccagcgcacgtggataggcagtgggcggcggcgacgacgacgcacctggagcaggcgggtggtcggcgtgcgggggtcgacagcagagtgcgaggatggcgcggcgccggcgccgaggaaggcgttggaggaggcgggctaggtcgtccctccctctctcgctctctgtgtctctttccttctcagctcaggcaggcagcgggagacgagtcctccacggggagggcgcggcggcgctgcacgcggcgcgcgcggtgaggaggcgaggcggccagcgggctatgtcgtccctctttctctctctgtgtgtatctctctgtctctctccttctcggctcaggtgagaccccgaggccggcggcgggcatggcaggggcgttgagggtgtgcgcgtagcccacgacggatctcgcgggaaggaatcgacgatcccgctgccgtgtcgagctccctcggcgaccctccttcgtctcgcgccgcctccgtttcccgtgccggagccgaccgccccagctcggcctccgcgcggcggcgccctccactgccgacaccttcatcgacggcgaggctgtcttccggggaggcgacgcatccgacgaggctgcagcgggcgcgcagacctgcgtcgtgttcgttggtgatgacggtggcgccgacggcgtggccgcgtgggcgacggagcgcgccgcggcgaggtttctgttggtggcggcgcggccgcacagcgaggccgcctcctcctcatctctcgccgccgtctcctcacctcgtgccgccttggcctccgcagcggcaccctccaccaccgacaccaccgccggcaggtgccggcgctacacctcctccagcccaccgcccgtccctgcatcgccgcccacctcctcacccctgcgcgctgccctgtaagagagaaagaagagagagaggagagaggaagaggggaagagtatgacaggtgggacccacattttttaattaaataaaatactgactggattgccacgcgtacgccacgtaggacaaaatcgctctggattgggccgaggggggtaattcgtccggtattgaaagttcgttgtgagtaatgtctggttttcgagtttagggggtaattcggctgaccacgatagttcagggctgaccacgatagttcaggggtaattcggccgaccaagatatcttcaatgtttatttttcatgttaaccggtttctctttcttaatctgttagcactacagttaactgctttctttggagtaatatattaaatatctagcgataagagttaaaatgtgtattaaagcagaaaactgatttccacattgttacttcaggaaactcgttgatagaacctcgtcaatattccatcagaagcaccagagaggcagagaccaagaaagatgactccccacaacttcacatataaggactaaattgtagtacatgtcacatcgaatgtttggccttcattaaaagtattaaatataggctaataataaaactaattgcataaatgatagctaatttacgagatgaatctattgagcctaattaatccataattaacacatgtttactacagcatcacataggctaatcatggattaattaggcttaatagattcgtctcgcgaattagttcaaggttataaaataggttttatcattagtctatatttaatacttctaattagtgtccaaacatccgatgtgacaggaatttaaattttaggttgtgtttagatcgagtagtataaagttttgacatgtcagatcgggtatgtcggtacacatttaaagtgttaaacgtagactaataacaaaacaaattacagattccgcttgcaaactgcaagacgaatttattaagcctaattaatccattattagtaaatatttacggtaacaccacattatcaaatcatggactaattaaacttaaaaaattcgtttcacaatttacacccaatttgtttaatttagtactcccagccatgggagaagtgggtcgataatttttcgaaaaagaccttcgattttctgtaattatatataggccattacaaacagtatttgggggcgaaaagggaccgctctgcaaaatgagaaaagagtaggggttttttggcaaaataacacccactaacccaaaccttatccgccgccgctcgcaccctctcgctctgcccgctccctctccctctccggcgccgccaccgagcgccgccgcctttgccacccctcgcgccgccacctccgcctcccccttacgccgtccccgttgtcgggcgccgccgcaatatctccctctatcgttcgcctccctcttcttgtgttgtggtggtgcggtgcgacttgcgagtgagctgcatataccctacgaatcgaatcgaattcgaagcccgccgccggcgatggccgtcgctggcctgctactccgacctcctccgtgcgtcgccatgtgcactccttccccttcccctttcccttcctcacagaggaggaggaggaggaggctcacgctcgctcagccctactgcacgctcggcctatccttcgtctccggccgccaccaccgcttcctcctccgccgccgccgccgtacgggtactctcccacaaccaacagacgattcattgattgatttgattgtttggattcatttagtagtagtatctaattaccttttagttgtactccttattctttgtattactatccgtcaaaagtattcatcatatcttggatggaaatagcaactcttgtcacaagctctatacagtgcacaaattgggcggcattcaacattttttgtccttgtgctgctcaggctcagctgctgcccaccataagctcgggaaaatgcctgggatcacctggctgctcgccacttcttccttcgtttccataactaccattcctaacctcatctacaaattttctcttgggctggaattagacgtcaacacactaccatctttgtatgaaaaacaggaaagctaaagactaggaaaggaagagatcaggatttcttatacccatctaatttgtcttcgccgctataactgcccatctaccttcctgctttatatagctggatgaaggatattccctttactatatttactatgcctgtattcgtatcgtgctgttccataattctttgccaaattaggcatctcacagcctttgtgtttctttgacttcttcaatgtagagagcaaaagaacaagtcgtggaacgggtgtttatgcttctttatttggagttggagctcccgaagctctggtcattggagtggttgctctgttagtctttggtcccaaaggactagcagaggtaaactctttcccaacaaacctggacatcatatttttgctgttgtccggcttcctattctagctaattcttcactaaaccctcagcattagcaccatattctaatcgcctatagtttcttaacctgttgcatgtactgccagatcgtggtaggttttctgcaaaggtttgaaagcacacactacatacagaaaagaaaaagccttgcaggaaatattttatgttgttgttttcttcactttaaatatgtcatgttgttgttctgctttattttactgtgaatgaaaatgagcatgtacttcctgccaacctttctatcattacgaactgttaggtctcacttgcttgcttgtatgcaggtagccaggaatttggggaagactttgcgtgctttccagccaaccattagagagctacaggttggtttgtgacttgtctgatgtgattccttgatacatatgtaacgtgtctcttttttccgcatataggatgtttcaagggagttcaggagcactcttgaacgagaaattggacttgatgaagttcccccatcaatgaactacaggcccccgaccatgaataatagtcagcaacctgctattgaccaaagttagttgatttaactgctcctaaagttattcagggggaagtcatacccaattagtttaaagcttgaagtccacattagaaattcattcatgtcagtaaaaaatcataattgcaccttgatacatttgcagtgttctgaccgctgggttgttactggttagctccacttatgtatttaccatttccttccgtcctagactcatatcctgcttgtcattcaatgctgttaaaaactaaggtggcattcaaacaagggtcttgacattttcctagccttgagcaagcacacatttttttccctgtgatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 27161 - DNA, 714 bp, Oryza sativa
  unsure (1)..(714): unsure at all n locations
nnnnnnnnnnnnnnnnnnnnnnnnnnnnnnnnnnnnnnnnnnnnnnnnnnnnnnnnnnnnnnnnnnaggccgaattggattccagaacgctgtcacgcccggaatttctatccaaaattctaaacgcttacatgtgtgtgaaccctcgtttaggaatcagccgaggcacacaataacaaattgataatagagtacaattattactctaattaataagcgaataaaatgtcattacagaggtagatagttcctctcaatcaataaagatctaagcagcggaaaaataagataaacggcgcagacgactccactccacaggcagcttgaccagggctacacctaatcctccacaccatcagcatcactgtagaactcctcctctgatgaatgattgcaaggtgagtatatgacatactcagcaagccatgcagcaaatatgcaagtgcacaggataacaaaggatggcatagtagggtttcatttgcataaacagcatttaataaacatttcagaatttaataaaatagttaagtagtaattaaacaatattaatccaacgctatacaacataccctgttgcataggcccaaccattctgaacaactatcccggctgcacagttctatcttcaaaccaggaatataccattccaaaccaggagctaatcaaattattaccaagtatagcatcttttattattgtgaggagtgtgaa

SEQ ID NO: 27162 - DNA, 578 bp, Oryza sativa
agcgcccgatggatttttgaatgatttgtagtttctttaagatgtttctgtgatctgtgaataattttgtttctgaatatgtttcgatctgtatttgtgagggtttgggaatggcgcaatgactacgattgtgagttccggcttgattcgagccggctctttttttttttttgctcgtgcaaacctataggtgccggctctattttggtataggtgccggttgtttttattggtgccaaccaataggtgtcggttggaaacccggcacctatagtcggttcccaaccggcatctatcatggctcttgtactagtggtataggctaactgcagttaattactcggtggtttcgttatttgtcctaaccatggaccattgggtctccatcgccatgtcactgtctcatatctaattggcatcttatggatttatgatgctgagatatgtgaacttccgtgtaaactctcgatggatcgatgtgaaagcttcaaggttttgagcaatagattatctaagatataatggccgagctgattcattcagagtctcaaaattaaatgtttacttggcctattagg

SEQ ID NO: 27163 - DNA, 284 bp, Oryza sativa
ccccgccaccgtatagtggccgtcgtacgatgtggcctgggtgacatcgatcgaggacggacggcgatgatgacgtatgaggcgtgtcgatcggtcgcgtcgcgtcgcgccggcactggctgtgatacgcgcgcgactatcttaattttgatcgatgccgctagcccacagccattcactccacccaccaaatgggagcctacatatatatatatatatatatatatatatatatatatatatatatatatatatatatatatatatatatatatatatatata

SEQ ID NO: 27164 - DNA, 862 bp, Oryza sativa
gcttgaatagccgtcgagttacatttataggtgtggctggtggggttgtgttgctaatatatgattaaggtcgtttttttcaggatcattgttagcagtgtcagatgtttgtattatgtaggcacgacgtattgactttttgtctacctgacattccgctcaaatgatttatgcatgtatttagcgtcaatctatctaaatatcaattgattgtcactgatttatcacactagccctagtagtagcgatataagtgggaaatcccgctacacgtataaaaaccacatttattcccacttgctaatttatagaattgtgataagcgaaaaaaaataagcttgcccaccccacttgcatcttttaatgtagtatgatatagctatgttataaccacaccggctaaaataatgcatatgccgctacctattggatatatttatactggcttataggttgtatgatatttttgggaggttttagacttttattattcttaaatatctttgaagattgttctagagcatgtgtagcacactgagatagttgtgttatggattatgtagtatactaaaagatatgggtgaaagtatatctaagtctctaatgagttttggattgtattagtccctattgtgatattgataatgcatgacgacccctacaaatgaaagcaaggttaaaactctcaaggcatttacattattttttattttgaattcgagtcataggaaatgccacactatggagaggtgttcgagtcaacgctgacttttgtgtctgctcaatgttactttgatctttagagagagacgttgcgcaacacccacatgggaaagatggggttcttataccttccatattg

SEQ ID NO: 27165 - DNA, 1558 bp, Oryza sativa
aagtaacttaggtgattgaagataatcaaatttagattaaagaatataaaatttaggttaaatctatttaacaagctgtaatcccaatagatcagacctaactgagaccgcacggaattgatggcaagtttaatagatttaaaggtttgataaacttatataagatgacagatataacacattaagcgaaagacaacttgcaatcttaaagcaaaacaattatacaggtaagatcagctgaaactcgatattacccctaccgacaatcaatgagcatgttaattcttacaacttcaactacaaattagtaggtcaaacttaattgatgcaaaaccaagttataattgaaattataaggtccaaacatgcttttgattgtgttaacgaccaaatttggtaatatcagtatcggagatgaagatgaaatcgaagcagaatcgaagataggggttttttcggaaacagagtaagaatcggctggagtccggatcggctacgactgggatcggctaatctgagttggactggttaagtaatacagccgattccgacaatatgacccgtgtgcgagattgggtttgagttgatgtgcttcaagatgattgccacgcatggatagagtcctgagaaggcaattgtatctattaattaggatattttatgtaaattccttagagatatgttcgggcaaaagtctgccgcaaagacttacaatatcttagagtttgttagagataagagtcgtgttcaatatggacatatcttgtattcctcgggtataaatagaccccgagccctatgtaaaaaaaacacaacacacatccaatacaattccgtgcatcgccaccttttgctttagttttatttcgacgagttcttgctttcaggttgagctgcaccggtttcgatcttcaacaagaggtaaaactcgtcgtggcgaattatgttcttagggattagtgcttccatcttcatgacattctaatctcgtttatataattcgccgagttatcatatatcttatataatctctagcaatatcgctatctaacccacaatcggctaacatctattaacagacggcagccgattgggttaaatgttgacattgatctagattatataagatatctaccattctatgaatcttctagtagcttgattgtctagatatcattcttcttttcatacttaatgctgcatcaattgagtttgatctattgagtcgtgcttagaatattgatctctagcctgccacctagttgtcgattagaatagcatcggagtttcagccgatcgtatctgatttaactataattatttctatttgctttactgatatgttaaatctgccctttatgccaagatattgctgtatttgaatatattaggcgtttgcttgatattctatgcctgttttaatatcctgacataaggtagtatcggggtatttgctgatacatgctagaactatatgatcggctatgctgtaagcttatatagtcttgttattagtatatatttcggtctaagtgattcattctgtctcggcatggcg

SEQ ID NO: 27166 - DNA, 1759 bp, Oryza sativa
  unsure (1)..(1759): unsure at all n locations
tgaactatcgtggtcagccgaattaccccctaaactcgaaaaccagacattactcacaacgaactttcaataccggacgaattacccccctcggcccaatccagagcgattttgtcctacgtggcgtacgcgtggcaatccagtcagtattttatttaattaaaaaatgtgggtcccacctgtcatactcttcccctcttcctctctcctctctctcttctttctctcttacagggcagcgcgcaggggtgaggaggtgggcggcgatgcacggacgggcggtgggctggaggaggtgtagcgccggcacctgccggcggtggtgtcggtggtggagggtgccgctgcggaggccaaggcggcacgaggtgaggagaccgcggcgagagatgaggaggaggcggcctcgctgtgcggccgcgccgccaccaacagaaacctcgccgcggcgcgctccgtcgcccacgcggccacgccgtcggcgccaccgtcatcaccacgaacacgacgcaggtctgcgcgcccgctgcagcctcgtcggatgcgtcgcctccccggaagacagcctcgccgtcgatgaaagtgtcggcagtggagggcgccgccgcgcggaggccgagctggggcggtcggctccggcacggggaaacgaagncggcgcganacgaagaagggtcgcgaaggaagctcgacacggcagcgggatcgtcgattccttcccgcgagatccgtcgtgggctacgcgcacaccctaaacgcccntgccatgcccgccgccggcctcggggtctcacctgagccgagaaggagagagacagagagatacacacagagagagaaagagggacgacatagcccgctggccgcctcgcctcctcaccgcgcgcgccgcgtgcagcgccgccgcgccctccccgtggaggactcgtctcccgctgcctgcctgagctgagaaggaaagagacacagagagcgagagagggagggacgacctagcccgcctcctccaacgccttcctcggcgccggcgccgcgccatcctcgcactctgctgtcgacccccgcacgccgaccacccgcctgctccaggtgcgtcgtcgtcgccgccgcccactgcctatccacgtgcgctggagagagagagagagagggggggtagaggggaaaaggggtaatgacatgtgggccatatttttttaatttctttttctgattggatttccacgtcggcgccacgtatatgccacgtaggataaaaactgctcaggattgtatggggggtaattcgttcggtatcaatagttcgaggtttaatatgtccggttttgtggtttaggggagtaattcgtaccgtcgcaatagtttagagggtaattcgtactttttccttttagtgatgaaattttcatgacatcataaaaatttccgcccaaacaagccatcatataaatttacatacccaagattttgactgcttatctttattctcttgtacagtgcttgctgccaccatcaagttcatcattatcaggaccaacaagatcaacaaaggtaattctgctagtctgtgagctgctgaagccatttgatgagcaaccctgtaatttggttgaacaaagtaaattcacaagataatgacagcatgtatatatatttgctgatcagttagtggaaactaatagaattgaattgactaaannnnnnnnnnnnnnnnnnnnnnnnnnnnnnnnnnnnnnnnnnnnnnnnnnnnnnnnnnnnn

SEQ ID NO: 27167 - DNA, 718 bp, Oryza sativa
  unsure (1)..(718): unsure at all n locations
agagagggggaagggggggaggggggcaaagcccacagggacccaaccggttgccgngggcagcattttttcttggttcaaacccccatcgntcgattgggtcttaaccgagcaagcgcaaccccctcccttactcgtttccacctctcttgccggaggccaagctagcacgagctcaaaccagcttgctgaccgccttcccctccctcgactaccctctatggcagcctagcgaggtagtagctcgcgccttgactaccttttacgctcctccgtccacctccctcgcatggaggccgggcgagcttgaacttggatgggctcgccgaccacctatccattccttttccgcctccgacttcctcagccacccctcagggcgacagcccgcaccttgaccgcctcatctgtccccgccttcgtgaatgcgctctccctacgtcttgcgcttcttcccgaacgcctccccatcaccagggtccaggagagaagaatgaagcacgcattgccacgtgggccccatgggtttttatttatttttgctaactaggatgccaccgtcagaaaaccaaccacctatagtgtcataggacctaatttagtccagtttctaaggtggggttaggatttagtattgtgtgtacggataatgatattaaacctgatggaaagatgaagaaccttaagtatacttaataccgatatcaacgatgagtcg

SEQ ID NO: 27168 - DNA, 664 bp, Oryza sativa
agatcattttgtgagagagctccacccaactcctccctcatttcaggtagagctaaggacctgtttagcacatagctggagctcagctaaacagtttcagctccacctaaaatggaagcggagctgagtggagcactcgcataaaataaactagagagatgtgaaggtggatttagacaactccacaacttcactacagacctaatttctgaagctaaagttagaagttagagctctattaaacagaccctaaaacacagttggactaagaaacgcttgaagaaaggaaaaaaactgcaatatcttatttctcttgtcaccttcaccaattttctttccccgttggtttgccacctcgccaaaaaaaaaaaaaaaaaaaaaaaaaccagaaccctctcacgtgtggatccaccgttggattggaatggaaccccctcgcgactccgccagccgttacctcgtcctcgacacgccatccttttcctcccccacgtacaaaaccccccctctccccctcgcgctgccacgtatcgatctcccccccctctctctctctctctctctctctctctctcttcgccgcgcggcggaggcgttcgtcgcgagctgtcggcttcccttctcgcgccccccgggggtgtgggcatggagggtcccatcttcc

SEQ ID NO: 27169 - DNA, 725 bp, Oryza sativa
  unsure (1)..(725): unsure at all n locations
aataaagcgacccgaaggacgaatattcaatgccggtaaccgatcagctagtcgatgccgcgtcagggaacaaaattttgagttttatggatgggaccgcaggttataactagatatttatggctgaagagaatatctataaaacggcttttaggtgtcctggtgcaatcggtttatttgagtgggttgtcatgacttttggcttaaagagtgctcgggcaacatatcaaagggccatgaactatatatatcccgatttgatcggctcgttggttgaagtttatattgacgatgtggttgttaaatccaaagaacttgatgatcacatagccgatctaagaaaagtttttgagagaaccaggaagtatggcttgaagatgaatccgacaaaatgtgcttttggtgtatcggctggccagttcttgggatttcttgttcatgaaagagggattgaggtaactcagaggagcattaatgcaatccagaaaattaagcccccggaaaataagaccgagctacaagagatgatcggcaagataaattttgttaggaggtttatctctaaattatctggaaggttggaaccttttacacccttatagcggttgaaagccgatcaagaattcacttgggggcagagcaacaaaaagctttggacaatattaaggaatatctcagttctcctccnnnnnnnnnnnnnnnnnnnnnnnnnnnnnnnnnnnnnn

SEQ ID NO: 27170 - DNA, 580 bp, Oryza sativa
cttgggcatgtattagaagactttacaggcatgcgactgaaagtgctattttggcattctcagcttccctctccgagtttgaactagaccagacaactatccgtaagatggtcatggaattaagagaacatgcaagaagtatagtagaagagaaagctagagaagaagctgggaacgttctgatgcgtatgaaagaaaggtagaatctgctactattatttttggaggaaaacttagcaaacatatcttgacttttcagggatcacacttaccatttttggaacatttatcttatctctacctgtttaattggactctaggttttccactgtgttgagccgtgataaggattccatgcctaggacatggaaaggaaatgaagatatacgtgcaatcactagagaagcacgcttagcggtatattctttcctgttgatcaatattgcactcatttatcctgatctatgctgtagaaacatgatctatgtatcgccttcccactgcagacaaaagacttatgtcggtaatggcagctgtacgtttggacgataaaccagataaaatagatcgggctctaacg

SEQ ID NO: 27171 - DNA, 535 bp, Oryza sativa
  unsure (1)..(535): unsure at all n locations
nnnnnnnnnnnnnnnnnnnnnnnnnnnnnnnnnnnnnnnnnnnnnnnnnnnnnnnnnnnagttagtgagggataactttacagtaagattttattccgtcgtcgaatttggtttaatcagttttttagaactatggtttaatcaattccttaactatgtttagctacgaagttatttttgtctatgccatatattgggccggtactgaccggagtgagatcgaaattgacataccggtatacgacttgttgatctacaataagtgatccttctaccgaatatggctttagtcgatttgaattatgtttaagtgtttaactattaagtaacacatatatatgtttttggattaagtgtttctctcattactaccatcggtgtcaaatattattatttcgcatgaaattttgatgaattgatgttaataatagatttatgatgttgtaccgccagtatagtgtcattcccgtgaaagcagtcgaaggggttactggtatgtcaagccgcgtgcaccttaatagtagagccatgtgga

SEQ ID NO: 27172 - DNA, 1346 bp, Oryza sativa
ggtgctgctggtgaaagtagttgtagtgcccgtggtggtgctccccaaaccctgcccccgccgccgccccgtcgccgtggtagtgcacccgccgccgcctcgccagctccacccccggaagcatctcctcctcgtcgtcgtctcctcgatggggggttggtgggtgggagagagctcggagaaatttctcccggcgatttataccgagggcgcgcgatggcggaggaaattccgcgacggcgacgagaaagacgacgacgacgtgacgtggggtcttggaagctgctaggaagcagcagggttacttggggaccttgaggttggggtggtgaaattaccttttcgcccttggcatgatatatcctccatgattatccatccatgcataggtttgttgctagtagcttatacatgttttttttttaatatcttgaatctatgtttggtgtcttaggtgagatggtgtttgtgttggtatggatgatcgggtgatataaattatatctggtgacgagaacgggttttggattggctggctggttacttgacgtatcagcgcatacaaatagagtagttaacggaaaactgtaggggtacggtaggtgcgtgcaaagttgctttttccgccaatattgaatgtacgtaggacaaaaccgttgcataacaatatagatctaagcggtcgtttgagtgattaaataagtgaacatatttagagtttttttttcttttgaaacgatgacatcatgaaattagaaccgtctgcgtcgagccatatagtagataagtttccctctagttaaaacaggttgtagtagtgtcattacttgcaagtaacaactattgaagaaggtagataaatcagggctagctttcttggttaaagagacaagtttcttatgactgaaaataaatgaaaaaaatatgttgagaagtcttcgcagttcacataatagaattaaccacaagctatcaaatctcactagatacggagatcgtttatgcttctggtgtaataataattgtaccctcatttccattgtgagtgaagaatcgtctttgtattaattagtttaccttaagaaacacttcaaaacatgtcttatattggatttatatgagtcgataagttatgtatctacgtttctcagagcatatcttaacaccataccttcaaatttttatctaagatgtcaaccaacatctaaagggttattcggattaatgccattttaaaccataccattttttggtgaagttgtcaaatatatgcatctatttagttcctcaccgaactcttataaatacataagaaatctacgaaagcttggtgataccggtaaatt

SEQ ID NO: 27173 - DNA, 761 bp, Oryza sativa
  unsure (1)..(761): unsure at all n locations
nnnnnnnnnnnnnnnnnnnnnnnnnnnnnnnnnnnnnnnnnnnnnnnnnnnnnnnnnnnnnnnnnnctcggagagggaagctgagaatgccaaaatagcactttcagtcgcatgcctgtaaagtcttctaatacatgcccaagagtccttttcaccagtttccaagattgactgtacaggtccagcaagtgtatccaagagttttttctgaacattgcggcaacaaaaggtccaagcatgaggatggtttttttaaaaatccaccgtaagaactcatgaaatggggaattctaggaacatgctgaaattgcaataataaaccgtgcactgagtatgaaaaataacctcataattagcctttagttcagccagttttgtaccccgaacagatgttgcatgagcttctatatgctgctccagtttgctcctaacttttgtcgtgtcccactctgcatgcttaaccaaagcatctgcatgacaatggagggacttgatgtcatgtatcgtaaaccaaagatttaaggaatgatgagtttcaaatcacattacttcaaactactaggaatttacttatgttgaacattgccgtatttctagtataatctgaatgaataaactattatttgaaaaacatacacaatatggttggcaggagcaagcacaagaggcttaaaacaagatcaagaagcaaggctcatagtcctagtcgacgtatggtttaaacattcattgaccaataaactatcaaatgagcaccaaac

SEQ ID NO: 27174 - DNA, 767 bp, Oryza sativa
  unsure (1)..(767): unsure at all n locations
nnnnnnnnnnnnnnnnnnnnnnnnnnnnnnnnnnnnnnnnnnnggcggcactgcttgtagcaggggtctctgccatggtggttgtcgtcgtcggcgtcgacctcctgtcgccggtggcggcagtccatgaggcagcgctgcttctcccaccagtcctgctggtgctcgcactgctcacggcagtccggcctggatccgccatggccgccgccgtggtggtgctgctcgtggcggcgccactcgcactgcctcatgcactcctgcttccgccacggctcgtcgcggtagccacggcactcgcggcggcactccttgccgccgccgccgtgcgtgttctcgtcgtcgtcgtcgtcctcctgctgccgctggagacactgctcctcgcactccctcagctgccgctggtcctgcccggcctcccaccggcactgcttcttgcaccaccggagctcctccttcgggtcccgccgaccctcctcctccgccgccgccgccgccacggccaccaggagcagcccggcggcgagcaggaggagcgcgccaccacctttccacttcacacccatggctagctggaagaagctagcaacaaagcaccgagatagtagtcgtacgccgtcgacaggtggtggtggggaatggcgttggaggaggcggaagcgggggtgcatttaagctcggcggagggcggcggcgggggggaggtggcgaggcgacgtgtccgccatgggctcatgcagcgagcccacgtcgcgcgcgggggaggg

SEQ ID NO: 27175 - DNA, 654 bp, Oryza sativa
  unsure (1)..(654): unsure at all n locations
nnnnnnnnnnnnnnnnnnnnnnnnnnnnnnnnnnnnnnnnnnnnnnnnnnnnnnnnnnnnnncttctcattttgagtgattgtagatttcaaagactgcaacccccaaaacacagaacttgttctttagatctgagctagattacatggatgatttccttgacacctcagagagtttcttgttacttcctgttacttgcaaacaagattcaaatactccttcagaatgatttgtgtatcctcaattgaagttcacatttctttgctcaatgctaacaggtaaagtggttctgcaagcagcaatcctaacggcggttgctgtcatcggcctcaccattttcacattctgggcagcccacaggggccatgatttcaccttcatgtatcccttcctggccgccagccttctggtgcttctggcatacctcatcattcaggttatcttcttcttccctgctcaacctgctccgtttttcttttcttctcaagtgctgtctaactcattgtgcaattcaccgtgacccggcagatctgtttccctctggggagggctggcatgacgatctacggctgcctcgccaccgtgctgttttccgccttcatcgtcttcgacaccaatcagctgatcaagcgccacacctacaacgagtacgtc

SEQ ID NO: 27176 - DNA, 335 bp, Oryza sativa
cctccatgcattgttgcttcttccactggtcgtggtggtggcggcactgcttgtagcaggggtctctgccatggtggttgtcgtcgtcggcgtcgacctcctgtcgccggtggcggcagtccatgaggcagcgctgcttctcccaccagtcctgctggtgctcgcactgctcacggcagtccggcctggatccgccatggccgccgccgtggtggtgctgctcgtggcggcgccactcgcactgcctcatgcactcctgcttccgccacggctcgtcgcggtagccacggcactcgcggcggcactccttgccgccgccgccgtgcgtgttctcg

SEQ ID NO: 27177 - DNA, 452 bp, Oryza sativa
  unsure (1)..(452): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaagaagaattggaagaagaaaagttttctcaacacgagggaaaaggtcccttcgaaattgcattattgtaaggggattttgagtatttatctaaaggaaggaacaaatgaggataagagaaaattgcttctaatttgtccaagtgggatatatggcgtaatattcttccattttcatccgaaaggacttttttctatttctctattccactccatctagatctaagaaagaagggtaccgagctcgaattcgccctata

SEQ ID NO: 27178 - DNA, 2856 bp, Oryza sativa
  unsure (1)..(2856): unsure at all n locations
ttcagggagagctaatgcttatgcttattgggtattttggtttgacactgcttcacgcccaaaaagaaggcagctacgtctgagctaaacttggatatggaagtcttctttcgtttagggtgaagtaagaccaagctcatgagcttattatcctaggtcggaacaaattagttgatagtgataggatcccctttttgacgtccccatgcccccccccgtgtggtgtggcggcatggggatgtcaaaaggaaagggatggagtttttctcgcttttggcgtagcaggcctcccaaagggaggcccgcgcgacgggctattagctcagtggtagagcgcgcccctgataattgcgtcgttgtgcctgggctgtgagggctctcagccacatggatagttcaatgtgctcatcagcgcctgacccgaagatgtggatcatccaaggcacattagcatggcgtactcctcctgtttgaatcggagtttgaaaccaaacaaacttctcctcaggaggatagatggggcgattcaggtgagatcccatgtagatctaactttctattcactcgtgggatccgggcggtccggggggggcactacggctcctctcttctcgagaatccatacatcccttatcagtgtatggagagctatctctcgagcacaggttgaggttcgtcctcaatgggaaaatggagcacctaacaacgcatcttcacagaccaagaactacgagatcaccctttcattctggggtgacggagggatcgtaccattcgagcctttttttcatgcttttcccggcggtctggagaaagcagcaatcaataggacttccctaatcctcccttcctgaaaggaagaacgtgaaattctttttcctttccgcagggaccaggaggttggatctagccataagaggaatgcttggtataaataagccacttcttggtcttcgactccctaagtcactacgagcgccctcgatcagtgcaatgggatgtggctatttatctatctcttgactcgaaatgggagcagagcaggtttgaaaaaggatcttagagtgtctagggttgggccaggagggtctcttaacgccttcctttttctgcccatcggagttatttcccaaggacttgccatggtaagggggagaaggggaagaagcacacttgaagagcgcagtacaacggagagttgtatgctgcgttcgggaaggatgaatcgctcccgaaaaggagtctattgattctctcccaattggttggatcgtaggggcgatgatttacttcacgggcgaggtctctggttcaagtccaggatggcccagctgcgccagggaaaagaatagaagaagcatctgactctttcatgcatactccacttggctcggggggatatagctcagttggtagagctccgctcttgcaattgggtcgttgcgattacgggttggctgtctaattgtccaggcggtaatggtagtatcttgtacctgaaccggtggctcactttttctaagtaatggggaagaggactgaaacatgccactgaaagactctactgagacaaaaagatgggctgtcaaaaaggtagaggaggtaggatgggcagttggtcagatctagtatggatcgtacatggacgatagttggagtcggcggctctcctaggcttccctcatctgggatccctggggaagaggatcaagttggcccttgcgaatagcttgatgcactatctcccttcaaccctttgagcgaaatgtggcaaaaggaaggaaaatccatggaccgaccccattatctccaccccgtaggaactacgagatcaccccaaggacgccttcggcgtccaggggtcacggaccgaccatagaccctgttcaataagtggaacacattagccgtccgctctccggttgggcagtaagggtcggagaagggcaatcactcgttcttaaaaccagcattcttaagtttaagatcaaagagtcgggcggaaaaaggggagagctccccgttcctggttctcctgtagctggattccccggaaccacaagaatccttagaatgggattccaactcagcaccttttgttttgagattttgagaagagttgctctttggagagcacagtacgatgaaagttgtaagctgtgttcgggggggagttattgtctatcgttggcctctatggtagaacccgtcggggaggcctgagaggcggtggtttaccctgtggcggatgtcagcggttcgagtccgcttatctccagcccgtgaacttagcggatactatgatagcaccgaattttgccaattcggcagttcgatctatgatttcgcattcatggacgttgataagatccttccatttagtagcaccttaggatggcatagccttaacgttaatggcgaggttcaaaagaggaaaggcttgcggtggatacctaggtacccagagacgaggaagggcgtagcaagcgacgaaatgcttcggggagttgaaaataagcatagatccggagattcccaaataggtcaaccttttgaactgcctgctgaatccatgagcaggcaagagacagggacctgnnnnnnnnnnnnnnnnnnnnnnnnnnnnnnnnnnnnnnnnnnnnnnnnnnnnnnnnnnnnnnnnnnnnnnnnnnnnnnnnnnnnntaaaccgtgaaaacggggttgtgggagagcaatacaagcgttgtgctgctaggcgaagcggttgagtgccgcaccctagatggctaaagtccagtagccgaaagcatcactagcttacgctctgacccgagtagcatggggcacgtggaatcccgtgtgaatcagcaaggacc

SEQ ID NO: 27179 - DNA, 16290 bp, Oryza sativa
  unsure (1)..(16290): unsure at all n locations
nnnnnnnnnnnnnnnnnnnnnnnnnnnnnnnnnnnnnnnnnnnnnnnnnccccaagatgagtgctctctcctccgacttccctagagcctccggtagcacagccgagacagcgacgggttctccacccatacggggatggagcgacagaagcatggaaataggataaggtagcggcgagacgagccgtttaaataggtgtcaagtggaagtgcagtgatgtatgcagctgaggcatcctaacgaacgaacgatttgaaccttgttcctacacgacctgatcaaatcgatcaggcacttgccatctatcttcattgttcaactctttgatgaaaagatgaaaaaaccaaaaaaaagctctgcccttccatctcttggatagatagagagggagggcagaggcctttggtgtcccttccagtcaagaattggggcttcacaattactagccaatatttctctcatgcctttcctcgttcatggttcgatattctggtgtcctaggcgtagaggaaccacaccaatccatcccgaatttggtggttaaactctactgcggtgacgatactgtaggggaggtcctgcggcaaaatagctcgatgccagaatgataaaaagcttaacacctcttatttgactttttcactattttgaaatacgaaaaagatccaaatccaaaatgcaaaggtcgtcttattcaaaacctcaatcatcacatcccctctctcccacttcacacctcggaacgcactgttcttatagagagaaaggggctttcccatcttcttaacccgaaatgaaatggctgaggagagggaggttccttttggggggtacccccgggaagagatccagtggagacggggtgggcctgtagctcagaggattagagcacgtggctacgaaccacggtgtcgggggttcgaatccctcctcgcccacagccttccaaaggggaagggcctttactttccccctgagggtaggaaaaccatgatcgggatagcggacgtaaagctattgaacttgggtatgctctttccttttgtcgaagtggaatcgtagaacagaatgtgatacgatgagataaaatgcaatagaaacaaggatagcgaacgggttacctactcctaagggtcaaagcaagccctttaattcaattctttattcttacattaaagaatgaatcaaatctccccaagtnnnnnnnnnnnnnnnnnnnnnnnnnnnnnnnnnnnnnnnnnnnnnnactgagctactgaggaacaagggggattcgacctcctagagttcaactcccgctctcaacccatgaacaatatgagtccgaagcttctttcgtaactcccggaatttcttcgtagtggctccgttccatgcctcatttcataggtaagcccagagtggctctatttcattctatttcacttcctagcacttcctatcatttaatatccatccctttggtcttattgacataagagatgtcatttatagtctatctctttctatatatggaaagtcaagaaattctcatcgaaacatcgagaaattgtgcatatagaaaactctaaagaaagaaaaaaaggagacccatgccatgattttcaaatcttttctacttagtagtctaagtttctcgatgaggataattaattcggtcgttgcggtcggactctattatgggtttctgaccacattctccatgggtccctcttagatcttctttctccaatcttggattagggaagaaggagatattcgcgactcctggtggtttcattatggggcagctcatgatcttcatatcgatctattatccacctctgcatctattctttcttagctaaacgggtggaagatccatccaatttggttatatcatggactcaaaaaacggatctgaatgtgactgaaatgcacgatcttcacaggtatcacttttcacgatacctaaaaggtggaatagcgattttcgaaccatttcctataagagaaaggtttccattactttgagaaatggattctatatcaaactatagctattgcattaaagaagaaaagaaactaatagaagtcgaagacgcggaatggtagtgaatagagagaaagattcttctggttttcttgttcctgaaaatattctatctatctcctagacgccgtagagaattgagaattttcatgtctttcaattctcgtactcgtaattggaaagttacggaaggagatccatcattttgcaatgaaaactacataaaaaactctggacaatttcgaaatcaggccaagcgtcttaatacatatgcaaaaaaattcattattggcccaccattgattagaagatttaacttgtatgaatcgctattggtttgatacgaataatggcagttgtttcagtatgttaaggatacagatgtatccacaattcatttagagttacttaatagcctatttcttataccatatctctatcccgtgaaattctcgagccgaaagatggatgcatatgctatgtttcattttgctaaatgatatcaattaaacggtgtatcaattccataaattggatatagcaataaataaatcagcaaaattcttttattttagatagaagaaacttttcttctatctaaaataaaagaatgtacccttctatccaaatccaatttgcatcgataaaataaatccaaattccagtagtagatgaataattgcaaatttttgtgtgtacgagattagaataacttcaaaataactgacataattttttatttttcctgatcagaaaaatacatgaaaaagaaaggaggtagaaaaatttttggatttatggttaaagaagaaaaagaagaaaactggggttctgttgaatttcaagtattcagtttcaccaataagatacggagacttgcttcacatttggaattacacaaaaaagatttttcatcggaaagaggtctccgaagacttttgggaaaacgtcaacgtttgctggcttatttggcaaagaaaaatagagtacgttataagaaattaatcagtcagttggatattagggagcggtaatttcatcgttcgaattttttttcttattttattagtagtcttatagtagtcttagattttgcattttgatgagcctcgttttgaggaattcatggaataatccattttcatggaataatgaattaaggaagaaaggatatgagtctaccgcttacaagaaaagatctcatgatagtcaatatgggccctcagcacccatcaatgcatggtgttcttcgactgatcgttactctcgatggtgaagatgttattgattgtgaacccatattaggctatttacacagaggaatggaaaaaatcggcaaataggaaagctacttaggcaggagataggggaattccttaagaaagaaaaaagaataagaacacagatacataacataaaaaaaagaataaataagacgaaattcgacctccccctacatatttaatttcttctcctatacaaaaactagcaagacctactccattggtaattccatcaatgacacccttgtcgaaaaactgcgttagttcggttaatcctcttatacccaaggtaaaggtcctagtatagaaaatatctatataaccgcgattatatgaccaactatatatctttttttttagttgatggaaaaaatactttttcggacccccttttacaaaggaatttattaaatccaaattctgaaaaaaagagtaagcagatccataaaacatatatgctatgaatagaccaaaaatagctagacttacagaagaaattgcattagtgataaattcatatgaatttatggaagaattagaactttcttggaaaaagttgattgagggagttagccactttgataatatggttaattcccctatttcattatcaaaatggattcctatagatccaataaacaaagtacaaagcagtaatataagaagaggaaatagcatagtatttcccggttcatgaggatagacaaaagtgtttttagtccccaatgaagtactaaaggaccctatcctatttcctgtattaacatgaattttggatagattttgtgaaaaaaaagaaactccactcttcgctgttgataaaacgaaatctctattgactcctttagatatcctttttccccataacgatattgaatacaacgaatcctctttagtactactgtaattttgaaaatgaacacgcaaatacccatcaaaagtaagtaaatatatccgaaacatataaaacgcagttaatcctgcagtaaaagaagctattattccaaaaaagggtgaatataaccaactattactaaggatttcatctttggaccagaagcaagcaagaggtggaataccacaaagagaaagggtaccccataaaaaacaagttcttgtaattggaatgtattttcttaaaccacccataagaaccatattctgacttttatctggtgaatatccaacaagaggttccattgaatgaataacagatccggatcccaagaataataaagctttcgaataagcatgagtgatcaaatggaataaagcagcttgataagaacctatacctagagctaacatcatataacccaattgagacattgtagaataggctaagcttcttttaatatctctctgagcaagagctaaagtggctcctaagaaaagtgttagtgtacctattaaagaaatgaaactcattatcaaaggtagggatatgaaaagaggaagaagtcgagctataagaaaaatccccgcagcaaccatagttgctgcgtgtataagagctgaaatgggggtgggtccttccatagcatcgggtaaccatacgtgaagagggaattgtgccgatttcgcaaccgcaccaaggaataataaaaaagcacacaaaatagtaagcaaggagttaatctcattattaggaatccagttattagctattttaaacaaatcccgaaactctaaactacctgttatccaaaaaaaacctagaattcctaataacagaccaaaatcccctacacgattagttacaaaagctttttgacaagcactcgctgcaattggccgtgtaaaccaaaagcctatcaataaataggaacacattcccacaagctcccaaaaaaaataaatttgtatcaaattggaactagtaaccaatcccaacatggaagtattgaaaaaacttatataaacaaaaaatctcaaatatccctcatcgtgagacatataatcatcactataaataagaaccaggattcctacagtagtaattagtattaacataatagaagtaagcgggtcgattaagtatccaaattctaaggaaaaatcattattgacggtccaagaccatagatattgatagatagaacttccatttatttgttgaatagacaggtgaactgagaataccatagctatacttaaaagtaaaacactaggaaaagcccatatgcgacgaagattttttgttgctgttggaacaagaaaaagtccaaaccccattgacataataactggaagtgggagaagagggattacccatgcatattgatatgtatgttccataagaaaagaaattgcaatttttacttgaaaattttacttcaatttttctataaaattgaaaaaagtttccgattcaccaaactaattcttatctatttctgaaggaataaaaaaatactagaattcttaatttttcaaaaattttctcattgaaacaatcaaaaaataagaataggttttgttggttaaagtcaaaaagttaatgaaataacttcgttacctagttattacctaaagaaggacttttattaaaatacaaaaaaaagattgaatcattttactttaatatttttttgtattaaaatgaagcagctcccttgtttcgtaactcaaattgattggaattcaattctggaatactttaattaactatttgattgaattttcccttccttttatcctcccgtcttatatgggggataggcccccataccttatatctgtatatggagagtatacttgaaatataaattgatttaaatagaaaacctttgtatatattctatattattaaaacaaagtctaaaaaaaatatataatatgttaaaaaactcttgtcttatccgcattagacaaaatgaagtaaaaaagaattcagaatttcaatatcttttagtatctaagtataaatactaagaaaaagaagaaagatggattgatttgcggcaatagatgtctttcacatacaactagaaaaaagtaatttcctttttgaatggcagttccaaaaaaacgtacttcgatgtcaaaaaagcgtattcgtaaaaatctttggaagaaaaagacttatttttccatagtacaatcttattctttagcaaaatcaagatcattttctggcgtcagcgagcatccaaaaccaaagggtttttctcggcaacaaacaaataatagggttttgggataatatgaattgacctatcccccaaaaattccaattatttaatatgaataattaggaataattaggattaattaatgagtttacttttatgtgtcgaattcctcggtacaatattcttagaacaaacctctctgatatataaaaaaagggtttttggtatactgtgacctaaatattcttttcctatcaatgaacttttcgtaatagaatccgtataataaataaaaaaaggggattctattatgaaaagtagagtattcctgcaataagacttacaacttctacctatcttatcctaaattaacaaaaaaattagttctatattgcaactgagaaaaaattgttccaactctttcaaagtttctattgggcaaagcaagaatttttttgttaaaaaattcgcaacgatactaccaaacgaagtctattttaatgaagattctaatgtcctaaattctatggaatcttccaatctcgacgattcgcgagaaaataacttaatattcttttaataaacctgttatttcaacttagccgccatggtgaaattggtagacacgctgctcttaggaagcagtgctcaagcatctcggttcgagtccgagtggcggcagtctcgaaaaagaatacaatagattataaaataaaatggattcaattcgaaatttccaattttgtaatgggaccttctccttatgctatttgcaactttagaacatatactaactcatatttctttctcaacaatttcaattgtgattacgattcatttaataaccttattagttcgtgaacttgggggattgcgtgattcgtcagaaaaaggaatgatagccacttttttctgtataacaggattcttagtttctcgttgggcttcttcgggacattttccattaagtaatttatatgagtcattgatcttcctttcatgggctctgtatattcttcatatgattcctaagatacagaactctaaaaatgatttaagcacaataactacgccgagtactattttaacgcaaggctttgccacgtcgggtcttttaactgaaatgcatcaatccacaatactagtacctgctctacaatctcagtggttaatgatgcatgtcagtatgatgttactaagctatgcgactcttttgtgcggatccttattatccgccgctcttctaatgattagatttcgaaagaatttagatttcttttcgaaaaagaagaaaaatgttttaagcaaaacatttttctttaatgagattgaatatttctatgcaaaaagaagtgctttaaaaagcaccttttttcctttatttccaaattattacaaatatcaattaattgagcgtttggattcttggagttatcgtgtcattagtctagggtttacccttttaaccataggtattctttgtggagcagtatgggctaatgaggcgtggggatcctactggaattgggatcctaaagaaacttgggcatttattacttggaccatatttgcaatttatttacatagtagaacaaatccaaattggaagggtacgaagtcagcatttgtagcttccataggatttcttataatttggatctgttattttggtatcaatctattaggaataggtttacatagttatggttcatttacattacccatctaaatgattacataacataaaaccttaatgaaatggaaaaaacttccatttttgtgtttgatttgagaaccccttgaacgccttctcaaagggttctcaaaaattcgagatagatctaattagactcttttacttttttctgaatttttgagtatttccactatggaatatagagcggactagtagaagaaaaaaaatcctatttaggataataattggataacagagcctctaccctgtcaacggatagcgagagaacaaaatctggataaataccgattcctattactggtaaaaagatacagattaaaagaaagagttctcgcgggccggaatcctcaaaattttcgtttggaacatgaaatagcttgtatccatagaacatctgtcgtaacatagataataaataaataggagttaatatcattccaattgccattacaaaagtaattagcatttttggcattaacagaaattttggactagtaattagtccaaaaaatactactaattccgcaacaaaaccactcattcctggtaaggcaagagaagccattgaaaagctactaaacatggtaaaaatttttggcattgggatagaaacccctcccagttcttcgagataaacaaggcgcattctatcacaagccgttcccgctaagaaaaaaagtgtagccccaataaatccatgggataatatttgtaaaatagctccattgagtccaatgttggttatggaaccaattcctataataatgaaacccatgtgagagacggaggagtaggctattctttttttgaaattgcgttggccaagagaagttgaagctgcatagattatttgcatcgctcctattattactaaccaaggggaaaatagataatgagcatgaggtaacaattccatattgatccgaatcaatccgtatgctcccatctttaataggattcccgctaaaagcatacatgtactgtaatgcgcttccccatgggtatctggtaaccacgtatgtaggggtataatcggcaatttgacagcataagcaataaggaagccaaaataaaatagtatttccaatgttgcagggtatgattgattaattaatctttccaaatctaatcttggttcgttggaaccgtataagcccatacctagaactccgattaagaaaaaaatggaaccacctgcagtatacaaaataaactttgtagctgaatagagacgcctcttccccccccacatggataaaagtaagtaaacaggaattaattctaactcccacatgataaaaaaaagtaaaaggtctcgcgaagaaaataatcctatttgaccgctatacattgctagcatcaggaaatagaataatcgggaattccgggtaaccggccaagctgctaaagtagctaaagtagtcataaatcctgtcaataaaatagatcctaatgaaagtccatcgattcccaatctccagtggaaattgaagacatctatccatttagaatcctcttttaattggattaagggatcctccaattggaaatgataacagaatgcataagtcattagaaggaattctaataaacaaatagacatagtataccacctaacgattttgtttcccctatgaggtaaaaagaaaattaatgaacccgcaaatatcggcaaaacaacaagtattgttaaccaaggaaaagaactcatgataaagtgataaagacaagatacgttttgaccagaaaagcccgtgctcgattattttgagcacaggcttcttcggtaaagaggaatcagacgattcaagtggaattttttgtaacgtatcaataagatagagccatgctgcgggttgtctcaggtcctaaataaacgcggacacttaaaaaatctgttgggcaggcggattcgcatctcttacaacccacacaatcttcggttcttggcgcggaagcaatttgcttggctttacatccatcccaaggtatcatttctaatacatctgttggacaagctcgtacacattgagtgcatcctatacatgtatcataaatttttacggaatgtgacattgggtctataaattttccttttcaacataaaaattttcgatctggtcaaaatgaaattagtactatatcaatcaaatgtattgtagacaccagacgaagcaatggtttatccaaacttcaacaaataatgcaatatatttcttaatccgtttgtgagaaagcatgaaaagagccaagagactttaattttgggcttcaacaatcataattatacgaattgtatatacgaattcgaattagccaataaattggctatcgtcttttcaatataaattattgcaatattcaaattgcaatatcaatgaattgcaaaaattcaactaagtaaaaaagaatactatggaataacctactcaaaaaatagatattctcaaataataaatagtattcatgttactatttcatattattattatatgtgtccctttgtttagaagattctatgtctaattattcaaaaaattagattgattgatacgagttgatttcctattacgatggatggaagaaagaatggataatccaatagctgcttcagcagccgcaagggctataacaaaaattgcgaaaatgtctccttttaattggcggctatcaaatagatcagaaaatgttacgagatttagattaattgaattcagtataagttcaaggcatattagagctctaaccatgtttcggcttgtgatcaatccatagataccaatcgaaaataaatagacactcaaaaaaagtacatgctcaaacatcattaactaactccttatcaatctcgattcatttcaatatggggacaagaattgaaccgattgaattaattagaatagaacaattacacaacaaaagagaaaagaaggtatttgttggcagtagatgagttttactaaatcaaaattgtggttctttagtgatttattttagatttgaaattcttataattttgactcattctaagtatttcttattgccgagccatagtaattgcacctattaaagaaactagaagaattatggaaatgagttcaaatggaagataaaaatcggttgctaaatgaatcccaatttgttgaacgttatttatgagaccctgttctactatttggtttgatcttgtagtccaaagaattccataccatgacgtatctgggatagtagtcattagtgaaaaaggaatagttatacaaacgagtgaagtgaacccatctccaatagtccaaaaattcttatctttagaccattctgagccatttacgaacattacggcaaatatgatcaagacatttatagctcccacataaataagaagttgtgccacagctacaaagtaggaattcaataaaatatagaataaggatatacaaacaagaactaatcctagcgaaaaagcagaaaaagttgggttggtaagtaataccacccctagaccccctagtagaagaacaaatcccccaaatagcacaagaatttcatgtattggcccaggtaaatccattatggataagaagaaattaatagtataaattttttcatgaactgactaaaactaaaagattcaaggaagaaaaaagggattaggaaatttttttgtatattgtatataagttctttctatagttagaaatcacatcacgaaaatctactctggtttaaaatcaggaataatttgcaataagcagtaggtattcgtttttctttctagttagtaaagaacttttggattctaacaaaaaaattctagtaatcagtaatcgttcttgaattccaagatttttcttcgtctattttactttgagttgaattcctaattgtttgaattgtgtaatctcccattatggagattggtaaccgactcaaagcaatttgattgtaattcaattcatgacgatcataagtagaaagttcatattcttcagtcattgataaacagtttgtcggacagtactcaacacaattaccacaaaatatacaaactccgaaatcaatactataattaagcaattgtttccttttaatatccttttcaaatctccaatccacaagaggtagatctatagggcatacgcgaacacatacttcacaagcaatacatttatcaaattcaaagtggattcgcccccggaaacgctccgatgtaattgatttttcataggggtagtgaatcgttataggtaaacgatttgtgtgggataaggtaattatgaaactttgaccaatgtaccttgctgcgcgtattgtttgttgaccataactcatgaacccagttaccatagggaacatattcgaaatatctatgaaaaaggtatgtttctttctcttgtttgagaggacttttgtgttgaaaatattcttactgttattgtattatcttattttatagtgaaacaagttgggaagaagttgttaataagagattgcccagggaaataggtaaaagaaatttccatccaagatttaataactgatccattctcatcctgggtaaagtccatcttattgtgatagaaatgaagagaaataaataagctttagttaatgtaataaagatactcattgtcatttctaaaattccaaccattttattcatttggaaaaatccaaaaaaggatatatagggaatagacaaattccacccgcctaagtagagaactgttacaaataaagaggaaactaataaatttaggtaagaaacaagataaaataaaccatatttgataccagaatattcggtttgataacctgctactaattcttcctccgcttctggtaaatcaaagggtaatctttcacattccgccaaagaagaaattagaaaaaccagaaaacctataggctgacgccaaagattccatccaaaaaaaccatattttgactgtgcttcaactatatcaactgtacttgaactgttggataatcatagtcgacgataacatcacagttcccaccgctattccaaaaccgtacatgaaaccttagtttcatacggctcctctatgatcagaaaaaaggaaagtactgtttcatttcgttattatcttcttgggcgtagttagaattatctaagataaaatcgatttcaacgtcctaaattagaccaaaggaattctgtctgctagaataataaaaaacgcttcggaattcatctcatcctttataatataatggtactttttctttgttcagcaataacttaatcttggaataaaacactcgttataacaattaataaacgaaaagagttgggtattagttcatgaagaattctgtatgaatatggataaacgacggaaagaataaataaagatctttttttttgtattgcattccatatcttttgtcctattcttctttccccgaggggtatttaaaaagaaaaaaggaataaagggttaattcgttcttgatagccatttccttaacaagtgaatgggaacatactctggatcggaatccgaagaaagtactacttgctcatttccaccaatttcaagtccttattatgattccttttatgaggaaaaatatctaatgctttagattccctcattactaatcctttatgtactttagtgtttctaatccctcactaacttttgatggattcccttatgattacaactttctgtatcgggaatcccttattattgcccgcttcaagatatgatgactaatcaaaaaatctcaaccttggggtaaagaatttacaccgcttatgtttacttccattttttcttgtacataggaaatgagattttttctttttactacaaattaataagcagttttgtttcactcatatagctatctagtttaacttactaacctgaatatagaataagaaaaggaggataaatattcaatgaatttcagaggaaaaagatcctattttaacgaatcgcacgtagagatattgctagtacacaaaaagttaatgggatttcataactaatagattgagcggcagctcgtagaccacctgaaaaagaatatttattatttgagctatatcctgccataagaagaccaataggagcaatacttgaaatggcaatccataaaaaaacaccaatactaagatccgctaaaacaaagcgatatcccaaaggaataactaaaaaacttaataaaattgatatgactgctatagacggtccaatgctaaataagggaatatcccctcgggatggcaagatatcctctttaaaaagtagcttagttccatctgctatagcttgaagcagtcccagggggccagcatattcaggaccaatacgttgttgtatcgatgcggatatttctctttctaaccacacaattacgagtacttctattgtgattcccagtaagagggtcaaaatgggtagaatccatatcagtccatagacttcttttaataattccaagttcgaaaaagaattgatagcttctacctgtaccctgtctattatcatttcaacgatcaacttctcccataatgatatctatactacctaatatcgtcatgatatcagccaatttcatttttttgactagctgaggaagaatttgcaaattaataaaaccgggtggacgaattttccatctccaggggaaaagactatcatctcctaccagataaattcctaattcaccttttggggcttccactcttgcataaagctcttgttttgacaattcaaaattgggtgaaggttttttaccaagaaatcgatattcaaaatcattccattcggaattctttgctttcttaaagcgtcggacttctaaattctcataagggcccccaggaattttttctacagcctgttgaataattttgatggattccctcatttcaccgattcgtactaaatagcgtgctaatgaatccccttctttttgccattggactttccaatcgaattgattgtaagactcgtaaagatcaactttacgaagatcccattgtattccagaagctcgtaacatggggcccgataagccccaatttacagcttcttctccgctaataaaaccaactccctcaactcgttccaaaaaaatgggattctgtgtaataagttgttgatattcaataactcctcgtaaaaaataatcacagaaatctaaacatttatcgatccatccataaggcagatcggcagcaactcctccgatgcgaaagtaattatgcatcattcgcatacctgtagcagcttcaaatagatcatatattaattctctctctctaaaaatataaaaaaaaggagtctgcgcaccgagatctgccataaaaggtccaagccataacaagtgagaagctatacggctcaattctaacataattaccctaatatagctggctctttggggtatttgaatattctccaagaattctggtgcatttaccgttattgcttctgtaaacatagtagctaaataatcccaacgtgttacataaggtaagtattgtataatagttcggttttccgcgattttttccattcctctgtgtaaatagcctaatatgggttcacaatcaataacatcttcaccatcgagagtaacgatcagtcgaagaacaccatgcattgatgggtgctgagggcccatattgactatcatgagatcttttcttgtaagcggtagactcatatcctttcttccttaattcattattccatgaaaatggattattccatgaattcctcaaaacgaggctcatcaaaatgcaaaatctaagactactataagactactaataaaataagaaaaaaaattcgaacgatgaaattaccgctccctaatatccaactgactgattaatttcttataacgtactctatttttctttgccaaataagccagcaaacgttgacgttttcccaaaagtcttcggagacctctttccgatgaaaaatcttttttgtgtaattccaaatgtgaagcaagtctccgtatcttattggtgaaactgaatacttgaaattcaacagaaccccagttttcttctttttcttctttaaccataaatccaaaaatttttctacctcctttctttttcatgtatt

SEQ ID NO: 27180 - DNA, 733 bp, Oryza sativa
  unsure (1)..(733): unsure at all n locations
ttactaacctgaatatagaataagaaaaggaggataaatattcaatgattttcagaggaaaaagatcctattttaacgaatcgcacgtagagatattgctagtacacaaaaagttaatgggatttcataactaatagattgagcggcagctcgtagaccacttgaaaaagaatatttattatttgagctatatcctgccataagaagaccaataggagcaatacttgaaatggcaatccataaaaaaacaccaatactaagatccgctaaaacaaagcgatatcccaaaggaataactaaaaaacttaataaaattgatatgactgctatagacggtccaatgctaaataagggaatatcccctcgggatggcaagatatcctctttaaaaagtagcttagttccatctgctatagcttgaagcagtcccagggggccagcatattcaggaccaatacgttgttgtatcgatgcggatatttctctttctaaccacacaattacgagtacttctattgtgattcccagtaagagggtcaaaatgggtagaatccatatcagtccatagacttcttttaataattccaagttcgaaaaagaattgatagcttctacctgtaccctgtctattatcatttcaacgatcaacttctcccataatgatatctatactacctaatnnnnnnnnnnnnnnnnnnnnnnnnnnnnnnnnnnnnnnnnnnnnnnnnnnnnn

SEQ ID NO: 27181 - DNA, 596 bp, Oryza sativa
tgttttctctctttcataacagattatctactatttgattttctatttattagatattatattatgctaaccaattaaattctttaaggggaaaggttggattcgaagggatagctttcgcatctacttctctttgtattgtgtcagtataagaatatctttcctaaattctttatccaaacctgttgatcattaacttagattttcccaagatcttgagccctattccgaattattctactattccgaagccggtgaaaattaagtaggaccctcaaaattgaggttttctattgatgccttgaataccatatagcttaccctatagacaaggaacaaagaagagaaaaaaagaattctgtttcgagaccaagcgaaacaggattgctgtgccataggaaggatagctatactaatttggtatactcaaaatacacctttggtacaaaattgacaatctcacaaggatgaaatatcagtaattttctatttactggttgatcccatcttttacggaatcaattccttttttgaatgtacaaaaatttggggagctcagcatgtctggaagcacgggagaacggtcttttgctgat

SEQ ID NO: 27182 - DNA, 461 bp, Oryza sativa
aaaatgggaatatgcgaaatcggtaaacgctacgaatttgattgtattgagctttggtatggaaacctgttaagtggcaacttccaaatccagagaaaccctggaattaaaaaaggggcaatcctgagccaaatccatgttttgagaaaacaagcggttctcgaactagaacccaaaggaaaaggataggtgcagagactcaatgaaagctgttctaacgaatcgagttaattacgttgtgttgctagcggaactcccttctaaattagggaaagaagggctttcgaaatctaatacacacgtatagatactggcatagcaaacgattaatcacagaactcatatcataatataggttctttaattcttttttaaaatgaaaataggaatgattatgaaatagaaaattcataattttttagaattgttgtgaatccattccaatcgaatattgagtaatc

SEQ ID NO: 27183 - DNA, 587 bp, Oryza sativa
aaggcttctttatttctttatgtgcagaaaaataagattgtctagaaccgacgggaccgaattttctcaatgtatttccacacaggatcataatacggatcttttgtagtgtaagtaatataatatggtatgttatgtggctctttctacacacaaatgcaaacccgctatggatggggattatgaatgcggatataggctacgagcataaatgcatgcatatgcggaaccgggtatagcgagtttttttaagtggatcaacaaatactttttgaatagaaagtcaatgtatctaaccaattattttacaggagtatctagttggcgaaggcgatttcagaatcaaaaaaagtaaagtcaaaatcatttagcttattctctcaatttcaatcgaccgctgttagtatatctaatatgaattggcgatcagaacacatatggatagaacttctaaaaggttctcgaaaaagaggtaattttttctgggcctgtattctttttctaggttcactaggattcttagcggttggggcttccagttatcttggtaagaatattatatctgtacttccatctcaacaaattct

SEQ ID NO: 27184 - DNA, 507 bp, Oryza sativa
catgctttctcacaaacggattaagaaatatattgcattatttgttgaagtttggataaaccattgcttcgtctggtgtctacaatacatttgattgatatagtactaatttcattttgaccagatcgaaaatttttatgttgaaaaggaaaatttatagacccaatgtcacattccgtaaaaatttatgatacatgtataggatgcactcaatgtgtacgagcttgtccaacagatgtattagaaatgataccttgggatggatgtaaagccaagcaaattgcttccgcgccaagaaccgaagattgtgtgggttgtaagagatgcgaatccgcctgcccaacagattttttaagtgtccgcgtttatttaggacctgagacaacccgcagcatggctctatcttattgatacgttacaaaaaattccacttgaatcgtctgattcctctttaccgaagaagcctgtgctcaaaataatcgagcacgggcttttctggtcaaaacg

SEQ ID NO: 27185 - DNA, 1030 bp, Oryza sativa
atatccttttttggaatttttccaaatgaataaaatggttggaattttagaaatgacaatgagtatctttattacattaactaaagcttatttatttctcttcatttctatcacaataagatggactttacccaggatgagaatggatcagttattaaatcttggatggaaatttcttttacctatttccctgggcaatctcttattaacaacttcttcccaacttgtttcactataaaataagataatacaataacagtaagaatattttcaacacaaaagtcctctcaaacaagagaaagaaacatacctttttcatagatatttcgaatatgttccctatggtaactgggttcatgagttatggtcaacaaacaatacgcgcagcaaggtacattggtcaaagtttcataattaccttatcccacacaaatcgtttacctataacgattcactacccctatgaaaaatcaattacatcggagcgtttccgggggcgaatccactttgaatttgataaatgtattgcttgtgaagtatgtgttcgcgtatgccctatagatctacctcttgtggattggagatttgaaaaggatattaaaaggaaacaattgcttaattatagtattgatttcggagtttgtatattttgtggtaattgtgttgagtactgtccgacaaactgtttatcaatgactgaagaatatgaactttctacttatgatcgtcatgaattgaattacaatcaaattgctttgagtcggttaccaatctccataatgggagattacacaattcaaacaattaggaattcaactcaaagtaaaatagacgaagaaaaatcttggaattcaagaacgattactgattactagaatttttttgttagaatccaaaagttctttactaactagaaagaaaaacgaatacctactgcttattgcaaattattcctgattttaaaccagagtagattttcgtgatgtgatttctaactatagaaagaacttatatacaatatacaaaaaaa

SEQ ID NO: 27186 - DNA, 957 bp, Oryza sativa
aaaatgaatgcatttccatactataataaaaagtaagtgtaataaatagagaattggatcatgtcacatgacttattccatttctactctatgggatcttacggagcctcttcatggatgacatggttgaggtatgatcatagaaaatattctcctcaagtgaaccagcctatccttactagacaggggacttacgtgttgattggatatggagacacctttggtcgtgaattctaatgtggcagatccaactctctatctgcatggccaaatcaataattcaagtcgcacactcccataatccgccttcttttctttcgtaaaattaacttcaactatttgtattatttgtatcacaatagttcggagttgaagagaagtatctaaatgacatgtcttattttagaataacccatgtttgtagcaatgaaataccacaacctacccgatatgatatatgagaattagaactctctatgagatgccttccttataaagggcccgaaataccttgcttacgtatcattagaaagtgcattaacataaatacggcagtaagcagaggaagtacaaaggtatgtaaactataaaaacgagtcaaagtggattgacccacactagcacttccacgtaataactccactaaaggtgatcctattaccggaatcgcgtcaggcacacctgtcacaattttgactgcccaataaccaatttgatcccaaggtaaagaataaccagttacaccaaacgatgcagttaatacagctaaaaccacaccagtgacccaagttaattcgcggggttttttaaacccacctgtgagatacacacgaaatacgtgcaggatcatcattagaaccatcatacttgctgaccatcgatgaactgatcggattaaccaaccaaagttggcctcgggcattatgtattgaaccgaggaaaaaacctctgtaacgg

SEQ ID NO: 27187 - DNA, 1525 bp, Oryza sativa
  unsure (1)..(1525): unsure at all n locations
accgcgtttgggcaaccctctcaacaattaagagatccattcaaagaacacggggactaattgaagtaaaaagtctcccagatggggagacttcttacttcaattaaattatttcacttttttagtcggaaccttaggtggttctcggaagaagatagcgaaaaaaattatccctaaagtcgaaactaaaaggaacgtataaaccaatgcttccatagattcgatcgtggtttatttacaattataacttccacacctattcatttgtcatttgggatcatttcccgtataaaaaaggaaaaagagtcaaagaagggatgggagatgtttcccatgtcaaatcaaaaaagagaggtgaaagataccaaagcaatgcggcctcagactggctgtctcctcgtagttggatctccgactttttggaatgttccaaattccacttgagcatccaagtctggatcaataccagcaaaaacatctcggaacaaggttctagccccatgccaaatgtgtccgaaaaagaagagcaaagcaaaggtagcatgaccaaaagtgaaccaaccccttggactgctgcgaaaaacaccatctgatttcaaagtagcccgatctaattcaaaaatttcccctaattgggaacgcctcgcatatttttttacagtagcaggatcagaataacttactccattaagttcgccaccatagaactccaccgttacgcctacttgttcaacactatatttggattctgctcttctaaaaggaacgtccgctctcacaattccctcttcatctaccaaaacaaccggaaatgtttcaaaaaaagtaggcatacggcgtacaaaaagttcgcgcccttctttatctctaaagataggatgtcctaaccatccaacagctattccatccccattgtccattgagcctgctctgaataatcccccctttgccggattattaccaatataatcataaaaggctaatttttcgggaattttagaccaagcttctgataaactgagattttcggctaacccatcactaactcttcgatatatttcttgctgaaagtatccctgatcccactgataacgagtaggcccaaacaattcaattggggtagttgctgacccataccacatagttccggcaactacgaaagctgcaaaaaaaacagcagcgatactactggaaagtacagtttcaatattgcccatacgtaatcctttgtatagacgttgaggtggacggacactaagatggaataggcccgctaatatgcccaatgtacccgcagcaatatgatgagaagctattccccccggaacaaaaggatcaaaaccttctgcaccccacgccggatttacagcttgtacttttccagttagtccataaggatcagacacccatatcccaggaccatacaaacccgttacatgaaatgcgccaaagccaaagcaagccacccctgcaagaaataaatgaatnnnnnnnnnnnnnnnnnnnnnnnnnnnnnnnnnnnnnn

SEQ ID NO: 27188 - DNA, 626 bp, Oryza sativa
caagatataggaaagaaggcattgctttcttttttttcatttttgatctgtaaattgagttgttaatgaatccgctttattcgctgactctatatgatatttctttttctttgaaggaaaaattctataacaaggtttgagaccttgtatctattcctcttttttctatactagtagaatttcattgcattgagttctttcttagatctagatggagtggaatagagaaatagaaaaaagtcctttcggatgaaaatggaagaatattacgccatatatcccacttggacaaattagaagcaattttctcttatcctcatttgttccttcctttagataaatactcaaaatccccttacaataatgcaatttcgaagggaccttttccctcgtgttgagaaaacttttcttcttccaattcttcttcattcaattcatttcaaaaaattcaattggtactcaaaatacttccattggtatgcgcaagaaataagccaattccgcagctttttgttcattttctcgtggagtaaaaaacttcttatcagtacgagtcaagggaatgcccccctggcccccgaaattccttttaaaggataccaccaagaaaaaaaccttcttaacct

SEQ ID NO: 27189 - DNA, 1004 bp, Oryza sativa
  unsure (1)..(1004): unsure at all n locations
tcttttttcttgcttatggggaaaaagtctttttcaaggattctatagaaatttcatatatgaaaccgagatagttacctttcagaaaattcggacgaaggatataggtctatctatgcttcatttttctgcaggtgggagaaaagatcaaactgattattgatcaaaatttagggtttgaaacttaggtaattaacttcttctgcgtaacccaagaagaaattggatcgatttttgagaaatcgaattcagttaagacaagggaaattaagatagcaatttctgagccgtatgaggtaggaaactctcaagtacggttctaggggaaggaactacctattccgaccggggagaacaggccattctacagggtgattcagaaattgcagaagcttggtttgatcaagctgctgagtattggaaacaagctatagcgcttactccgggaaattatattgaagcacagaactggttgaagattacaaagcgctttgaatttgaataagaccactctcctttttcagaaaatgggggtttggttgttgatccattaatcaaataaattaggtcggaagatcgaatcaagaatttcattatatctctttcctctgccttctattttatattatatttcataaggataaacgatagggtctagaatagaagtaataaagcgaataaaaaggggcaatataaatattgctaatatatcaggaccatcttattaataattctaatgagttatcttggaatttggaatcgaataaaaaaatctatattatgctcaaggaaagtagatatagatagggacttatactcttaaaaaaaatagactagctttttaaattaaaaaaaggtttttttgttacgtggagaaatccaagataaaaaaagtccgttaggcacccaatccttatgtcataatagatccgaacacttgcctcagattgacttcaatatataattnnnnnnnnnnnnnnnnnnnnnnnnnnnnnnnnnnnnnn

SEQ ID NO: 27190 - DNA, 702 bp, Oryza sativa
  unsure (1)..(702): unsure at all n locations
cgctagactacatagagtaatgaattcaacgattcaaaaaaaactaacagatggaggaaattgcacaaggaatcctggtctcaaagaaaaagaaaatggggatatggcgaaatcggtagacgctacggacttgattgtattgagccttggtatggaaacctgctaagtggcaacttccaaattcagagaaaccctggaattaaaaaaggggcaatcctgagccaaatccatgttttgagaaaacaagcggttctcgaactagaacccaaaggaaaaggataggtgcagagactcaatggaagctgttctaacgaatcgagttaattacgttgtgttgctagcggaactcccttctaaattagggaaagaagggctttcgaaatctaatacacacgtatagatactggcatagcaaacgattaatcacagaactcatatcataatataggttctttaattcttttttaaaatgaaaataggaatgattatgaaatagaaaattcataatttttttagaattgttgtgaatccattccaatcgaatattgagtaatcaaatccttcaattcatagttttcgaaatctttttaaaagcggattaatcggacgaggataaagagagagtcccattctacatgtcaatnnnnnnnnnnnnnnnnnnnnnnnnnnnnnnnnnnnnnnnnnnnnnnnnnnnnnnnnnnn

SEQ ID NO: 27191 - DNA, 718 bp, Oryza sativa
aagcttgcatgcctgcagggtgggatggcggaaccccaaccaaaaaaattgtcttatttgataaggttatgaattaacaaataagacaggaaagagtaaatattcgcccgcgaaatttttattgaattagaatactttaccgcgattcaataagagtaaaataaaaaaaggagattaaaaaaaaaaaaaaaaagaattacattaaatatagaatatagataaataaacatacacatctagatatattctagatcctctttcttgactatatattttagtattttaataaattcaatattaaaaaccctaacctttcctattaatgtgtatctatccgtaatattttagaatattgtggaattagagaaatttgcacactttctcatttgattcgcgaggagctggatgagaagaaactctcatgtccagttttgcagtagagatggaactaagagagaaccatcgactataaccccaaaagaaccagatttcgtaaacaacatagaggaagaatgaagggaaaatcctaccgaggcaattgtatttgttttggtagatatgctcttcaagcacttgaacccacttggattacggcgaggcagatagaagcaggacgaagagcaatgacacgatatgcacgtcgtgggggaaaaatctggtacgtatatttcccgacaaaccggttacaataagaccgaccgaaacacgtatgggttcg

SEQ ID NO: 27192 - DNA, 1764 bp, Oryza sativa
  unsure (1)..(1764): unsure at all n locations
nnnnnnnnnnnnnnnnnnnnnnnnnnnnnnnnnnnnnnnnnnnnnnncacataataaaaaaatggactcaggctcaagttccgaagtaattacacatatagaaattcaaaaagaaatcgatacaatccacgtcataatccatattggattccccaatttattaaagaaaaaaggagcaatcgaagaattagagaaagatctacaaaaagaagttaattctgtaaaccagagacttaatattgggatcgaaaaagtgaaagaaccttatagacaacctaacattcttgcagaatatatagctttccaattaaaaaatagagtttcattccgaaaggcaatgaaaaaagccattgaattaactaaaaaaacagatataaagggagtaaaagtaaaaattgcaggccgtctcgcgggaaaagaaattgcgcgtgccgagtgcatcaaaaaaggtagacttcccctccaaacaattcgcgctaaaattgattattgctgctatccaattcgaactatctatggagtattaggagttaaaatttggatattcgtagacgaagaataaccaaccctgtcttcccattctgttcagtaatagaataaaaaatgacaagagccttattttccctaaaatccctgaaaaaaagaagaaattctacctctttctataagatttaatgaaaattgagaaatcttttaataaaattgctatgcttagtgtgtgactcgttagtttttttttagggttcaaaaaggggattaaaaaaaaatagaatgaaccctactatgtaattatagaaaatgaactaataaccaacctattgcttcgtattgtcgagatcctaactaagaaacagtcactatatgaataaatacatctatcataaatgagtaaatctatcatatacgtgtagcaactgcaattttttctttaaaaaaaaataggattctaagttgtgaagcaaaactaaaggggatgtagataaaaggaaggatgatagaaagaaggaagagaaataagaaagatataggattccaatatgtatggtctatgaattacatcataaaaagcaatgtgataaagcatcaatataataaaaataacagagaattcgaaatcgtaatttgattgaaacaagaaatacaaatttcaaggaataacaaagagcgtcccgagttaataaaactgagaaattgactcggaaagaaattttttggaagctccattgcgagattcaaacctaaccattaaaggagaagcagtgggaacgacagaacctatgactggataggattttcttgaaaagaatcccaatacttcattgggtgggatggcggaacaaaccaaaaaaattgtcttatttgataaggttatgaattaacaaataagacaggaaagagtaaatattcgcccgcgaaatttttattgaattagaatactttaccgcgattcaataagagtaaaataaaaaaaggagattaaaaaaaaaaaaaaaaagaattacattaaatatagaatatagataaataaacatacacatctagatatattctagatcctctttcttgactatatattttagtattttaataaattcaatattaaaaaccctaacctttcctattaatgtgtatctatccgtaatattttagaatattgtggaattagagaaatttgcacactttctcatttgattcgcgaggagctggatgagaagaaactctcatgtccagttttgcagtagagatggaactaagagagaacca

SEQ ID NO: 27193 - DNA, 522 bp, Oryza sativa
ataagtctattggaactggctctctatccatggaatctcatccatcatccatacataacgaattggtatggtatattcataccataacataagaacaataagaactcgaattcttatcgatactggaactcagagcataggagggaaagtcgatttatggatggaatcaaatacgcagtatttacagaaaaaagtcttcgtttattgggaaagaatcaatatacttttaatgtcgaatcgggattcactaagacagaaataaagcattgggtcgaactcttctttggtgttaaggtagtagctgtgaatagccatcgactacccggaaagggtagaagaatgggccctattctaggacatacaatgcattacagacgtatgatcattacccttcaaccgggttattctattccacttctagatagagaaaaaaactaaaggagaatacttaataatacggcgaaacatttatacaaaacacctatcccgagcacacgcaagggaaccatagataggcaagtg

SEQ ID NO: 27194 - DNA, 818 bp, Oryza sativa
tccgtcccagattttttctgatgaaacgaaagatgaaatcgtattgtattctgcacgagacataaagtttattaaagagaatttttttctcttataaactcttagattcgatgcagtcctaatgcgttcattttctgtctcagaaaacataatccagtgtcaagtccagtcaaattgaaaatctttttttcatgaaaaaattttaaacttgacgtagaacattgtataaaaaacgagacctattcctttatggtagagatagatttatgatagagataaattttttttatagtattttattagtaaaaaaggttccttcttctttttctttctttggttaagcaaaaacgatctcgatccgcgattttttaaatatccagaatgatccatcccggtaaagataagataagaactgctcgttagatagaatggattcaattttgatttggagttgcttcttttaggtaaaagaaaaaataagtaaaagcaaagaccttaattttactttacaggaaatgcgttttttttacttcatttttttctttcttttggtattcgagtcgaagaaatacgagaattctataactaccaaaaaactttcttttcattgcaatagtttaactagttaatagttaattagttttgttacggaaaaatggtatggaaaaatagattgctaatctaatatattaattaaattaattaaacgggaggttgatagtttatttgttggagaagagtcaattcttctcttatcatttcaggattggattgatcatctcgagtcctttgtgaggatgggaactccatattaaata

SEQ ID NO: 27195 - DNA, 7398 bp, Oryza sativa
  unsure (1)..(7398): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggcaatttggcgaagaaaaaactagtcggataaataacagaattaaaacaaatacaggttaaactaagtatattaggcataacaagcgtttcgttcttgtagagtagataattggattttgattgagttatttttctaagggaaaaaggaaaaggaggattcaaaatccttttttcttcggactttcccaaacacaaaatacctccttgtattcgcactctcaaatgagagtggaagaaattcgactttcatataatatcttaatagaattccatgtaatgatcaatgcattttttggattctatattattcgcatgtctagaatcctaccaagagaataccccccatttttatgtaattgaagtaggattgacgaataagaaataaacataatactgtttattagtgtcgcataaaacccgaaatggggcgtggccaagtggtaaggcagcgggttttgaaggttcgaatccttccnnnnnnnnnnnnnnnnnnnngttcaaatccttccgtcccagattttttctgatgaaacgaaagatgaaatcgtattgtattctgcacgagacataaagtttattaaagagaatttttttctcttataaactcttagattcgatgcagtcctaatgcgttcattttctgtctcagaaaacataatccagtgtcaagtccagtcaaattgaaaatctttttttcatgaaaaaattttaaacttgacgtagaacattgtataaaaaacgagacctattcctttatggtagagatagatttatgatagagataaattttttttatagtattttattagtaaaaaaggttccttcttctttttctttctttggttaagcaaaaacgatctcgatccgcgattttttaaatatccagaatgatccatcccggtaaagataagataagaactgctcgttagatagaatggattcaattttgatttggagttgcttcttttaggtaaaagaaaaaataagtaaaagcaaagaccttaattttactttacaggaaatgcgttttttttacttcatttttttctttcttttggtattcgagtcgaagaaatacgagaattctataactaccaaaaaactttcttttcattgcaatagtttaactagttaatagttaattagttttgttacggaaaaatggtatggaaaaatagattgctaatctaatatattaattaaattaattaaacgggaggttgatagtttatttgttggagaagagtcaattcttctcttatcatttcaggattggattgatcatctcgagtcctctgttgaggatggaaattccataataaataagtcttaagcaaacttgtttattcccttttttcgaactatatttcattcatatgatagaatatgggtttaaataaattggctctttgcggagtctttcccgataaatacttaatttcttttattcatatttctccatagatagcaaagcaagtttgaattagtatacaaaaaacgaaactaatgactattcatgattccatccatattggatcaattccctataacactttgcaatgaaattagaggaatgttatgttaaaacttcgtttaaaacgatgtggtagaaagcaacgtgcgacttgaaggacacgatcgattgtggattttgctatccaccattttccatagtaatgaaaatgctcttggctcgacatagtctgttctattcgtcccgaaccgaattttcgctgggttgtttgtaagtaagctaagtaaatagtacacgatggagctcgagaggacagaatttattttttatcaagggaaagaatctagggttagtgaaaactaataaattaggccaactttgtcattctacccttaatatagaaatcgaaataatatagaaatcaaaaggttaaaataagaagaaagtccaattttggaagatatgggaaaactcttttgattaaaagtctatcagaatcaatcgctcatattcgatttctatagaagagggaaatgctttatcgaaggaaataagaaaaaagggtatgttgctactcttttgaaagaaaaaagaataagaattcccgaagtaatgtttaaacccaaggatttcacaaatcaaagataaaggattcccgaacaagtaaacacgattttcaactgtctcaacaatagaattggaccggaataaggaataaaagtgaatttgttcgagatgaggcaaagaaaagagtttagagacgactcaaaaaatttcaaaggatttttttctttcaagtctgtcaatcaaaattagtcaacttgagtcatgagtataaatgaaatttgttttttctgtacggaaattaatgcaagtcatattctcgagccgtatgaggagaaaacctcctatacgtttctagggggggctttgtttatctacatctatcccaataagctgtctatcgaatcgttgcaattgatgttcgatctcgaagagaaggaagagatcttcgaaaagtaggtttttatgatccgataaagaatcaaacttgtttaaatgttccagctattctctatttccttgaaaaaggtgctcaacctacaagaaccgtttctgatattttaaggaaggcggaattctttaaagaaaaagaaagaactttgagttaattgaagaactaaatgaataaaaaactaggagaggctcactagtatcccttgttgtctaactatttagaaataatttgcctctttcttaatcctatttttgactggatttatgtcgtgccaatccaacataagcctttatttttttgagtttttctatctaatttttttcttaccattgtatttccattgacaaaggtccattgaacatctagaatttgtagatggataagtctctttatcctcactccctattaggttttttgcctacactttgctcaaatggtagggttgtccctcttgtttgtactctcatacaagatttatttatttatttaaataaaaatgctaaaaaaatgacaattttacgatcgtgattggtgccacttttaaccttagtgaaatttaaccagacccgttccttttggtatctgagtgttttcaatggtgataaaatctttcttttaatgtcttgctattttaagattttgacaggggtgtgcggtgtaattccattgatttttggatttcgatcgtatctaagatcctagtttatctgggttgctaactcaatggtagagtactcggcttttaagtgcgactatgatcttttacacatttggatgaagcaaaaaattcgtccagactcttggtagagtctataagaccgcgactgatcctcaagggtaatgaatggaaaaaatagcatgtcgtaataaaatcaatttcttattttggatttttggaatggaataaaaaaattctgattttctgggtctaatgaataaatggatagagcctggctccaattctggtaaaacaaaaagcaacgagcttaacttcttaattggaagaactccctgatctaattagacgttaaaaatagattagtgcctgatgtagggaaaagctggttttcctatgagtagacctttgattttttcttttttttttagaaatcctaattattcttgattttggattgaaaaggatgttatggattgaatgtgtaaaagaagcagtatattgataaagagactgtatcccaaagtcaaaagagcaattggcctgcaaaaataaaggatttgttctcttttgtaattagaacaaacataaacaaattggatagaaaaggagcggaaaaagatccgtggattagactccttttcttccccaggggtttgtattaaaaaatgcaacaccctgttctgaccatattgtactatgtatcaccatttgataaaccgagaaatatttctctctctctgattcaagtagaaatacaaatggaaaaattcgagggttattcagaaaaacttaaatttcctagacaatatttcgtctacccactactctttcaggagtacatttatgtgtttgcccatgattatggattaaatggttccgaacttgtcgaaattattggttctaataacaagaaatttagttcactacttgtgaaacggttaatgattcgaatgtatcagcagaatttttggattaatttggttaatcatcctaaccaagatcgattattggattacaacaattttttttattctgagttttattctcagattctatctgaggggtttgcgatcgttgtagaaatcccattctcgctacgagaacagtcttgtccggaagaaaaagaaataccaaagtttcagaatttacgatctattcattcaatatttccttttttagaagacaaatttttgcacttacattatctagcacatatagaaataccctatcctatccatttggatatcttgcttcaactccttcaataccggatccaagatgttccatccttgcatttattgcgattctttctcaactactactcgaattggaatagttttattacttcaatgaaatccatttttattttgaaaaaagaaaataaaagactatttcggttcctatataactcttatgtatcagaatatgaatttttcttgttgtttcttcgtaaacaatcttcttgcttgcgattaacttcttccggaacctttctggaacgaatcatcttttctaggaagatggaacattttgggttaatgtaccctgctttttttcggaaaaccatatggttcgttatggatccccttatgcattatgttcgatatcaaggaaaggcaattcttgcatcaaaaggaactcttcttttgaagaagaaatggaaatgttaccttgtccgtttgtggcaatattctttctctttttggactcaaccgcaaaggatccatctaaaccaattagaaaactcttgcttcgattttctggggtacttttcaagtgtaccaataaattctttgttagtaaggaatcaaatgctggagaattcatttctaatagatactcaaatgaaaaaattcgataccaaagtccctgttactcctctcattggatctttagcaaaagcccaattttgtactggatcggggcatcctattagtaaaccaatttggaccgatttatcggattgggatattcttgatcggtttggtcggatatgtagaaatctttttcattatcacagtggatcttcaaaaaagaagactttgtatcgactaaagtatatacttcgactttcatgcgctagaactttagctcgtaaacataaaagcacggtacgagcttttatgcaatggttgggttcggtatttttagaagaattttttacggaagaagagcaagttttttctttgatgttcgccaaaacaacttacttttctttccgtggatcgcacagtgagcgtatttggtatttggatattctccgtatcaatgatctggtgaatcctcttaattaatcattaaacaaaactaataaactagaaatgattgataaatgatcaaggtaaaactttcacagtttccattctgaaatgttctctgtactataataaatagtaagtgaatcaacttactactaaaaaaattagtagacttcctcttcggaatagaaatagcctatttctacatagggaaagtcgtgtgcaatgaaaaatgcaagcacgatttggggagaggttttttctctattgtaacaaggaataattatctactccatccgactagttccgggttcgagtcccgggcaacccatatggaaactagaaaggagcaatctgagttttgatttttcactcacttcatttacaaaattttttggtttggtaaattttgttgtatggatatacaactgtcggggctggcttggttgacattggtatatagtctatattatactgttaaataacaagccttctattatctttctagttaatacgtgtgcttgggagtccttgcaatttgaataaaccaagatcttaccatgactgcaattttagagagacgcgaaagtacaagcctgtggggtcgcttctgcaactggataactagcaccgaaaaccgtctttacatcggatggttcggtgttttgatgatccctaccttattgaccgcaacttctgtatttattatcgccttcatcgctgcccctccagtagatattgatggtattcgtgagcctgtttctggttctttactttacggaaacaatattatctctggtgccattattcctacttctgcggcgatcggattgcacttttacccaatttgggaagctgcatctgttgatgagtggttatacaatggtggtccttatgagctaattgttctacacttcttacttggtgtagcttgttatatgggtcgtgagtgggaactgagtttccgtctgggtatgcgtccttggattgctgttgcatattcagctcctgttgcagctgctactgctgttttcttgatttaccctattggtcaaggaagtttctctgatggtatgcctttaggaatatctggtactttcaactttatgattgtattccaggcagagcataacatccttatgcatccatttcacatgttaggtgtagctggtgtattcggcggttccctattcagtgctatgcatggttccttggtaacctctagtttgatcagggaaaccactgaaaacgaatctgctaatgagggttacagatttggtcaagaggaagaaacttataatattgtggccgctcatggttattttggccgattaatcttccaatatgctagttttaacaactctcgttctttacacttcttcttggctgcttggcctgtagtagggatttggttcactgctttaggtattagtactatggctttcaatctaaacggattcaatttcaaccaatctgtagttgatagccaaggtcgcgttattaatacttgggctgatatcatcaaccgtgctaatcttggtatggaagtaatgcacgaacgtaatgctcacaacttccctctagacctagctgctcttgaagttccatctcttaatggataaggcttttctgctaacatatagcaatttttgaagaaaggaaagctagaaatacccaatatcttgctgaagcaagatattgggtatttcttttttttttattttgaatctttctattctgaattcagttaacgacgagatttagtatcctttcttgcactttcataactcgtgaaatgccgagttggtacgaattcccccaatttgcgacctacc

SEQ ID NO: 27196 - DNA, 703 bp, Oryza sativa
aacaactctgctgcccacgatggatttttatctaggcggaagagtcctctcaatatttatctagtcccatatgggtttcggtatattgaaatataaacagaaaagagagggtagaggataggctcattacattaaaaaaaatatggaagtagccatagcaaaaaaagaaaaaagggagcgtgagagccaaatgaatcgaaagattcatgtttggttcgggaagagatcataaaagttgtaaacttaatagcaaggtaatctactttcattaaaagatttattagataatcgaaaacagaggatcttgagtactattcgaaattcggaagaattgcgtagaggaaccattgagcagctcgaaaaagctcgaattcgattacagaaagtcgaactagaagcggatgagtatcgaatgaatggatactctgagatagaacgagaaaaagcaaatttgattaatgccacttctattagtttggaacaattagaaaagtctaaaaacgaaaccctttattttgaaaaacaaagggcgatgaatcaggtccgacaacgggttttccaacaagccgtacaaggagctctaggaactctgaatagttgtttgaataccgagttacatttccgtacgattcgtgctaatattagcattctcggggccatggaatggaagagttaaattaattaggccttgaacttctacttt

SEQ ID NO: 27197 - DNA, 1246 bp, Oryza sativa
  unsure (1)..(1246): unsure at all n locations
nnnnnnnnnnnnnnnnnnnnnnnnnnnnnnnnnnnnnnnnnnnnnnnnnnnnncggagaggataactgctgaaagcatataagtagtaagcccaccccaagatgagtgctctctcctccgacttccctagagcctccggtagcacagccgagacagcgacgggttctccacccatacggggatggagcgacagaagcatggaaataggataaggtagcggcgagacgagccgtttaaataggtgtcaagtggaagtgcagtgatgtatgcagctgaggcatcctaacgaacgaacgatttgaaccttgttcctacacgacctgatcaaatcgatcaggcacttgccatctatcttcattgttcaactctttgatgaaaagatgaaaaaaccaaaaaaaagctctgcccttccatctcttggatagatagagagggagggcagaggcctttggtgtcccttccagtcaagaattggggcttcacaattactagccaatatttctctcatgcctttcctcgttcatggttcgatattctggtgtcctaggcgtagaggaaccacaccaatccatcccgaatttggtggttaaactctactgcggtgacgatactgtaggggaggtcctgcggcaaaatagctcgatgccagaatgataaaaagcttaacacctcttatttgactttttcactattttgaaatacgaaaaagatccaaatccaaaatgcaaaggtcgtcttattcaaaacctcaatcatcacatcccctctctcccacttcacacctcggaacgcactgttcttatagagagaaaggggctttcccatcttcttaacccgaaatgaaatggctgaggagagggaggttccttttggggggtacccccgggaagagatccagtggagacggggtgggcctgtagctcagaggattagagcacgtggctacgaaccacggtgtcgggggttcgaatccctcctcgcccacagccttccaaaggggaagggcctttactttccccctgagggtaggaaaaccatgatcgggatagcggacgtaaagctattgaacttgggtatgctctttccttttgtcgaagtggaatcgtagaacagaatgtgatacgatgagataaaatgcaatagaaacaaggatagcgaacgggttacctactcctaagggtcaaagcaagccctttaattcaattctttattcttacattaaagaatgaatcaaatctccccaagt

SEQ ID NO: 27198 - DNA, 667 bp, Oryza sativa
  unsure (1)..(667): unsure at all n locations
tcctaggggtaaagaacccacaccaatccattccgaatttggtggttaaccttacttcggtaacaaaactgtaaggggaggtcctgcggcaaaatagctcgatgccagaatgataaaaagcttaacaccctcttatttgactttttcggtattttgaaatagaaaaaagtccaaatccaaaatgcaaaggttgtcttattcaaaacctcaatcatcacatcccctctctcccacttcacacctcggaacgcactgttcttatagagagaaaggggctttcccatcttcttaacccgaaatgaaatggctgaggagagggaggttccttttggggggtacccccgggaagagatccagtggagacggggtgggcctgtagctcagaggattagagcacgtggctacgaaccacggtgtcgggggttcgaatccctcctcgcccacagccttccaaaggggaagggcctttactttccccctgagggtaggaaaaccatgatcgggatagcggacgtaaagctattgaacttgggtatgctctttccttttgtccaagtggaatcgtagaacagaatgtgatacgatcagataaaatgcaatagaannnnnnnnnnnnnnnnnnnnnnnnnnnnnnnnnnnnnnnnnnnnnnnnnnnnnnnnnnnnnnn

SEQ ID NO: 27199 - DNA, 641 bp, Oryza sativa
  unsure (1)..(641): unsure at all n locations
nnnnnnnnnnnnnnnnnnnnnnnnnnnnnnnnnnnnnnnnnnnnnnnnnnnnnctcatatttatgagataatataatatgacaaaagctataccaaaaattggttcacgtaggaaagtacgtattggtttgcgtaggaatgcgcgttttagtttacggaagagtgcacgtagaataacaaaaggagttattcatgttcaagctagtttcaacaatactattataactgttacagatccgcaaggtcgggtggttttctggtcctccgcgggtacttgtggattcaaaagctcaagaaaagcatcaccctatgctggtcaaagaacagctgtagatgctattcgtacagtgggtttgcaacgagcagaagttatggtaaagggtgctggtagtggaagagatgccgcattacgagccattgctaaaagtggtgtacgattaagttgtatacgcgatgtaacacctatgccgcataatgggtgtcgacctcctaaaaaaagacgtctgtaaaaaaattaaacccctttcaagagaaataaacgattcaatgatcaaataataatactagtctatatggttcgagaggaggtagtaggatccactcaaacactacagtggaagtgtgttgaatcaagagtagat

SEQ ID NO: 27200 - DNA, 451 bp, Oryza sativa
ttcaatgcgggatataaaaacatatctctctgtagcacccgtgctaagtactctatggtttggggctttagcaggtttattgatagaaattaatcgtttatttccagatgctttgtcattcccctttttttcattctagttgttgctatgtgaggaatagagttcttcgtgacatgataaaaaattcccacttttcaatccctttttagtataggaaagaaaaagaaagaaaagatagattgggttggaccttagagtcatgaaaaatttggtaaatctcatttttgaaaaaagaaattcaattaaaagcagtatccaagctaagtcaggcctcagaaatcagagcatagaaagaggctgggttggctactaaaatgaaaggattttgcttcaaaatccttgctaatttgacaaggattgtattccttaattatttctctattttttatta

SEQ ID NO: 27201 - DNA, 625 bp, Oryza sativa
  unsure (1)..(625): unsure at all n locations
nnnnnnnnnnnnnnnnnnnnnnnnnnnnnnnnnnnnnnnnnnnnnnnnnnnnnctatagtagaattcctatagcatagaatgtacacagggtgtacccattatatatgaatgaaacatattatatgaatgaaacatattcattaacttaagcatgccccccattttctttaatgagttgatattaattgaatatcttttttttaagatttttgcaaaggtttcatttacgcctaatccatatcgagtagaccctgtcgttgtgagaattcttaattcatgagttgtagggagggacgtatgtcaccacaaacagaaactaaagcaagtgttggatttaaagctggtgttaaggattataaattgacttactacaccccggagtacgaaaccaaggacactgatatcttggcagcattccgagtaactcctcagccgggggttccgcccgaagaagcaggggctgcagtagctgccgaatcttctactggtacatggacaactgtttggactgatggacttaccagtcttgatcgttacaaaggccgatgctatcacatcgagcccgttgttggggaggataatcaatatatcgcttatgtagcttatccattagacctatttgaa

SEQ ID NO: 27202 - DNA, 429 bp, Oryza sativa
gacactgcttcacgcccaaaaagaaggcagctacgtctgagctaaacttggatatggaagtcttctttcgtttagggtgaagtaagaccaagctcatgagcttattatcctaggtcggaacaaattagttgatagtgataggatcccctttttgacgtccccatgcccccccccgtgtggtgtggcggcatggggatgtcaaaaggaaagggatggagtttttctcgcttttggcgtagcaggcctcccaaagggaggcccgcgcgacgggctattagctcagtggtagagcgcgcccctgataattgcgtcgttgtacctgggctgtgagggctgtcagccacatggatagttcaatgtgctcatcagggcctgacccgaagatgtggatcatccaaggcacattagcatggggtactcctcctgttt

SEQ ID NO: 27203 - DNA, 931 bp, Oryza sativa
  unsure (1)..(931): unsure at all n locations
tcaagctcccttatgtctttgcactcgaggaccaatgttcgtctggcccgaagaaacctttgcacgcctccgttaccttttgggaggcctacgccccatagaaactgtctacctgagactgtcccttggcccgcgggtctgacacaaggttagaatccgagctcttccagagtggtatctcactgatggctcgggcccccccggaagggggccttcttcgccttccacctaagctgcgcaggaaaggcccaaagtcaatcccagggaacaggaaagcttcatagggtctttctgtccaggtgcaggtagtccgcatcttcacagacatgtctatttcaccgagtctctctccgagacagtgcccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcgccggcttccctgtcatcagttctccgacttccttgaccttcgggcactgggccggcgtcggcccccatacatggtctctcgactttgcggagacctgtgtttttggtaaacagtcgcccgggcctggtcactgcgacccccttttgcgaggggcctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggtacccctttgttgaaggtcgttcgagcttttcctgggagtatggcatgggttacatacttcagcgccgtagcgcctggtatgagcctcgtgcagaagcaatggctagtccacggggctcatacttcagcgctgcagcgcttggtactcggacctcggctcgaggcattttctcaaccccttctaaccctgaaaaagcaggg

SEQ ID NO: 27204 - DNA, 498 bp, Oryza sativa
cgagtcaagggaatggccccctggccccggattttccatataaaggatacgcccaggaaaaagaccttctttaacctgaattctaattgattggatatcccgcataaggaatcgaaggaagacgcgacgttttattccagggaatccccaacgaaaaatgcacactactccctcttttctatcgaatcggtcatatccacttatggacccgaatcctttagtatggaacattgtcttttccaagtaaaaacccccagtatatgaaagaatgaaaaggtgctttcgttcttttcttgtggaataagaagccctcgtaccttaatgaaaggaaaataggaatttttcattaggtatttgaccaaataggatcgtccagttcctatagaacctatcactaaaatacccgatagggctaagcggaacgaaaaggattttccctgagatggtaaatgaaaccgattagccccatacgaggtttgggaataagtgatgagcaag

SEQ ID NO: 27205 - DNA, 763 bp, Oryza sativa
atagctgccaagaaacacaagccagaaaacacaatatgcgcccctgccacgccttcataactccaaatacccggattcgttacagttcctcctgaaatactccaaccaccccacgaattggttattcctaaacgagtcatgaaaggaatgacgaacataccttgtctccacattggatccagaacaggatcagagggatcaaaaaccgctaattcgtataaagccatcgagccagcccaaccagaaactagagctgtgtgcattatatgcaccgaaagcaatcgacccggatcattcaatacgacagtatgaacacgataccaaggcaaacccatggaaatacccctttagcaaagaaaaatagacacgatgtcactttattttatcgcattggcaaagactatccatatcctatgtacctaacccttctaggggattctgtgtcagaaagcgtgaatatttatttcattccattaaaaataagaagccaattctgttcgtaagaagaaagagaagcagatctattctatactcgataagtgccaatatgcaatgggcagcttggcttatttggaaaaaacgaagaatagatccctatctctttttgtttagtattcgaatcacccattcttttttctttattcaatctgtcttatcctacttatatgtataatctttcaatctatgtattatttcaatctacgtattaatagaatctatagtgttcatattgaataagaaaaaagtgaaaaccataaactgc

SEQ ID NO: 27206 - DNA, 770 bp, Oryza sativa
ctggttgggagtttcttaagtttcgattggaattgaacttttgtgttaatggaggaatatgtctattttttctgggtctaggacctgtaattattgaaattgactgggcttgaaattgtttctcattctcatagttacgaaatggtaagaaagataaaatacgagcctgttttatagcaagagtaattaatcgttgttgtttcaaggttaatctatttattcgtctcgataatatttttccttgttcactaataaatcgattaattaaactcatgtttctataatcaattcgatcccccgggccaatccgaggacgcctacgaaaaggttgtttgggtttgcgaaaaggttgtttgaatttacgaaaagtttgcttggatttacgaaaagtttgcttggatttatgaaaagtttgtttggatttatgaaagggttgtttagatgtatacatgatttattccttattttaaaattgaaaaaaaaattgatttgtttattttattaattttggatccagaagaaatagtctctctttggtccatatattagatgaataccctcgatacatatgaaataatatctaatggaaatcagacaagttgatttgtattttgtattctatctatgctctatatattaaataggaagttcttattctttttgatctttggaaagatcgaacacaagatgctcctatttctttatttcggcatgaatcgtatgcttacgacaataacgacaaaattttcttaattctaattgtccgggtg

SEQ ID NO: 27207 - DNA, 249 bp, Oryza sativa
  unsure (1)..(249): unsure at all n locations
tgggatgtcaaaatgcatcggtaggggagcgttccgccttagagggaagcaaccgcgaaagcgggggtcgacgaagcggaagcgagaatgtcggcttgagtaacgaaaacattggtgagaatccaatgccccgaaaacccaaggtttcctccgcaaggttcgtccccgtagggtgagccagggcataagatcagnnnnnnnnnnnnnnnnnnnnnnnnnnnnnnnnnnnnnnnnnnnnnnnnnnnnnnn

SEQ ID NO: 27208 - DNA, 439 bp, Oryza sativa
ccgcttcgcctagcagcacaacgcttgtattgctctcccacaaccccgaattcacgggagaggctgctcccatttcgctcgccgctactacgggaatcgcttccgctttctattcctctggctactaagatggatcagttcgccaggatgactcttgcctgctcatggatgcagcagcagggcaaaaggttgacctatttgggaatctccggatctatgcttattttcaactccccgaagcatttcgtcgcttgctacgcccttcctcgactctgggtacctaggtatccaccgcaagcctttcctcttttgaacctcgacattaacgttaaggctatgccatcctaaggtgctactaaatggaaggatcttatcaacgtccatgaatgcgaaatcatagatcgaactgccgaattggcaaaattcggtgctatcatag

SEQ ID NO: 27209 - DNA, 400 bp, Oryza sativa
  unsure (1)..(400): unsure at all n locations
nnnnnnnnnnnnnnnnnnnnnnnnnnnnnnnnnnnnnnnnnnnnnnnnnnnnnnnctcctggcccaaccctagacactctaagatcctttttcaaacctgctctgctcccatttcgagtcaagagatagataaatagccacatcccattgcactgatcgagggcgctcgtagtgacttagggagtcgaagaccaagaagtggcttatttataccaagcattcctcttatggctagatccaacctcctggtccctgcggaaaggaaaaagaatttcacgttcttcctttcaggaagggaggattagggaagtcctattgattgctgctttctccagaccgccgggaaaagcatgaaaaaaaggctcgaatggtacgatccctccgtcaccccagaatgaaa

SEQ ID NO: 27210 - DNA, 723 bp, Oryza sativa
  unsure (1)..(723): unsure at all n locations
gcattttcaaagtcataaatcgtcccaaaccctattttctatttgattgtatggggtaggataccttatgcaaacagaattctagggttccttttttatcgaataaaaagaattcttccattctctttttctttggtttggggaaaacccaaactaaaacttttcgagggagcggaattcctagtaaaaaaatcctggacccgtccacttagatgaaaaggaatttttctatctaatagaacaatggaactctcgcgcggttgtggttgtacctgtactgcaggaataggaaaactcgctattcactcagttttttttccataataagattatggaggagagatggccgagcggttcaaggcgtagcattggaactgctatgtagacttttgtttaccgagggttcgaatccctctctttccgtttttcttaattcagcaacgttaatgattacaatgtatcaaatcaaatgacaatttattccagcaataatacaatacctttatttaatagaaattctctataccaaattactatggtatgtaaaatacacatagaggaaagaacaaaaaacaaaaaggaatcctagggttaatccatttctgttaggtgaatgggaaaatacgaattaagagccttaggtcgatttagttcggggaaaggggaannnnnnnnnnnnnnnnnnnnnnnnnnnnnnnnnnnnnnnnnnnnnnnnnnnnnnng

SEQ ID NO: 27211 - DNA, 508 bp, Oryza sativa
  unsure (1)..(508): unsure at all n locations
gtatccgtatttggcggagtaggggaacgaactcgtgaaggaaatgatctttatatggaaatgaagaaatctggagtaattaatgaaaaaaatcttgaggaatcaaaggtagctctagtctatggccaaatgaatgacccgccaggagctcgtatgagagttggtttgactgccctaactatggcagaatatttccgagatgttaataagcaagacgtgcttctattcatcgataatatctttcgttttgttcaagcaggatcggaggtatctgccttattagggagaatgccctctgcagtgggttatcaacctactcttagtacagaaatgggttctttgcaagaaagaattacttctactaaaaagggatctataacttcgatccaagcggtttatgtacctgcggacgatttgaccgaccctgctcctgctacaacatttgcacatttgnnnnnnnnnnnnnnnnnnnnnnnnnnnnnnnnnnnnnnnnnnnnnnnnnnnnnnn

SEQ ID NO: 27212 - DNA, 2913 bp, Oryza sativa
cccttttgtttaatcctaaaaaagaaaacgagtcctttagattagatactttcttctttttttagtaaattggtatttgcttctgcaattccaattatatcaatactttactcctaatttattactcctagagttttctatttatggggacagacaataccccaccccaggaatagctgatttgaggatgatcaatttagaggatatgttcgccgtcttgcttcccgccctttgtttagggcagtggaaagtatttttccttttattttaggaattttgggaacatttcaacaaaggaggtctttcacaggtcaaacgagatctaagacttaatctaaaagaaattactaaattgaatctatttctattaaaaaaaattgcattaaaaaaaccgatcaaaaagggcgagcgaagtaagtgatcgaaaaactttgttctttgttcgtcctatctataagaggagagcatatgaaaaatgtaacccattctttcgtttttttagctcactggccatccgctgggagtttcgggcttaataccgatattttagcaacaaatctaataaatctaactgtagtggttggtgtattgatttattttggaaagggagtgtgtgcgagttgtctatttcaagaatagattggatctatccggctgcactttagaatattttttagtatttttcgaataaataagaaaagggtgcacgatctcgacgaattacttctgaataaatgcagaaatcatatgaaagaaccatagcatttcgcgacctattggtaaatcaaatcaactttgattctctatagaccaataatatgagaccattaacacggttaaagctaaactgcttgaagtctaggcaaaagggggtactctttctacaactatattagtattagtaccaaatgctttaaacaggaaatagctaatgtagaatttatctgatatagaacactcatatcgataaaatggtttgaactatttactagaaggggcaccctgcccttttttatccaatgccgaatcgacgacctatgtataaaaaaggagaaagtttttggatttgaagaaaaaagtaggaattctatccattttcattttccatttttctatttagtttttcttaatgaaattgaaaattttaactaaagggcaaatacaaataaaaaaacaactttgctgcccacgatagatttttatctaggcggaagagtcctcttaatatttatctagtcttatatgggtttcggtatattgaaatataaacagaaaagagagggtagaggataggctcattacattaaaaaaaatatggaagtagccatagcaaaaaaagaaaaaagggagcgtgagagccaaatgaatcgaaagattcatgtttggttcgggaagagatcataaaagttgtaaacttaatagcaaggtaatctactttcattaaaagatttattagataatcgaaaacagaggatcttgagtactattcgaaattcggaagaattgcgtagaggaaccattgagcagctcgaaaaagctcgaattcgattacagaaagtcgaactagaagcggatgagtatcgaatgaatggatactctgagatagaacgagaaaaagcaaatttgattaatgccacttctattagtttggaacaattagaaaagtctaaaaacgaaaccctttattttgaaaaacaaagggcgatgaatcaggtccgacaacgggttttccaacaagccgtacaaggagctctaggaactctgaatagttgtttgaataccgagttacatttccgtacgattcgtgctaatattagcattctcggggccatggaatggaagagttaaattaattaggccttgaacttctactttcctttagaatttaggcattatttttccccttgcttccgaaaaaaaaatagtaaagaaacactaatggcaacccttcgagtcgacgaaattcataaaattctccgcgaacgtattgaacaatataatagaaaagtagggattgagaatatcggtcgcgtagttcaagtgggggatgggattgctcgtattataggtcttggtgaaataatgtcaggcgaattagtcgaatttgcagaagggactaggggtattgctctgaatttggaatccaaaaatgttgggattgtattaatgggcgatgggttgatgatacaagagggcagttttgtaaaagcaacaggaagaattgctcagatacccgtgagcgaggcttacttgggtcgtgttataaatgctctggctaaacctattgatgggagaggcgaaattgtagcttcggaatctcgcttaattgaatctcctgctccgggtataatttccaggcgttctgtatatgaaccccttcaaacggggcttattgctatcgattcgatgattcctattgggcgcggtcagcgagagttaattattggggacagacaaaccggcaaaacagcagtagctacagatacaattctcaatcaaaaagggcaagatgtaatatgtgtttatgtagctatcggtcaaagagcatcctccgtagctcaagtagtaactactttccatgaagagggggccatggaatacactattgtagtagctgaaatggcggattcccctgctacattacaatacctcgctccttatacgggagcagccctggctgagtattttatgtaccgcgaacggcatactttaataatttatgatgatctctccaaacaggcacaagcttatcgccaaatgtcccttctattaagaagaccccccggccgcgaagcttacccaggggatgttttttatttgcattcacgccttttagaaagagccgctaaattaaattctcttttaggggaaggaagtatgactgctttaccaatagttgagactcaatctgga

SEQ ID NO: 27213 - DNA, 1223 bp, Oryza sativa
  unsure (1)..(1223): unsure at all n locations
agagtaggatccgcggctcaaattaaagccatgaaacaagtagctggcaaatcaaaattggaattagctcaattcgcggagttacaagcctttgcacaattcgcctctgctctcgataaaacaagtcagaatcaattggcaaggggccgacgattacgagaattgcttaaacaatcccaagcaaatcctcttccagtggaagagcagatagctactatttatatcggaacaagaggatatcttgattccttagaaattggacaggtaaagaaatttctggatgagttacgtaaacacctaaaagatactaaacctcaattccaagaaattatatcttctagcaagacattcaccgaggaagcggaaatccttttgaaggaagctattcaggaacaactcgaacggttttcccttcaggaacaaacataaattttgcacgtctactcttgttagtagaagtagtagaggagaaatcgttgagaaagatttttcatttgaatcatgcaaaaaagttttcttagtttttagtatagttatttaaagaatagatagaaataagattgcgtccaataggatttgaacctataccaaaggtttagaagacctctgtcctatccattagacaatggacgcttttttcatattttcttctttcttttcattttttatcggaccaagagaaaaaactgttagaccaaaactcttttaggaaagaaaaacaaatgcatatacaaatgtatgatgcatatatcataaagaaggaatatggacagggtagtggtaatcgacgccgcaaccccacggttatgagccttgtcagctaccaaactgttctatcctgttaaactaaagagaggggaactagtggataaaaggggggttgaatacgcccctctaccatatctatacaaatagaatagtccatttatacagaatggtaaagagggctcttctacgatcatcaattccagaaatccatacaaatacgaaagggtattttatccttaccaactggatcttgttgcacccggtaacaaacatgcataaaccatttctcgaagtatgtnnnnnnnnnnnnnnnnnnnnnnnnnnnnnnnnnnnnnnnaggtcttccggtcaaaaaacaacgtcgatgaaggcgtgtcggtgcactattacgtggcagggattnnnnnnnnnnnnnnnnnnnnnnnnnnnnnnnnnnnnnnnnnnnnnnnnnnnnn

SEQ ID NO: 27214 - DNA, 13945 bp, Oryza sativa
  unsure (1)..(13945): unsure at all n locations
ataaaacaagtcaaattcaattggcagggggccgacgattacaaaaatggcttaaacaatcccaagcaaatcctcttccagtggaagagcagatagctctattatatcggaacaagaggatatcttgattccttagaaattggacaggtaaagaaatttctggatgagttacgtaaacacctaaaagatactaaacctcaattccaagaaattatatcttctagcaagacattcaccgaggaagcggaaatccttttgaaggaagctattcaggaacaactcgaacggttttcccttcaggaccaacataaattttgcacgtctactcttgttagtagaagtagtagaggagaaatcgttgagaaagattttcatttgaatcatgcaaaaaagttttcttagtttttagtatagttatttaaagaatagatagaaataagattgggtccaataggatttgaaccctataccaaaggtttagaagacctctgtcctatccattagacaatggacgcttttttcatattttcttctttcttttcattttttatcggaccaagagaaaaaactgttagaccaaaactcttttaggaaagaaaaacaaatgcatatacaaatgtatgatgcatatatcataaagaaggaatannnnnnnnnnnnnnnnnnnnnnnnnnnnnaccccacggttatgagccttgtcagctaccaaactgttctatcctgttaaactaaagagaggggaactagtggataaaaggggggttgaatacgcccctctaccatatctatacaaatagaatagtccatttatacagaatggtaaagagggctcttctacgatcatcaattccagaaatccatacaaatacgaaagggtattttatccttaccaactggatcttgttgcacccggtaacaaacatgcataaaccatttctcgaagtatgtgtccggatagcccaaagtctcgatagttagctctaggtcttccggtcaaaaaacaacgtcgatgaaggcgtgtcggtgcactattacgtggcagggattgcaatttttctcgcattttcgttttttcactcaaactcaaagggtaaactttgcttcttatctttttttttgaagatcgacgaatcaaatgatatttctgttctaatttctgccgcttcctctctctctgaatcaaacttttttttgccataatgtgccgttcctactatctaccaagtatacggttctaatcctagatggaaaaataaatagaaaaagaaatctaagaaggcggatcctccccctccatcaagagtaatgaactaggtgctgatacagtacaacaaaattaactaaattaaccaaacttgcctgatgttgaggcaatcaagaaagcggcataagtgaatatataacccacggaaaagtgagctaatcccaccaatcttgcttgcacaatggaaagagccacgggcttatctctccagcgaattaaattagccaaaggtgtccgttcatgagcccatgctaaagtctcaattaattcctgccaatatccacgccaggaaattaagaacataaatccagtcgcccaaacaagatgtccaaataagaacatccacgcccataccgataaactattcatcccaaaaggattatatccattgataagttgtgaagagtttaaccataggtaatctcttaaccatcccatcaaataagtggaggattcattaaattgtgaaacgttgccctgccataatgtgatgtgtttccaatgccaataaaaagtaacccatccaatggtatttaacatccagaaaactgccaaataaaacgcgtcccaagcagaaatatcacaagtaccgccgcgaccagggccgtcgcaaggaaaactatatccaaaatcttttttatccggcattaatttggaaccgcgtgcatctaaagcaccctttactaaaatcaatgtagttgtatgcaaacctaaagcaatagcatgatgaaccaagaaatctccaggtcctattgttaagaaaagcgaattactattctcgttaacagcattcaaccatccgggtaaccatagggttcgacccgcattgaaagcgggaccgctcgttgaagataagagtatatcgaacccatatgtcgtcttaccatgagccgattgtatccattgagcaaatataggttcgatcaagatttgcttttctggagtaccaaaagcaagcatgacgtcattatgaacataaaggcccaaggtatggaatcctaggaagagactagcccaacttaaatgagatatgatagcttctttatggtctaacattcttgccaatacattatcctcattctgttccggattgtaatctctaatgaaaaaaatagctccatgagcaaaagcccctgtcatgatgaaccctgcaatgtattggtgatgagtatataaagctgcttgagtagtaaagtcttgtgctatgaatgcataagaaggtaaagagtacatatgttgagctactaaggaagtaataacccctaaagaagctagagcaagacctaattgaaaatgaatcgaattattgattgtgtcgtaaaggcccttatgcccacgccctaatcgaccccccggaggagtatgtgcttctaaaagatctttgatactgtgcccaattccgaagttagttcgatacatatgaccggcaatgagaaaaataaatgcaatagctaaatgatgatgagcaatatcggtcagccacaaactttgtgtttgtggatggaatcccccaagaagagttagaatagcagttcccgctccttgagtggtaccaaataaatgattactcgaatcggggttttgggcataaagattccactgacccgtcagaaggggtcccaacccctgtggatagggtaatacatctaagaaattattccatcgaacgtactctcccctggatgctggaatagcgacatgaactaaatgtcctgtccaagccaaagaacttaccccgaaaagtcctgacaaatgatgattgagacgagattccgcgtttttgaaccacgaaaggcttggtttccatttgggttgtagatgtaaccaaccccctattaaggatagggtagaaagaaataatagaaaaagagctcctgtataaagatcttcattggtccgtaatccaattgtataccaccactgataaaccccagaataggcgatattcactggaccggcggcgcctcctcgagtaaaggcttccacagcgggttgaccaaaatgaggatcccaaatcgcatgagcaataggtcttacgtgtaaaggatcctgtatccatgattcaaaatttccttgccaagcgacatgaaacagatttccggacgtccatagaaagattattgctaattgcccaaagtgagaagcaaaaatgttctgataaagacgttcctcagtaatatcatcatgactttcgaaatcatgtgcggtagcaataccaaaccaaatacgacgagtagtggggtcctgagctaagccttggctaaacctgggaaatcttaattccataatgcctttcaaatcctcctagccactatcctactgcaataattctcgctaagaagaatgcccatgttgtggcaattccacccagaaggtaatgggttactcctacagcacgtccttgtataatgctcaaggctctaggctgagtagcaggagcaacttttaatttgttatgagcccaaacgatagattcaatcagttcttgccaataaccacggccgctgaataaaaacattaaactgaaggcccagacaaaatgagcacctaagaaaaaaagaccatatgcggataatgaagaaccataagactgaattacttgggatgcctgtgcccacaagaaatctcggagccacccattaatcgtaatggaactctgtgcaaagtttccccctgtgatatgagttaccaccccttgatcacttatagtaccccaaacatccgactgcattttccaactgaaatggaaaatgactaccgaaatggaattgtacatccagaatagacctaagaaaacatgatcccaggcggatacttgacatgttccccctcgcccaggcccatcgcaagggaagcgaaaaccaagatttgctttatcgggtatcaaacgggaactgcgagcaaataaaacacctttcaaaagtattaatacagtcacatggattgtaaatgcgtgaatgtgatggactaaaaaatctgcggttcctaatggaataggtaacaaagcaactttgccgcctactgctactaactcgccacctccccacgttaagctggtacttgttgttgcaccaggagctgttacgctaggcgcgccagcatggagattttgtacccattgagcaaagatcggttgtaattgtatggcggtatccgaaaacatatcttggggacgacctaaagcactcatggtatcattatgaatgtataaaccaaaactgtgaaaacctagaaatatacatacccagttaaggtgggatatgattgcatcacggtgtctaaggacacgatctaatagatcgttgtatcgagtcgttggatcatagtctcttaccataaaaatggctgcatgtgcagcagcaccaactattagaaatccgccaatccacatgtggtgtgtgaacaaggaaagttgtgtaccatagtcagtagctaggtatggataggggggcatagagtacatatgatgagctacaacaatggttgtagagcctagcatagctaggttaagagataattgagcatgccatgacgttgttaggatttcatagagacctttatggccctgtcctgtaaatgggcctttatgagcctccaaaatatctttcaggccatgaccaataccccagttggtcctatacatatgacctgcgatcaggaaaagaatagcaatagctaaatgatggtgcgcaatatcgctcaaccatagaccgccggttattggatctagccctccgcgaaaactaagaaattctgcgtatttggaccaattcaaggtgaaaaaaggggttgctccttcggcaaaactaggataaagttgagccaaaaggtcgcgattcaagataaattcatgaggaagtggtatctccttaggatcaaccccagcgtcaagaaattggttaatcggtaaagatacatggatttggtgccccgcccaagaaagagacccaagtcctaataaccctgctaagtgatgattcaacatggattctacgtcttggaaccaggctaatttgggagcggctttgtgataatggaaccacccagcaaaaagcattaacgatgcaaaaatcaatgcaccgattgcggtacaatagagttgtaattcactagttattccggatgctcgccaaatctgaaaaaacccggaggttatttggattcctcggaaacccccgcctacatcaccattcaatatttcttgccctacgattggccaaactacctgagcactgggtccaatgtgagtaggatcacttagccatgcttcataattggaaaaacgggcaccatggaagtacatgccactcaaccaaagaaagataatggagagttgaccgaaatgagcactaaagacttttcgagagatctcctccaaatcacctgtatgactatcgaaatcgtgagcatcagcatgtaggttccagatccaagtggtagtatcagggcccttagctattgttcttgagaaatggccgggtctggcccattcctcaaaagatgtttttacaggatccctatccacaacaatttttacttctggttccggcgaacgaatcatcattaagtcctcctctttccggacaagacatacaaagagacccgccaactttttagtgaacctttgaaagatagatattatgattagtccttttctttactatctaccgtccttctatttttttttagttattcactggagcaattatatattgaagtcaatctgaggcaagtgttcggatctattatgacataaggattgggtgcctaacggactttttttatcttggatttctccacgtaacaaaaaaacctttttttaatttaaaaagctagtctattttttttaagagtataagtccctatctatatctactttccttgagcataatatagatttttttattcgattccaaattccaagataactcattagaattattaataagatggtcctgatatattagcaatatttatattgcccctttttattcgctttattacttctattctagaccctatcgtttatccttatgaaatataatataaaatagaaggcagaggaaagagatataatgaaattcttgattcgatcttccgacctaatttatttgattaatggatcaacaaccaaacccccattttctgaaaaaggagagtggtcttattcaaattcaaagcgcttcgtaatcttcaaccagttctgtgcttcaatataatttcccggagtaagcgctatagcttgtttccaatactcagcagcttgatcaaaccaagcttctgcaatttctgaatcaccctgtagaatggcctgttctccccggtcggaataggtagttccttcccctagaaccgtacttgagagtttcctacctcatacggctcagaaattgctatcttaatttcccttgtcttaactgaattcgatttctcaaaaatcgatccaatttcttcttgggttacgcagaagaagttaattacctaagtttcaaaccctaaattttgatcaataatcagtttgatcttttctcccacctgcagaaaaatgaagcatagatagacctatatccttcgtccgaattttctgaaaggtaactatctcggtttcatatatgaaatttctatagaatccttgaaaaagactttttccccataagcaagaaaaaagaacttactatctttgggatctgatactacaccgctgcttaatcccttagtggatcggctctattacataagcggattcctaaattttgccccatatcatgggataagtaagcagttttttttagttgtatcgacccagtcggtcactaattgatctttacggtgctttctctatcaatttgagaactctatccatagagtagtataggccatactttctttcttcctattttgattctcgtgaagtgtcctttcttcctacagctgatagggcaaaatcgttgttttgacgatccctatgtagaaagcccccttttctagtaaatactagaaaatttgatcctttcttatttttctttctatagtggagatagtcgcacgtaatgacagatcacggccatattattaaaagcttgtggtaagaaggggtttcgttctagtgcccggaaataatattccaaagcctttgtatgctctccattgcttgtgtgtataaggcctatgttatagagtatataacttcgatcatagggatcaatttctagtcgcgtagcttcataataattttgcaaagcttccgcataatttccttcggattgagccaacatccgttacggtcgttcgttctattcaaaaaatctccgttccaaaaccgtacatgaggttttcacctcatacggctcctcccttctgtacatagtactaagcgaaaaaatctagagaataaaaatagaattagttccatctcattatggaccgaaaggggctggtatttttccaagaaatctctagccaaccttcccacaagaggtttttcttaacaccaatgaattctattaatgctagaggaaaacgatagctccaagaatttctttgttctcaacgcctcctatttagaggaattagccacttcaacgatctttgatggttataggggtatccaaagtacaaacttgatggttgtttgttatcccaaccattcttcccagccctgataccaatcaggaaagggttaatttctaacaaagtttttctcttgttgattcctatttctaggtgtagtgcttttatcccctatgctacctattagtactagtagagtaggattagcctgtaatacagaacctatcctgtaggtgtaacctttcgctcaatactaaaatctacaattgaagcatccgaggccgcgtcagtcgaggatacacgacagaaggagttgttagttcacctcaccttccctaagcgtgggtttcccttactaatttggttttctctccgcgaacccccactctttctcgtaaaaccggggtgtaggtagggctaaaaaaacaaaaaaaagagtcaaatcgcaccatctctataataagtaaatgcccttttttccccggaggttgtcggaattattcgcaataaaatattggctacaattgagaaggtcttatcaatgaaatttccatttatacgggatctaggcataattcccaacccattctatcattctatatagaattcttttcattccttcacaaaataacataaaaaaaaaacaaatccattcaattcttataaatcgatccctatgctccaaatggataagagaggtatttctgctcagcccaaattctctctttttccttctgtttgaacaagaagagatagaaaatatttgactaagattggatttcattccactttcctatttcttttctcaacaacaacttctctcatcaactatttcgcattttcaaagtcattaatcgtcccataccctattttctatttgattgtatggggtaggataccttatgcaaacagaattctagggttccttttttatcgaataagaagaattcttccattctctttttctttggtttggggaaaacccaaactaaaacttttcgagggagcggaattcctagtaaaaaaatcctggacccgtccacttagatgaaaaggaatttttctatctaatagaacaatggaactctcgcgcggttgtggttgtacctgtactgcaggaataggaaaactcgctattcactcagttttttttccataataagattatggaggagagatggccgagcggttcaaggcgtagcattggaactgctatgtagacttttgtttaccgagggttcgaatccctctctttccgtttttcttaattcagcaacgttaatgattacaatgtatcaaatcaaatgacaatttattccagcaataatacaatacctttatttaatagaaattctctataccaaattactatggtatgtaaaatacacatagaggaaagaacaaaaaacaaaaaggaatcctagggttaatccatttctgttaggtgaatgggaaaatacgaattaagagccttaggtcgatttagttcggggaaaggggaaggggaagaaaattctatgaacctttccgtttttccttaagttcaagtttgacgagagtaatattctacaactaacaactcatttattttgagaccgacccacttcctatccaggattttttttactagtcctttatattgcaatgtgtcaatcgtcaaatgctttggcaatttccccgggtcggatgaagcaatagaattttgaaccagacgttttgatctttggttatccttcgtagtaataatatctcggggtttgcaacgaaaacttggtatatcgactatacgaccattaactaaaatatgtctatggttaactaattgccgggcctcgggaatggttgaagccatacctaatcgaaaaaggatattatccaaacgcatttcaagtaattgtagtaaaacctgacctgttgaactttttgcttttccagcgatatgtacatatctaagtaattgtcgttctgtcagaccataatgaaaacgcaatttctgtttttcttgaagacgaatacgatattgttcttttttcccagaatggaatttctttttcagattacttccggatttaggtgtttttctagtgagtcctggtaaagctcccagacggcgtatttttttaaaacgaggtcctcgataacgggacatgaagactcctttttttattgaaatttcattttacacaattaatttcattgtatttacattacagaatacatcgaaattaaaactgaattaaagtaaaggataaacagagtaaaatctactaaaagtaccacaaaaaaatggaatttcatcaacatctgaatttttgtatatatattatttattttattgttttgtatctagcaaaattgtagggtagaacgacataatagatcctggcttctccatttaattcggagaaaaagaggtatttttgttcatggaacattgatagagaaaaaagccgactatcggatttgaaccgatgaccctcgcattacaaatgcgatgctctaacctctgagctaagtgggcttacataacagaaatagtgtaacaaatagaaatatgtatagtataggaaatccgtaaaatgtcagatcttaattattaatcttagctattaactagttcgaaattggaagttctacttagaaaaaaatactagaacttcataaaataaagttagatagatttttttgaactttcttttttctctaattcgcaaatctatttttctaatagaatctattccaatttctatattgaatttgattttagatatttttaatttgatatggctcggacgaataatctaatacatggaaaagaataaataatatatattatatacgaaaacataataaagagaacatgcgaatttcttgtattttcagtccatcattatagacattttttgagatattttgtttttttttgttatttgctaataatttaatgattaatatttcactaaggagaacatagaatcatagcaaatgaaattgctaattctgattagcaaaaaaaaagaatgaatatcaagcgttatagtatgattttgaatactctaaaaaaggaacgcggtaggtgggggagagaaaaaccttgggatatattgattcgcattgaattgcaaatacatcaacgatagaatcaattcaatgctgaattgcaataagcggagtctctcaactagagacgaaccgctagactacatagagtaatgaattcaacgattcaaaaaaaactaacagatggaggaaattgcacaaggaatcctggtctcaaagaaaaagaaaatggggatatggcgaaatcggtagacgctacggacttgattgtattgagccttggtatggaaacctgctaagtggcaacttccaaattcagagaaaccctggaattaaaaaaggggcaatcctgagccaaatccatgttttgagaaaacaagcggttctcgaactagaacccaaaggaaaaggataggtgcagagactcaatggaagctgttctaacgaatcgagttaattacgttgtgttgctagcggaactcccttctaaattagggaaagaagggctttcgaaatctaatacacacgtatagatactggcatagcaaacgattaatcacagaactcatatcataatataggttctttaattcttttttaaaatgaaaataggaatgattatgaaatagaaaattcataatttttttagaattgttgtgaatccattccaatcgaatattgagtaatcaaatccttcaattcatagttttcgaaatctttttaaaagcggattaatcggacgaggataaagagagagtcccattctacatgtcaatactgacaacaatgaaatttctagtaaaaggaaaatccgtcgactttctaagtcgtgagggttcaagtccctctatccccaaaccctcttttattccctaactctagtatttatcctgtttttttattaataggtttaagattcaatggaatacatttcttttttattatagtatcggcaaggaatgtcgattattaactcgatatttaaatattattaaataggctttctttgtacaatgcataggactgccccctccccatttccaaattttggatattgacatagatacaaatactctactaggatgatgcacaagaaaaggtcaagnnnnnnnnnnnnnnnnnnnngaggactgaaaatcctcgtgtcaccagttcaaatctggttcctggcacagaaaaaagggatcttccgaataggtattgatacaaatacctcgagatgggttgggatacatattcgttaataatatagatagagtatgattttttcatctaagtagataaatctctaaatagaggcacttctttttctgcatttttgcatttcttaattttctattccgctattccgacaaatatttttttattcttgcttatcttatcttactttactagttgttctaagtaatgcacgcggtacaaagttcgtggtagggaacttctttgagtcatcatatttttctgttcatacgaaggaaatgaatatgtgattttccaacgaaatgaagcccttttttgcttagtctatctgaaccttttgtataattggaattaattagaatgtaataggtattctgtttcatctaggaacagagcgtaaaaatattccttgacttgcataaaatctggagttgtgttgtataagtgagcatgaatttcttatcattcaatgagcatcttgtatttcatagaaattgggggttatatagtccttacgtaagggccagcctatccaactttcaggcattaggatacgtttaaggcgtggatgattatcataagagattcccaccatatcaaaagattcgcgttcttgaaaatcggaacttctccaaatccagaagacagatgggattctaggattatccttttgggcaaagacttttatgcatacttcttctgggttatctataccatactgtattctcgtaagatgatacacgctagctaaagatccaccgggtgcaacgtcataagcacattgggaacgtaaataattgtaaccatatacatataaaatgacagcaatggaatcccaatcctctgcttttatttgcaaagtctctattcctcgatgatcgaagcccaaagatctatgaaccacctcatgtttgactagccaattagataaccaaccctgctgcattatcttgatctctcctcctttgtataaatatttcgcagttcgaatgcaagtttgaaatattgccctgctctttctttttcggcacaaagagctcctcctaattcactaatttgtaggaagatactggacttttggatttgaaaaaagtttcagaagatatgtctaaagtagatggtgattgatagagcaattcttgctcataagttccagtattagtactgcgccgaacataaagcttgtggctggtagtaaaacatcgatttttcttttgagatagagttcgatcctcaactatttctcgcgatatcttcttacgaagttttgttagggcatctataacagcctctggtttaggtgggcaacccggcaagtagacgtccacaggaattaacttatcaactccccgaacagtactataggaatccgtactgaacattccaccagtaatagtacaagctcccatagcaatgacgtattttggttcaggcatttgctcatataatctcactaaagagggagccattttcattgttactgtaccggctgttaaaattaggtccgcttgcctaggacttgatcttggtaccaatccataacgatcaaagtcgaatcgtgagcctattaatgaagcaaattcaatgaaacaacaactggtaccatatagaaggggccataaactagagagtcttgaccaattcgaaagatcttttagtgtagttgaaataacggaattggaacttgtttggtcaagtaggggaaactcaatcaaactcataactgtcttaatggaatcttttccttcttttttttttttgtctgaatattcagttaagaccattccaaggctccttttcgccatgcataaactaaaccaacaactaggataagcacgaaaatgaaagctt

SEQ ID NO: 27215 - DNA, 4738 bp, Oryza sativa
  unsure (1)..(4738): unsure at all n locations
tagcaatgacgtattttggtcaggcatttgctcatataatctcactaaagagggagccattttcattgttactgtaccggctgttaaaattaggtccgcttgcctaggacttgatcttggtaccaatccataacgatcaaagtcgaatcgtgagcctattaatgaagcaaattcaatgaaacaacaactggtaccatatagaaggggccataaactagagagtcttgaccaattcgaaagatcttttagtgtagttgaaataacggaattggaacttgtttggtcaagtaggggaaactcaatcaaactcataactgtcttaatggaatcttttccttcttttttttttttgtctgaatattcagttaagaccattccaaggctccttttcgccatgcataaactaaaccaacaactaggataagcacgaaaatgaaagcttcgataaaaacggatatacccaatacgtcgaaactcattgcccaagggtagagaaagaccgtttccacatcaaaaacaacaaaaactagcgcaaacatgtaatagcgtattcggaattgtaaccaagccccccccatgggttctatacccgattcataactagaaagcttctctggtccttcacgaaccggagctaaaagtgctgaaatccaaaatgctaaaataggaataaggcttgctattattagaaatgcccaaaaaatatcatattcgtgaagcagaaacataaatgtactcccattaatgtggaataggcggaactgaattagtcaattcaagtcagcattgtcaatttatacagaatttctctcttttcctcggtgaaacaaggatcggtttttctcaaaccaaagggcttagtttagcctttgtttcctctttgccacgtcttctttaaagattcatccaatggaatcccgaccccctttctttttgatttcctttctatttaggtatggtggagacataattcttatagaaacaaaactctctcgcttcactttgtctcattttctctagaatctctagaaaaaggaataaaaacgaaaatactacgaattagagcctaattaagataggatgactaatgtatgcagcctaatgaggagtaattctataaaaataaagaactctatttcagaacgtagattgatttagatttaggtaatctatagatatagataagcaaagtaatatacttcaaacaaagtaggaatttgcaagatggagaacatcttgcagttgatttgatagaaattcatttttcttttcctgtctctataattttcgatgaatgagcctctggtaatccttttatctctattttatggcgcaggcgcctgtccagtctataaacaagtactaatagggaaatgaaaactatactaaaggaaacgtaggatatctctcctaaaatctaaaaaaggacatattagggctatacggattcgaaccgtagaccttctcggtaaaacagatcaaacggattattatcgaaatgattcgaactgtttcaaagacccaacatgcatttttttgcattgggctcttttatcaactgatagaaagatcagttagtccaccatagtttttctttacggaaagataatgagatggctccctgcgctctgattgattatttgtattatgatctatctaagagcaataccaaagtgtttcaaaggaggattaccttgacttaggtctgcctccggcctaaattaaatcaacctaagtgaaatagagtctctatcgttccgctacaagagttgactatgagacttcatacaccttaaagttcatagaacgaaaagaatttttttggaggcccttatcctcattaagcctagcatttagtgggctggatatttaccttatcaactagcaaatcaataaaggttctatttgtttaggcacctggattggtacctgaatcggactgaaccaactatttgtcaggcgactgttctcctattctctcgaatccatgaagtaagacattgattttgcaagaagatccactatgttcattgcataataagctcccttgaaaagcattggcgcacgtgtaaacgagttgctctaccgaactgagctatagcccttgtcagagatatcttaatatatagagaatttcttgtcaagatgaatattctctaatagtagaggatatcctttgatctgtttactataataacataccaataacgaagcggtatttgcttataaaaaggattcgatctataatcgatcgaagtaaagggtcttcctttgtggtgataaattgcctacttaactcagtggttagagtattgctttcatacggcgggagtcattggttcaaatccaatagtaggtaggtaggtagaaaaattactagatagcattggccctacttcgcttcgctatctaataattttttctacccctcttccctttttctttgtatcaactaaaccgttgggttgtcttcaattagatgggggaatccaattaacagcctcgactcgtatcctagctcgtctgagagctaccttcgcttcaaccaattctttcgtaccctcagctctactcacgttagcttcggctatttcaagtgcctgttgagcttcttccggatcaatgtcactacccagttccgcatcatttcctaaaatgatgatctcattattaactattctggcaaaaccgctccacagaaccgccgttaaccattgatcgttgaggaggcgtattctcaagggacccatatctacagctgtgttaatgggggcgtggtttggtaatacgccaatttggccactattagtagataaaatgatttctttcacttcacaatcccaaataattcgcttaggagtcagtacataaagatttaatttcatttcttcaatttgttctcctcttctaagtttatagctttcgtgctagcttcatcgatgttacccaccaaataaaaagcctgttcgggtaggccgtctaattctccggaaaggattagttgaaatcccctaatagtttctgcaagaccaacatactttnnnnnnnnnnnnnnnnnnnnnnnnnnnnnnnnnnnnnnnnnnnnnnnnnnnnnnncaatttttcgtgctcttgctacagttaaacgatcctcctccgataattcatccaacccaagaattgcgataatgtcctgaagttctctgtaacgttgtaaagtttgcttaactctttgcgcagtttcataatgttcgttgccaacgatccgaggttgtaacatagttgaggttgaatctaaaggatctactgcangataaatccctttggaagctaatcctctggaaagtacggtagtaacatccaaatgtgcaaatgttgagccagagcaaggtcggtcaaatcgtccgcaggtacataaccgcttggatcgaagttatagatccctttttagtaaaagtaattctttcttgcaaagaacccatttctgtactaagagtaggttgataacccactgcagagggcattctccctaataaggcagatacctccgatcctgcttgaacaaaacgaaagatattatcgatgaatagaagcacgtcttgcttattaacatctcggaaatattctgccatagttagggcagtcaaaccaactctcatacgagctcctggcggttcattcatttggccatagactagagctacctttgattcctcaagatttttttcattaattactccagattccttcatttccatataaagatcatttccttcacgagtccgttcccctactccgccaaatacggatacgcccccgtgagctttagcaatattgttgattaattccatgatgagtactgttttacctactccagctcccccaaatagtccgatttttcctccacgccgataaggagctaaaagatcgaccaccttaataccagtttcaaagatggataatttcgtatctaactcgataaaggcgggcgcggatctatgaatagggaatgttgcactagtatctacaggacccaaattgtcaacaggctccccaagaacgttgaaaattcgtccaagagtagctccaccgacaggaacactgagaggagctcccgtgtcaatcacttccattcctctcatcaacccatctgtagcactcatagctacagctctaactcgattatttcctaataattgttgtacctcacaagttacattaatttgcttaccgtcagtgtctcgactcttgactaccaaagcattataaatataaggtaacttgcccgggggaaaagtgacatccagcacgggtccaataatttgatcgatacgccctgtacttttttcttcaattgtagaaaccccgggacgagaagtagtaggattggttctcataattatcacataattttcaaaaaaaaggaatttatcgaaattttgatttttttcttgttgaataatgccaaatcaacaccaaaaaaatatccaaaaatccaaaagtcaaaaggaaatgaattagttaattcaataagagagaaaaggggaccagcacttgatttcgttgcccaaacgaatcccattcaatcgtttactcatggaatgagcccgtcggaaagttcaatcaatctttttttcatatacattttgccttttgtaaacgatttgtgcctactctactttcttatctaggacttcgattacannnnnnnnnnnnnnnnnnnnnnnnnnnnnnnnnnnnnnnnnnnnnnnnnnnnnnn

SEQ ID NO: 27216 - DNA, 16479 bp, Oryza sativa
aagtgacatccagcacgggtccaataatttgatcgtttcgccctgtacttttttcttcaattgtagaaaccccgggacgagaagtagtaggattggttctcataattatcacataattttcaaaaaaaaggaatttatcgaaattttgatttttttcttgttgaataatgccaaatcaacaccaaaaaaatatccaaaaatccaaaagtcaaaaggaaatgaattagttaattcaataagagagaaaaggggaccagcacttgatttcgttgcccaaacgaatcccattcaatcgtttactcatggaatgagcccgtcggaaagttcaatcaatctttttttcatatacattttgccttttgtaaacgatttgtgcctactctactttcttatctaggacttcgatatacaaaatatatactactgtgaagcatagattgctgtcaacagagaattttcgtagtatttaggtatttccactcaaaataagaaaagggggtctattaagaacttaataaggattagaagttgatttggggttgcgctatatctattaaagagtatacaataaagatggatttggtgaatcaaatccatggtttaataacgaagcatgttaacttaccataacaacaactcaattcttatcgaattcctatagtagaattcctatagcatagaatgtacacagggtgtacccattatatatgaatgaaacatattatatgaatgaaacatattcattaacttaagcatgccccccattttctttaatgagttgatattaattgaatatcttttttttaagatttttgcaaaggtttcatttacgcctaatccatatcgagtagaccctgtcgttgtgagaattcttaattcatgagttgtagggagggacgtatgtcaccacaaacagaaactaaagcaagtgttggatttaaagctggtgttaaggattataaattgacttactacaccccggagtacgaaaccaaggacactgatatcttggcagcattccgagtaactcctcagccgggggttccgcccgaagaagcaggggctgcagtagctgccgaatcttctactggtacatggacaactgtttggactgatggacttaccagtcttgatcgttacaaaggccgatgctatcacatcgagcccgttgttggggaggataatcaatatatcgcttatgtagcttatccattagacctatttgaagagggttctgttactaacatgtttacttccattgtgggtaacgtatttggtttcaaagccctacgcgctctacgtctggaggatctgcgaattccccctacttattcaaaaactttccaaggtccgcctcatggtatccaagttgaaagggataagttgaacaaatacggtcgtcctttattgggatgtactattaaaccaaaattgggattatctgcaaaaaattatggtagagcatgttatgagtgtctacgcggtggacttgattttaccaaagatgatgaaaacgtaaactcacaaccatttatgcgttggagggaccgttttgtcttttgtgccgaagctatttataaatcacaggccgaaaccggtgaaattaaggggcattacttgaatgcgactgcaggtacatgcgaagaaatgattaaaagagctgtatttgcgagggaattaggggttcctattgtaatgcatgactacttaaccggggggttcaccgcaaatactagtttggctcattattgccgcgacaacggcctacttcttcacattcaccgagcaatgcatgcagttattgatagacagaaaaatcatggtatgcatttccgtgtattagctaaagcattgcgtatgtctgggggagatcatatccacgctggtacagtagtaggtaagttagaaggggaacgcgaaatgactttaggttttgttgatttattgcgcgatgattttattgaaaaagatcgtgctcgcggtatctttttcactcaggactgggtatccatgccaggtgttataccggtggcttcagggggtattcatgtttggcatatgccagctctgaccgaaatctttggagatgattctgtattgcaatttggtggaggaactttaggacatccttggggtaatgcacctggtgcagcagctaatcgggtggctttagaagcctgtgtacaagctcgtaacgaagggcgcgatcttgctcgtgaaggtaatgaaattatccgatcagcttgcaaatggagtcctgaactagccgcagcttgtgaaatatggaaagcgatcaaattcgagttcgagccggtagataaactagatagctagactaagtggataaaattagatagaaaaaaggtctaaataaaaaagaagagaaatagaaagatcaaaaatcagttacgaaaatgcagtaattcttcttttttcttctaattgattgcaattaaactcggctcaatctgaaaaaagattgagccgagtttaaatagattttgatacgatcatgagacttgacaaatcgggattcctctattctatatatttagaagatataaaggtataatacaataaataaatacaaatagagtattatcatatgataatggaatcaaatacgcagtatttacagaaaaagttttcatttattgggaaagaatcaatgacatacaatgcattacagacgtatgatcattaccctttaaccgggttattctattccacttctagatagagaaaaaaactaaaggagaatgaatgaaaaaagacagagtttggaagttagacccctttctaagactctctttcaaaaaagaggacattttgaaacttttaacaggcacaatcgtgagtcaacaagtgactcgaaatgctcgtaagaaaagagaattgattttcaaaatggtagaactagatgacgaagttttctataaccttgatgaagaggtagttttagtttacgactccgatcaagagcgagaagtctttcatttcagattggactgctatagaatctggacccatcgtagagacgttcaaaaggctcctgatgataagaatcatactttcgcggaactccatggggctatgggcttcaacgcggtagacgttttgttccgaatttttctggagcaaacctccgacccaacgatacaatgaattttttctattcacaaagaaaaaagattcggaatcgcaatgctactatacgcacccggaggaatattcggaattatattcttatataatccatttttgcgcggggtcttactaacaggacttcgctgcacgagacgaggattcgtcgaaaagctaaggtcatccggtattttcataccctttgggggtggtatatggccttacaaagtctaaggggtagtatgagatctgtagtaggtaaaagaatttgtcccttgattgagtatgctattttccctcctttaccgcgcattattgtatatgcttctagaagagcacgtatgcagagaggaaattacagtttaataaaaaagcctaaaaaagtttcaactttacggcaatatcaatcaactaaaagtcctatgtatcaatccttacagcggatttgtggggtccgagagtggttgaataagtattgcatgtggaaggaagtagacgaaaaagattttggattcgaaataggcgcattcgactaagtcgtactttgaatccaatttcaagttcgattagaaggatagaaaggccgcgaggatcggaaaagaaaaatcaaatctttttaattgcttctccttttttgctattttcttattatttatataatccattcgattctttttttttagaatactttttttttagaatactaaagtattctaaaaaaaaagtattctataaaaaatctttttttgcaaactcaaaaatacaatagtcaatattcgttataatagatatacttaattatatcataagaatcttaagatattttttgaatagatcaaatcgaatagatagaaatagtaaatttgaatggagacacctattctatgatggattttaacttaccctctattttcgtgcctttagtaggcttagtatttccggcaattgcaatggcttctttatttctttatgtgcagaaaaataagattgtctagaaccgacgggaccgaattttctcaatgtatttccacacaggatcataatacggatcttttgtagtgtaagtaatataatatggtatgttatgtggctctttctacacacaaatgcaaacccgctatggatggggattatggatgcggatataggctacgagcataaatgcatgcatatgcggaaccgggtatagcgagtttttttaagtggatcaacaaatactttttgaatagaaagtcaatgtatctaaccaattattttacaggagtatctagttggcgaaggcgatttcagaatcaaaaaaagtaaagtcaaaatcatttagcttattctctcaatttcaatcgaccgctgttagtatatctaatatgaattggcgatcagaacacatatggatagaacttctaaaaggttctcgaaaaagaggtaattttttctgggcctgtattctttttctaggttcactaggattcttagcggttggggcttccagttatcttggtaagaatattatatctgtacttccatctcaacaaattcttttttttccacagggggtcgtgatgtctttctacggaatcgcaggcctattcattagcgcttacttgtggtgcactattttgtggaatgtaggcagtggttatgaccgattcgatagaaaagagggagtagtgtgcatttttcgttggggattccctggaataaaacgtcgcgtcttccttcgattccttatgcgggatatccaatcaattagaattcaggttaaagaaggtctttttcctcgtcgtatcctttatatggaaatccggggccagggggccattcccttgactcgtactgatgagaagttttttactccacgagaaattgaacaaaaagctgccgaattggcttatttcttgcgcataccaatggaagtattttgagtaccaattgaattttttgaaatgaattgaatgaagaagaattggaagaagaaaagttttctcaacacgagggaaaaggtcccttcgaaattgcattattgtaaggggattttgagtatttatctaaaggaaggaacaaatgaggataagagaaaattgcttctaatttgtccaagtgggatatatggcgtaatattcttccattttcatccgaaaggacttttttctatttctctattccactccatctagatctaagaaagaactcaatgcaatgaaattctactagtatagaaaaaagaggaatagatacaaggtctcaaaccttgttatagaatttttccttcaaagaaaaagaaatatcatatagagtcagcgaataaagcggattcattaacaactcaatttacagatcaaaaatgaaaaaaaagaaagcattgccttctttcctatatcttgtatttatcgtacttttgccttggggagtctctttctcttttaacaaatgtctggaactttggattaagaattggtggaataccaggcaatcccaaactctcttaactgctattcaagagaaaagagttctagaaagattcatggaattagaagacctttttatcttggacgaaatgataaaagagaaaccgaatacacatgtacaaaacccccctataggaatacgcaaggaaataatacaattggccaaaatagataatgagggtcatctccatatcattttgcatttctcgacaaatataatctgtttggctattctaagtggttctttttttctgggtaaagaggaacttgttattttgaattcttgggttcaggaattcttctataacttaaatgactcagtaaaagctttttttattcttttagttactgatttttttgttggatttcactccacccgcggttgggaactactaattcgttgggtctataacgatcttggatgggttcctaacgagctaattttcactatttttgtttgtagttttcctgtgattctagatacatgtttgaaattttgggtctttttttgtttaaaccgcctatctccttcgcttgtagtcatttatcattcaattagtgaagcataaactcatttgatctcctgatattaatcaaaattagcatcctttttcctttagaaagaaagcctttttccattttagcaaaattctttttttctatttctacctgctcaaggtattcatcattccagtacaactgttgcagtagaatgacaacagattcgtgtatagggaactagattagcttagctacctatctaatttattgtagaaattccgggatctgtgattggacatggaaaatagaaatactttttcttgggtaaaggaacagatgactcgatcgatttctgtatcgatcatgatatacgtaataactcggacatctatttcaaatgcatatcccatttttgcgcagcaaggttatgaaaacccacgagaagcaactggacgaattgtatgtgccaattgccatttagcgaataagcctgtggatattgaagttccccaagcagtgcttcccgatactgtatttgaagcagttcttcgaattccttatgatatgcaactgaaacaagttcttgctaatgggaaaaagggagggttgaatgtgggtgctgttcttattttgcccgagggattcgaattagcgccgcccgaccgtatttctcctgagttgaaagaaaagataggaaatctctcttttcagagttatcgtcccaataaaaaaaatattcttgtgataggccctgttcccggtaagaaatatagtgaaatcgtctttcccattctttcccccgaccctgctatgaagaaagacgttcatttcttaaaatatcccatatatgtggggggaaaccgaggaaggggacagatctatcctgatggtagcaagagtaacaatacggtctataatgcaacgtcaacaggtgtagtaagaaaaatactgcgtaaagaaaaggggggatatgaaatatccatagtcgatgcatcggatggacgccaagtgattgatcttatacctcccggtccagaacttcttgtttcagagggggaatcgatcaagcttgatcaaccattaacaagtaatcctaatgtgggagggtttggtcagggggatgcagaaatagtgcttcaggatccattacgcgttcaaggccttttgttcttcttcgcatccgttattttggcacaagtttttttggttctcaaaaagaaacagtttgaaaaggttcaattgtacgaaatgaatttctaggtcccgggatttcttaccatcaagttggtaaaaagccgcgatttattggcgattgctagaattctctatgatccattttggaaatcttttttttgtttagactattttttgtttgcgagatgtcttgtctgcaattccttatttctatcatctcatgcaaaacgaggagaatgcaaggcaagggcgagaacaataaaaggaacaaatccttttaggagggattgctggtcttcttaatcctctattgggcacaagaaaaaggcttttttgcctttttcttgtgtcgattcttcttgtatcgaaatatgaatcttttttcttcctattcggcaaagattactatttcttctttatttgggtctgtctcttgaacctcttttgcttaggttcaggcgatgtagtggacaaaaagagggaaagaaaatatggcgtgggacaaattttttgtgaccaaatagaattgcttgacttgttcaattaagttcaatttagaacttacagaaattttgcaaaaaaaacggatactcttccattgaaggctgttttttatttttaggctagttgagtagttttaattaaggttttattagtttattactctaaattaaatcaatgatttacaagagacttcctccggggaataaaatattggatcctcgattgatcctttctttctcctcgcttcataaaagtgaattaatttcattggcgagggggttataaatcaactgatggattacttcactaacattattaacaaacaaaattaacaaacaaaacgaataaatagagggattctgaccatcagagcaaaggctttctctttgttatttttacaaatcaaaataggaaacccgtttgtaggttatggaatagattaaaaaagtcgggttataagagtaagaattccgcgggtcctttccgctctaatcagataaaagggggtaaggacccgctaagttcctattttttcatgtttacaacctggtccctccaattactatagagatgaacccaatccagaatatgaaccgtaaaagaaaacacctattaaaccaatcacagcaataccggttacagtacctatcagccaaagaggaattcttccagtagtatcggccatttcccctactttcctccacattttatcaagtggtcatgctagagacaaaaacagtcatggatagttataaggatggtatccttccaaatggggataagagaattcttactactctctttctttctctcaattgaagaagtaattggaaaataaaacagcaagtacaaaaatgagtaataaaccccagtatagactggtacgattcaattcaacattttgttcattcgggtttgattgtgtcatagttctatagttggaatttggtttatcgttggatgaactgcattgctgatattgatcccaagaaaaaaacagtaggtacagctagtccgtgaacagccagccatcgcactgtaaaaataggataggttcgatctatggtcattgagggcctcctaaaaggatctactaaattcatcgagttgttctaaagaatcaaaacggtcggttattaacggaattccttgtcggctttctgtgaaatactcgtttggccgaggacttccaaacacgtcataagctaaacccgtactgacaaataaccaacccgcaatgaatagggaaggtatagtaatgctatgaataacccagtatcgaatactggtaataatatcagcaaaagaacgttctcccgtgcttccagacatgctgagctccccaaatttttgtacattcaaaaaaggaattgattccgtaaaagatgggatcaaccagtaaatagaaaattactgatatttcatccttgtgagattgtcaattttgtaccaaaggtgtattttgagtataccaaattagtatagctatccttcctatggcacagcaatcctgtttcgcttggtctcgaaacagaattctttttttctcttctttgttccttgtctatagggtaagctatatggtattcaaggcatcaatagaaaacctcaattttgagggtcctacttaattttcaccggcttcggaatagtagaataattcggaatagggctcaagatcttgggaaaatctaagttaatgatcaacaggtttggataaagaatttaggaaagatattcttatactgacacaatacaaagagaagtagatgcgaaagctatcccttcgaatccaacctttccccttaaagaatttaattggttagcataatataatatctaataaatagaaaatcaaatagtagataatctgttatgaaagagagaaaacattctttgaagaatcaagattcgtaatcaacccttgccttgtttactaactttcttgaccaaactgcaagcgtggaactttgccagttcttaggtttccgaaatagtgtaatggaaaaagaagtgcttcgaatcgactttgattggggttcgaaaaaggaattaaaaaaaagtaaattcaggaaagatttcctttttttaggagaccctcgaggggtcgtggaatgcttttcttctcctcttattccatatggaatacaatcaattaaaataagaaggaataggggaatattcgactgttcgctccaaaaagaaggttaaatcatcctattgaaaaagaccaaaatagaaagaactttttcaaattcaattctttatttttcactggggttagctgatctagttcttaatatttttactttactcaattgacagattacacagcaaatctcttgattcggaattagggactcatgccccatctgatgaatccattttcttttacacttctgtatctcactctatcttgttttttagtattatctaaaataaccgatgaattatgaattttccataacttaggtaagtgctttaccaacatatgtagtgtagtaaaaaaaatggaatttaaccctttcatgcttactataactagttatttcggttttctattggctgctttaactctaaccctagctctatttattggcttgaacaagatacgtcttatttgaaatgaattgaatgaataaggcagaaaagaaaaaatctctcttttggattcctggtattctacgcactaattaccaattctttttttcttggtcattgagattcgtggataatttagactactatttagggataaatcgtacctcttttttttatcccctcgaacaaatcgaaatgattgaagtttttctatttggaatcgtcttaggcctaattcctattactttagcgggattattcgtgactgcgtatttgcaatacagacgtggggatcagttggatctttgattgagtaatatttcttttttgattgccctcctctctggtctggaggaggtcaaattggaattgcaatttgttttgttaagttattttgccctgcttcgacataagatagatggaatcacgctctgtaggatttgaacctacgacatcgggttttggagacccgcgttctaccgaactgaactaagagcgctttcaaaaatcaaatccttttctactcctaatgtgtctcacgtacgtatagtatccacaaattcaagttatacccgctttaatcgacctcctcactactgcctataaagaagaaagaagtaataggtagggatgacaggatttgaacctgtgacattttgtacccaaaacaaacgcgctaccaagctgcgctacatcccttttccaaattgttgtacaatgtcattgtacacaattcctatcttgttttccacatcctaattttcttgtctttttctatctatagagaatcctcgtgtcatttcttctttttggtctcatataatcaaggaatggtatatatctaaatccaatctaatttcacctataaaagaaagattactattccttggtaatctataggaagggattgtctttttcgtttttagttcggaatttcgcctaaacaaaagaaatacaaatgatcttgggcaataatatctgatcatatacgtattccaataaggaaggaggattttcaatgcgggatataaaaacatatctctctgtagcacccgtgctaagtactctatggtttggggctttagcaggtttattgatagaaattaatcgtttatttccagatgctttgtcattcccctttttttcattctagttgttgctatgtgaggaatagagttcttcgtgacatgataaaaaattcccacttttcaatccctttttagtataggaaagaaaaagaaagaaaagatagattgggttggaccttagagtcatgaaaaatttggtaaatctcatttttgaaaaaagaaattcaattaaaagcagtatccaagctaagtcaggcctcagaaatcagagcatagaaagaggctgggttggctactaaaatgaaaggattttgcttcaaaatccttgctaatttgacaaggattgtattccttaattatttctctattttttattacttaattgaaaaatttccaaaaatttttattctaatggattttcttcttcctcttcggtttcaaaatagaggaataaaagaataagtagaagaattaagttaagtcaatccaaaaaggaaaggaggttcatggccaaggggaaagatgttagaatcagagttattttgcaatgtgtgagttgtgttcgaaaaggggccaatgaggagtcggcagggatttctagatatagtactcaaaagaatcgccacaatacacccggacaattagaattaagaaaattttgtcgttattgtcgtaagcatacgattcatgccgaaataaagaaataggagcatcttgtgttcgatctttccaaagatcaaaaagaataagaacttcctatttaatatatagagcatagatagaatacaaaatacaaatcaacttgtctgatttccattagatattatttcatatgtatcgagggtattcatctaatatatggaccaaagagagactatttcttctggatccaaaattaataaaataaacaaatcaatttttttttcaattttaaaataaggaataaatcatgtatacatctaaacaaccctttcataaatccaaacaaacttttcataaatccaagcaaacttttcgtaaatccaagcaaacttttcgtaaattcaaacaaccttttcgcaaacccaaacaaccttttcgtaggcgtcctcggattggcccgggggatcgaattgattatagaaacatgagtttaattaatcgatttattagtgaacaaggaaaaatattatcgagacgaataaatagattaaccttgaaacaacaacgattaattactcttgctataaaacaggctcgtattttatctttcttaccatttcgtaactatgagaatgagaaacaatttcaagcccagtcaatttcaataattacaggtcctagacccagaaaaaatagacatattcctccattaacacaaaagttcaattccaatcgaaacttaagaaactccaaccagactttaagaaacaacaatcggaacttaagttccgattgttgatgttttattcgaaagggccagactatatataaagaaagtaatccaatttagattcttgggtttgttataagaaagaacaatggggaagaaaaaatagtttttttatttattgcaacatgctcgttgattcctaccacttaatcttaatttattgtatcttcccggagttacctctccgggaattcttttttaattattcctgtatattacttttttatccctttaattgataatctttattttattggaaatcgtgtaaagattatttgaatttaatacagctacttgtgcaaggattttacgattaagaatcaattctttcttgtaaagattgtgtattaatttactataattatcgaatactttatgtatccgcgttgctgcgtttatccgactgatccacaaacgccgaaaatccctcttttgcctgactctatctcgatgagaggaaacaaacgctcttcttacctgttgagtaatcattcgattaagtcttaaatgagcccctctaaagtttgaggcaaatgaacgcatttttgcccgtcgtctccgagctatatatcctcgcggaactctggtcattgaatcaaattaaccttaatgaataactaatgatttctcttcttttagccatcctttttcccattaataacaaaacgaattattcccatatataaaatattagttccaatggcttttgctactataaccttcccaaccacaattttctcttctactcccttcagttatttcgcacgatactaaaaaatagtgggttccatcgtttctatggttcccttttaaacggcgaggccctctctatacaccggagccctttctttcatttcatcaaagggtattgtgaacttgtatagttcacattctttggctctacctatccattatagagtaaatagctcttttcacaataagagttatccatacagtgacggcatttaattatgaaagttggctaagtagctgaccctcttagtccgtttttttaagataaaggagcataagcctttatctttttattactatttcctccgcttaatgaatagccgtttgctaccaatgggggaattgcttcttatttccaatctagatgattggatttgcaccaaaggaaaccagaaattccatataccgtagaaatctaggatagagaagctctatcctattcattggtaccgatcatggatacttcaaaaattgtcttatttgtttgaacccatgatccgaacgagtcgcacatacaccctagcacatgttcctcgacgctgaggacatcccttaagcgcggccgattttctagcatttcgtattggctgtcttgcgtttctaataagttgtttaaccgttggcatgtcgtatgtatatagaaaaaatggattggtttagatcgatcttaacctgaatgattgatcattatgaagtatttccattaaattgcataaaacccgaatttagggttgaaataaatttacaagaaatctggccactaccaatccttaaacatttctggaaaccacactggatcagtatcgcagtgctcgtcaagcatttcatcccctacaatatcgacaagtccataagctttggcttcgtctgctgacataaaaacatccctttccatgtcttcggatacaacccaaaaaggcttgcctgttcttagtgcataaacccttgtgatcatttcgcgaactttgtgtaactcttccacttctagtaaaaattctggtgttcttgcccgataataagcactagcaggttggtgaagcataatcctcgcgtgggggaatgctatacgcttggtgggttctcctccaagcagaatgaaggacgccatggacgcggctattccgaggcatattgtatatatatctggtgtcaccgtttgcatcgtatcaaaaatcgccattcctgagattaaccacccgccgggggagtttataaacaaaaaaatatcgctaattccatcttctatactgagatataccatgagacctgtaatatgattcgtgacctcgcaacgaatctcttgacctaaaaaaagtgtcctttctcgatacataacattgtataagtcaacccaagtcgcttcttcatctccgggaatccggtaaggtacttttggaacaccaatgggcatattagattaatattattaaatttaagtaagaaaactacactttaatatggaaacgtaagaatggaagagaaagaaagaatccgcagtttattgttttcactttttttcttattctatatgaatactatagattctattaatacgtagattgaaataatacatagattgaaagattatacatataagtaggataagacagattgaataaagaaaaaagaatgggtgattcgaatactaaacaaaaagagatagggatctattcttcgttttttccaaataagccaagctgcccattgcatattggcacttatcgagtatagaatagatctgcttctctttcttcttacgaacagaattggcttcttatttttaatggaatgaaataaatattcacgctttctgacacagaatcccctagaagggttaggtacataggatatggatagtctttgccaatgcgataaaataaagtgacatcgtgtctatttttctttgctaaaggggtatttccatgggtttgccttggtatcgtgttcatactgtcgtattgaatgatccgggtcgattgctttcggtgcatataatgcacacagctctagtttctggttgggctggctcgatggctttatacgaattagcggtttttgatccctctgatcctgttctggatccaatgtggagacaaggtatgttcgtcattcctttcatgactcgtttaggaataaccaattcgtggggtggttggagtatttcaggaggaactgtaacgaatccgggtatttggagttatgaaggcgtggcaggggcgcatattgtgttttctggcttgtgtttcttggcagctatctggcattgggtatattgggacctcgaaatattctgtgatgagcggacgggaaaaccttctttggatttgcccaagatctttggaattcatttatttcttgcaggggtggcttgctttggctttggcgcatttcatgtaacgggtttgtatggtcctgggatatgggtgtctgatccttatggactaactggaaaagtacaagctgtaaatccggcgtggggtgcagaaggttttgatccttttgttccggggggaatagcttctcatcatattgctgcgggtacattgggcatattagcgggcctattccatcttagtgtccgtccacctcaacgtctatacaaaggattacgtatgggcaatattgaaactgtactttccagtagtatcgctgctgttttttttgcagctttcgtagttgccggaactatgtggtatgggtcagcaactaccccaattgaattgtttgggcctactcgttatcagtgggatcagggatactttcagcaagaaatatatcgaagagttagtgatgggtt

SEQ ID NO: 27217 - DNA, 20969 bp, Oryza sativa
tttggtatctttcacctctcttttttgatttgacatgggaaacatctcccatcccttctttgactctttttccttttttatacgggaaatgatcccaaatgacaaatgaataggtgtggaagttataattgtaaataaaccacgatcgaatctatggaagcattggtttatacgttccttttagtttcgactttagggataatttttttcgctatcttcttccgagaaccacctaaggttccgactaaaaaagtgaaataatttaattgaagtaagaagtctccccatctgggagacttcttacttcaattagtccccgtgttcttcgaatggatctcttaattgttgagagggttgcccaaacgcggtatataaggcatacccagtaaagcttacaagtaaaccagatatggagatggcgactaaagttgctgtttccatttttatagaatttcaagattacaatggatctacgaaaagatcgtgtatttacaactacaacggaatagtatacaaagtcaacacaaatcattaaatggaatttatggctacacaaaccgttgaagatagttctagacctggaccaagacaaactcgcgtaggtaatttattgaaacccttgaattcggaatatgggaaagtagctccgggttgggggactactccttttatgggggtcgcaatggctttattcgcggtattcctatctattattttagaaatttataattcttccgttttactggacggaattttaatgaattaggtttctactaacgaaaactacgaagtcatagtttttccatccaaaagagcctttctactttaagctctacatttctagacattctggtagttcgaccgtggaattttttggtttcggtatctctggaatatgagtgtgtgacttgttagaatttgctcctattgataatacatagaaagcacctgttatctctatcaagatgattctaattcgtcggatattatttattctagtatctggaacacgaaatagatagagtggatcaagaaaaaaaaatgaaactatgattcatattaactattcagacctcgcaaccagactgaaaaaaattcaagtagttcttaataaaaataaaaaaagaaaatttcttccttccaattttgtttgcccaaaaaacaactttttttctctcgattttgtcgagtcattacaccgattcaataaatgatcatcaagcggttcttattcgaagaacccttgccttttgtttagcttgagactcaatcatcgtggctctagtatgaatctaaggttttaattgaactgattcataggatcgcaacaagataatttctaccagaaaactactccaatttttgctttatttatttatctagtaaaacaagagtaaatctgcattacgcacaaaaaaaagaaatccaaaatagggaagagaaaaatcaagaggcctctaatgatcaacatttgggaaagaaagatagacgagccaacttgagattttttggcattatcatcacaaagaagaaattctggatttttcttatttcatatcttcaaggcaaatcgacccaacccagtggctgatgaagttttgaaccttttttctaatatccgttgaaaatttgtgtgtttctgtttgagccgtacgagatgaaattctcatatacggttctcggaggggggttcgggttagttacctatctcaataaagtatatgattggtttgaggaacgtcttgagattcaggcaattgcagatgatataactagtaaatatgttcctcctcatgtcaacatattttattgtttagggggaattacacttacttgttttctagtacaagttgctaccggttttgctatgactttttactatcgcccaaccgttacagaggctttttcctcggttcaatacataatgaccgaggccaactttggttggttaatccgatcagttcatcgatggtcagcaagtatgatggttctaatgatgatcctgcacgtatttcgtgtgtatctcacaggtgggtttaaaaaaccccgcgaattaacttgggtcactggtgtggttttagctgtattaactgcatcgtttggtgtaactggttattctttaccttgggatcaaattggttattgggcagtcaaaattgtgacaggtgtgcctgacgcgattccggtaataggatcacctttagtggagttattacgtggaagtgctagtgtgggtcaatccactttgactcgtttttatagtttacatacctttgtacttcctctgcttactgccgtatttatgttaatgcactttctaatgatacgtaagcaaggtatttcgggccctttataaggaaggcatctcatagagagttctaattctcatatatcatatcgggtaggttgtggtatttcattgctacaaacatgggttattctaaaataagacatgtcatttagatacttctcttcaactccgaactattgtgatacaaataatacaaatagttgaagttaattttacgaaagaaaagaaggcggattatgggagtgtgcgacttgaattattgatttggccatgcagatagagagttggatctgccacattagaattcacgaccaaaggtgtctccatatccaatcaacacgtaagtcccctgtctagtaaggataggctggttcacttgaggagaatattttctatgatcatacctcaaccatgtcatccatgaagaggctccgtaagatcccatagagtagaaatggaataagtcatgtgacatgatccaattctctatttattacacttactttttattatagtatggaaatgcattcattttctttgcatcgattgcgatctgcaatactatcggagtaaaagaagggatctaaggaagaacgtaggctaaactttttgattttttattagtaacaagtaaatactttgtttggacgtaagaaacttgcaatattgggggggataaataccaactaatcaagagacgcgagacaatccacaaagcaattgatcatgatcaaatttgtaagcccacttggatattgagcatttacccataagagtaggattcttttcaatgaatagttgtaggtgcaacttcggaaaatagaatctgataaagcttttcttacttagagccattgagccattatataccttattctattatggatcttctacggttttatttctttcattcttgctcgagccggatgatgaaaaattctcatgtccggttcctttgggggctggatcttaaagaattcacctatcccaataacaaagaaacctgacttaaacgatcctgtattaagagcaaaattagctaaagggatgggacataattattacggggaacccgcgtggcccaacgatcttttatatatttttccagtagtaattctaggtactattgcatgtaatgtaggtttagcggttctcgagccgtcaatgattggtgaaccggcggatccgtttgcaactcctctggaaatattacccgagtggtacttctttcccgtgtttcaaatactccgtacagtacctaataagttattgggcgttctcttaatggtttctgtgccgacgggcttattgacagtaccttttctagagaatgtcaataaattccaaaatccatttcgtcgcccagtagctacaaccgtttttttaatcggtactgcagtagctctttggttaggtattggagcaacattacccattgaaaaatccttaactttaggtcttttttagggatttttcagtttgattcattcaatcgtgaagtaccgtgcataggtatctaggaaatagttacttccaagtgaatcttccctagatacctataatctattttattatgatccatttcgcgaaaatatagattgtcccaaagatgcaaaattgttttattttttctttttattctaactcgaaaaagaagaagaggaaaaaattgcaatggatttaaaactagaacttattcttaggtaaatccattgggagatgcttctctagagtgtcccatatctgttttccatcttgcatacgaaaactgtcaattctcatcagatcttcttccgtcttactcaaaaggtccaatagtgtatggatattggcccttttgagacaattatacgttctagaaggcagttctaattgatcaataaaaatacaattcaatggaattctttttttgtttttctttagattagttaatcttttttgaaagcttaaaaggggggaagtaaacctgtttttattttcttggaaacgagtaccctcttcctccgtgtgaagaaaaggaagaaataaatcaatcaaattacgagaagcctcataaagcgcttccttaggggttaaacttccattggtccatatttctagaaaaagtatctcatattttgcatttccattcccacaagcaaaaatactataattcacatttcgaacaggcatggatacagcatctataggataacttccatcttgagtgttctttctgacttccgtgtgatatccgcgatctctcttgatccgtaactcaatacggaaatccgtgggttctgtcaagttagctataggttgtgccgtatcaacgatttctacggaaggcggtaagataatatcttgggcagttatgtatctaggacctttgacgcaaattgatgcggttctaactccatagagattacttctcaatacaatttctttcaaatttagtaaaatttcttgtaccgattcttcaatacctgctattgtagaatattcgtgcggcacgctcccaaattttgcatgtgtgatacatgttccttctgtttctccaagtaaagctcttcgcaaggcaataccaacggtatccgcttgaccttttctaagcggggacagaatgaaacgaccataataaagacgcttactatctactcttgattcaacacacttccactgtagtgtttgagtggatcctgctacctcctctcgaaccatatagactagtattattatttgatcattgaatcgtttatttctcttgaaaggggtttaattcttttacagacgtctttttttaggaggtcgacacccattatgcggcataggtgttacatcgcgtatacaacttaatcgtacaccacttttagcaatggctcgtaatgcggcatctcttccactaccagcaccctttaccataacttctgctcgttgcaaacccactgtacgaatagcatctacagctgttctttgaccagcatagggtgatgcttttcttgagcttttgaatccacaagtacccgcggaggaccagaaaaccacccgaccttgcggatctgtaacagttataatagtattgttgaaactagcttgaacatgaataactccttttgttattctacgtgcactcttccgtaaactaaaacgcgcattcctacgcaaaccaatacgtactttcctacgtgaaccaatttttggtatagcttttgtcatattttattatctcataaatatgagttagaaataacaaaaagaaaaaaagatacaaagatatccgtttcagggtaaaatatatcctttacttgaatttttttatttggaatttggacattttcgcgggtacttttttttttactttttagaaagtcaagttcttttttcgaaagattacccctgtctttgtttatgcttcggattggaacaaatgactctaattcgtccacgcctacgaatcagtcgacattttgtacaaattttacgaacagaagctcttattttcatatttccgtattcctttcttaaactatgaatttactcttttggaaaaaataagtctctttgtttgaattttagaactttgaattttttaccctagaaaaaaaaaagaaaaacctaaccctttgaatctttggtatccttcaaatcttcggtatccttcgagtcttcggtacgcttcgaatccttatggggaagtctataaattatacgccccttgcttgaatcataacgacttacttcaattttgaccctatcccccatcagtattcgtatagaactagaccggatctttcctgaaatatagcccaggatgatggtgtcattctctaggcgaacgcggaacattccgttgggtagggcttccataactaaaccctcgaaagtaatttttgcttctctcgggttttttttttctctcctatttttcttttctgtcatatttttttttctcctatttttctttttttattttcaaataaaaaaacgttgtatttttgtttgaaaaataggaagttcaagatagaatttgggtactataactataggtggggcgattaccgctataggcggggcgattaccatatataacataagacttctcccccaattctgtttagtcgagcttctcgatctgtcattatacctcgagaagtagaaagaatagcaattcccattccgcccaaaaccttaggaattccttgatagttggcataaattcgtaagccaggtcggctgatacgctttaaaaaggttctagttctatatattccctttctagtctttctcttttgatgtcgcaaagttgaaaccaagaaatatctgttactttcctgatgtttccgaacactttcaataaaaccctctcgtagaagtattttaacaatgttttcggtaatatttgtagatactacccgaacagttccttttttattcatgtccgcgtttcttatagaggttagtaaatcagcaatagtgtccttgcccataagactctaattctaggttcctcctaatttttctataatcaacatgttctcttttttcttttcgttttggattctaaagcatatacgtgaaacacaatctactaattttttatttgatctatatcttgtctactagtatttataatacttcaggagctaatgaaactattttagtaaaattcaattctctcaattcctcggcgatcgcgccaaaaacgcgagttccttttggatttcctttttgatcaatgataaccgctgcattgtcgtcatagcgtattattataccgtcttcgcatttgaactctttacatgtacgtacaattacagctcgaattacttcggatctttctagaggcatttggggcactgcgtctttgattacagcaacaataacatcaccaatacgagcatatcgctgattactagcagctcctatgactcgaatacacatcaattttcgagctccactgttatctgctacatttaaaagggtctgaggttgaatcatattattttgatttcaatttgttatttcaatgcaaaaggatgaaagaaatattgtctttccagaaagaagaacctggttttttattttcaatactactttttttggggggttatatttctaaccgaagaaattgacttcgtatgggcattttgctggcagctatggaaatagctgctctagctacagtttcggatactccgcccatttcataaagtattcgacctggtttaacaacggctacccaatattcgggggatccctttcccgaacccatacgtgtttcggtcggtcttattgtaaccggtttgtcgggaaatatacgtacccagatttttccaccacgacgtgcatatcgtgtcattgctcttcgtcctgcttctatctgcctcgccgtaatccaagtgggttcaagtgcttgaagagcatatctaccaaaacaaatacaattgcctcggtaggattttcccttcattcttcctctatgttgtttacgaaatctggttcttttggggttatagtcgatggttctctcttagttccatctctactgcaaaactggacatgagagtttcttctcatccagctcctcgcgaatcaaatgagaaagtgtgcaaatttctctaattccacaatattctaaaatattacggatagatacacattaataggaaaggttagggtttttaatattgaatttattaaaatactaaaatatatagtcaagaaagaggatctagaatatatctagatgtgtatgtttatttatctatattctatatttaatgtaattctttttttttttttttttaatctcctttttttattttactcttattgaatcgcggtaaagtattctaattcaataaaaatttcgcgggcgaatatttactctttcctgtcttatttgttaattcataaccttatcaaataagacaatttttttggtttgttccgccatcccacccaatgaagtattgggattcttttcaagaaaatcctatccagtcataggttctgtcgttcccactgcttctcctttaatggttaggtttgaatctcgcaatggagcttccaaaaaatttctttccgagtcaatttctcagttttattaactcgggacgctctttgttattccttgaaatttgtatttcttgtttcaatcaaattacgatttcgaattctctgttatttttattatattgatgctttatcacattgctttttatgatgtaattcatagaccatacatattggaatcctatatctttcttatttctcttccttctttctatcatccttccttttatctacatcccctttagttttgcttcacaacttagaatcctatttttttttaaagaaaaaattgcagttgctacacgtatatgatagatttactcatttatgatagatgtatttattcatatagtgactgtttcttagttaggatctcgacaatacgaagcaataggttggttattagttcattttctataattacatagtagggttcattctatttttttttaatcccctttttgaaccctaaaaaaaaactaacgagtcacacactaagcatagcaattttattaaaagatttctcaattttcattaaatcttatagaaagaggtagaatttcttctttttttcaggattttagggaaaataaggctcttgtcattttttattctattactgaacagaatgggaagacagggttggttattcttcgtctacgaatatccaaattttaactcctaatactccatagatagttcgaattggatagcagcaataatcaattttagcgcgaattgtttggaggggaagtctaccttttttgatgcactcggcacgcgcaatttcttttcccgcgagacggcctgcaatttttacttttactccctttatatctgtttttttagttaattcaatggcttttttcattgcctttcggaatgaaactctattttttaattggaaagctatatattctgcaagaatgttaggttgtctataaggttctttcactttttcgatcccaatattaagtctctggtttacagaattaacttctttttgtagatctttctctaattcttcgattgctccttttttctttaataaattggggaatccaatatggattatgacgtggattgtatcgatttctttttgaatttctatatgtgtaattacttcggaacttgagcctgagtccatttttttattatgtgtaattacttcgaaacttgagtctgcttctatttttctattcgagccctttttcctattcttttgtatatagttcttgatacaattccgtatttttttatcttcctgtagaccttcagaataattttttggttgtgcgaaccaaaaggaatggtgattttgggttgtaccaagtctgaaaccaagtggatttattttttgtcccatatttttctattctattttttttaccgggaatcaaatcttagatggatctaaagattatttcgatttctttactatatttagtacaattgttatatgacacatggttttttttatgggagaactacgtcctcgagcccgaggtctgaatttattcataatagtactcctactgacttcggctttagtgatgaataaatttgctttgtcgaaatccctataatgagtagcatttgctgctgccgaataaaccaactttaagatgggataagatgctcgataaggcatgaggttcaatatcataacagtttcttcgtagtaacgccaacgaatctcatccagaactctttgtactttgaaaacggacatgtggatgcgtttttgtgctttgaaaacccgttcgaacttaagtagacgatcggttggtacttttcttgcgagtttccttagcccactcttcttcttctttatcctaggggtatactttaccagtttgaaacttgtcataaataaggttattccccgcttacctatttcttttttttttattttgaatctttctattctgaattcagttaacgacgagatttagtatcctttcttgcactttcataactcgtgaaatgccgagttggtacgaattcccccaatttgcgacctaccataggatttgttatgtaaataggtatatgttcctttccattatgaatcgcgattgtatggccaaccattgcgggtagaatgctagatgcccgggaccacgttactattgtttctttctcctccttcatattgaccttttctatttttgccaataaatgatgagctacaaaaggattcgttttttttcgtgtcacagctgattactcctttttttccattttaaagagtggcattcgatgtccaatatctcgatcgaagtatggaggtcagaataaatagaataatgatgaatggaaaaaagagaaaatcctttagctggataaggggcggatgtagccaagtggatcaaggcagtggattgtgaatccaccatgcgcgggttcaattcccgtcgttcgcccatcccattattgcaaattccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccgcccccatgggggtggtccacagggttcataactacccctcttactacggggcgtttacctagccaacacttagacccggctctacccaaacttttttggttcaccccaacattacccacttgtccgactgttgctaagcagttttgggataccaaacggacctccccagatggtaatcttaaagtggccgatttaccttcttttgcaatcagtttcgctacagcacctgctgctctagctaattgcccaccccttccacgtgtgatttctatgttatgtatggccgtgcctaagggcatatcggttgaagtagattcttcttttctctcaaaaaaccccttcccaaactgtacaagcttcttccaaagcatacggctttctagatgtatatgacgatctctagacagatggatcttatatgaatcgtatgatgaagtaccacatgagtggatatataggaaaggaatccaaatctgccgaatcgctcatgttatgatcttctacatcctaggtctccgcgttccgtcatctggcttatgttcttcatgtagcattcagatcgaatgactctatgaaattacgtcgatacttctacatattatgggtaacgtaggagacatccctattttcccccgggggtcttaattaccactgcttagctttcaattcgcctctgaccatcaaattaaatgtgaataacccgtcctcctctctttgaaacaaggggcgcttccggttctgtgcgtgcttcaaacaattttgtcttctccatattaccatatctctagagtcaataattttctatgaggaactactgaactcaatcacttgctgccgttactcaacagttttctgttgaggtctatcccgtagaggtagtcaaattggatcagtgatcgatttctaggtttcgtcgtaaacctaattggttacttccaattacgtaaatcaatagttcaaaccgcactcaaaggtagggcatttcccattgatataggaacttttgtaccagaaacaatagtatctccaattatagcccctctgggatgtaaaatatatcccttctcaccatccccatagtgtatgagacaaatgtacgcatttcgattagggtcgtattctatggttacgattctaccagatatgtctttttgattccgtcgaaaatcgattttacggtataggcgcttatgacctccccctctatgccttgcggtaatgattcctctggaattacgacctttaccacaacggtgccgtccatggatcaaattatttcgtggattggatttcacttgcctatctatggttcccttgcgtgtgctcgggataggtgttttgtataaatgtttcgccgtattattaagtattctcctttagtttttttctctatctagaagtggaatagaataacccggttgaagggtaatgatcatacgtctgtaatgcattgtatgtcctagaatagggcccattcttctaccctttccgggtagtcgatggctattcacagctactaccttaacaccaaagaagagttcgacccaatgctttatttctgtcttagtgaatcccgattcgacattaaaagtatattgattctttcccaataaacgaagacttttttctgtaaatactgcgtatttgattccatccataaatcgactttccctcctatgctctgagttccagtatcgataagaattcgagttcttattgttcttatgttatggtatgaatataccataccaattcgttatgtatggatgatggatgagattccatggatagagagccagttccaatagacttatggaacgttccggttcgcgtgcatccagcaggaattgaacccgcaaatttaccaattatgagttgggcgctttaaccattcagccatggatgcttaacagggatcatcgtacatcgtaaataaccaattttcatatagaaagacatatcatagaaaaatgaaatcgaaaatattcggagatggcaaatattcggagatgactatgaaaacacctctctggatcctcgaattgaaagagagattgagagggatccagaatcctaattctcgctatttggaatggatccaattctattgagtctgactcatagtgatcatttctctttagcaaagaatgaccttggttatcaaaggattgaacaaccgggatccgtttacttatgatacctagttgacattgataacaaggatctaatgaattatgagtttaatagatcctctttagcagaaagacgtatattccttgctcatcacttattcccaaacctcgtatggggctaatcgttttcatttaccatctcagggaaaatccttttcgttccgcttagccctatcgggtattttagtgataggttctataggaactggacgatcctatttggtcaaatacctaatgaaaaattcctattttcctttcattaaggtacgagggcttcttattccacaagaaaagaacgaaagcaccttttcattctttcatatactgggggtttttacttggaaaagacaatgttccatactaaaggattcgggtccataaccacgagttccagtgcactagatcttgtagcacttagcaacgaggccctatgaatagacatatagaatttttggtcgggaaattcgaatgaatcattgagtgaaaaaggagcaaagaatgacaaaagacgagactctactagtcttcactcttgtggtttcctcggtttctgttttcttattcgggatcttgcttttcatggttctcatctctgcaactcgcgattttcgcgagagaaccaaatccaagttggtgaagatcatgatttgggctggcatagtagtgattacctttgcaattgcggttcgaatctatccgatctttatctttttgctcaaagaacgaataaaaccccttgtcgaagccctttatgataagcttccctggatctgggaagtttctctttcacggtattgggatcgtttgatcgatttccttgatcgctacttatgggcgtgcgctcaaaggatacaaacagggattcgcaaacaaaaaggggaattcgtagtcactttttcctgtcgcgtaaaaaaaaggctttacgcgagagcaatagaggttgggatacatctatctcttctgagcaacctcttttggattcttaagaccacccttgcagtaggataccgtctgctttgggttctttattatattatctccttcgagggatttttaggatcgttcaggctatatttagtctattttggcttttactgtctccttttctcagggaagtggttaaggacctcagaagatagaggagagcgccaggcgcagatttccggaatacttctacggggaatgctcattgaatgcgcattctccgtattatgccttgaagaggactcgaacctccacgctctttagcacgagattttgagtctcgcgtgtctaccatttcaccatcaaggcatcttgaaagtgaatcatattccatgaatatgatatctatctaatgtgatatcttgaaagtgaatcgtattccatgaatatgatatctatctaatgtgatatatggaatatatgacaaaggtggagtcttggagtatttcgatcgatcggtcatataggcctgagtcagacatcaaatagcttcgatttgcattatccgtaggacaccttatatgtatcaaaatcaaaaagatgtacaatccaatttctcgattcaatagaagcccaaagaggtgcatatggtacccaaataaggataggatagatatgtcaaaagcaggtctgattacacctattcctaatcctaaatagaatgtaaggacgtggggatttctatgtaaacagagtatcctatttccataggctcgaatgaccccttctcataataagaatgtgcacggtctggtccggtatggaatgaacttataatctgatgatcgagtcgattccatgattataagttcattaccctagcgcccattcccattttgggcggaacagatctactaattcttttattccagttagtaagagggatcttgaactaagaaatagacctagcagctaaaagagggtatcctgagcaattgcaagaatggggttcattgatattcctggtatagtagatgctatcacacatacagtcatactcaattcgatggaattgtttgatcttaaaggggatcttctataatttcgcacataaggggttatttcttggtttcgtccagtcattaataacttgactatttttagataatagtagatagaaagaacgctcgtaaggagtcctattgaaaccaagaaatataggcctgcttgccatccacaccagaatagatagagttttccgaagaaacctgctagtggaggaaggcctcctagggataagagacatagggctaaagagagagccaaaaaaggatctttcgtgtataatcctgcataatctcgaatgttatcagttccggtacgtagaccaaataatacaatgcaagcaaaagttcctagattcatggagatatagaaaagcatataagttatcatgcttgcatatccatcatttgagtctccaacaattattccaataattacatatccgatttgccctatggacgaatatgcaagcatacgtttcatgcttgtttgagtaatagcaaggagattccccaatatcatgctaagaatagctaggatttccagaagaagatgccattcgtttgatgagaaataaaaaggaatatcgagaattcgcgtggctgaagctgaagcagcaactttcgaagtaacagaaagaaaagcaacgactggagtgggggagtcagagtcgaaaagaggattcctcgcttctttctctcatgcaaaaccgtgcatgagactttcatctcgcacggctcctaagtgataaaagaaagaagaacttgtcttctttcttttttgattaccttcctcgcgtatgtataagaccgaatccattctttttcgaaatcgatttcgaaaaagaactactaatccttaacttttcgaggaatccttcatcagtggttgtgaatgactgactttttcaatcctttcgaccttggttccgtaggagcaagtcagaaaggttgagaaatagaaccatctgatttgattcgttcccaatagccatgagatgatcatcttagggtgatccttttgtcaacggatgctcctattacactcgtagtctctgaaggatgagaacccactatgtagcatctacgtcgataattcaagcattgtatacgtcattagtccgattctttgtaggaactacccgtaataacgagcttgcaaaatggatctgtttatcataaagagattcgttgttcctgaccctgcttcaccttaattgttatttgaacaaaaagatcacaataaacttttggtaaaagttctgtcttggtcggagtggggatagcatttctcttctgcatatctatggagttttgcaaaacccaaacacctcagagatagatatagaggtaggaatttgtcgaacgaaccacactccttcgtagacgtcaggagtccattgatgaaaaggggctggggaaagcttgaacccaagtcctacagtgatggatataagcgcaattgaaattcctggggagttatacatttgtgtattgataagaccgttcacaatttcttgaagctcgatctcccccccagatgaaccatatagccaagagaaaccatgaaccagaatagaagagcttgccccacccatgagtaaatatttcatagtagcctcattagaccgtagatctctcttggtatatccagacaataggtaggaacataaactgaaacattctggagctacaaagatagttattaaatcgttagcaccacataaaaacattccccctagagtagctgttaatacgaataacagaaactctgttatagccatttctgtacattcaatgtactctacggatagaggaatacataaagttgaacataataaaataagaaattgaaagatttcgttgaaattgttcgtttggaaatttcccgaaaagctaattataggttcttctctccatcggaacaatagggccgttatgcttattactaaacttgttgaagagatgaaatagaaccaaggtctatctttttgatcagaggttaaatcgatcatcagaagaagaattaggccaaaaattaggatacattctgggaaaatgaaacttccctggaagagaagcaaatgaaacgctttcataaaaattctcgtagaatcgagaatgaagttttcattctgtacatgccagatcatgaattagtaactgcatccaatctccgaaaagtcccgattgtttcgatttttggaatgggatatttacggaatccccatgaataggatcaaaccttattccatgctatttccataagattcctctttcttattcttaagcaagcccccgagagggcttagttgatcatgatttctgttttctctttcttttcctttttgtttgtttcgagaaagatatcgtccgattctccttctattgattcttttccgatcgagatgtatggatccatgtgtctacatacctagattctgttcatggattaacgaaaatgtgcaagagctctatttgcctctgccattctatgagtcgcttcctttttgcgtatggcacccccaccccctttggcagcatctactaattcggaacttaatttgaaagccatatttcgacccggacgcttttgggatgcttctaataaccaacgaatggcaagtgctcttccttgtttagatcctatttcaatcggaactttccgcgtcgatccttttttattacgtcttgtttttactcctatattgggagttactctacgtattgcttgacgtaaaaccaatagtggatttgtttctgtcttttgttgaatctttttcacggctcgatagagaatttgataagccaatgatttttttccgtctttcataatacggttaaccaccatgttaactaatcgattacgaaaaattggatcggattttgcagttcttttttctgcagtacctcgacgtgacatgagcgtgaaagaggttcaagaatccgttttctttttataagggctaaaaacgaatcacttatttttttggctttttgaccccatattgtagggtggatctcgaaagataggaaagatctccctccaagccgtacatacaactttcatcgaatacggctttccacagaattctatagggatctatgagatcgagtatggaattcagtttactcacttaaaattgagtatccgtttccctccttttcccgctaggatcggaaatcctgtattttccatatccataccatcaagtccttaggtttccgaaatagtgtaatggaaaaagaagtgcttcgaatcattgctatttgactcggacctgttctgaaaaagtcgaggtatttcgaattgtttgttgacacggacaaagtaagggaaaacccctgaaagaatttccatattgaccttggacatataagagttccgaatcgaatctctttagaaagaagatcttttgtctcatggtagcctgctccagtccccttacgaaactttcgttattgggttagccatacacttcacatgtttctagcgattcacatggcatcatcaaatgatacaagtcttggataagaatctacaacgcactagaacgcccttgttgacgattctttactgcgacagcatctagggctcctcgaataatgcgatatctcacaccgggtaaatccttaacccttcctcctcttactaatactacagaatgttcttgtaaattatggccaataccaggtatataagcagtgatttcaaatccagaggttaatcgtactctggcaactttacgtaaggcagagttgggttttttggggttgatagtggaaaagtcgacagataagtcacccttcctgtccctctacagaaccgtacatgagattttcacctcatacggctcctcgttcaattctttcgaagggatccttttcctcgttcgagagtctccgcccttcttccactccgtcccgaagactaactaagaccaattgagtcacgttttcatgttctaattgaacactttccatttatgattaaaggagaagattgttcttttaccaaacatatgcggatcaaatcacgtcttataataagaagaaatctttctcggtatcaatccccttgcccctcattctttgagaatcagaaggatccttttcgagtttccatttcttcatttggaatctgggctcttctatcttcgacttattttttttttgctttattctttatttatttcatttcgatttttccctcttcctctatccctatcctctaggtacagcgtttgcatcaatagagaaccttttcctctgtatgaatctatattattccattccaatttcttcccgaaacttcccaagaaaaatcccgaattggatccaaaattgacgggttaatgtgagcttatccatgcggttaggcactcttcaaataggaatccattttctaactggctttcgtgctttggtgagtcgtccgagatcctttcgatgacctatgttgtgttgaagggatatctatatgatccgatcgattgcataagacccgcggtagcaatagaacggggaaagtatacagaaaagacagttcttttcaatttcgattatctatatattagttcgtttctatttctagatatctatttctatatattagtattagttagtagtactattctattagttagcgatcccggctctgtgagttctttcttccgtgatgaactgtcggcaccagtcctccattttttctctgtggaccgaggagaaagggggctcagcaggaagaggattgtaccatgagagaagcacagaggtcaaccctcttcaaatatggaacatggattctggcaatgcaacgtagttgggtcctcatatcgatccgaatgaatcagtctttctacagaggtcaatctttgcctattaggcaagaggatagcaagttcgaaattctgtctcggtaggacatggatttctattactatgaaattcataaatgaaaatgaagtagttaatgggagggctaccattatcctttttcttgtatgtgttcctaagagaaggaatttgtccatttcatgtttcgaggtctcaaaaaagggcgtggaaacagatagaaactcttgaatggaaattgaaaagaaatgtagccccagttccttcggaaatggtaagatctttggcgcaagaagaaggggcgacccatatcatcttgacttggttctgcttcccctctttttttaagaataccgagtcgggttcttctcctaccagtatcgaatagaacatgctgaacaagatcttcttcatggaaacctgctcgatttagatcgggaaaatcgtacagattttatgaaaccatgtgctatggctcgaatccatagtcaatcctattttcgataggaccggttgacaattgaatccaatttttcccattatttgactatccataatagtgtggaaagaaagcccggaggaagggtggccttgagtttctcgcccctttgccttaggattcgttaattctctttctcgaggggacggggaagggatataactcagcggtagagtgtcaccttgacgtggtggaagtcatcagttcgagcctgattatccctaaacccaatgtgagttttttctattttgacttactccccccgccacgatcgaacgggaatggataagaggcttgtgggattgacgtgatagggtagggttggctatactgctggtggcgaactccaggctaataatctgaagcgcatggatacaagttatccttggaaggaaagacaattccgaatccgctttgtctacgaataaggaagctataagtaatgcaactatgaatctcatgg

SEQ ID NO: 27218 - DNA, 215 bp, Oryza sativa
  unsure (1)..(215): unsure at all n locations
atgatttttttccgttttttataatacggttaacccccatgttaactaatcgattacgaaaaattggatcggatttttgcagttcttttttctgcagtacctcgacgtgacatgagcgtcaaacaggttcaagaatccgttnnnnnnnnnnnnnnnnnnnnnnnnnnnnnnnnnnnnnnnnnnnnnnnnnnnnnnnnnnnnnnnnnnnnnnnnnn

SEQ ID NO: 27219 - DNA, 781 bp, Oryza sativa
  unsure (1)..(781): unsure at all n locations
nnnnnnnnnnnnnnnnnnnnnnnnnnnnnnnnnnnnnnnnnnnnnnnnnnnnnnnnnnnnnnnnnnaatggggttcattgatattcctggtatagtagatgctatcacacatacagtcatactcaattcgatggaattgtttgatcttaaaggggatcttctataatttcgcacataaggggttatttcttggtttcgtccagtcattaataacttgactatttttagataatagtagatagaaagaacgctcgtaaggagtcctattgaaaccaagaaatataggcctgcttgccatccacaccagaatagatagagttttccgaagaaacctgctagtggaggaaggcctcctagggataagagacatagggctaaagagagagccaaaaaaggatctttcgtgtataatcctgcataatctcgaatgttatcagttccggtacgtagaccaaataatacaatgcaagcaaaagttcctagattcatggagatatagaaaagcatataagttatcatgcttgcatatccatcatttgagtctccaacaattattccaataattacatatccgatttgccctatggacgaatatgcaagcatacgtttcatgcttgtttgagtaatagcaaggagattccccaatatcatgctaagaatagctaggatttccagaagaagatgccattcgtttgatgagaaataaaaaggaatatcgagaattcccgtggctgaagctgaagcagcaactttcgaagtaacagaaagaaaagcaacgact

SEQ ID NO: 27220 - DNA, 441 bp, Oryza sativa
  unsure (1)..(441): unsure at all n locations
nnnnnnnnnnnnnnnnnnnnnnnnnnnnnnnnnnnnnnnnnnnnnnnnnnnnnnnnnnnnnnnagaatttcgaacttgcgatcctcttgcctaataggcaaagattgacctctgtagaaagactgattcattcggatcgatatgaggacccaactacgttgcattgccagaatccatgttccatatttgaagagggttgacctctgtgcttctctcatggtacaatcctcttcctgctgagccccctttctcctcggtccacagagaaaaaatggaagactggtgccgacagttcatcacggaagaaagaactcacagagccgggatcgctaactaatagaatagtactactaactaatactaatatatagaaatagatatctagaaatagaaacgaactaatatatagataatcgaaattgaaaagaactgtcttttctg

SEQ ID NO: 27221 - DNA, 442 bp, Oryza sativa
  unsure (1)..(442): unsure at all n locations
nnnnnnnnnnnnnnnnnnnnnnnnnnnnnnnnnnnnnnnnnnnnnnnnnnnnnnnnnnnnnnncatggaaagggatgtggttatgtcagcagacgaagccaaagcttatggacttgtcgatattgtaggggatgaaatgcttgacgagcactgcgatactgatccagtgtggtttccagaaatgtttaaggattggtagtggccagatttcttgtaaatttatttcaaccctaaattcgggttttatgcaatttaatggaaatacttcataatgatcaatcattcaggttaagatcgatctaaaccaatccattttttctatataccaatttcacatgccaacggttaaacaacttattagaaacgcaagacagccaatacgaaatgctagaaaatcggccgcgcttaagggatgtcctcagcgtcgaggaacatgtgctag

SEQ ID NO: 27222 - DNA, 482 bp, Oryza sativa
  unsure (1)..(482): unsure at all n locations
nnnnnnnnnnnnnnnnnnnnnnnnnnnnnnnnnnnnnnnnnnnnnnnnnnnnnnnnnnnnnnnnnnnnnnnnnatatgaaaagaaggcggattatgggagtgtgcgacttgaattattgatttggccatgcagatagagagttggatctgccacattagaattcacgaccaaaggtgtctccatatccaatcaacacgtaagtcccctgtctagtaaggataggctggttcacttgaggagaatattttctatgatcatacctcaaccatgtcatccatgaagaggctacgtaagatcccatagagtaaaaatggaataagtcatgtgacatgatccaattctctatttattacactcactttgtattatagtatggaaatgcatacattttctttgcatcgactgcgatctgcaatactatcggagtaaaagagaggatctaaggaacaacgtccgctaaacttttggatttttaattagt

SEQ ID NO: 27223 - DNA, 748 bp, Oryza sativa
  unsure (1)..(748): unsure at all n locations
ttcgttcgccggacccagaagtaaaaattgttgtggatagggatcctgtaaaaacatcttttgaggaatgggccagacccggccatttctcaagaacaatagctaagggccctgatactaccacttggatctggaacctacatgctgatgctcacgatttcgatagtcatacaggtgatttggaggagatctctcgaaaagtctttagtgctcatttcggtcaactctccattatctttctttggttgagtggcatgtacttccatggtgcccgtttttccaattatgaagcatggctaagtgatcctactcacattggacccagtgctcaggtagtttggccaatcgtagggcaagaaatattgaatggtgatgtaggcgggggtttccgaggaatccaaataacctccgggttttttcagatttggcgagcatccggaataactagtgaattacaactctattgtaccgcaatcggtgcattgatttttgcatcgttaatgctttttgctgggtggttccattatcacaaagccgctcccaaattagcctggttccaagacgtagaatccatgttgaatcatcacttagcagggttattaggacttgggtctctttcttgggcggggcaccaaatccatgtatctttaccgattaaccaatttcttgacgctggggttgatcctaaggagataccacttcctcannnnnnnnnnnnnnnnnnnnnnnnnnnnnnnnnnnnnnnnnn

SEQ ID NO: 27224 - DNA, 193 bp, Oryza sativa
ctggtgatccgggctgtttccctctcgacgatgaagcttatcccccatcgtctcactggccgaccttgacccctgttatttttgggtcatatctagtattcaaagtttgcctcgatttggaaccgctcgcgcagcccgcaccgaaacagtgctttacccctagatgtccagtcaactgctgcgcctcaacgca

SEQ ID NO: 27225 - DNA, 14731 bp, Oryza sativa
  unsure (1)..(14731): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattgcggtgaaagataagcagttagtctgaaatctgtacagatctgtcagctgttaccgaagcaaaaggttcaatgtgaacttaaagatgcagtactgatccttttaagaggatttaacacagatttaacaggtacgtgccccttgtgattctttgttagttttcttgttataatgatgtttttatcctctgaattcaagcagggtgttctgtatgcgagctgtgatgggatggttctcttcagaagcattttattttaactaaattcagaagcatttcgatggcatgaggactgttcgattgacaatttgtatgtacatttccaccgtttacgcagcttaggaattggaccataattagttgtgtacctgcaagttttgtatacgaattatcctgaagggtgttcggtggattgaatattgcccttttggttgttttgcgcatcgtggatgcggctgctctacatttttcttataggaaatcagcttctgataaaagggattattatctgtgtgatctactgatcgatattttacccctctagctgagtttattaagccaattgattatcgagtgggatcctctcaacgacacatgagcatgagcatccggctgtttgttgattaaggccctcttttgtttatgtttaaacctaaataaatagatattttttcgtttgtattttttaaggtcataagtcactctatgttaagctaaaagctaggttacagtagcttttctggtctatgtgaagctaacagtctactacttaaggtttaaaaaacagcggcttaaacaataaaaatattcaaaagaaccaaagcgagagggcttaaatggttcagccgtactttaacggaaaattttttggaaagacaaaatggcaaagttgattgtcacccattattatccaatttcgacgtttggacaaatcctcaaattttaaatgataaaaagtactccctccgtattttaaacgacaccgttgacttttcgaccaatgtttgaccatttattttattcaaaacttttatgtaaatatgaaaatatttatgtcatgcttaaagaacatttgataacgaatcaggtcataataaaataaatgataattacataaattttttaaataagacgaatgattaaacgttgaacaaaacgtcaatggcgtcatacattaaaatatggaggtagtaatttagaaggtaagatattcctttacatgtgtggtagtttttatggcttggggactggggaccaagatctggtgtggttgctagtataactacaacttagcagttgcattagcaatgcatgatgagaaatctaggtttacacaaatgttctttaatacataatctagatcatcgaatcaaaatctggggttgcgaatctgccctagactgcttcgatccttattgcacagttgcagtaagcatataatctccatgcggggacaagaaagtcgattaaggtaatcaatgctagtctttgaggaaggcaacatagggtaattctagttgctaatagctgcgttcgcgacaatgatttgttggggtttacaccctctaccataatgacactaccattatagacattgatatgtgtaacactaagaaagcggaactcacatataagtgaccgtaatggtatagtgatattatggtagaggatcctcacccgatttgttgtcctctttatttccctttttttaagaaagatgacgtgtgtgacttgttagttgtaagatagattcacttgttttaggcgggattatttctcacactacagcaaaagagggggagcaaacacctgattttggtaaccttggtaaagactagaaatgtttctattttctctcaaaatgaaagatagcgaaagtggtgatttggcaaacccaattcaatggcacaagggctttcgccattgtgaaaaggtgagctctcagaagattttggggtgtaggtggatgcatataaatggatgaggttgtttattttgaagttattggctaccatctttgttgctgtagagactaggttttattctattgttaaaaaaaacttgattcaagtgtaatcaactaagagttgagaaggccaatacatatttattccttaccattgtcaatgtacatttactatgcaaaaaaccacatcactaacatttaaaacaagagaaattatatgtttcgttattgacaaactaccgattttaaaagttgccattagaaagctcgagctctagaaaaatatcatcgtacaagtgttttttttctcgttttgtcactgccattaggtttccatccataaacctccattaagtctttagaaaaccaatttgcccctagaatttgataaaaactgtatgaaaaaaatgtttgcacacttaatggagatctttttatgagcagaatggtccttttagaagaatgcaggtctatggatggaaacctagtggcgatgataaaaagggacagaaatgcttgtaccaaggtattttgtatttcgtagaactcacgttcgtcgatgccaatttataggacatgtcgcttgtcaatcgtaaaacgtagaatttctcttacaacaaacaatgcttacttttttcatcacaaatgtagttagtaataaaagttgtaagccttgttattccttgggtttatcccgagaaaactcacaaataaattactaagtctgagttgagctactagctatagtttttttttttggaaaaaaaaaagggttggcttactaactagtgtcaacatcattgagtcacggtgatgagaatgcaatatgttctgcaagctatgctaccttcatatagcatgcctctacccattacatgcctatgtcataattttgcacctatgaagggatgagctagatatacttaagttggcactacttcttaagataactccttatataccatccaaagctaccttatatcccaatagggcaaaaccaatggtagaatttgcttgcacggtaggcattgttaggtctatcaactaaggaaacatttcgcttattggaaggttggttgaagagtaaggacagaggagacaccactacaacataaaagctcatcgtggataggctatcaagaactatttgaaattcctcttatatgaatatagagatgcttggttaccatgtccatctacatttgttgataccaagctaaagattgtctttggtgagagtattcggtacttataaggttcatcatcactatatatagttaatgttaattctctcttctctcctgaagccacatcatcctagttatttgtagcctttggatcattcatctacgatgtaaattgtctatgttctctaggtatacacacatctaatttatttctagcatttttaatacaccatctcaattatttgtaccctttgatctcatatgaagatacattatcttaatatttttagcatgatatataatatataaatgatatttacttatatgatgtccaatcatttaaaataaagcaaatctaatttgcatctcatgtttacttatctcatacattttttccgcggcaacacgcatgggggttcccctctagtatacctaataaacacgaccattgtttttgtatatgcatacatgcatgcagatcacgcgaattataacgtagaggatgaagcaatgtgcttacatgcaataatggtgaaaaggtgtcactaatggaccaaaatgggaatgcatcctgctaagtgctagctaaataggcaatagctccgataacaaagttactgcaatgtacacatgcagtaggtagttttttttttcctggcctgtttaaattaaaagcctagctaattaaagccattttcctgtactttgtgccttagttttgctacgtataactacaaatataaacttgcctaactgatgcacagtaaaattagagaaccttgattgtgttttcttttaagataattgaagtgaacactcccgctctacgtataactacaaatataaacttgcctaattatctcttattacataattcactcaaaacaacggagattttaactgaaaaactctgatgtgtccttactcgaaaataatttcttggtaacagttgagatgatgtagacgaaggaaaataaaggatgttgtcaacacgatgaaaatattgaacatttataagtttgtgcatgtttgaaatatcaaacagtattagtgggaaaattaattatgcatatcatagacggtcagatatcgggaaactatccttcagacatactgtcgcagaaatttgtgaattctgaataaacagcactgacaaatttatctccaccggaaaccaaattaatcaggctttcatctgtgcgatgatcaaatttatcttgttcaattacgcttgaaaagagataaatagtattccggcagggggtgtagtgcatgtgcatatgtccaaccaaaacactggaactaacccaaatgaatagatgatgtcaaaggattatttcgatctctgttcttatttttagttaagtactgcattaattagaacaacttgctagctcctgcatgctttttttattaatctctgttgagttaatttctctcaggttagagtttagaaaggttagttctctgttatatatatgaagacgctacaaaactcctaaacaacacaaatgacagagatcggcagaagaagaaatatgtttagttgcagtcatcaaggcataccttcagctccgagttggggtttgcgacgtgctgctgctcctccttagctcgcccatatcgatcaatcactgacttcatgctgcacaaaacgaatggccggcacaactcttactaagattatttttgtaatctgaaagcacatgcatgcgtgtgctagcttttgagtgtaagagtacggcaaaaagggtaaattaacaattatatgaagtgagcagaaatcatacgtataagtgtacagttatcacacaattttattccaagagtgctagatcaattattgcttcactgcaaagcatagttgacatatttattccttcgaaaaatatgcatgacaaaatagtaaacacacaactgacatatggccatacatagggggaccctagctagaagaaggttaaaaacaaagatgaacaactagtagttaatctgagactaacaggaaattgaagaacctgacacatgcattagttcttaaacacttatggccgatgtatatgtatacatatgacagggaataataggtgcaaagatgcaaaaaaaaaatatatataaaattttcacgataaccttttgtactactgaagctgtcaaaggtaaaactcattcataagattctaatctttcatggagagaaaaaaaaaccgtagaaacggagaacaataataagaagaaagatgccaaccaaataaagtgtttacgcatggagagttgaagacgatcgaggaaaacatgctaataatcataagccaaagcaagaacggaatctatagaaaagctaataagctagggccggagggagaagccattgacctggtgctggcatactcgtagaggcggccggtgctggagaagatgacgaggccgacctcggcgtcgcacaggatggccagctccttggccttcttgaagatcccgttgcgccgcttcgagaacgtcacctgccggctcgtcgagttgtcgatccgccggatcactatcttgcccctccccatcgatcgatcgatcgatctcagctggattgtcgccgctcaggcgagagcacagatagaaatggacagaaagagagagagagagagagagaaagagaggaggagatctagctagcagggagctcttgaaggagaaagctcccaggtttcccagaagagggggttgaattattggagggggggggagaagagaggaagaggaggaatggaaatggaggggtcttttgttggtgcctttgcaagttggctttcctttaattgcttccttcctttatttagttaggaggggagagatatccccccattggctaggatcacaaggtgggttattttaactgtgaatgctaaataaatggctgcaattaagaggccagggcaaggccaggcacaggtagctagcttctagaaattgtgcagtgcctggaattggtcgcactactgaggaaagttaaaggggatgctaaggttgtgcatccatagttgtgctactaattaatccatgtttggtctcttaatattttttattcatgaagaactgatatatatactttctataaaatatatatgccattactcatctttatatttttctagcaatttttagaattttgtattaatttgcaccaacgttacttcaaagtttcaatcatttgccatgatttatatattagacatatatagagacatactgaaaaaaataatcacatgcctagttcattaatttcacattgaatttttttcctctacttttttttttgcatatatataatactgcatttgtcccaaaatataatgatgtcaaaagttgctatattttggaacaaatgtactatatacaaactgaatactctaatttaatttaatcttactcaaccataaaaattgccagctaaaattacctacaccactagaatgtcatcgattacgggtggtttaaatcttttactagcattagagaaggtttgattaaccgcctttggaaaagagtaagtgagataaagagggccatcactgcctcacaaaaccgtcttgaaaactgctgcagctatagtttgaaactaatagatcagaacaatgttctccatacggttctaattaagtcgagaacaattaaccatgataggtgtaacaagtgcgtcaaagagaaatggctaaccttttatagtggctatggattgagctcattcgatttccataacatagcaaggtttatcatctacctaccaaaatagtttcaactagaaaaagacttgtaggaggagaaaagaaaataatgtcatttcgagtaaagtgacccaattttaataaccctgatgataattaaagtgatccaaagatagatttcaatttgcagtgatgatagctgctgcctgagcaatctctactatggctggatgcatgctgtcatcatttttccatggacaatttaaaacataaagcctactactctctctgtattttaatgtataacgccgttgactctttgatcaacgtttgaccattcgtcttatttaatttttttgtgcaaatataaaaatatttatgtcatgtttaaagaacatttgatgataaatcaagtcataataaaataaatgataattacattttttttaataagacgaaaggtcaaacatttattaaaaagtcaaaggcgtcatacattaaaatacggaagaagtacaatgtaaaattctttacatgtactccatccgtacttgtaaaggaagtcgttttggacagcgacacggtctccaaaacacaactttgacttcttgtttctataaaaatatttattgaaagtgatatatatgtatacttttatgaaattattttttaagacaaatctattcatataatttttatatttttaaactcaacaacttgagagttatttctgatttatatttccaagacttgacttaaacattatcataaacgactttctttatgagtagtgaaggaatacatgcatgttcatccatgcacttttgtacatctaaatgtagaacttcatctccttaattagctggtgaggtcaggcatctctatcatagctaatgaggtggtcacacaaacctcggcatctctccctaattaagctccgtttcgtcttaaacaacgttggagtactagagtagtatagtagtactagagtacgccaagctgaaaattttaattaatcgatactaaaattgagacgtgcatctcgtaacaattgtcgcgctgatcacatgggagcctaatataatgcacgcccatgagagggccaccatggcccatccaatgagagctagctagctagctcttaattacttggtggtttagttgcttcgagtttcgctgaagaaaggcaacaacctgtgtcacggtgtgtggttaattagtgtagtttattgttctaaatcgagcaaaacgacagagtgcgtgaccaacgatcctcttaattccgacctcaagagattaattagtcctgtttaatttgccccataagctaaacgtaattagagcaggtacaatagcaggctataagccagctgcaaacatattttaagaagataaataaggagagagaagagcagcgggctacagatttgtaatcagctgtagcacggactctaagacgcggtgtgtgtatgataggtgggactagatatttatagtgtagtatgtaactattgtatgaatgagctattagattggctatatatgaattggagctagtagttggctatactattaaacttgctcttaagctatcaagctatacctcatgtgactagatagccaattgattggctgagacggctactaccctactactaataattaatgataggtgtatatatattagatgaatcaagtgtatatatatatatatacatatatatatatatatagatagaactatgtatagattaatttgtacagattgataagatctatggactgcatgtttcggagttcagctagctgtagagatcgtgcagggtttctgaatagggaaagatggaaattagtgacatcgatccgccattaagtggaggattaactatagcaagttgatgccttttgaattcttacgtacgtaccgcgcaccttcttacaagagaaccacactatactaacactcctttttggatcttctagctcgtagtcgtagacatatgcagcttttctagaatctacatctcactcaaacagtagaaaaataaattcgaaatcaaaatggaaatctagattttccatattctcactatggctgtgtttagatcctaagtttgatccaaacttcagtctttttccatcacatcaacctgtcatagacacataacttttcaatcaaatcatctctaatttcaaccaaaatctaaactttacgctgaactaaacacagcctataactgcacctcaaaatttcgagttccaccgaatagggcctaagtatatctcaaaataatagcaataatatgtcccacattaagtttctgaatttccttaatttctgtaagaatattccctgctaatcaggtcttctatgagcttttttaattattcttgaacttgttttattatcatggtcaacaacttacatgctaggatcctttttttatacatcatgctaggaacttgttcgtcatgtaatgccagttgctaaaagtcaagatataggtgataaaaccattatacacacgccctagctaggtattcctccggtcataatgttgtcttcaattatgtgtatatatatgtagctaatccgcgttaaccttaaccatatgtagttactactctatcgaaaatgtaggttttgggtatatatatatatatatatatatatatatatatatatatatatgaaaataaataatatagtcacatttatcataacgatatatatttttaataatactacacttataccactctctttttcatttatgcaagagaattagaatattagatcatcaaagtcattccatatgtatattggcttttagaaataaaatacataagcttttttatgagggtaggtaccactctcatctctaaactcgaaattaagctaccatgaggcagtgttaagaaaggatagatgctctctccctccgttccaaaatatcttattttaagagtaaattgcattggtggtacataaacttgttagttgggtgcaatttagtatataaacttgtaaaatgcttgtttcagtacacgaacttgtctagttcgtgcaaacgaggataaaaataacttggcaatgttaattttacgaagctgatgttgattaggatatgacgtgcatacgtgtagtaagtatacataagacatgcaatatttataaatttggtctctaattttatcttttatcatggaaaagatgaatttggtatatttctaacccttataccattgctcggttttttaatctttttctactatcgctatatcctactctattttttattgaagcttttttattgaagaggtgtatttctaatagcaaccttctcagatatatgtttacatagtatcctaaccagccctaaatcaataagattagccatgttttattgaagaggtatatgtctaatagcaaccttctctcagatatatgtttacatagtatcctaatcagcccctaaatcaataagattagctatgtagtgtctttttcaccttcctccgcacgcacagacaagttcatataccaaagcgagtattttacaagttcgtgtactagattgcacctacctgacaagttcgtgtaccgatgattcaatttactcttattttaatatgggatgtgatataatcgtagtgttaaaatgtgtcacatattttactaggttaatttattttgatatgacacgaggataatatttaattaaggtcttgtttagttctaaactttttcttcaaacttccaactttttcatcacatcaaaactttcctacatatacaaactttcaacttttccatcacatcgttccaatttcaaccaaacttccaattttaacgttaactaaacacaccctaaaacacaccctaagtactgtaaggaattgcattcaccgatgacaggaagtcttgtcgtaggagaagcactaggtccgtctttttgagtgaatatgcgtttctgagtttgagccagccaagaggttcatggtaccaatgctctattattgcacaagagtgcacgtgaacacgtcaccctgaacggcctgcgcagtgcgcacgagagccaatacatttggttttgcacctttgcttatcacgggttaatcacaaattatttgctccacacttttaacaatacaatttcttaaaaaaaaacgttttctagtgtattgattaaactacttattctaagttatttgttaaatttatttattaaaatatttaatttatacctttaataaatatataatgtgcatcaataatacaataaattattaataatttggttcaatcactgccatagatgagcaaatgtagcagttgctagctagctactagctagtagtagtaccacttatatatgttaggttcagctctatgctagttgcagattgcatatgagggccattcctttggatccatatgaagccgtatatgagttataattgcactttcgcgcgcgaaatgattgttcttcatgtatatttttttaaaaaaacgaatgttcttcctatctcagaaaagaaatctatctcctttcaaccgcatataaatagaaatagttggttgtaactaaacaccgcatctacaaaccttaatcttcactaaaccaggatgatctaaaaaacggtgggcgcgacgcataacattgcttataaagcaagcaagaataaaatgatcactctaacgtgtctaaataagtttcagaaccgtcggaccaatcacagccacatctgatgcgatatatagggcccaccttgttagaactcgacgtagatggaccccccgaataacctataatatatataaaatattgttatccgttgtcgtcttgcaacactaaccatataacacaaattgtttgttgtagttttaataacttgggaataaaatgttcagacttcaaaatggttttgaccaatttcctcctatctcaagacatcatttctaataaacttaattaggtgacaaaagaggacatagattagagagtaaataactttgagagatgtggatatatatgcatccctgcgtttgttggtagctcaaatcattcgccacaaaggatcgccgctagcgattcctcgggcaactgctcttgcactgtttcaggctttggtgcagagctcgaaattggccatgtctggccaatggccatacgccaaccgtaatgactgcagccgttgtcatgtgacggccatactgataaatgtcgccatagtacaggacttgcacgttgcagcgtagcaaacgagcataggatgcagccttcccgatgtggcaagcagcagatgcagctagcggcaagccggccggcgacctggcttttaatttccgggcactgttaacttttggccatgctaaagtctcgtggattccaagtgtcaatcatcgtctgcatggcagagggcaaaaaaagcaagatcttgtccaacaaaggtaaccatcggtggttatagctttgaccatgggtgcaaagcacaacgatgagtatcgttggttgaatggttgtccagcgtttggattccgttctcttggtaattggtctagtagagcctaagtaaacatactttagagaattttgtggattaaataagtattaataatttgttgtttttaatagtttgatctggcacaacttaaaataaatcaggtagatgaacaaagccgtgcaagctccgacaaattaaagtaacctagctagctagctagtaagcattgtatgagtttagtagataaaagataagctttggactcttaaccaccattcaacaacatgttaacccatgacatggcgttcaagagaagtttctcgaaatataactgctatgcatgtgcatccaatcaatgagataagagaggatagcataaatattaacacgaatcaggtcaatcacgtgtgggagattcgcattgtcgataacctttatctgtatgaccaattttcaggctataggtttcctacttttgtcgatattgggccactctttgttttattaaaatagatattttaatttgtacaaaaaccaatttttagcacgactatgaactgcatcattatttcggcttgaaatctactatgtaaacattataaactttcaaataaaactatatgcatagtttctatatatatggtgaattccccctttaaagaaatgatgaccagactgggtttatcatgaatgctacaaaggttttaggccatgtcaacttaataattgtcgtgtagtgcttgcaaattcaagtggtatattttttctaatctgcccatgaccgatgctgtgtgcctgtgtggtggactggtggatcatcaaaacacgcgcagagaactggttgcaatggttaagtttccgttaatttgttaccgcaatgacaattaacagcacaataacgtgcatgagtatagtattttctctaaaaaaagattatgtattaaaaccagaaatatggtgcccactagatgagtggaattaatatatcatattaagaaatgtagcaataaccatcattaggcacaggatgttcttatcataaaatatgcattttggtaggacctttgattagaaatttttctgtttataatatatttatttgcaaaactggttataataatatcgaatagattaatcaaagataggaataaaggaaacgccaaatagtcaacattaacaaaccacgaaagattatagcatactactctaaatgaaaaactttaaataccacatggaactgtgctcttaattaattgtgtctttggcaatatataacactaggaacttctgctatatgttggactctgtggttgtgcagaaataatgtggtttttgataaatcaccatctattacatatatgcaggtaatttttagggcaacatactggctccggctctggactcaactacaaaggtctaatgaagatggtgagttcataaaagttgcatgccagaaacttgagacgatggttatgcaactctttaccaattttggatggagattcacaaatagacttcaataaatgtgttctccttatcttagtttggtctctctttaaacattggtgattgttttcgatgtctttgatgttttgttgaactacactcttctagagtgttagattgtaataattggttgtagctctttgagcaaaggccggaatgttattccattatctaaaaaatataaactaggatacgggcgctcgcgcactagtgtacctggtgcgtattatgtagaatctgtttaatatgcagagcataatcttttttgtgttttcaatataagaaaacttactacatttgttaaataggataaatatattcttctatttaaaagtatgtttgataaatttacattcgtaaaataaaatgtgtatatgtgaagttttcatcctacttttgtccttcatatatctatacatttaattatgagtaaagttcatcaccggtccctaaacttgtaccgatgtatcatcctggtccctaaactcgcaaatcaaccgtttaggtcctcaaacttgttcgattgtgttatccaggtccctaaacttgcatatcactcgtttaggttctccaacttgttcagttgtgtcaccccggtccctaaacaggacggtctaaaaactttatatcaaaaaataattcataactttttcatgtgaactctaatgaagacaaactttatatcaaaattgtagccctcgacacgaccta

SEQ ID NO: 27226 - DNA, 89478 bp, Oryza sativa
taaaaaaaattcaactacaaaggtgtagatcgcgtcgagggctacaagttcgatataaagtttatcttcattagagttcacatgaaaaagttatgaattatttttaaatataaagtctttagaccgtcctatttgatccagatgatattcaaatccaagtttagggaccggggtgacacaactgaacaagtttgtggacctaaacgagtgatctgcaagtttagggacgggatgacacagtcgaacaagtttgaggacctaaacggtcgatttgcgagtttagggaccgggatgacacagcggtaaaagtttagggaccggtgatggactttactctttataatattgtctcgacagtttggatccagctggcgaatcaagccacagtgcatatttgttttaggtccgcttttctgacctaccaaatgggctgagaggtcgagttcacgtgaatagatgtgcttttattaatggtactcgtgataaccccctttatattgatcacctcaagttgatccgttccactcctatgccgcttgttaatgtacttgcttatttagatgagtgttttttcgttactatctccgcagatgcatcatgattcggtaaatatataaaaccatttctttttacatgactaaagctaaaacccaatatccttccctttgttttaaaataatcaaacacacaattacatagccatgggagagatcgaacaagctgtactgtgaatatgtgagtatcccaaacggttttctttgccaaactcacggcagtgcaggccataagcgtgacacagaggatcgatctaggactaggacagcagcggatccgtacaccggaacttttaatttgatgaagtagtactaaacatggcagctcgaacaaaactaggttttagagatccaattcatggtggaacccatgcatgtgagcaccacggggtgatgcctcaccaaaccgccgtgcttatctgactcagcctccccttaaaaataagagacaaagaccacctgatcatgtcgaaaacgtcctaagagaaaggataataatacagccagctgcttacttatagcctatctatcagctcactcgtataatggttaactcttcactataaatatatggttcacatgtctgtctcacagattttcttggttcctgtgcctaagccggctgtaaacttacagcccgcttctcatctctctcctcttttctcctatccacttcagcattcagctttcttatagctcactattatacttgctctaatctcgatcgatcgatcgcccatggtggcaatagtttaatccccagaggccacaagtgtcaatcatcaggtcgatgggaagaaaagggcaagatgacgagattgacgccgtgcaggggattcccaaatggggctgattcgtccttttcaggtgtacatttcccatttttatactgcctgcctggagctctgcgatgaacttggacaactttatagggaagctacgtatactttgccagcctctctctccggttatcgcaagtaataaagcctaaagcggcacgttactctgtaaggaagttgagtgttaagaaggtaaagatgccatctgagcagtgcattacacaattgagttgattggtcagtctctactatagtagtagtacttacctttttcttatgggaggacagttggtagtgctagctagcttaacaatattctactttgatcatagaaaacagtactagtactaagttagtactacgttgtcgaagaggaaaaaaataagttatctctttgggacttaacaatactctgtttcctttcattagaaaaaaaaaaatcagtactgctaaataagcttatcttctggtacacgcggtacaggttctccattattttttttcctagcgagtccagcttcctgcttccctacctaggaggtccaactccaacccaacgcctccatgtgccttgcccctcctccccccttggccgagatgatgataagctgctacgccttgctcagttgctcccatgccttttgaacgcttttgagaccgtgaccaagctggcgcggcgctgcatgcggcgtgagaacgagcgtcgcagcacgacgcgcgggcaccacgacgactccacgagtccacgagcgttttcacgctcgtttcgcacaggctcacgcgttgccgcagcccgttttgcagaggcctacgcgtggacggcctaggctcgtggtgcgcggagcgggccgggctttttcagggcatcaccggtgttagttaatcgcagtagaaggggtatatgcccccgtgaccccaaatctcttcgaaagaaaagaaattcccctttttcttcaagttcaaaatatcgagttacatttatttaactggatcatggtatagtagtatcaagaggtattagcaatcttccctgcggatgatggagcccaaatcgtttaccttacagagatcaatcacaattcatttccataaacaaaaccgtatccgaaaacagtttgaatcgatctacagggtcatgtaacaacaaagatccgtgtaaccaaagcaagaaaaaaagaaacaaggttctcaaggatgggagaattgagatatcctcttaggttgacaagctgccaccaccctgttgccaaaggttgatgatatcagtggcctgattcagaaggatgatcatctgtttctgagagatccactctttctcctccagctttgctcttagctcctcccaggcatctttccgtggccagaagtagtatgggcttaacggaatgctgccatagccgggaaccaactggtcgagggctatgccaatgttcttctccatccatatgaacttcagaacaagcattggatcctgcctttcaggcaccttaaccttgtactgcgatacaaaatcaattcgtttcaaatctcataatgctaatactgattttgcatatctgagtaaaataaattgtgcagttttaacacagctcaagtcgtagtaaaataaattgcaacaactactgtacgtgttccattgacaacttcatttctctacaaaaggccccatttttcaactgtgagggtaactcccatataatcaaaactaatccacttttagtgtacatctctgaaatctgatatagtgatgaaaaaggaacttattgtgcctgttaatgttgttacataatcacgtaaatagctgaatgaaaaaaaactcctttcatgaccaaaacctgtcaatgctacagtttgttcaatagttcagttcttgcttacacatacaaccaaaaatggcacacgctcaagtttgtggacatgctttcatgtgctcttcgcctcttcatcactagcatacaccttttatctgcagaagtgcaaaactgcaccaaaaggacagcccgagtgcccaaacatgctcaactagactagaacttctctaatttactctacttgtgacttctcttaagctttcagctgtgcattgtgtctaaagatttactctactcgtgaattcacccaaatgtacacctcgtactgtatttcacctatgagctcaagtaatcagttcggtaaccaaaattgattcaagaaaaatcaaattcatgcgaaaccaaatgtgattgaactccatcctcttcaaaaaacaacacttccttctgaaattgagctcgactcggtaaaaaaaaaaaccccgtaatttcagtcactggcatggtttggagcggctactagcccattacctcctgcgcttcctcgccggcgctcgcatccccacctccgacttgcttctcctcttctccctcctccgcttcgacggcgccagaagcggcggcggcggcgaggccacggagcgagcgaaggggaagcctcctgctgccgaggtggacgaggcgtggagtggaggaggaggaggtggtgcagggggaggcggcggaaagcttgggccgggagatgcgggcgcgcgaggcgagggccggcgtggcggcggggtggacggacatcgccagcatcgtgtccgagtccgaggctcctgtgcggataagaggaggaagacgatggtgcggggctgcctcctcttatctttacccttaataatccccttctcgtcagctattagatgtgggctagaaagttatggtaaagcccaatatggcccagcacaaaacggcccggcccagatccaatctaagtaaaaagctcacagctcaatcgtctcggttattcgagaataaacgaaatggcatatttgtaaataaaaaataatttgtgaataaatcttttatatatatatttttaacgatctaaaagcaaagactgaaaaataaaccttcgataaaaaaaataaaatcaaccccaaatttaaaggtaaaaatttaaattttgactgataaacataagtataagcgaaaagatgaggccgtccgtttgccttcagcagggtttgcaaaaccgtctgtaaccgtgcgattaccgcgcttaccgtggggtacggtaaaagggaaaccgcggtaacccccttaaattcaaataaatttaaaaaataattttaaattttgataaattttacacggttaccgtgtggtaaccccggtccggtggtttgggaaaccctggccttcagtagtgctagtgcccagttgccaaccgcttgggcgtagtaaaaactgatagtggaatgaaatgaaccgggtacaaagtactgaaatgatcgtaagttttgaaaaaaaacaagcaggagtagtaactttgcaagtaaggatgctacattctctgatagtagtttcagtgttttacacattctataagaacaccgaacaaaacaagcatcgaatttcaaatgtcgatacagccttgaacagttgaagttcttgcccacaagtttaatcgaaagcattgtcaggttaacccaagaacgtgattaataattactaacattaatattagtcccatcttattcgacaatcattgctaaactatttactgtgtcatgagatcgaatcaagtttgatgccggcgaggttttctccgctcagaagtccggcgccggcgagtacgcgtgggaggcgggcacaaccacggccgtcgacataggtgccgacgaggagttcaccaggttcagtatgctgttccagtagttcttctcctcctcggtctcctggaactcgccgtcggcttccgcgtctctccccgccggcctcgggatctggttcaaggagccttcgaggagtaggcccgtgaaccccgctccggcgccggggaagcccacgtcggcggcgtcgacgtcgccccagtgctggtccttgcacgcctcgtcgtacgcctgcatgggctgcatggcggcgcgcgcggccgccgcggcggcggcgccgtgcgcctccagcacggtggcgagcaccgcgctctccgagaagctcagcgtggacgtcggcgagtcgaggccgtgagccgccgccgccgccgccgccgacgcggggggtgccgggaggtgcggcgcgcccggggtcgcggaggccgcgagcgcgcgcagcttggcctcccgagccaagcgcgcctccgcctcgagccgcgcgctctcccactgcgccgtgtggctgaggtgcgccgcggccttggcgtgctgcgcgcccgccgcgccgccggccgcacctccgccgccgccgcccgcgccggccacgtcggagcgcggcttgtgcgtgaccgggtcgatccccatcttggccagccgcttctttaggtgcgtgttccagtagttcttgatctcgttgtccgtgcgcttcggcaggtgcgtcgcgatcgccgaccacctgcaaaacaacaacaacgccaacgccggccaagaaaaaagatcaggaaaatcgcacgtcaaaagccctccattcgcagtgacaaaattaaacaaacagcactcttgaaaacgtaaataatcggcggtgtgatttaaggcgtgcgtggcgtagtacagacagagggcagagatgatcggaagctgtgagtcaaaatgggaagaggggcaggtggcaacagtggaccaaaccccagttttggtccacaatgatgggggggctcgcctccttaaatgacgagcttgaatgccgaatcatatgggagaaaagaaaggaaaattctgggccgagcctctcactgcccaaccttttcacactttttcccttgttgatgcatgcattgattggtctgtgctcacagctaatgcgtggttgttcgacgggcaaaagatgagcaatgcagcattacgtgtgaacaaaacgaaaacaagtgatgattctgttctaacgtaagaatttttagcctagcttgtgtgttaatctatggacagtacggtttgttacggacaaaatgctgaagcaggtgtgtacggggacagcaagtaagtagcacggcctgcgaaatttacacatcccctggctaagctccgtgttccaacccttgcattgcataaccctttcataaatgtctgccaagactacggtgcagaatggtggctactggctagtgtgttcttgacctgccggtcagcaacaagtactagcagtcaaaattcgtgcaggagaatcaagggttccatcgcgattacggaattaaatgtgctccgggtgcgaggtgaagaacgagcgagcagctagcaggagggagagttgtgcactacgtatcttgtatgcatgatgcatccatgcgaaaacgaagtaatcgatcacctgttgccgagaagggcgtggagctggatgatggtctgctcctcctgcaggctgaacttgcccctcttgatgtccggccggaggtagttcgtccaccggagtcggcagctcttgccgcaccgctgcagccctgcacacgattgtcacggtttgcatgcacctcagatcagagttcagagagtagccagcctcgaggatcgatcgcctcgaccgaacattgcagctaggattgcagaggttgagaagaaatttaagctagataagcggcgcttaccggccttggagggtagcgagcgccagcagccgtggccgtgctgctcgatgtaggccagcagcttctggtcctcctccggcgtccatggccccttcttgagcccctccttctcgcagcacggcgatcgccccatcgccggagaaaagcaacagcagcagcgagctctaggaaaactcctccccgatgatcttcgacgccctctggttcttcctcctctcctcttctctcgggctcaagtagtaggtctatgtgtagtagtacgtgatcgaggcaattcactacgagagatcttctttgcagggagctgtggctctctgcgagtgactaatgcagcagcagagtcagtgagagtgtgtgtgtgtgtgagagagagagagagagagagagaggccaaaagcgaaagagtgaggcacattgcgctgcgtagaggcataaatagaggagaggagagggggtacggtgtggctggctcggcacgcacgactcgactcggctcgcgcgaacgactcgatatcttcttcgggcgccgcgatctcctgccggcaaagtggcctctcactgtcagtgtacgtaactccaccccgcgagaggagtaggggcaggaccgtgatttcaccccccacggtgtacgtgtgccccaccccgtcgccgcgggaggaacgaacgaaccatcgctgccaatcgcgatcccacttcatccatccacccgatcagagggcgtgcatttaactcggcgcggggctcgtctctgcctctgcctctgcttggtatatgtggacgctacactacacatgcctacatggtcctttcctcgcgctaccgcgagtggcgtggacggcgtacggcgcctgtgtcgtcttcccccctctatcgcccaatccatccatccatccatctgcgtgcgtgcgtgcagtgcagtgcatgcatgccatgcgctttcatggcgctgccctgaccagcgctgttgctgccgcaggggagggggaatctcgcgcgctacagctcgctgcaccaaagagtggtcaggcgcgcgaacccgatcgatccaacagtgttccagtacaggacgcaaattccaacgcgaatcgttagttcgaagctggcacagcgtgcgggcgcggcggccgatcgaagggagagatcgaattactggctggtcccgcgattgttcatatatcgcgcgatcgatcgagcgagcggaggagtgcgtgctgttccttgtcaatagtagtatacgcttggcccggcccccggcgtgggcaggtgaccagtagctagctaggcttaggctagctcgctcggcttgcccttgcccccatccgtttggacgattgacttgattgcaaatctcgcggcgtttttgggaacaatttgttttactcattcaattcggtgccattgccgcaagtcacgactggcggtgcatggttcatgattgcgtcgcatcgcatcacattgcgtcgcattgcatgcatgccggtttcagttgtttgcttgctagctcggtcgatcggttggagtgtgagatccccgcgccggccgctagctcctggtttctttgcacatttcgcttgccatttcggggcgctagccatggccgatttgtggatctctccccctgcagattgtgcaggcgatcgtcccagatttaatttgctgtttgttgggccctgtatgtgttgctacgagtcgcggctaaagtgatctctgaaattagctggttgctcgtttgtggtaggtactctattcctagcgttcccatttctcagtaaagcttttgctctcctggaaaaatgtttgtcagtttccaaggaggacaaacggaagtctccaatccattttctgaatctctgatctcgccatccttaatcacgtactaatccagtactgtttatcacgccatcaagtcctagtccaacttactacccaccagatcaacagcttactgctgcgaacattgtacgggaggctgagaaaaaggaacagtactggcagtgaagggtgatgatgatgtacggggtagagagactaatggaacactctgtaaaattccgccaacctgcaattgcaaggcctgagcgcagggatggcttttgccatttattccgctgttcccggtgcccaatcgcaacagtagtacagaaggaccaccgctgtgaggtgaggggaatcattcgatcgaaacacagccgcatgtgcgtcttccccaagaattcaccgtgttctttttaccaccatcactgtaaactgtaaagcaaaattagcttcgctacttcggacacggatcctctacggtattatacttacagtagtattggctaacaggtgaacccgatcccacgtgtcagcgatagctaatgtagatacaatatacttcagacgattcccactgtcttcacttgcaccatcacatccttcagactttagaacttgctgtgaatgtcagtatgtcacatcacggcataaaattataggcacctgccagttgcttatttactgtactagcttgatcgatggcatggctctcaacgagacttaatcgatgctttgcttttgtttgatttcgtatttccatggcctacgttgggttgcagatagatgctgctgttactattctacggctagctacgatgggtatatacttagatatgcatgctagtagtatcgatcaaattaagtcctgaacagtggaacgcacagtacgtgctgcggtgatttggcactggcaccggtgtttaattagccatgcatcagtagcagtaggcaaaaaacttcaattgcctactgaagtagatcgacgccattagtacgtagctagtagtatgtagtatgagctaacctgtgtctagtctgcaataggaaggtgagttaagcccatccgctccgctgccattgcaccgtttcggaaagacgatatggcctcgccaccagatcatctgaaagcgaacgttttctcggacggatctggtagaggttttacgtccaagcctgtgtccagaattgctccgtcctaggaactgaaactctgaaaaggcaatgcgcgagaaatgggcacggcattgattgaagaagaggatcgatatgatgatcgtctgtatgcagtggagtgcaaaccagaatgtttgcctctaatgcatggctctagctgggatgcagacttaattcatttagagtcgagtgattgcctggaaaacgcatcatggtttattacaaactctctatcgtttagcgtgcagacagaacagtacaagggggggggggggtgaagtttgagttaattcaactgttgatcgcctgacatggccattgctcatgccggctggaccagctgattgacgtcgagaggggaatctgatcatctttatagcgctgacgatttgcaatagcgcttgtactactgcagcatcagggcagaagtttttcatctaatgtttttgcagacagcagaagttttccatctaatgttttgcagagatgcgatcaagcacatatatttccattaatgttataaaatcttataggactactatgtaataagaacatgcaaggcagaaaaagagcagctcgccatttagcaagtctgcgtgagctttattattgcgcaaaatggtggtcctgatgaacctttttctagggtccttttcttctccggctctgcgtggttttcctggtttttggcagcaacgtagcaccctggcctggtagacaagtatttaaaggtgtgagccctttacattttcgtcctacgagtactactcatcttttcttttttttcttttgaaaagaaaatgatagcagcgtactgaagtccaatccggtacattaatactccgacctctgttctcaggcctggtaggaccgtaggactaaggccgagtttagatacaaagttttttttttcaaactttcaatttttttatcatatcaaaactttcctacacacataaaattttaactttttttgttacatcattccaatttgaaccaaacttttaattttagcgtgaactaaacacaccctcagtatagtacactttttggctgtgtttgcaaaatgggtttggaatatgattttccaccccttcaaagggtaagctttaatcttagccatccattcttctcacccatttcatcatatccctccattcatttctattttttaatcccacctctcctaacccattttccaaacattccaatccaatgggtttcagcatcaacgctgcagcaatattggtctttagacccgaaatttgacctagttcactcagccaagttaaaaaacctactccctctggtcataaatatgtggcatttataacaagatttgatagcactgttgatactttgtattgatacttagactgtaagtaacttttgaaatgcttaggtaaaaacgaataaaatatatagtttgtgtggctttgtctagaaaagtaatattaattataatatcataagcttattaggttttacaaacttctcctatatcaaagcgttaaacttttgaccaaactttgtgctaaacgtttactatttacggaaagggtacaaatctgtcgacagattttttttttatggatatctttcgatttctggtccattgatttcgtgattagatccgtgctggttgccagagataaaaaaacacagcaaactgcaagatcggggattcgatcgtaggaccaactggtcgcacgcatcacgccttaaccaagtgagcagttattcaaatttgaactgaaataaaaattacacattagttaaacagtaattacatataacttacactgattacatttgaaagatttttctaaaaaatctgttgctagaattttagatagtccctaatatttatgactagagaaagtagctcatccattaaacgaccggacttgtttcaaaggtcgatcttatctccgaatgcttatacaatcctctagaattgaacttctgcacccctccatgcccccagaagatcaaaaagataaacaaaaatatagcttttggcaagggattatctttgaaatgctcaaatgcaaaagtccagggaagcagcttagggcacctccttatgagacacgattacacagtgcacggttgctggcttggttaaagcagcgatcactctatcccacttataaatatctctttagctcttttttaaacctctttgatggcttatatcttttaaatcatatattatttaaagatctatttgcactattatactccactaaaaatatgtgacaaaatgagatcaatgttgaatatatttaaatattttattaattaaaagtaatttatttaaactgtagaagtaacttagctatgcaatagaagtaactctctatagcattagcattagaagtaattacattatgtctgagttgatgtaagaaactatgtagagtaaattcacaagtaaagtgtagggaatattttcaagtaaatacatacattatttaaagtaattattgtattattttttaaaaaaaaacaaatcttgtgtcatatagaaagtaactcttcatgatattaaaagtaactacactgctggagggaagtaactttttaaacaatagaagtaactcttgataatattagaagtaaatacactcctagagggaagtaactataaaaaaataaaataaaaataactcttcaaggtattagaagtaattgaaccgctagaaagaattaacttttcacggtgttagaagtaaccttttgcattattggaagtaactacactagaggagttaagaaaattttttttgaataatttgaatatattcagtatgggtgtgtttggttgctagtatgtccctagtctggctcgtatccctcatccagggtgccctcaacctggataggataatgcaattggctatgtttggttgtctgcatgggtttatcctagatgatatgagatgatgtttggttggttgtatgacaggatgctgtacactagagatggtgtttggtttgttggttggaccttgggtctgggtgacctcttcttacatatggtgaccatggtgttactatttaagccaagttttcgaaaatctcgttaatttcatatatttgacaaatttaaacaactagctgtcagtaatcatgtaattttttaacaaaaaggaatcaatgtgaaaatcatgcatgccggtaacatatatatatatatatatatatatatatatatatatatatatatatatatatatatatatatatatatatatatatatatatatatacacacacacacacacacacacacatgtatatatatttctctacctctcaacagccgtcgtcgatatcattagcatgtatatatgcgaatattctgataaaagtggtaaccatctagctgtggaacataaaccataaatttataaatttatagttatccagtttaaaaatcaaaatcaaagtgaccatctttcccaatctctaacagcaaggaaaataaaaagaacaagggcagaccaaaaaatcatgcccagacatgttagaaaggagaagaagggaagacgagcagccaacgacgggggaagatgagcagccagcgatggtgggagacaagcagctggcgacgggggggaggagcagctggtgacgggggaagaggagcagccggcgacgggggaaacgagcagctgccgacgaacggagacaagcagcctgcgaaggagggagccggcgctcacgcccgcctggcgatggaggatgggcgcagtgaggttcctggcgagcagcccaaaccctagctttttttcgttgtgaaaaaatgaggaagagggagaagcgctcgaggagttgaggcaacgcgcggtgaccccatctctttctgcctgcacacgcgggtgcagcctcgtgccctgtcgctgcacgccacgagccaggccgcccagcaaagctcaaattggccgtttcccctcagcctggctcgacgggcctttttgcatctcctaggcctggctgagtcccccgtccaagcaaccaaacaacctgcaggttgcacgccagatgcgggccaggtgcggtccaggcaaccaaacacgccctattagactcattttgtcacatattttaagtggagtatgatggttcaaacggatcttacaaataatatatgaataatatacttctaaaaaatataactcatcaaagatcctataccaaaggaaaatatacttttgtaacggtatgttagcctcagtagtatgcacgtgaattgacatgacaactagtagatagtatgtggtcctctttttctagcaagtggtctcgtttatctgtttcttggtcaatataacattcatgtgtttatatatatcttagccatcatcggacgacttacgaaagggtctctagttaagaccaaatagagagagagagcacactgaatagattttaccctccttatgccatctaaatattatccctcacacccaatgacacactcacacccaatgacacactgtcccctactaaagcaagccatccccgttgaagatcgatgctaccgtttccttaagggtattgatatgccttcaccaccatagccaacaatttcacccttgttgaagcctgacggcaacctttggcaaaagctttgccactacgtcttcttcaagtccacaaccttaaaagagatcactaccgccatcccttgcaaaagatagaatttcataaacaatacattcttcaagcaacatatttttttttggaaatagcttacgtggcactcaaattcttgagtttcctcgtatgctactaaaaatatggcatttcccttacaagacaccaaaatccagcgtgtatacaatctctaactgtaccatataacttggttgaaccgttgaaatgtatgaaatcgtatgttttacatcatatctgtataattgaacttcagcgagaaacagttaggaaaaacatttttattttttttgaactttcgaaggtaatttaagaaaattcactttgttttttaataaaacaaaacctttttgacatggttgcagtacatctgccacaccgggaaggcagggaccatggcgagaccaaaattttgaatataaggtaccaactaaacggtatgttttacaatgttattagaatagtattttaaggtggagaagcaccaataaagttgtggtatgcggatgtgcttgaagtgaagtggtggtggctagggttcaaactctatcaatatacattacacaaacatagttgtgttttaaatagaaactaggaaggtagcccacgcattcgcgcgggcatgcaccgtacactatgtttgaaaacttataaaggtgaaattttaattggaacttatgaaagatcattttttatttggattatttgagcacatttagaaaaaaattggaatattttctctaattaaaggcactcgattttttatgcagcggctcaaactattcttgtttacgtagtgaacgtttaatttagctatacatgtttcaaaacatgtcatggtgcgtccctgtgttgttgaattatttcttttccttttggcaaattaaatatgaaaattttgttctgataatattgatttaatttagctatgcatgtttgtagaatttttcataatgatatataatgtcttttcataatttttacaagctaaattatagtcaacgggtgtattaaattctaatttgtgattaattgtaatttgtgattttaatcataaataacataatgatataaatagaacgtataatttggtccgacagaaaaagaacttccttaaaacagaaacggagaggaggtatgtatgtgcgtattgtttgcacgcacgctacttgcatgggaagaggggacgtctctttgttagaatgagaaaaatcaatctaatccaatggcttggagtagtgggcctattaattttagagaaatcaaaggctagttgttatttttctcagattttctataatttattggaacgtcacgtggtgtcataggagcatttatatgagcatcatatggtggcttaggagcattatagaaattttcatggacttttactactcccttcgtcccacaatataagggattttgagtttttgcttacaacgtttgaccactcgtcttatttatttttttttgcaaatataaaaaacgaaaagttgtggcttaaagtactgtggataataaagtaagtcacaaataaaataaataataattttaaaaaaattgaataatacgagtggtcaaacgttacaagaaaaaactcataatcccttatattatgggacggatggagtatataataatagaaaggttagatattccttcaacatatttggagaattattcaagctgacatattatatatgttatcaacttttttaaataaaaaatagttcgttgttatatttggttgatatgcaaagaatatggctcatagaataaatatatcttgaattaaataagacatgtaactattgaaattgaagattaggaaagggaagaggagatgaggggagtgaggtagtacgtacaggtggaggtcaggaggggaatatagaggaggtggggtgtagcgcccgttccgtcgtggcgcctagcaggaaaactatctcttaaaaaccctatttacgaaatctgtttctttgcttgttgtctagtgtccgtgccatctcagatctcaaatctccgatctatcgttgagttcaatcccgaatccaaatccttcccgaaactccctccgcaaaagtctattttgcctccctcggattcgttgggccgaatctctctcggcccatcttcccctccctccccggctctctctctctctctctctccctcccttcccggctctctctctccgctctgcccgcgcgccgtgcgcgcgtgcgcgtgagccgcgccgagccgagccctccgactcggcccccgcgcgccgttgttcacgtgtgcgcgccctcgtagtcgccgcctgtgccgcgcatgcgccgtctgcgtcacccggccccgctgccctgccgcgcctgcagccgcgcggccgctcggccccgcgagccagcacgcgtgcccgagccgcccgttgcttcccgcgcgcgcgtgccgtgatggccgaccgcctggtcgccaccgccgtcagcctctgccgcgcctgcccgcgcctgtcgcccgtgtcgccgctccgctccaaaccgctccgccgtcatcgtcgtcgtcatcgactcggccccgcctctccccgcgcatgcttccaaggaaaggaagcagggctcctcctcatcgccctctctccctcctccttttcccaaggtggcaagggggcaagccccctttctctcccccttttctccctttttccctctcgccggcgtcacctcctgtcgccgttttggccgctagctggagcgccagctcgccggcttgaccgtccaatgtcggttcctctctcccaaaccgaccttgtcgcccatttaaacccaagctcctccccctccaatctccctcgttttcgtctctcgccgccactgtcgcccctgttcgccatcgccgttcgtcgttgcgcgtgtcggaggagccggcacgagcaaggacgtggaaggggacttcggccgcaccctcttcctcctcttcctcggcccgaggccgaaatgatcacgtttcgcgctgtcggctctcgtcactgctgtcacatcctgatttttgtttcaggatttataaattatttaataaattaataatagaatttatattaaatgttctttaatttacaagtgaagttaaatgtgggaaataaaatttcttaaatataaagcatggatggatttaatttttattaaattctccatgattaagtcaactctctgaaattttctcggatttttcagagctcaattcctaaatgatacaaagaacagttcagtaattatttgatcattaataatctaattataattgttaagagcttttcttgtttaaaaatccttaaattataaattgttgtttaattggaattattagaatttattttaaaagcctagaagagaagatctaattttaattaataaatctcaatataaaatggggccagataaaatttcattaaatactttgcttaattctataattcctagatttttctgggatttatttgagctaaggaagtatttttaataaatagaattgcatttcatgaataatttaaattgaaaaaggtttttaaaagtctctttttggctttgggccgaaagccggcccaaaacctctctctctccccggcccaagtcggcccagtccgcagccgccgcgcgcgcgcgtttggtcgctgacaggcgggacccacctgtcagtcttcgtctacctctggccgccgccgcccgaaacactagcgccgccgccgctttccaattcggtcgctcctttccttttccggccgaatcgattgaggggaaacgatcttcgcgatctcctcttccttttctcttttggaagcgtcgtctaaatcgctttggaagttcgtggattcgaggtcgaatcggatcggtctctttcctccgaacccgaggtttccttcgcgtcgccggtcgccgtgggccttcgccgccgcctccttgcccctataaaaggacccccggtgtctcctctacccgccgccaccctcgccttcgcctctcgtcgccggtagagccctagcgccgagccgcctcacgccgccgttgtcgccgccgctccagccgtgcgccgccgtcgctccagtcgtcgccgtcgcttggggaggtcaccgtcgtggtcgccgtcgcgtcgccgtcctcgtccgccccttcgccgtcgttgaagaccgccggagcaccgtcgccgctgtcgacccgatcttctccgccgcttcgacctcgtcgccgacgtcgtccgttgctcctccgccgttgctttggtcaccggtgagttcgccgcgatgcccgcaccgttttggtgtcctccgttcgcgccgccgtgccgtcgttcgccggcgagcatgcgcgccagagccgccgagccgccgccggtggtgacgtcatcgtcgacgccatcgtcatcgtttccccgtaagccgccgtagacccgatcgatctcggccgtccgttttggatagggttgatctcggccgttcgttcccgtgaaccgttgccgtgcacccggtccaccgcaaaccctagccgctgacgcaataatgtggttcaagttgcaaaagttatataaaataaagatctacatattaaaattatccataaattgaattaaatttatttaattctttttaaatgggctttaattagatttaatcttgtaaaattcataataaattcatatgaagtcagaatgaggccgttcaagtctcataattcatctaaaattatgatctacatgtttgtttactttttatgtattgtttatttggtttttattagtatttttcttcgttttgcgtgttagcttgtcgtttccgtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactttattccttgataccttgggttattataacttgactagttgagctttatatattggttcagctagatattagatgtaattgcttagccatgcttagaaacattggcacactattgggataacttatgactcactattatttaatgatggcttaatgatagttcacgatggttaatcgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcgtgggcaacggctttaccttttgtataacatgattcattgcggagcaccagactgagaagtggcggagataagcccacgggggtcgctggggagtccatgccttgttttataagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctgatcagagtaaaactattcgaatagccgtgcccgcggttatgggcgggttgagcaatgtttttcgtgattagtctcacacctctcacaataattatggatgttatacctggtaataaattgtttagctcctggtttggagttagatctgtttagccgggtgtggttgttcaggatggttgggcctgtgcagcatgggtgtgttgctcagtgttgattaaaatttctgattaattactccactgttttatttttcttaaatgttttgctaaatgctgcttttgcaaatgagcctatattatgccatcctttggtatccttgtacacttgcatatttgttgtgtggcttgttgagtatgtcatatgctcattcttgcaataatcaatcaacctcagttgaagaaaaaggatccagaaggagaagacgtttggcttataccccagttgagctgcctgtgggagtggggctgaagccatcgctagaccgttattccgctgctgttttcttttctcttgtaagtgtctaacgttattattatgatggatttgtatattaaattgtcagtttgtgtacctcggctgattcctggacgaggattttatgcacaaataagttcggaaattactagtgaatttccgggcgtgacaactgcgcccgcccgcacggtagtgcctccctccgttcttcctcctcgctccttctcctccccttagactcgggtagtagcacgagtagcctccccgtagctagccgtcgccgccccgactgctgccatcgctcgccgtgtgctcgccgctgtcgccgcccgagctcggaagcgccactcatcgccggcctcgctcggcgtagctccgcccaatccaacgctagcatcggattcccgtagccgcgtagatgctctcgccgccgggaatcggcccctcgtgacctcgtcgccgtttccctcttcttccgccgccggttgccgccgccgcaatccgctgccgtcgagcatcccccggcaaatccgagccgttggctcgactcccctcgtcccgcgcaaccagccggtgtgctcgctttcgcctagatcgccgtgtttcgctccgccgctcgccaccgccgtccgccgtctattccggccggcgtcttcttcaacctcccgccggcccgcgtggctgccacgtaggcgccacgtcggcgccagctcggccaagaccgggtcgagccgaccccggtcagccgctccctccggccccgctcgcgggcgcggtccaccgcgagccgtgaggctgcgcgtgggcccgccgcatccgcgtccaccgcgaaccgcacgcatgcgccgcgccccgctccacaccctagcgccgcgccgcgtgctccctccgcacggtgagccgagccgctgacaagcgggtcccacccgggaccacgcgagatggactcggtccaccggcgccctctctctcccctccccgcgccctattgggccgtgtcctcttgggcaggccggcccatttagctcggccgagccgccccttttctctcgggtcgcgccctagccgcccgagggaagtttatttcccctccctcttccttttctttttccaaaagggtttaattaaatccttttcctttagaccaaaaatccaataatcttagaaattcaatatcttcccaaccgtaagtccgtttgactctgttcaacttccaaaattcctcaaatctctagatctatctaatggcacgcttagaggtcattaatagggctttattttcgccgtttgttgagttgtcccgttttgcgtatagtttcggagcccgaagacccgcagtgcgaggatttcgaggatcaagctccagatctcgagcaaggcaagccacctttgaacatcttgagcctatatttgaatttaattatgttgcttgaaaaatattatgcattgataggatcgcacttaatctgtttgtcccgtctgcaaggcagattgacggacctacctaatttgttgcatttgatccttcctttgttaattgttatatcatgtccccttgtaaccatctagttgcgcctcgatattcgtgcaccctgtgcgagtatcgacggtcgccttcaaacttaaaatctgaaaaaacttcttgggtaaaacttgggttttacaaaaggcttggaaaacccgacacctgggtcggtgcttgcgaactaaatgaattttcaaaaccgcggaccggggaacgtaccgggtgtacggtttcccgctcttgcacttaaggaccgtttccttggaatttcatccgaacataagacaagtacgaccacatgggtggaatgggacacccctggctaagtaattagcttatcaggggagccttgatgccgagagacatgtggattcgccggggtggtgtcggggaggacccctgggcttcctggcacagtatggtctgggacctaacctgttgttggtctgggacccctctcgtcggcatatggtaaatctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgccttgtgaaattgctgttgtgaaaaggggatcgttgtttggaaaatctgcagctgatgggatcggctaggcccgggtggccgtttgaaagttgttggcccgggtggccgtttgaaagttgttggccgggtgccaatcttgatcaattttaaagactgatacattgcacatactccgaccggacgagacgcactgtctcatccgtgtcgtttgagaagcactcacttagttgttttcagaaaagagttcaaataaaatcaattgcaaaaacaacagccctttctttgaagcctgcattaaacacttatttcccatggcttgttgagtactcccgtactcacccttgctctatataaataatcccccccagttgctgaagaagatgaagcggatcccgctgacgaggagttcttccaggagcaagccggctacgatgagttttagggtttcggcctagtttccaagtcgcgcctgtgttgtttggtccaagtcttggcttccgcttcccttttgtaatgcagttgtgagctcgggatctgtccgcagcccgacttgattgtactcctactctataataaagagacctctgttgctgtgataatctgtcttcctgtgataccagcactgttttctgggactggtatcgattaataggttaatttggagcgtcacgggctagttccggtcgggactagtttggggcgtgacatggggaccggtgtggagaggagggttttattttttttatttgatctaatggttggtaatattagacccactaatttaaaggaaaatcaatggttagattttagactgccacttggcaacttagaaacgtttgtagaaggatacgtgatggctaaggagcgtttgtaggaagtttcatggatttttaatatataatatattagttaggttgggaatttgccatttatttgagtatgttttagggactcaagtgtgtacatgtgagattagggatttgggaaggacaggggcgaaggcaggaagttatcaagggtaaggttcaaccatatagttctgtttattgtttattatgttcaaattttctatgatgtttagtgttttttcattcatttttttaagtcccatgtggggcttaagcccaagctgcctcatatgtggcatatgttgtaggggggacgattgtgggtgtctctagggtacatgtgtgtataatgccataggtgtgtcatgctcaaagagctaacctcactaaactctgttaaaaaagcatccgtgtgtaccatgtacatattattcatggtcattagagttttgagtcgtagttcatatttctttttatttatttattttgaattttttattctaaattcagttaacgaagaaatttaccatcctttttttctactttaattacgtgaaatacctgaattgttccaaattcccccaatttgctaaaccatacatacacgacttcaccatcacaacacgaacgcttctcttgctcgaacccactttggctgcaaataatctgcaatattgcacaccgtcatcgctaactagggttttcttaacacgtcaacccaatcgaccgtaattgcagttaaggaagtatgggagcaccgaagttaaggatacaccggatatttgtataggtttctgtttagcttatgaaactttagctagacatcacatttatgcccttttaatggttgttttagttgttaccgagcttagatactactaaaatggtcctgatcaaagcctacatacagaagctaagtgccaagtaaactccctttcctgatgcacgtagaattgtactacttgtgtcgcggttgtctcactaggccgggcatttgggtaattcattttattattgtctataggaagttttactataattagtgcttaggggtatcagaaaacagagtaatcaccagtgaaatatgcggtatttcctccgtcacataataagttaatttagtacgagatgcgataatatgtgataatattagtaactgctctctgtgtgattactgattgtctggttagataacttgttaattaatcacctcgttcgatcggatcaggcagttgagtagtactactacgtacggcaacgacgtacctactgctagtctactgctactccatacctaagagcacctacaatggtaaagtaaggtgctatctataaaacatgtacatctcagcaatagactagattaatagtaaatcaccttaacagtatgtctacatagttatctatagctctctcatgcattgcctcgtttttctctatagactatctctatgttagtagatagctttgctctctctcttcatttaatatcttccaagtaggaaaatatactgacatggatctcttatagagagcttatagataaccattgtgggtgccctaagagaagctccgtggtcaatgtaggagagcgacgtgactcgccttttatttgagcttaaatgcttaatgacagggggtactgtatatattaccgtacccgtgtagtcgtatgttttgacgtagatctacgtacagagactagttatggcaataacttactgctacatctctcataataactatttttttcactctttctgtttatctcaaaataaatttattttttaatgatcactgcattggagtttatctaagtagaagataaatatattaagagcggataaagtaaaaataattataaagatcaccaccaccattagatctatgcgggaatgacgtttggctagatcggagctcctaaaacatataagcgagacaaacgcactactaaaaaccattttcacagacaccatatttatttctgcaggcaggctaaaacgttcccaattatgatcgttcgtacaaatatataaagttgtacctgatcaaaacctgcctgcgaaaattgatttccgtataaagtagttttatactggttacctggaaaaataaaaacatttttgcaagcgaacctcttaaaaggactgtctacaacaattgaaatttttgcagacggcatattaggagcaccgctaccaaagataaaaaaatcagccaactatattctttttcccaaaattatcctctcactctcgtaccactcctttcttatcctctcctctctctccctcttcatcttccacacttatcctctcctctccctctccttctccggttctccctctcctatctctctctcaccggtcggcatggagcagcggtaactccacgaaaaggcccggcggcggtgactgcaaagcgagcatggctcgcggcaactcaacaaagcggcccaccagcgacggctgcaaagcgggaaggaggggcgtagcggcggctcagtgaaggggtttggcgcatctcctcctctgctcccgcccgcctctaccaactaagcccatagtcgacgagcctcgagaggccgcatcagaagccaacagccttgggtggtgacgacgacctcgatgatgtgacgatttctaggaacaagctcgggggaggtggatccatcgccggtgagcttgggggaggccgacgatccgttgccaacaagctcaggggaggtggatcatcgtctgcgggctcaggggaggccgattattcatcagcttgtttgtaacctattgtttgttctagtggatctaattatagctgtgttcgatgttgttcttgtttatacttgtcttttcttgtttgtctatggatctgattctaatttgaatatgatgcttgcatgcaatgaaaattgaacatttccccctttttttttttgccccaaaataccttttacacgcggggtgatattagagcgccacctgtgaaaagtggattttcccaggtggggctcttaggatgcctatttgagaaaatcgatttttgtaattggttggaggctccgcctgcaaaaatcaatgattttagcaagccttagcatacaggcggagcgttagccgcctacgaaaacttgttttagtcacatgtaaatggttttctagtactgacgtagaactaagttcagggcaaggcaagattgccccgcctctaatgctgctttcatcttcgctccacgtcttgctcgtgtctattttttttatcacttagtgtttgattcaactctaccttctctagacaacgatttgagatttagagccctgtcaaacaatataaataaaatgaaaaagaagagtgcatatataacacaaaataaagtcaaatagaagtacaattttgaatatgtaaattcatataaaactgtaaaagccaatgctaaaaataaacattaataaaaagcataaaattcaattttaaaatgtgttttaaaaatcaaaatttagtagtggcttgtaagctataggacaaaagatgaaagccatattttatttgcagaggaagctcctctaacatgagtcactactatgagctatgagacccacatgtcagcaacttgtcaaatgatagtgagggcctatttgagagagcttaagattctgataagcagctgattggtaggcagcttctaagaatctggtttctagttcattttctggattctataactatagcttctcagaatctgaaccaaaagttgtactgtttggggagcttttgattttaggagaacctgcaacagttaaaagctcctctaaacaaggcctaagagcatcaccaatagtttccctttttcattccctatcctaaattttgaggatttttggtcaaaaattgaatccaaccgattccctatcactgctcccaaaagatctcgttcccttctccggatatatcgatcccaacttccaaggagcaatatttcgttcccaatcgcgtggtttttctctctcgcgcgcgctggagaaaatgttcccgcgctccttctcgcgacctcgttcctccatggcggcggcggtggcctcttcctcggcagcggcagccacttcatcggcagcggcggccacttcctcagcagcggcggcggcggcggtagctacggcggcctcttcctctgcagcaatggattggtaccttgatgcggtgcgtggtgtggcgacgacagaaaaggcattgggcttcttcaaggaaaaggcatcaatcatgcacgcaaagtcattttggttgtacaagcatattccccttgtatatcatactatattcacaatgattttactcccaactcggagaatcaaagggatggaacgtgcacgtgcatacgtgtacatgcggtattcagctgctagtgtcaaatactccctctgtttcataacgtaagtcattttagcattgtatatatagattcattaacatccaatataaatgtgagaaatgctaaaatgatttatattatgaaacagagaaagtacgattttgtccttcgctgactagcaatactgtagtaggaggatacaatacacacgatgtactcatgtacatcccacgatcgtgcagtcaagtcgtcgttcgctgcacggacgccgtggcgcgctggcctggggtaaaagtgcagcggtacgagtacgaccgaacggttgatgaacctgacgtgagcatgctcgatcggctgcccgtccggatccttcggaagatcggcgaatcaggctagagcacgcatccgccggccgccgctgtacggcgcgcgtatacagcgtatgtagttacccttccgtctaaaaagaatccaattctatcaataaatctaaacatatacgtatccagaattataactaagatttatttttttttgggacggaggaataggtagtagtactactcctacggtacaagcaaggagatgacggcgcaaccgacggcgaacgcgcggcctcgtgctgtgtggatcgatcggatcgggccggacgacagcatcacgtggccagtggttactgcggcgggagaggaccggccggcggctggttgctcgatcggccaatggcaagcggaagagggtagtagtaggctagtagctgcctgctaggctgctactgcctgcctgcctgccggtttcagcggccgtcggccggcgaccttgctcggttcgtaagcgcgccggcgcggttagcgcgcggcactcgcatcggatacttctcccgtttctccgagcgacaaatcacggctcggacaaatcggggcgggtgatttgctgccgctttgccggcatctcctcgtattaatggcaccgccagggtgcagcggatgcggtcagtcagtcggtaagtcagtgtagtaccttgcagtgttttgttcctttgcttcatcgtttacgggaggactattatggtcaaaggaggccacgggtctggagtctggacctgggttatgcgtgaaggtagtacgatctaccgtgcacggtgcacggacagagagggtcagggcgttagggtgaaatgctacgtacgtgctcctaactaacgacgtaccgcctgcctctctacgagtctgctgagtccggacatggagccatgtatgcatgagtcagagtttgcccgtggcgtggagtcgaaaattgatcgaggaaaggagctcaggaaataccggaataaattgtggagtaatatatgcgagttgtacatttctctcatttatatgcaaaaagaaagatatatatcttttcattcttcaaatagtaccacaggatccgtggcgcaatggtagcgcgtctgactccagatcagaaggttgcgtgttcgattcacgtcgggttcaataataccccgaaccatttcggattccttttttttatttctttaatgaacgtgaactgttctctttttgtttaggctgccttttctttagacaggccgcatagggcttctcactcaattaatgggcctggcgtttgcaaggccgagatgccgcatatggcaacaggcttatcttcactctttagatgggcctcaacaacggttcatcagtacatcaaagccccaaagacctgccgacctgattaacaggtatacatgctggctttttgcttgttaagccttttgtttggcctcaaacacccgccgtttgtgtcagcctcgcggcgtggcatatgccatacaatcccattgcgaccgcgcggtcgcacgccgtacgcgtgccgggcgaccgacgcgaatgctccgcgcgcatgcagaggggcggaaagcgacgcgtcgatcggtacacattctgtccctcgcgcagtcgcgcctcctcctatacgtgcgtacaaactatccgccacatgccaacaatggactctagcttagctagctttgcatggaggcgcgcgtgttccctctcccccgcttcccccacacccatggggatcgttgtccgtcgcgccccgtgaacgacacatctcggcttgcctccctgcacgcgcgccaccggatggatcggcgcgcgacaaacgaccagagcgtaagtacatacatgcccttctctagcgctgacgccatgcacagcgcgcaacaagctagatcgcgttgcatgcggctgcagctgctgctagctgtagattcgtatacataggcagtcgccaataaggtactaggtcggtaagtcggttaataataataatctagtaatctactactagtagttatattagtttgtgctacttggcgcaagggaacaagctgggggagtgggggttactggtgagcagcagaagcctacaaggcgctgatctgatgagggggtttggaatattttctcgtgggagagattgatggcatggcttgacagttccaacgacacatcagagctggaatatatatctagctatcgccaagttgtggcttgttcttttcatagaccgataggcggagagccaagagttagccggtttgcagcccctctcgacccctttctttttctcggtggggttccgtgatgacacagcaggggttgggcatgggcataataaacatatatatagcggtcgattttataagtgaagatcgagttgctatatatatgaacacttgtataaggttatgatagaggataattaatatagttttggtgtcaatttcattcgtttatcaaactgctaatagttttgcccacagaatccaacctagtatatttctgaaactctaaactaaccatctgcctttcctttcttgagttcacatgaaattctccacttgttatatcctaaactgaccgggttggaatcaactaattaaaggtgcatcttgcataaacatcaaaggtactgtataaaatagcaacctaaaaagtgaggggaaaagtcaggttaattacccacctacacccttctctttacatctaccgcaaataacatacttaacttaattacttgttttacaaaccaaagcattcacttggagaagcaccatgtattaggatgatggtggaattgtgatgtatgactttaaccatcggaattcaaatccttatgtctagaaatatagttgtgtgcatttcttagttggggtatagggcggaagttgtactaccattgtttgaaagaaaaccattcacctcacaaggcactataagagagaatcaagagaatctcttgttggatcgtctctacctaggtatgtttctattttcagaagtattctctgtctcgtgcgcaaagacggagagatggttccattgcgtccaaagcatcattttacatttgacttaaatcaaagtttttaaaagttaccaacgaaggctggttatatctaatatgttaattgagtcaacagtttatgtcccacttactaaaaactaattaattttattatagtattttagggatatcatcattatctccttatatctacttcctccgtttcataatgtaagactttctagcattgcctacattcatataaatattatgtctagatttattaacatccatatggatatggacaatacaaagaaagtcttacattatgaaacggagggagtattagttattagctataaaatcaaaatgtttgttttgagcatgtagtgatatcaaatggtacactgaatttgcacgatagctaagaatgacaagtggcaccaccatgggaatccatgttcattttttgccaggctggtgaaatatcgacgaagaatgaagttgtcagaaaagcattacaaatactcaacaaccatgggtcattgagaaaaaggcttacgagagctcacaccacacttacaacaaatttaacacactaaacaaacattaattggttaaattaacaaatattcttattcattgcgaagaaacctacattttattatgtgtttgtcattcctctagtataacggacaagcactcagtaacatatgtatttacagagtgttccgttcgaacaatccgcaacttacaaagtgctacatgaataaaacctgtaacactttgatgccccttgatacaatcccatccttgtagtaactccactaaatctaaaaattacctaaagtagatggagagagagggagagaaaggaccaacgttgcgcgctccaagccctaaactaattacttggagtatacatataatgtacatgaggtgtccacaagactccattttccattgcataatgggcaagtagcttcatggggctatcctcgatgctggagaggttaggttattgacaataaggttcatctatccacttatgcttgacttgtcactttgacatagctcacagtactaattaatacccctctctcacgagtcccataatagacgttgtgcacaacttgaatatatccatgattttagtactgaaaatctagcatcgtcgttacttattattatccatcatctactaggctactcgtttggataataggaaatgaaagtaatttcctacacatcatggggttacttttacacactagctatctatttttttcccacctcatttcgtcctaattcttcgctcatttcgatctctatcccacccaccagccctcatatctcattattccaaggcaaaatagcccctagctagtgctggcattgtgactgagctacacttcaggggtcccaaaccctaatgctgatccccaaactacattttttcagctactcgctccctcattgacattgacggtctccattcacaatgagagatatgctgctttagggggctcgcttttgcaggatgttatcttgattgtgaatgaaggactagcttgctctattaaaaagcttgaatgcacactattttgttcgttatgtttttttttgaaaatatctttgtagttttcgagatcggaattcgtgcgaaaggtagttttgtgaattgaaatctgaacatttccatgttgaaagttttacaaattaatctagctaattacaagtatttaacaatgacaaattaaagaatggcacataattaatcatcattgtttaaatgcacctgatccccgaatcccctgcaatatttcataatcgactgtatatatcgatataactactacatgaatattctatttgatttgttgatgttgttagagatttttgcataatattaattaataacttttctagtttcacatataattaagttgtttttatattttactttctttgttcgtttagtttttttcctcttcgtctttgttgggccggggtaggaaagtacaagcacaattgagattttttttttaaaaaaaatagcttatttgtttgtgtgttgcaacagaatcaaaggacaaattgggaattgggaatcaggagcatttgaattagggggcacaaaaattccacaaatattctcacacaagtgataggggtggcggtggcccactatcaacattaaagtaatataaaaaaataaaagctgtacttttatctgagaataatggaaaggagactaataaaccacaaacagttgtatatatcttggagtaatatctctagtacactccattaaaatgtccaataaactaagcggatgcaacaatccattgtacgagtacaatagacatatgcacactgatttaatttgatcgagcacaatggatattgcgttggaagtacaaagctttatcaaatggacagttgtctttgctgacatctttaattggcaggatggaatagaattcccgagggagatgatgtccaaagatacgagacacactaaacaaaaggagatcgtactcatataaaatctatgcgagctgccctacatggtttttttttttgggttacagcagaagagttttttttctctataattcaggactagtaggcataagagatctactagaagcagcacagttgtccttgcagcatttgctagctcatggcagggaggcaaaatgcaggagctttgattagttgacctaactggcccctgttagctgccacatataattatatttaatttctcaggattttgattgaaaacaacatatgggctagctctatggagaagccaccatcaatcagggtgggtcccacacattcatatgacaagtgcttgctcatatcattaggggccccatgcctgcgtagagacaaggcatgggaaccaaattggtgacatgtagggcgttgtgtgttcttgtgtgtgccaacctaagctaagctgcatagatagctagccgggggccactgttgtgtcatgtgcactgtgtaagggttgcgatgtgatgtgatcgcccaaggacaatggagctactagctgatcactaattggggattagagctttgtgtacgatggttgagatgtgctagtcatggaccaaaccgaatcatgctttaaatgctagattagctatagctgatggtaccagctactatatcacacagcaggtcaaacttttaggttcaggatgagatcacagttagctattagtctctgctagctttttagaaagagctaaattaagcaactctaactaattaactggcaactgaggagtggccaattgcttaactaaccctccaaacaatactgcatcgatcattctgatacgaattacaaacaaacaatgctaattacatctcccaaatcaccaaataatctacacctataggtacaagcaaattaagcgaaccttggtagatgcctcgatcgcgatctcatggttttatttacagtaatcgctacttcgctaatcgcccgcgattaacgtacacggcgctgatcatatcaaaccttagtagccccatagcgcggcctcgtggtcgaatttttggccggaggatgacgagatctccgggttcacgtcggaggtgaggccggtgtcctgcgacgcgctaagcctctcccgctcgccgccgcacgccgccggctgcagctggctgccggacgctgccatgtcgacgaggccgccgtagccgttgcagctctccaggagttgcaccaggctcacgccgtggtgcagctgcccgtactgcgtgaagctcgccatgaacggcgaggagtcgccgccgccgtgcccgtgtactgccgtcgggttaaagaactggccctccagcgcgttggagaagcaggtcacgtgcgccgtcgtcgccgggtcgacggcgccggcgccggctccggacatgtccatcagcggagggaggacgacggacgacatggcgatctcgtccgccacggacgacgacgtcgaccctcccctcgccatctccatcgtcaccacggccgccttcttccctcccgccgcgcccacctccacgaggctcttcttgaacaccctgcacaacacccactcgttctacgcaccaacaagaaaaacccacggcgtgtcagtccggcctgctcaatcgatcgatcgatcgatcgatcaaactggtcacaaccaaacacacgcacgcggcgtacgtgcgttcgtgtaccttggacgacgcgggcttgccgtggaggaagccgagggcggcggcgtggagcttgccgtggaggcggtactcgtgcatgacccagccagacttctcccccttgggagcgcgccccgtgtagaaaacgagcgtcttcttcatgccgacgagggccttccgtctgaagatgtccttgtccttccccgtggccttccagtacccggactccgtcgccctgttcgtcctcagccccgtcgggtacttcctgtccttgaggcagaagaagtaccactccttctcccccatcttcgccagagctgccaataattccatcgcagcatcaacagatgttagctagctagccaatccaatgatccatgtatatatcaatcatcagttcatcactgcatgcagattgcagaggtaattaagtagaggagaggttgcttacatggcaggtcccagggctcgcacttgttgaggtcggcctcggcgacggcgagggcggcgaagcgggcgtcggcgaccttcttggcgaggtagtgcgtgatcagctcctcgtcggtcgggtggaagcggaagccagggggcaagtccatgcctgcctggccctgatgctgctccattgctgcctaagctagctagctagagctttacctggctaactgctccttgcttattgctgctatatatgtaagatttgttagctgttatgccaactcctgtcctgaaacatttgtacatatgcacacagatatgcataaactaggaccggagatgattcacacacttttaaaggtagagcaaaccaaatcaaattaaagctggtatgtatccatgacacctctttgctagctagctagctaagctagaacaaaaacaaaccacacggatgcttaaaaaatcgaatcgaaccaaacggacatggtatgcaagcacatagaacacacaaaaagaatcagcacatgagatgtttatgcacagaaaagtttaaaaagtacatctaagaaagtagaagaacacacttgagggatgaggtgataaatagttaggatatgctaattaccttttgcagcagaagtagattcagggtgacaagaggaaatcgttgtatagaggaaataaagtgggaggggtggtggtgccccttaaatactagaggcgagctacatgatggtctttttagtagaaagagacgtgggtgatgaaggaaactcatcacaggttactactccctccatttcaaaatgtttgacaccgttgactttttagtacgtgtttaaccattcgtcttattcaaaaaatttaagtagttatttattcttttcatatcattcgatttattgttaaatatactttcatgtacacatatagttttacatatttcacaaaaatttttgaataagacgaacggtcaaacatgtgctaaaaagtcaacggtgtcaaacattttaaaacggatggagtactagctagtaggtgaaaaatgcatgggaagagatagatgagatagctatacaggacagcgtagtgttatgtaatagtaccttgtaacgagccaaaacttgcttccacacatgatcaatcaccggattaatttagtggctagtgatccatcagatcagagtgttttaccctaggatgactttgatctgatctggctggatttaaggatttggtgcattactaattaaatgagtcttaattaatggaaattatgagtactactagcagcattaagtaaagcgtcatatgcgacacgcgagccgagcagcaaccgagaaagcgaccaaaccaatccttcgtctccagaagcttttgagaacgaattagagcagactccatggcgagtagtacacctactatttgtattcgagtactgcaataaacgggagaatttattagcttcatgctaagcatgagctggttcgatcatttggtacaaaatcactaattcaaataattaattaatatctggggtagctaccgacgtccaggcgcaaacaaaagatatattcagtccatagcaaaccttgatatttggtctttgtgcgtaattttctgcagggattgtacagtagtacgtataatcatttgccctgaacctgattagaatcaggggtacttaaacccttaaaaggagaatctcccaggagataagccaatcaaatcggtgacaaactggcagtggcacgatgatcctgtagcccagtgacagcacattggtcacaggctgatactattgtgtaatagcagtggatgtgcacaacattctgctgcttgtatacatgcaatccaatgggggagaattattctctccgtttctgcaaaggccgtaagataatatgcagatctgcagagccaatgtacctgtgttctctttgcagccctgcaggtacatgcaatgcacagcacagcacagaggatccacttggttttgtggggcttagaacggatatgtgtgacaaacgccatgctactgtgcattattctccgcggctgtcagaaatggggcaaacgtctgaaatgtccccggcccccatatgttcaggccgcagagaatactgctgatggggaattcaaatgtctggttaaagaattcatatgtctaatttacactactacatattacttcatccactgtatcaaccaaaaatgtgcgtaggtccatgcatgatgattatgagtgtgattttggttaacaagccagaacaaacaatgagatatttgacatcattttcgtgcgaaatatctgctacagtggtgcttctgctcgcgcaataaattcaccaagaagctcttatcagtttgccgatgcatcctgaatcctcggttagtgctgtgttgctgtcaacaaacttaaggaagagacaaactgaacacaacggaaaagaaaaacgccatctccaagacgagttcggagttccgtccagcatttaacgctttgcggaaaacgcagaaaaagatcgaatattaccacacaagggacttgaaaaagctagagccgcatctatctacaaatgggaggagcctgcagccagttgcaaaacaccatcatcagttagtcatctgctacgacactccgttgcaaaggaagaactctctgtgatctctccaacgcaacgcgtgcatcagctgatgctttaagatgtgtggcatgatgatatgtactctgtgtgtgtgtgcgcgtgcgcgcaccaaatggatcctacacgggatgattggtgtcatgtcgatgtgccatcgaggcaatcctcgtctctgaatttctgaaaatctctggagcctgcccccttccatgctgtcatgcatggcgatcatgggttctgctcatcggcagccgacaaaacggcttctttcaaagtacacgtccagcacaacgcgctgctggatcaataatcgatagtgctgctacccccctctatcatgagctacggttttcgggatcaaatcattgcgtggtctcggtctccggatgtgaacttgacctgtgagaatttgggacacttaaccgggtatgaacccgagctgtgattttctgggatagacagagaaagctatgtccgatcctcactcacattgcaacgtatattcccgtacgttcagggccaggccagcctaatggtgttttgtcaccaccgtacgttggaaacttttacgcgtcttcgctaatttattttgtacctacgtgacaagtgtttatcgtactaacacagtcgcgtgatcgcgtccgtcgaccaaacaacgtaaccctcctgcaagcaaacaaagcccgacacggacgtacgcgtcacggtcgatcgattcctccgcgcagccgcgcgcgcgcgccgatacgccgatcgacttccgccgagaaaacgctagcacacgcaccacggccgccgatcacccggtgttgctcacgcgcggccgcgcgcgcgcgcccctttcgcgcggcaaggagccgggcacgccgaaacgggcaggtcacagcgggaggcgtgtagtaggcgatcgatcacgcgagcgccacgggtttcctttctcggtgtgggcgaccaccgcgacgcgtgtcgtggcagccgcgcgcgcgcgcgcggagagagaggagtcccgcccgtgcgggggatctcacggtcgtctctcttaccggtcgatgtccacatccaccgggaaaaaatgaaagaaaaaataatccccgcttctcacgcgcgcacgcacggcactcgcatcgccaatcaccatgggtgccacccggctacgtagcggggcgcggggccgattcttctctcttttttccccctctcccgccggttgaacggctcagactgccagatcggcttggtgtcacgatagtgcatggcgaatcaaaaaataaccccgggggggggggggggggggatatggcatcacgcgtacttacgacttttggcatgttgaggtggccgggtacgtaggcttgccccgttccgtttcgacggggacgttttcgttatagaatgatatctgctgctttgtcgtggttgcattgcttctcgttcgcttgctgatttcttttccgtcgtgctgattggtttgggcaaatgcttcgttgccatgtgtgcgcacgtacgttttcttgtgggtatatgatattgcacgtacgtagaaaaatgccccataggtgattgtactcgtgactcttagggaattgtagacttccacgcgtccttcagaaaaaatgtagtatactatagctctgagttgttaatccataaaactactgattatcacctcatgccacggatcggattaggcgttgaaaaattgtggacatattttaggctgtcaaataacatgtaggaatacctgatatatgggcaggctgatgcactgtcagattttccggctttctgaaaagaacaagagtagaattgtttaggtggctgctttggtaccactgaacacagacattttttttatatttggcgtccaattcggtcgcgtcaagttagccagattctggcagagcaaagtttctacaagtatgctagcatgacaacaaattgtggatcaaaccatgcaaatcccaataccaaactcaagtgttgcaaaaatgtggctacaaaacaatatggctgagatgtgaatacggttgctgctaatgccatcataatgcaactgtcaatatgttgtcattcacatgccgatcagaaaggacacgagtgctttcagtgagaactttgtttctttaacgatataggtgttcatagcatgcatttttgactcgattcctttttcgaatcatcacgtctctcgtcttgtagcacgcacagatatgtatttcattagtttcgccaaaccccccggtgcaacattctgataagtttggcccctttataatcatatcctatttgacgtggcagcactttctcatcacatctgtcaacttttccataagggcttttatacttaactctcttaattgagattcagatagaccatatgtccatatcaagccagtagcacctgataattctgggtgaaggaaccagggaatcactcgactgacatgacaagatgctaatgttaggttgtcaacaaccaatagcagaaaaggaaagaaggccaagtgcttggatctctctctctctatgctttaggcaaagacatctttctagatcaattatgtgctgtttgctcggtttaaaataaaaggagcactagttagtattgttgtaccaacaaggtctattcaattctttgcagacagacagcataatgttcatgcataagaagtcagaaatatatgttgttcatatatgactcataatgctgaaatattaataaatacgagagaaaattgtactcactatcctgaaatgctggtcaaatcaagatccacaagatctgttagggaagcagacaccaggtgaccagggatcattgaccaaaaatgtgcttgttgcatatctcatatgcttatagctgcttactctcgctggccaaaagaactatttctgagtggttggaacgacgccgcgcagaaattgacctcttctgatgccatcatcagagaaaaaggatacattttcaatagccgatctgttgggaagataataaagaattggaatgtcagatgttctatatattgtcggctccaaatcgagtcaatggctacggtggccagattacaggagatgagcagccaactagtgcaaaacctgcatgccatacaatatgcctagctcattatatattactcaaaccttccatccaggtgttcatttgtcaaaatttagaagagaaaagaacaaaaaaaaaaccaagtcccaactactccagggtgatgtcaatatgtcacggtccgtttagatctgttctgtataaactaaaagttccataccattcacaagtgttatgtacattgtgtaactagagaagaaaatggtcagctaaacatcacgtagaaatgattttgatgtgctatgtcagttctgtcgtcccttccctgagtcattgtctcacctctagcatgtccggccaataggtttaaaaatcgtcatgtttaagcacatcaagataaaaatgttttccctgcatcatcagaaagtgataagattatcaaaataaccaaatgcaaatacgataccacttaaagaattaggcacggtcaggacaacaattttgtcactgcctgcaaataagcaataacatcatcatattgataggaactaggccgagaagtttggatgtttgaaaccttgcatgcgtcattcaatgaaagcaaattattaccttctgttgttcattattaggatttccagctcctgagtttttgggcgaagggttcaatacaaaaagagtccatacaagatgtatgtccaagtataataaggttgtcaagatgaagattaagattaagatgtcacgatttatcagctagttggctatactgattgaagactttaactaatgcatttttttatcatctgacatggcatataaacatgtcatgttcaaaagcaatgccatctaaagtattatgcaacagattaagttgactgaagtgcagacaaagaaaactgtaggagaccgatcattcttgatttcctgtgtttcactttattgcccatgtgtttatggaagaaatacattctaccacattgtaacgaaacattaaaaaaaaagtaccctcagatcgatactactatcaacattataattctgcgaactatatctaatgtacaactaaaacctatatgtttctgcacctaaaactcttccaacacagtaccataaatatctcactatagttaccttgattgctatctaccttatgttgataagtcatgtgcatagcacttcataacgttatataatatgcagtaataagtgatgaagaactgatactacatcagggaaaagatgcatttcacatcaggtaatatatatccagtcatcctaaaataattgaacagtgcattgtgcgatattagagagtaaaattaatccgattactagaagtaaaaatattccaacaaacatttattgaagcctcagaacctattggtatggtggttatgaaatttggtacccaattcattcttgtgattcacataaatgtctaacttctggaccagcttccactctttccaccagatttgtgctggagacagatatctgttatgcatatgttctttgaagcagctttgcacatgtcatagactgtgagaccagcaatggcaactgctgtcattgcttccatctcaacccctgtcttgccactggttgaagcttctccttctatcataacactagaatcttcttcgttaagagtaagatcaacacgaacatgggatagattaaggttgtggcacagcggtatgaggttgctggtttgctttgcaccagttattccagcaatctttgcaacagttagaacatctcctttggcaatcttgtttgatgctaccaaatcaaatgcctcctggcctagcaagaccctgcatgtggctatagcaactcttgtgctgtcatgcttggatgagacatcaaccatctttgcctggccactgctatcagtatgggtaagcattggttgtccatcccctgatccattagtgggccttgctggttgctgaggagttgaacctaaaggactgggtgaaggagattcaccaaacacagattccatttcctggtattgcaaatgtcaagataattaataatttattttaatgaaaaatgataaataaactagatggagatgttttatgacgatgctgcacaacaccaagttacatatctgcatttagattttacttttgctttctaaattatatcaattaattgagacggtaagttctaaatcatgcacaaaattgtaaagtaaaaaaaagctatattgtgcatcattgtagtatggataaaaattggcaagaactcaaaagtgcatcaggacatgttaagatccgactattttgttcctgctgtagtggagtttacttgtaaaaatcatatagtttacattactagttcaattaagtggtcgaatacataagcaccagcttacagctctggcatatattagaaactatctgatcaggtaacagttcaggtatataggagtatgagcaatagacagtttagtttcagttaaaaactctatttccactctcaacaaacaataatcaatgtgatctgtattcaaaatcatgtggttgcgtttgttcaaaataaaaaatgaacattagattaacccaacacaatgatattgaaatcccaattagatatcgatgaggtcatatacatcatactcagtttcagtgagcttcatgtcagtaacaccaaatgagaaaaaaaagggttttatagcagccattaaacaaatcaccaagccacaaacatacatgttcatgtcagtaacaccaaaaccatagctgcaaaaggaaatattcagggcagagatagagatcaaatccctcaccttattgagctctgctatagtatcggaaggaaacccagtagcaaagcatctccaaccattgtttcttgctactgtcgggagaatggagcgaaggactgacattgttgtcaagctagactgctgttatgcttctgcaaacaaggaattgctaaacgtgtgaacagacaacacaaataaattttagcacacggcactcgatgcataaacaatgtgagaaaatcccttatatacccctgaaatttttcctaatcccttctatacccctgaattttgcttacttccttatatacccccaaaatttgattttgatcccttgcatacccctcccgtcagttgaccgttagttgaccgtgtattttctataaaaatgaccattttacccttggatgaacaaagaaattcatgaattacattattaaaaatataaaagcttctcgcatgagactattatagttatgagtttgttgtgcgatgcattatttatcccaaaaaaatatttttagataatgaaataaaaaatacgtatttattttttaaaaaaaaggtcataaaaatgaggagcattcatataaagataggtataccaatgttcacaacattttttttatgaatgctcctgataaaaaaatccattgtcctattaaaatttcaaataaaaattttaattttttacatttattttattttcaaaatttatgtcaaaattttctgcactaattatttagtctcattagttttataaaatgcacacgatgtgcactcaaacaaaattttcaattatttttgaagcttatatttaaacctaaagcatcaagggcaaaaaagacatatgcaaccaaacgtaacagtaaaatgatggaaaatgtaacggtaggggcatggaagggatcaaattgaaatttcaagggtatagaaggggtcgggtaaattttaggggtatgaaagggattgagtgagttttcaggggtacacagggaatttactcaaacaatgttgagaccattgctgcatgataagagctgcaggttgcagagagagaattcttgagaacaatgaaatagcttggtgattttactcaacaagccagttgctttacaacttagatctcataagtgccccttgtggccagtggcggacccaggatttcgccaagccccgagccaagcctagttgttatcacaaatcataaatatactacccgtaaagtatgatggaaagaatgcgaacttaaccatgctgagatattgaagtacaaattatttctcagacctataatatgctctagttcagcacttatcatatcctaaaatgacaaaagaatcctaaaatcaaatcctctatatcatgatcttacaaagaaattttttttaccaaaatcccgcatattgaagatgtgggtagaaaaaccaagttaatgccagcaggtttcattaagaaaaaaatacagtactagcaagtggtttcttagtaaccttggttctcatatttctcactctgaatcattttcacacttccacagcacagcaagattactaagatcattacaatgtaggaaatgtggatcccctctcacatcggtagtctcaagttagccttaaggactataaaatcacatcattatctcaagttggtcatctacaaattctctctacagtttttttttaaaaaaaaatcgaatcgatctgtacttgtcttgatctaggcatttgaaaattgaaagtgaacaaactaaagaatgaaaataactaaaatcactaaatgagaggtttgagacctagaggcagggcaagaggcaagagagatcggcttgttgcaacacctagttggggtcctcgtcggctagcaggcgccacatgctcggagagacggggagcacagactcgacggcacccagagaccggagtgggacacagtggcggacccagctttttgaacttgtgtattcgaaatgacaaggggtaaaaaaaaattgttcatacacctaatagcctaaaaattagcttgtatagtataacacactaataattcccttgtctgcccacgactcatttggctggcacgtggttctttgtacatatgaagacattacaaaactggttccccaatcgaaatataagctgcaaactgcagcaatttgctacttgacatgaaggtagaagataaagatcctctagtttctgttcatatggatactgaaactattgcaattgaccaatagaatccatatattttcgttaatcaacgagaggactacgttgaagcagagtattcttactagtcgcagaaatccttcccactagatacaaacttgctaattgttaattgtatgtgtgcaataaacaaaagggactaaaaacaggaagatgtttacctgcaaaccgcttcacctcgggcacgcctcctttcttcctccagtcgttgaagtccagcagtgggtccttgtgggcggcctggtatctggcgctcagcttcttcctcttcctttactaaccccggccacccggccgccaacgccaagccgcgcccgccgccgcgccgcagacccgcagtcgccgccgcacacgccggccgtcgcgcgaatcgcccgccctccgccagtccggtccgccgcggcgggcgccgctccaacccctcactgtctagggtttaggatttgccggctgttcgccggagctcggagtggagcggtgctgcggcggcagagatctggacggccggatttcaggagaagcaaggcggaggtggaggctggggatgggagcgacagagaaacgcaccgcccgtcgagcagagggcgaggagggaggaatccactcaatattctctgtgctcgagtggttgcatcaccttctagtcagcagctagcttagctccgtcctcacgcaccctgctcgctacgcacgcgccgtccaccgtccgccgccgccgctcgccgacggcgacgcctgcgtgcgtcgttctcttcgcgagaaaggggaggaggtgggtgggtttggggaatagagtggcaaatgtgaagtcaaccaaaacagcccatacaagcacaattacggtccaaaacttacgggccggttttctttctacggcccaaaaccgggtttccaggcaggccttacactttcacacaatttttccgttccacagtcacaatttggacagtttatgctaagagttccacatccaaactgtatcaaagatatcgaacgggcttgcttatacatttatgaaaggaaacacacacagagctaattaaattagggaagcaaaggaacaaaaaagacgtgcattaatattggtgcacgcacgatggatcgcgctggtcgatcggccgggctgctggctgcaggatggtggtcgtcgtatcgtacgtacgtacgtctatgatcagtggcgccttgcgagcgcgaacgcggagagggtgatgaggacgacgagcaggaccatggcggcgaaggagccgatgagcgagccggagatgcgctcgcagaaggagtcgaactgctggcagatggagaaccagtttgcccgcacgttgcccttgtgcgccaggtacacgatcgccgccgccgccgacgcgcccgccgtcagcagagccagcatcgcctgtgcatatatatatgcacatcacacatacgtatatccatcacgaacaagagcaatttctagcaacaaacatgtagtcagcgtcgatatatgtcgttatttcctcaccgtgtcgaagaagacgaggaacagccggctgtaccgcgccctgggcctgaggatgtgcacgatggacagcgggatggacagcaccaggtacgtgcacaccaccgcgttcgccgccacgaagaacctgtccgtccggccgtgcatgcaaaaaatcgaactagctgcatcaaacttcctgcgccttgcagcagaacacagatactattgaccctgagctgtgagtggcatcatgtgtatagcggatcgatggcttacgtgaaggacgggaggtcgctgtacttggcctcgaactggatgaactgcgtgaagaaggggagcgtctcgttggtggtgcccatggcgatggcgctgccgatcgtgccgatgatggcgatgaaccggaggaatgtgtccaccaccgcgacggcgcggttcacgccggccgccaccggcgccaccaggggcgccttcgagctgatctccccgtgctccatcactgatccgtccttcgtcatgacacgtacgcaccacgaacagcaagcagctgctagtacacctagctagcttgagtgtggcaacaacaattaactactgcaattttggttgctaaatctaagcgatcgttgcaactcagaggtgtgagaatgcctgattaattgcttattgcttgagagaacctgcatgtggcaagaccttcttatacttggcaaaagaagatttatttccggtaacaaaaccaacatggtctgtttggtcaatcatgcagcacggggcaagggtgttgatttaggtggctttgacaattcattgttgacaccaactaaagcacgccttgccattggttgactctgcacctgctcttacttgctcgagtgaggctatgggacgcaacgtaccaagtcgcaaatatttctgcttgaactaagccctctttagctccaaacccacagtgtaatgtcgatactcgatactcctagtcttttgtctacttttggcaccccctgaaaatctggacttggtaaggctcctggctctcccctgcacaatgatgcaaaattctttaatttcttcggtaatttaaggctgcgtagcgagttggtttcatgagaattattgttgaagcagttcaaagatcacaccgatgcgatgtgcatgtgctgtatttgatgaaggcatacagcagtttcctcaaatgcagggacatactttctggagtctggacagtgcttgccatctcatgttaacctacttgcttcgagtgcccgtctccacgatcgatttaaaacgctccagcccagctcatatggacctgaacatcatgggccacaaggaggcccggatcctgttcaggtccaagatgtatggggtcgcgcgtcggccggaatttcgtcacggcccatcttatatgggcccgcactcgagccgcaatcctgttctggcccaacgaaaaataaataaaattaggcgcattcattcttgaccttacgtaccgagatcaaacgaaatcatcacgtggttaaacaacgcacttttaagttcaaaaaaaaaaaacaacgcacttttcccgattaaaattccgctctgattcgcaaactataacaccaaacaaacgggcgttgagattgagaaactcgtgagctccatccgcaaccgcaaatgacgcttcccagccgcgaaaacgacatcggcgaccttccaaaccctccataagctttagcttccaattccatgccctctcatcgccaccaaagccgttgacctcgcagctttaatccccgcccccagcctctgtcccgtggactcgcagcagcacacggcatccgtagccgagggcggagcagggatcgacgagcggcgaggaggcgggcgagcggctggccggcatggaccggaatctgagcgggttcctgatcgggtgcgtcggcgccgccgtgacgctgctggcgtacgagcagacgctggtgtcgagcacgcagtgcatcgccgccggcttcgtcgtcctcctcttcgcgctcttcgtcaaggagggcttcatctcgctctgattttctgcgtgtcagcggcgacttggtttgggggttccccttctctgcagctcgtttccgattctttgcttccgtttttctgtacctcatgtcctgtagaagtgtagagtagccactagttggaaaaggaatagcttttgcaagcaaaaactaatcctttccgaactatgaatgccatcttggtgacttggtgatggttgggtcatgtaatcctgcaattgctgatgcttgttaccaatcaaattgtattagtagatgactacttgtatctctgtatgtacccttcttccttaacacgatgaactgcatagtccttgttgtagcttccacttatcatcctgatatctggtctgtgtgactgttactctttgctttgcttctgaatacatacagatatactttgtttcgttagctgaaacataagtcgatggttctctatgagttttatcttcggctgaacttttgaataaaaaaatcagtatcatgaaaacataaattgttggataaaatccacctaaattggtacttaatttactccgagtgttcttttttttttcccgaagagataatcttgatctgctagtgttcagcccaaaatatttaaaagcgatgcccggcaaaaaaaatattttaaagcaatgagcaacaaaattaacacagctgcaataaaatgcttcaatacattcaagttcttacaagatacaacagattcagatggagtgctgatatcctacaaatatcatttggcattttgactaactgtactatttctgacaacagagatacagatacaaggccaatagctcccatagctcaaacatacttacgatcccgaattaaagcactctaatcctcgttatctgtactaccttgcctccactacagaatctcaggatttaatcagattactctgctgactgctgacattgaggtacattacggaattgcgttgctacaaaaacgtacacaaattcggacatcggtgtttccatgcctaatgtgcatctcttgacttcaaaactcatagaaaatcttcttcagagaagagtacgtacccgtcgcggcaaccaacgaaccgagcacgatgatcgcggcgatcagcagggtctcgcccctgccgcatcgcgtcaggccgaagatcttgaggtagcagatgcaggggagcagcatggaggccatgacgctgagcagcgagccgacgagcgccatgaggtggccgaagaagggcaccgtgagggcgatcaccaccgtgctgacgacgatgagggtcctgatcagcacgttgacggacctcttgttgccggcgagcagcttctcctcgatcgccgtcgcgaccggggtcaccatcagggcgtacttggagaacgggttgatcagcgtcgtgtagatcgccagcttcgagctgatctttccctccgggaggttcagtgtcacctgagatttgacgtcgtcgccgtacatgaggtagccgagtatggccatggatccgtagttgacagtgcacgccacgaagcatatgaccagtacctatatgcaggtagaaccgtagaagacagacagttcagtcagtcaggggtagtaaaatgagctactgtaggagtactgtccaaagttaaaaaaaaaagaaaataaagagttaatttttactacctccacccaaaaatgtcgcaaactagtatgagatttgacccaacctagaacaaagaatttgaacaaaggttctatcagattcattatcctaggacggataggaagtagttgcgttggatattgtactactgttcagtcatcgtcagacattttcattttcagatagctatcaactatatagtgtcagattcattgcataattccacagttcatatgagaattaaagcatttctttttgtcaagcaataatatgtggcaacagacacttaacagctatttgatgcaacttggcattgttgagcttgacatgaattattcgatgctgcaatgtgcgtgactgttttactactcaatatattcaaggttacttcagagttcaatatcagataaataaagttaaatgaaataaaaagaacccaaattcaccagtcaagccttcagtagttcagtgacatcaaaagtgaaaacagtgggcagctcaccctggagaacttgtccttttcctgcatggagttgcagagcgtggggaatatggcatgaccgcagtagcagaaggtgtacaggccaagagcagtaggcaggccactgacattcagcatcctccccttcccgtggaacccgacgccgtcgaacaccgccgcccacagcacgcagaacaccacgacgacggacgcgagcacgccgctggccgacacgtaggcgagcacggcgaggctcctcagccacgtcgtcggcaggatgacgacggcgacgaccacgacgaacagctgcttcccggacaccacgagcccgccgacggcgaggctggtgcccgggaacagcttgtccaggttgtccccctccagtatcaggaacccgatggcgacgaggtagagctcggcgtagaggaacgccgacacggcgagccggcccttggccccgaacgccagcgcgccgatgtccgggtaaccccgaacggccggcgacgcggccatgcaccgccgcaggaggaggccggtgtagcagcagaccatggcgacggcgagcaggagcaccaggctcagccaccctccctccgacaaggcgtacggaatcgacagcagcccaacgcctgaaccccaagagatcaagattaatcgagttaaacagaccggacgaacagctcctacgaccaaatatcgagtgtttcttgtactcgcctgacagcgcgttgaggccattgaagcaggtgcgcacgaaggtggcgccgtcgccgtcggcctccggcgagcactgcgcctcgtggtcccgctccaccggctcctgcttcccgcgggccggcacggcggcgtgggcctggaggaggggctgctcgaagtccggccgccgcgcggtgctgctgtcctccggcgagccgccgccgccgccacggggcgggtgcggcggcgctgctccgccaatggccatcctcctgcacgcgacgcgacggaggggggagcagagaaccgtggagcgaacggaacagagaagcgagcagagcacgcgcgagtcgtgcagtttgctagtttttggcgtcgcgggcgaacccgcagctgtataaaagggcgagagaactgcgctgttgttttcgtgaaattcttgcgtgcggcgcggcgcacgcgaagttggagagcaacactgcatgcaacgcgatgcagtactgcagcgagggggatctgcacacgactgcagctaaaactggtggcatttagttcttccacgtgggttcaaacatcttttagaaagcattggggatagactccgtctctatttttatcaagattcgtagtattagaatatattatattcggttatttattttttatgaaatggagggagtatactgctaatgatttctcccgtttacttttcagttctttcatttcatggaatctccgaagtttgaaccttggagattaatgtgccaataatcagaaaatctggaagcaacaagctcacttcaatgcgtgcctggtatgctatcatcctaggagtggtgtgtccacaagagtatgacttatgaggatcagactgcacctagatggtgagacggaagcacgcatacagatatttccaagagagtattgttgattgaatggattgcattggatggatatggaccatatggttagctagctactggttgcaaagatttcattttgattcttggatttggctgcagcatgcagctttgctagctagaacgtgacaggccgctccatgttgataagaaatgttcttctacggtttatggagaaaccggtcggtacctactacgttggtactggtcattggtcaatctttttttcccttgggcgtacgtgtcgttctcgactaaattgaagctgaaagagagccagttgacattcctgcgtagctgaaactgaaagagcatttcaccaaactaccaagcagagcaaagctgtgcgcctgcggctgcgccctttcttttttttttcttgacatggggacatggattcttatcatcagcttagaaaattgtgactcaatttgtaactaactaagcaatttgcacctatttaacactttgtatatagtcgttgctttcatccggtaatcaagcatgattaaagcgtgaattaagtagctgtaaggaacatcgatatcatactactatagtattcacacactagctagctatagacggagagtcgtatatgatgctatacatgtggttcgattgagccgttgccaatttgtccttgccgttgagttctagccatgtgagctatgagcagtctcggcaggactccctgtccggcctgatccttttagctagatggatcgttgtgtatttcgtcgtgatcgccccacagagcttggaaaaaggttcgtccgtccggcgcccgccgctagctaacctgcgtggctgtgtgtcacgccatgtggtttgttcgattattaattcgtcgtcgcctcgcgagcggcggtgctctcggtcgatggcgacatgaaattgaagctatagcgtacgtgctgaacggtacatgctcgatcggtacaacgttttttgggcttcaccatcgtcgtgcaacgtttttgggcatgtacgcacgtagctagtacgagtacgacaaccccgatcgagcggttgaacaattgagcggcacctagggcaccagatagaattattgagatcccaataatttgcaaagagaccttgtacgtacgtttgctggagacttgcagctaaacttattcttctaccgcgtgcagacacgtattgatacgtacgttgtcgtacgctctaggtgagcagctatttgcgctcacagctcacgcgctgagtgatttgcaccacacaagacaggagcgcgctggtaattggcaaaggtaacgttgctcatcagcagtccgcacgatgtgacgatggtgacggtagtgcgtgccgttgcgtacgcagtcagggtgagggaggttgtgcgtgaccaggccaggcagagcatatgcggatgtcaacgaggcccatagatccatgggacgacagttttggtccttctccagccggcccggcccatgcacgttgtcctcgatcaaccgtccccggctataataaagcggcctcggctacggcgtggtgtaaaaatcatgtctacatgatgaacgccacttagagcaagtctaatagtacagcccactactaactctaattcatctatagccaatctaatagtcaattcatacaatagttgcttactatactattaatatatggtcccacctgtcatacacagtgtgtcttggagtccgtgctgcagctggctacagatctgtagtccgctgctattccctctcattgtttatcttattaaaaaatgtttatagctggctaatagcctgctattgtacttgctctcagagcaagtataatagtgagttataagcctactataagattatgtggaggagagaggtaaacaaaagagaagggtgttggctctcatacaaaacctagcttaacacaaactccaagacaaatacattaaatgtataagtgagagataaagatagaagaaaaaaaattatagctaactgattttagtataggctaatagtagaaagtggactatattattatccttactcttatacaacaacgtggatcaaatcttcagtgttttgtcacaacaactcgtaaacaaagttacgttaagagtgcgtcctcgtgacagccaccagctagcccagcgctatatcctgccgatcaccgcggtctacttggcgacggtgccagcgcagcggcgcgggtcgacggcgccccgaagatgcggaggtagcaggcacaatatgcacgcgcacccacgcgctgagcatctacccaaccagcgccatgagagcaagttcaatagtactattaatgtatgcttcaattaaacttattaatggtactattaatggtgtagtatactccctcatcataaaggaagtcgtttagaataatgtttaagtcaaacatcgggaatataaatcatgaataactcttaagttgttgagtttaaaaatataaaaataatatgaacagatttgtcttgaaaaatactttcataaaagttacatatatcatttttcaataaatatttttatagaaacaagaagttaaagttgtattttggagaccatgttgctgcccaaaacgacttcctttacgagtacggagagagtatacttaaattcatctatagtcaatctaatagcttattcacacaatatatggtcgcacctctcatatacacacgacgtattgaagtctgtgctgtagttggctacaaatctatagctcactttccttttctctcttctcttctcttctctccatgactttttgaaagctcctattcacacctcctagtatatttgtttgtggcaacttgttgacatggactcaacaataaataatcccccttctagcagcatgtccactattcaggtacgatcaagtgttcaactcagatcagaaaagaacagtccagatactgaaatcatatcatttcaaaccttcttcactgaataagagaaaaaaaaactgtggatatattgaaagcatatcatttcaaaattcttgcaccgaatgagagagatcatccatggagccacatctaccacacgcgcaaagaacagatggataatggtacgtgatgcaggacatcggtgctagatcactagggttcaaacaaacataatttcttggtcacttggggtcaaacatacatagaaacaagacatcattgctggcatgttgctatgaaaatactccagaatgttgctgcttgcatgtagatgtagtagcccacttatctactgtcaccttaatcgtagtagtaggagtttcatcagcgataaaaaagatgaatgaaaagaaaaggtgaaatcaggttttccccaattacatcttatacatgtaagagcatggtcaccttgaaattgtgaacagagtgcatatttttcaagtcgctatgaccgccgaacagagtcctactcttaacatttgggacgataaaatactttaacaattattgtactaaaactacgttttattatctttgttttctttttctcctttctcataaagtaaaagttataaatgctagggatcgatattaagccgttgtcatacgtaacaacgatatttctttctcttccggccccctcttttccatgttagtagacttacctgataaacaaatctaagagattgctattgattgtcattgtacatgttctcagattcactactcttttattgtgagcatatttctgaaattatgaaatggtgtgtgttttaaatactttctatataaaatttcttttaaaatcatttttaaaaaatttacaatactcaatacttaattaattatgtactaatgcctaatatcattcctgcgtccctaaccaactcagatgcagtcttagttctttcatcaccgatatgtgggacttaccaagcctaacaagtcctttcttatcatttgatagtcctttcttactattcgatctagtagccactgcctaacttagacagttggcagccttagtcagcccacttgcatgcatggactatggaagggtggagcccaacaaccgtcaaggagaatatttcttggaatgtttcgtttggagtggtatatttcatattaatttggagtaaatttcataaaattgcatatattttgcacattctatcacaaaactacagatttaagaacttatttcacaaaactacagatttagtgtctacgtttatcacaaaactataggtactttccacaatacatcacaaaactacagatttaagaacttgtttcacaaaactacagatttaatatcttcatttatcacaaaactacaagtttagtgtcttcattatcacaaaactacatattttagcatttaaaacatgtagttttgtgataatgaagacactaaacatgtagttttgtgataaaagaagatactaaatgtatagttatgggataaacgaatacactaaatctatagttttatgaaacaagttcttaaatatgtagttttgtgatagattatacaaagtacatgtagttttgtgataaaagtagacactaaatatatagttttgtgaaacaagctcttaaatctgtagttttgtgataaattgtgcaaaatacctgtagttttgtgaaatttactcattaatttatcttatcaatctggtaaaaataaattaaactcaacttaaaagaaactttggtttttgtaattgtagaagtcaaatttaatattttatgtttgtaaggcgatatatctcatactaatctatcttacaagttatttttaaaatataataaacgagggatattcccttaaaagacaaatccatctccttataacttatactatttttctttcacaatagagttactgatttatatatacaaaacttataacaatgttacccgtgcaatctatgcacccttgcaatctatgcaggccaccacactaatcgacgaaaaatcaatccacacactcccataacaatttggatcaaatcttcgatgtattatcacaccaactcacggataattttcatcagggaatagtaagtccccgtgacagccaccagcgagcccagcaccagtatcccgccgatcgccacggcctccacgctgctcatcgacggcgccccgaagatcctgacgtagcaggcgcagggcagcagcatgcagacggccacgttgagcatcgatcccaccagcgccatgaggtccgcgaagaacggcagcgcaagcgccacggccaccgtgctgagcaccagcagcgtcctcaccgccacggagacggcgcgcgctcccttgccggcggcgccgcggatcctctcctcgacggcggcagcgatcggcgtcaccaccagtgcgtacttggtgaccgggttgagcagcgtcgtgtatatggcgaccttggagctgagcctcgccgacgggaggttgagcgtcacctgggacagcacgccgtcgccgtacatgaggtagccgagcaccgccattgcaggaagcatatcactagcatctggttgatatttgataataattaattgatcaataatcaattgaagagttggtcagtatattgatcgaccatcaattaatccattctgattatgcaccagattgtttataacttgctttaaaaatatatgttttctcaaaaacgtgatttcttctactacattatttctcaggattatctatttgtcaagagattttttttcttatctatcaatcgcatttttaacactagctagatcaatatatatcaacaaactcatccttatgttctttctccttgtggtgaagaaaataatattctaacctaaaagtttaaaaaatattttttggtatatcttctatgtcccttctatacctcttccattagttagccgttaaatttctatcataaagttcattttgccctttggtatcgagaaaatataaatttatgaaatatattgatgtagtgtataaatttattgtatgggactattatatgtatgagtttattttgtgagatattatttaataaaagtaatattttagtttcgcctcgcgaagggaaaacaaaagtaatttttatctatgacaatttattttagataaaacaaaaaataatattttttatcattgaaaactgtatatatatagcatagtttgttatagtagtacgcaaatttttataagataaatcttgttatatgagataaaaattatttttgttaaataatatcttacaaaataaactcataaatataatagtcgcatacaataaatttatacactccatcaatatacttcacaaatttatttttttataccaaagggtaaaatggagtttatgatatgaatttaacggtcaactgacaaaaggagtatagaggggattcaaagtaaaatttaggagtatggaagtaaataatcaaatctcaggaatatagaagggattggacgaacttttaggggtacatagggaaatttctcttcatataaacataataatgcactaaattggtccagaaaatatttttttaaaaaagcaaagctaaaagttgcagtgttttttttatatatagtagtgtgcaagtttagtaaatgacctttgcaaattggttgactaacggataagaaaaaatcacgactgataaatagcatagtgttatgcgcatgcgtatacgggtatacctttggaaactgagacttcctcttcatagatgtgtagagcgtcgggaacatggggtgtcccccgtagcagaagatgtacagcccgagagccgtcgggagccccgcgatccgtagcggcgtcgtcgtccctcgtccggagaatccgacgccgtcgacggccgcggcccacagcacgctgagcacgatgacgacggacgcgaacacgcccgtggcggagacgtacgcgagcacgccgaggctgcgcagccacgtcgtgggcgccaccacgagcgcgacgagcacgacgaacagccgcttcccggcgagggacaccgtccccagggtgactctggctcctgggaagagcttgtcgaggttgtcgccctcgaggatgaggaagccggtggcgacgaggtagagctcgacgtacgtgaaggcggacacgaggaggcggcccgtgcggccgaacgcgcgctcgccgatgtccgggtacgtccggatggcgtcgtcggcgtccatgcagcggcagaggaggatcccggtgtaccagcaggcggcggccacggcggcgagcagcgcgaggctcacccagcccccctcggagagggcgtagggcacggtgagcaagccaacccctggtcgatcagagaatatatagcggcatgagtgcgcacggtaaatcaacgcaagcaattaagcaagactgcaaggtagctagaagatctcgagcaacatgtacgcaccggacagggcattgaggccattcatgcaagttcgcgcggtgccgaccggcattgtgttcccgtttatagttagtaaataaatctggcaatattagtataagaggctcagcatggattaatgcagggtcatcttggagcagtatatataggcaatagccaagccccaaaacaggctggaacttggaagcatttctgcacttcagcgtctcgcttttgctgcatacagcatacgttgttgggtgcatcacctatacctacctatgcgcagctatgctagctagttggtcactatgaaagatacagtagctaaagctagttggtcactgtgagagaactcctatgttacgtttaactttaaaaaaaacatggttattgataagtaaatcatgttatcctaactgtagattgtataatttaatttgtgttgtcctgaaccacctaacacttgcttggtccagactgcttcttatgtaacgagatatgccctcccactgatcctccagtgactgcccggcgtgtcacagttgtatactacacttcttctaatatattgatgtgtaaagtttctacgtgttcatgaaaaaaacccttgcatacaatacaatctcgagaatgctctaccaattgcacacctaatggataacgaaatattggttttgctttaaatttcctagccacccgtttcacagccttgtgacaatcctcctttccctcctctctcaagcctcaagcaggtcctcgtggtggagcgaacggtactacttgttttcattaacagggtcaggggcacggttgccatgagcaatgaggaggaatcggagggggggggggggctggctccccgtgcgctagtggggcccttgatatcggtgtgcgtcaagacaaagtgatacaaagtttatacgtatgtatataaaagtatatacatacatatatacatataaagaggagagatgagagactagagggggcgaactcaccgcgcaggcttgcccccgtgtgaccacccatgcattagcacccctcagcgcggcacccatgtactatctatctaagaatctataccattgtacatgctccgatgagctccaccgaaagttagggatgggaacggtgatggatattcccaaccgatccattattgttctcgtagaagttgtgacgtttctgattctagacataaatttaaattgtctaattcctattagtatcatattgatggtattactaaaatagttgaattggaaaatatagagaattctccaacgatttcatccctaccatccactcttacaaaaacagtgctcgatcagttgggaatttctatcaccattttcatttgtcacatagttgagagttctcctttgtaatttaatatatggatgattcaacatcacgtccattaatcttttaattcctgtcccaaaaaaactgttaaggacttcttagaaaaaaaaatcgccgtattttctaagggaattttattaattgatcatggagaatatcctgtggaactcctatgttcaaaaagagcactaaagtcccctgtagtgatgagtgtgaataaacatgtttttttaagaaacgcattataaatccagttgctcatatcgtgcacgcatttatcctataaacgcacaaacacacgtggaacacaccacctctacgattgaacctccgaaagactaggttgacatattttgagactaatgcaaaagtcatcacggacgccttgatgtcgacagatatatcgccttgaaagaataattagccgtaaatatgagcatccatgtgaccatgtcaagtttagaacttaaacctgaataggctggttacaacttaagttagttaaggtaagcatattttgtatgtgaatatatttatatatacacacacacggataagagacaaaggtttgacaatgtcatgatgtcaagagaaagaacagaaagcgatcacactatcatttgtcaagtttcgctatatagaacttatatttcgtgacaaacaacgaaaatcttcaatatataacgcctcctgcttcgtaatggatgatttttagagaaatttcacaataataattaaactagttcatgtgaaaatcatgaaaattaacgtctcaaggagctctaaatccacatgcattcattgatgactccaactcctggtaatttgatgcacatgttgcatgctagtaacttcactgatgaaaagaacaaaaaaaatctacaagcaggctagtaactcctggtatattgtatagattaattagttaattaccgtgagttactagcaacactagaagctgaaacatacgacctcgaccatgcgttcggtgatccgtaccaacatgagattttgtataagcactcgaggttgcttggtggctggcaaaccaagtgtaaaataattcacgatcaggtgcagctagcgggagccatacgttcttttccaatcaaggagtgatcaagctactcgcacactcgactgatcacatcaggttcaggaagcacttgcgtgctatccactgtgctgctgcatgcatggttccatttctttacagttaataacacagtatgatacgtctcttaattctgctaagtatgcttattccctcctatcataaatacttgaaacgttttggataagttaagattcgatctaacattttaaacttcagctgtaacaaactttgaaatatttagtttaggagtagtagattcgtcttgaaaacacacaactccctccgtttttttcataacacgattgacttctaaagatagctacgaaagttaatatatttttattaacttattctagtaactagcaaaatacatgtgtcttataacatgttctaataatactagatgatctaatctattatattattaaaacagctttgaaagaaggcaccacgttcactgtgggactagaaattttcacattaatcggagaaaagaaaaaaaaagaaaatgagagttcaagtagaaatacaatcttccatataagaacccaatacgagattaatcaaaattcgaaataaaaataaaataaaatccaaaattagaaaagaaaaggatagtccaagtaggaatacaattttaaaatagctgaaattcggaattaaaaatatggtatattaaaagaagagtccatataagaacccaatacgagattaattaaaattagaaataaaaataaaaataaaatctgaaattagaaaaaaaagaagagttcaagtaggaatacaatttaaaattagctgaaattcggaattaaaaataagcaatattgaaaacagaatccatataagaacccaatatgagattaattaaaattcagaaaaaaacaaaataatatccaaaattagaaaaaataaaagagagctcaagtagtaatacaattatgaaacaactaaaaataaaaataaaaataaaaatattaaaagaacacaatacgatattaattaaaatttgaaaaaaataaattctaaaattagaaaaagaaaaacaagatttcaattaagaatacaatttataaataactaaaatttgtgataaaaataaagactattgaaagaaaaaaccatctaaaacacatgacgagataatttaagtaacatgcctacaaaggagtagagtggtggcggttgatacggaatataaaaactgttgataaaacaccaaatataatccaaatgacgattaaatggagggacgacaagcaggctatgaagcaaacgagtaaggcggttgccgggacttctaaaaaataataaataataaatcccattgataatcatattcgatttttaaaatctcaatgacaataaaaaggagaagcagcggacggggtgtataggagtatagttgcaaagccgctgattgttgacgggacttctagaaaataaaaaatgaattccatcgatagttatgttcgatttttagaatcacaatgataataaagagtaggcggcggacgggacgttgaggagtatagtggcatcgtttgacgagacttctaaaaattataaaaaatgaaactcaacaagacaataaactctaaaaactacaatgtccaatttttaaaggtttggaacttctaaaaagtaaaaaaaacaattataatcatgttcgattttaaaatctcaatgacaataaagaagggaggcagtaggcgagccgtagagaagtgcaatggcaaagccgctgatggtttggcgagacttctagaaagtaaaaatgaacccaaacgataattatgttcgatttttaaaatctcaatgacaataaagagaaaagacaatggacaggcaatagaggagtataatgacaacgtttgacggaacgtctagaaattataagaacgaaacccaacattacaataaactctaaaaactatttcatccaatttttaaaggttccaaggagaataaatagaaatagtggtagatcaagcaagcaaaataaggaaggagatgatataaggggcagcaactgatgtgacttttaaaaaactatataagtagaaacactagatgataaggtttggtgtttcaaagtcttaagacaatgagatagctatttataaattttaagtaaaattatattaaaaaatatattattttgtttggatgctagtcgcgcaattgcgcgggccatccagctagttaagactaaacgcacatgtaattattatcttaaaaaaacgcacatgtaattaactggtggcggtggcagacgaacgtacattatcactggtttcttttaagattatataggtatatagaaaagttgtaattgaagtcttaaaaattataaaagaatgaaacgccttaaactcttatgtcgatcggagggagtttcgacacgagttttaatctgagaacgtccgtgtgctcagtgctaggaacgagacagatgacaagaaggaagtaaaagtaaaattgctttcgctgtgttggtatcaggtgtgttggcaaatgacaatggcatttgaaataatcgtttccatgaccacgagagtccttgtcagactttagtttgttcgacgaaaaaaaaatagttactactactacgttgctcgcgtacggcaggtttagcattaatgaacgttgaattatgaccaaggtgattatttttgtgctcagtttgttcaacgaaaaaaaatactacctatgtttctaaatattttgacaccgttgactttttaagcacatatttgaccgttcgtcttattaaaaataattgtaaaatatacaaaactatatgtatacataaaagtatatttaataatgaatcaaatgataagaaaagaattaataattacttaatttttttaataagacgaatggtcaaacatgtttaaaaaaatcaacggcgccaaatatttagaaacggaggtagtagtagctagtagtagtagttacattgtgctaactactttgtgtttaattggtcatgttcgtcaggtttagcatttatcaccgtgttgaattagagccaagtagccaaggtgattgtttttgtcgttagtaacttgggcacgataaccataatttttcactgtttcagattttaacacgacttgaacacaaagatgtgctttgtgcagaacgcgtatatggtcaccaactcagcgatgacctttcactttcagcgagctatcagtagtaacagcagaaaaaaaaattgagaatatgccttttattttaacaatttacgtttatatccctacgtgggaagaaattgcagaaatatatgtatgccgcagaccgaaaacgtgggtgcgatcacaaatcgtgttgcggagacgcaggactgctggtcagaccgtccccgcagaatgggcaagaggaacccgcgtctccacaacacgatttgtgagcacatcagcattttcaatttatagcatgtgtatatttcaatgatttcttctcatgcaagtatataaacaaaaaatatttaagaaaatgtatattatcattttttttcagtaacagcataatcaaaacaagggttttgcacaagtcggcagtattttttgcgcataggacatctctataagtgaaaattaaatcccacaaagaaactaggatatgtcacgtcatctaacaaatacttaccgtcagatgcacttaaagacactacatatataaaaagtgattctcggtacatctttacatatatagccgtagagtaacccaccaataaacataccgaataacgtgtgtgttatggattttatgtcaataaaattgcaataaatcctacattcgcaattaaacaacatagcaagtctaaaattatcagatgtgcaggtcatagaaacaatcataaattaataaataaaataaaaaaatatctaccacctacagaaatatatatatatatgtaactaacaaatagaaaaacaaactgatatgcataatccaaaactatatctcaacctaattgcttgaacattgaaccaaatactctccaaagttcaattcttaacaaaatcaaataatataattcaaatccgcaaatagaccaattaaattttaacatacgtaatcattacaaacaatgtactatcatattcgaaaataaaagacaggttatggtcgcctgtaggcacgacttagatagctagtgttaagtgatgataatttctagaaatgtgcagttatcgactcatgcaagcctgctcaaatatatagaaattaaatttagtaaagtttaatgaaaaccaaacaatgcgtatgaatttcgagtggttgggtcgcatttcacagtacggaaaggcctggacaacgcaccgggagtctcaagggctcaaggcttcaagccgatgatgcgagtctttttttttacgggctcaaaagcccaacgattctaacgtagcccatggttgccctcgcttggtccggttgtacggtgtacggtgtaccacgcgctgccaccactaacgacagcgcgccgagcacagatccaccggtcgtcgatggctgtcgcgtacgctcagcgcttgcatcgatcggctgtctgtccggtcaagtcgctgatggctgaagcgaactgaaaatgtcgaagagaacatggtaattttgatcaaggacaagcgcatttcgctggtttactgcatctgcatgcgtgcgaacttggaaagagggttacacattacattggcctcgactagcatacgtgtcgcggcagcctaattagcttgcccactctagcttgacatctctgtacaagtatctctataacaaaatcgttcgaactccacaaggcggaaacgactcagacctcaagacaaaaggagctagaagaagaggaagaagaagagaattgacacttaaaatatatatatcccgaccatcgaccatggtactgacccaggcgagtcatcagcaactcagcatttgttgtgtatcgggtcggaccctcgccggactcgacgcttgctcatcctgtcagggtcgaacaccttcgaaggagaggagccggtcgccgtcgccgtcgccgccgcggccttcacggaggcgtcaaaggtggcggtggcggcgacggcattgccgccctccacgagctctcgcggccgctctgttggtggcgaggcgctccggcgactcgcggcgaacacggccggggttctgacggcgagaacctcgtcggaaaaggaggccaagaggacgacgacgagaaccagcaccgccagtgctaggttgagacctctcattctcttctaaccaagggcgcgttgttggtacaagctaagctagtttttgcgagagaaatctgtgtagatagtgtaagcttcgaccatgttggtaacaatggccgcatcctgtgcctttgttctgctagatataggaatagggaagcagggacacttaggcagtgttaggccacatctgtaactgggatggctgagatctcggtccaaaagcataaagctcaaagagatggacacccaacaaggcaaccaaatcactttatacttgaaggtgattcttgctgagttgctggctcatggtgttgcgcatttgcatgtaacccagtactagtttggtagaaagagaagggcgttgcgggtctgcctgacaagctactgaaatatactcctatcttagacgtgacatgtgagtgactgaggtactccctccgtcccaaaaaaaagacaaaccctgatttctgtgtccaacgtttgacagtccgtcttatttgaaaaaaatatgaaaaaaaaattaaaaagataagtcacgcataaagtattaatcatgttttatcatctaacaaaaatgaaaatactaattataaaaaaatttcatataagacggacagtcaaacgttggcacggaaacctaaggtttaccttttttttttttgacttagggagtaaatagtagcttggtgttttggtaatgcaggattatgcggtgatggttaatcaacatcaaaaaaacaaaggtgaccgtgcccactgggaaaagaaagcacagcatgcagttgcattctgcggtgctgaattctattttagaagaatctgccaggtggaaataaagatgctggggaatagctagctacactacagtgtcacttggaggaatttaggaccaatgcaagactgtcactgggttacctctctactgtctctttctttggattataaaccgtctctttttttggattgtagatcagccaacccaagctgttgctttctcttctttgtgtactttggaagcttctctctgaataaaggagcacgcctccccatgctgaaaccaacacaacgcacatcctgctactcctgccgtgctttaccttactgtgccatatagctgttgctttatgttgtgttattctacagtatcattcttggcttcttgtcgtgtaacaccatttttaccttgggaaatttttttcccttccgcaatgaagcttgttttgccttggattgagtggatcagtccaaaaccaaaagccaatcttggcccgttcaaagatccaaagtgggaaccaagccacgccacacagcgaaaagcctcccactgttgccgctagtagcgacattcccttcttcttttgctttctttaggtaatccccctagggttacttaggctgcgttctttcaaaggagattggggagattgtcattcgttttccgcgcgcacgcttcccaaactactaaacggtgtattttttttaaaaaaattctatatgaaagttgctttaaaaattcatattagtccatttttgaaatttaaaatagttaatactcaattaatcttgcgttaatggctcacctcgttttacgtatcttcccaattttctcaatcccctcaccatcaaacacagccttagagcaaacacccttgttaaccccccaaaagagaaggaatttcagctggttacctacatatacttacatcaatgagatcatcaggatggactgactgcatcataatcttcaaaggattatgacgtataataagcagaaactctgatgtatattgaggcaccatctatggagaggagagagagagagagagagagttctgaatcgattcgttttagtatttaagaaacaaacgaaaaaggcttcaggttggaagcatgaacagctcagcaaatgcgatatttacaaaagcaatagatcggggatgccaacttactgctagaaatacatcagatacttgcctcttctaaaggcaaggttacctccagagtttcagcgcctctttggattgtcaagctcaccttgtctccaacgccataatcatccagaaccctcgatagatcagatttgcctttgatctgctccaaaagatccaacatgagaaacagagactggactaaggctaccttagtacatagcatccaaggattctgacagaaggctataaaatcagtttaatgttaaccaatcaacacttacaggtttaccgtccacggcaacaatgacatcaccaagaacaatgttaccagcaaaacccctactggtaggaacaagaccagctttggctgcagcactgcccccaggaacctgcagaaacagaaatattatgaacagaatccagtttggccaacagaaaatatgggttacaccaactcagtctacctgcaatattagagatccagtgcgaacattaagctgatatgcgattggatctggagcaaactccacattcaagccagcacggcgaaccttaagagaggagtgtaagcataatttaaaataaaatagaatacagaagctaactgctaagcacatgtgtcggcaatggaaaagaaagaaggttcttaatagcaatctaaaatttatctgtgctcaaaatttttgcaacaaaaacattcaagcaatagtgttcacaaagtttcaagagagttttcaggaggggagggcaaagttttgggccaaactcagaccaaaattaatttaactatctttggaaaaggtccctatagtatttacaaaaacttatcaaccgaaagtttcctcctactgctaacacctaaagttgactctgagcatgtttcacagcatgttggtctaaaatcatgacaaccacagttattgattattgataaagaatcacaatccataagatgccatctaatgcatgaaacatatacctacatatggcatctccataaacataacacattattctaaggggatgattagaaaatacgtatgttattaggttgatgatgatgttattgaaagatatccatgcaacatacttttccaaactgaattaactgaggagctattttcagaacagttgatgacgggatggcaaaaccaacaccagcagatgttcctgcgacattgaagaaataatggaatctcagactaacataggaatttaagttacattggacatagttggatctgaatatctgatttatgctctaccaaatcaacaacaaaaacaaatggtctaatgcacagcttcaaggaggtgattttgagtcaactataatcaattatgtcaattcttacagcccattaggatgcaagcaaataacaatttcaaagaatgctgtgaatccgaatataaacatgatagatgataccactcactaatcatgccatcaaaatagaaagtcactcaaagtgtgccatcaaccagagtactctgggaaatgaactgatgtacagggatcgaggcaagctttgcaatgtgttatgatcattttagtttattgaggatgaacttttactaattggacatattctcttttgaatgctaagtgcagtgcttgacatctgtagagaaagcatgaacatctactaatgttacctccgcaaatcagcatgaaacaattcagtgctatttgattaatacatttcatgttgagataatctaacctgtctgtgtgaaaattgctgtattaataccaatcatatgccccttcgaatccagcaatggaccaccactgcatggacatacatcagtatacatgcttagtaaaaccctctataatacattttcagaaacataaatatccaacacatattgtataaaccactacttacaacatgatccttaaccctagatgttcattgccccagagtacaggtaatgcatactaaatcacttcaaggacgagggcatacatggtcaagctgattttgaccacaaatatgatcaaattctaccctaatatagtaaactggtagcaacaaatattaccactatgccaactgccagagctgcaatttagccccaatctatgtgtcctgactttagatgcgatgctagaaactcaagaaagtaagaagtaaaatacttcctcttctgtgtcctgagtcaactgttttgcactgttataggcaagtactatcattttgtgcatagtagaaaccataaacagtaatacagtatagccatcaagtaactagtgacaaaagtgtttatgcttgtcagtaagtaatatacagatgtaaaccagtacaactaatggtagtttccaggttgggttctgagaccagaaaagggtaatcagttgataaatcattaaagaaacatatctacaaacctgttcccagggttaatagctgcatctgtttgaattccacctccaattgttactccagcttgactgaaaatgtctcgatttaaaccactgatgacaccaacagttagagcatggtcaaagccaaatggatttccaattgctaaacactgttgaccaactcttagagctgaagattgtcccacgttaattggcttcaacagatctgtaggagcatccacctattgcatgtccataatccatatatgaggtactatgtctgacaacatttgagctcaggtgaaaatcacaacaggactttacgcactaacaaaccgtaaaattatctaatacagcccttccattggttgtccttgaactagattccattgggacaaggcaggcataagatgagtaggtaaataaaaacatcttggtatctaaaaacatacatatactatttccgtaaaagaagaaaggacggggcaaacaaaagtatgtattcttgacctctgaaaggaacctccccccctccccccccccctcagtttcgtaacttaactcttcaaaaaacatttcaatcaaatagcatgggacccctaactcaacagaagaaaatgttgtgttactgtcacaaataaactattataccataacaaaacaaaacaacaaaaagggaaaaactgaagcagttggctaaagagatgaatttttacttatgaaactaaaactccaaaagtatcatttttttctttttctgttacttccactttctactccctttttattttcttagtccatgacatatgccatgtgagataaaaatgagcagatagttaaatccttggctaacgacagaaggatattaatgagagtttgaggcatgtacatgccaggccaccagggagatgaaatgaattgaatgactaatataaaatgttgcacaccgaaatgagatgagagaaacctatggtaaacatagtgatgatagatgacaattctctatagctaatcaaaagacttctcaccttgagaacagcaagatctttagaacggtcagcaccaaccaatttgccttcaaaatttttctgtatcctttcaggtagatataggagagcaccagagcattaacgattagttggcttgcatatacaaggaacattgcaattgtatatacattaaatcatgaaactatcctgtaaaatgcagttttattagaatttacccatcagcagcaagaatgttgacacgcgcaacaacttcgccaggctttggtttttttgaaagggcattgccaaccactgtcattgcaccaacaattaaaatgaataagatgagtgtgcaacagggtgaaagggtcaagcaccataattatgtatgaaggaatttagatctctcacatatgatgggtttttaatttactgactgccataccatggtagtttgtaacaatatggccggaatcatcccaaactacgccagaaccatttccttcgggaatctataatgaatattaagaagtttctttcaaacaagggcttctaaaatttctattaaaagtaacaataagactctacacatgatatctgcgaaagatatacaggacatcaagacaataaatcagcaattccttgtctaactttagcttgatcgaatcaccagttcagaaagaaagaatgccagacttgtcctatcctagtgcttctatggagaatactagtgatgcatttgtcaatttgagcaacaactaacacatactcttgactctactctaacctataacacgaaagcacattttagttttacctcaacaacaccagttacattgagctgagggcgcagagttgcatcaaaaatgttgacaacagagtaagtatttgtttcaaaaagctctgcgatccgtttctgccatgcaagccataaaagaagaaatatccaaagaaatgtaaatatatttttggaagaagtaaaataggataaagtgggttcaactaagtactgacctcagttggaaacagtggaccagatggaaaaatctttggagtgacatcatcaattttaacagatggatcacccaaagcaagtgctgtatttaaggagttgtaagttacaaagcatgaacacttatagagtaaattaaatactacaaaagcaatcatttgggtaggtgacaactgacaaggatcgagttaatttctattaacacctaaattatcatgccacttagtccgaacctgagaagtaccttgaagaatgtaagcaaaagcaaaacgatgataatgcaacaagcttcctccttgacgcaagcaatacaggtttacttgacatttcaccatatgtttccatcattgacctggaatataatttcagataaacataaacagatagagtgaataggaaaacggtcaaccaactatgaatacctaatgcaggtgcacatagtcacagagtgagcgccgtgcaaaagacaaatactactaacagaacatgagaaaatgtggacgctgcttgatggtgagttaactaacacgaatgttctcgcacatcgaattttcccctaaaaattcatcaactactactctactagatatcaaacggaacacaactggaataatcaataatctcccgctagaagcaaccgagattcagcaagcgaaaggtacccaaattgggccatcctacactaactacgcaatacagttatccagaaccaccagattgtaccgatgaaaaccacccggttagaacaaaatttctggcgcaggggcaaggggcgggcatacctcggggccgtttcctcgccgtcgcgggtgaagggggaggaggcggcgcactcgatagccatcctccggcggccgccgccgccgacgcgactgcccggggcgcgcgcggccggagcggcgcaggcgaggcagtgcatcccaggttccgagcaagcaatccagagccccgcggggtctcgaatgggaggagtggtgggggtgcgtgcgtgtgtggcttgcgagcgaccaccgtgaagcgagatgatttgaaacctcacaccaattctggggcgtgacggactgacggtatcgtgggggatggccggatgggagaggtgtacgggcatacggcccagaccatctcagcccaattaaacaggccacacgatgctgtttttgacagagccccctctttccaaatagcccctatttttgtacttttttttcagaaaggtccccatgtatttgcactcagtccccttaaggccttgctcggtttaaagagtgttgaagaggattggaggggtttgtggggattaatcgaatatagcctaagggttgaaaacagtatggattcggatactcgaatggataccaaattattttagcggattgggatttggtgtggatgtagcgttgaaaatgatatagagtcgaagataacacggcctataaacgaatcaaaaatatcggatgttgcatacatatacaacgtaatacaataataacaagaattagaaacacttaacatcacaccacacaataaagctaattagacttacaaactagatagagagcttatatctactattataaaaatttaagatgtttttatcggtactttgatacgtcatccgtgtttgaatcggttttaattttattttcagttttaatctctgtatctctatctctacttaaaaagaataagaaatttccaaagtcggtaaaaaagaaaaagaagtccgactaaaaaggtaaaagaaaagtccgactaaaaaaaggataaaaaagcttctatcgttgtaagaaagaaaatcgtccgactcaaggaaaaaaagggggaaaaagtctcgccagtaaaaaaacaaaaaaaaaagtccgtttgtgtttttttactggcgatttttttttcacgctaaagagtttttttcctgcgcacgcgttattggtttttttttctggttttttcaatcacaccgcgcctcccgggcgcttttgttttttttttgtcaatttttttcaccggttttttatcccatgcgattttggtttttctcatctggttttttttaatccgatctattcgcggcacgtgtaccaagttgaaccctggcgacgcgctagcgccatatcgatcgtgcgttttccctccaatttgattgcaaataaaaaaatcgattcctactcctccctcatcattctctctatgattttcctcgctttattttgtcggatttaatctaacggttgccgatgatgacggcgatctttcccgattatttttatcccgagttttatgctctgattttgggtaaaacggaaaaaggtgagtggccggataaaaaaccctcaaccaattttgggtgattgaggaagattcgtccggatttgatgggtcgaaggaagcaggccaaacgaaggaggtagcggaccgacctagggctaaaaacggcttcactcgtgactgggtcgaaacaagcaagctaaatagagggaggtagcggactggcctagggctgaaaagtaaggaatgctttcgccccaaaacccaagaaagattttcattaactttttttaattataatatatagcgatcccaatattagaattttcattaactttttcaattataatgtatagcgatctcaatatttcaatttgttgctcagctcttaatatatcattgaaaaaacgtatttactcattgcaacgcacaggcattttttctagtaagagaaaaaaacaaacaaatcatttggttgagctatgatagcaatataatcatatggctagttattaaaaattgaattatctggatagcactttgttagataattcgcattaaaaaatcggataatatgcatcattgaattttagcaataccatattctaatcctaatacgccagattttacaaaatattttaccatattattagttctattggattcggaccaaaacagaaaaataaccgatccatttttcatcccttctggtaaaccatggacctcgaagtcttaactccctcaaaggttaagataaaatacggagaaaattctatccgtgatccaaaaatttatcccaaatcaaagaataccacaaaattttcacaataccaatcaataccacataaagaaccaaatgatgcattcatctttctctcctcatcccctctcatctgatctttggagtggattcatcctcttccggagcttgagatagatgccattgtcgtgtctgccattgccaaggacgaggtggtcacaccgaggcttcggctggagctcgatctagatggcgtcatcgctgctattgtcgtagtcttgatgattaatcaattcaatcttggctgtcatgagaggagaggttagatttcgtggtatagatggaaaatttggttattagatttcgtggtatagatggaaaatttggttatctttgtggtattatttggcattcaaaaaattttgtggtattctttgattggagaaaatgtttgttatgggcggattttcttaaggaaaaagtacaccaaaggtccctcaacttgtcatcgagttacaaaatcgtcccccaaccacaaaaccagatatgaaacatccctcatcttgaggaataagaagcaacccataacaaacatttgctccgagaggagagaagtgagagagggagatagaggaggaagggagaggatgggatgacgtggcatcctaacatgtggggcccatgtgggtcacatgctgactcggccactacgtgggataaaatcgggctcaagaccactgagggacctaaagtaaacggttttgtaagttgagatggatgtttcatatctggttttgtggttgggggatgattttgtaactcgatgacaagttgagggaccttcggtgtactttttccttttctcaaaggttagctatcaaccccgccgactccgctggaggcccaactcggcccacggccaattactgggccgccgcctgtcgcgcgacgcctctcccttcttccccttgccccatgtcgccggccgcctcctaacccgacctactaccctccatggccgccgccgccgccatcgccgccgcactcctccgccgctccacatcctctcaacaccaccggcgcatcctcctcctcccactcctctcccacctccagcgggccgcgccccgatccccttccccctgggacccaccgccccaccaccgcttcttcttctcctccgacgtgaccgccgagggggacagtaagccgcggccgcctcttgacgggaagcagctatggcgcgaggtgtcgacctcggagcccgccaccggcgcgtcgcgcctcccgaaggccacgtgggacgccgtggtggcgctcctccgccgcttcggcaaggacccggctatgtccgaccaagccctcgcgctctacatccccgcctcggcgttccccacctacgcccgccgcttccgccacttcctccccgcgcgcctctccctggagtccgccgagcacctcctctccctcccggccgacgacgcgcacgccctcctcctcccggccttcgctgagttctgcgtgacccacctcgcggacgagctgaggaagcacgagtctgtcatggccgcggcggacctcacggcgccgcacgcgtggtaccccttcgcccgcgccatgcgccggcgggtggtgtaccactgcgggcccaccaacagcggcaagacgcacaacgcgctcacccgcttcgccgccgccaagtccggcgtgtactgcagcccgctccggctcctcgccatggaggtcttcgacaaggtcaatgccctgggcgtctactgcagcctccgcactggacaggagatcaaggaggtgccattctccaaccacgtcgcgtgcacgatcgaaatgctctccacggaggagccctacgaggttgcagtggttgatgagatacagatgatggctgaccctgtcaggggctatgcgtggacacgagccgttcttgggctcaaggcagacgagatacatctctgtggtgaccctagtgttctgaagattgttcggaagatttgcgcagatactggagatgatttggaggtgcatcaatatgagcgcttcaaaccgcttgttgttgaagcaaagacactgcttggagacctcaagaatgtgcgctctggtgactgcattgtcgcgttttcacgcagagagatatttgaggtgaaactggcaatcgagaagtttacgaagcacaagtgttgcgttatatatggagctcttccaccagagacacggcggcagcaagcaaagctgtttaatgagcaggataatgagtatgatgtgcttgtagcaagtgatgctgttggtatgggattgaacctcaacattaggagagtggtattctatagtttggccaagtacaatggggacaggatggtacctgttgctgcttcacaggtaaaacagattgctgggcgagctggtcggagaggcagtatttacccagatgggctgacaaccaccttcttgttggatgatttggattatttgatccagtgccttcagcagccatttgaggaagcgaagaaagttggtctattcccttgctttgagcaggtggaaagttttgccatccagtttcctgaccttaccttcaatgaactgctggataagttccgtgaaaattgccgcgtcgacagtacatacttcatgtgtcaccaggaaagtatcaagaaggttgctaatatgcttgagaggatccagggtctctccctcaaggatcgctacaatttttgttttgctccagtgaatataagggatccaaaagccatgtaccatcttctgagatttgctacaaactatagccaaagccgtcgtgttagcattgcaatgggaatgccaaagggttctgcaaagaacgacactgagcttctggaccttgagacaaaacatcaggtcctgtcaatgtacttgtggttgtcacaccattttgaggaagatcattttcctcatgtgcagaaagctgaggaaatgtcaataaatattgcagatttacttgctaagtcacttgccaaagcaagctggaagcctacatcaagacaacaagcaaaaccaagacgagaaaatgaagaagacaacgatgtggagcaggcatcagatgataatgcaaagaatgattcagaagatggttatgaaaggtcaatatcacgtataaaaccgttcatgaggtacagcttccaacccatatgtttcacagatatgctgattcagcaaaattacatacattttttttctttcatatagttctcgaacatatggtactttttaaatgcaatagctcaagatatcagatttgtcttcttatatcaacaaaattagtattttaaggagctactgcaatgcatctgtggaagtgttttattggacccaagaacatctcctgtaaacgaccacagctattatatgaatctgtgtgatggcaaaattagagcaaaccttgtctatttcatgagcctataacataaagtgttctctttagtctttacttgttgaggatggtaaattggtaaggagtaaggacaactatattttgtatgaagtcaatgggcatgctggtgctgaaaacaggcacttctttcatgttcaaactaaaaatatcattatatgcccactaaatgtgcttagaattaaatttaaatctgtggaaaggggctgtttgatatattataatcctacataaaggttgctagttgctacaaccagaaaaaaaaaaatctcatttgcatattgtgtctgctgacttaaggccatgaagtgctatgaatgtgtttgcttttttttgctcatgataattgccaggaaagttgtagcggtatgtaactgtttgtcaccagttttcaatgctggcagtaacttttgattaaactagtggaactatatggttatatcattccattggaaactccacagtgtttcttcaagtttcatgacctcattcattttgttttggctaaactaaattgaaaattcttaataatctacaagaattttatcactgacattggtcattgatgtttcactgatttgaatgatcgcaccttgtaatgtaacactagatcagcagggtttttttttttttcatattagttaagttcctctgaagattaagtccagctaagtttcctgataatgcagaaatttgcttttcatttgccttttttcaaaggaaaatattttttccaattattatcatatacgtacattgatatgtttgaacgaggtgaaaaggaacatctgcattcttgttctcaaggtttaaaaataccatgttaaaagaagaaaaagaaaaagatcgcagagttgattgcgtggtggggccagattttgcccaagtaatttcgtaaatttagaatgtataaaacaattttcatttagaatgtatataacaattttcaattagaatgtagtttcagatacagttatgatggtattgtttgtttccttttgcaggaaaaggctggatagacctagtcaggacccttcttccttgaactttgtggcatgaattacttgtggcctgggtgattaaccccgactgattgcttcatgagatcgtgtgtagccaagtcgttgcagccatttcaacctcccagaactggcagttcatctatcagttctggtgtaggatggttggttatgttggctgaagtttggaattgatcttatcctcaaaatgacactgaagccatccagaggtgtaagctagtatgctttagtggcgccacgggatactttaacttcagttttgtagattatttgcacgagaaggatatatcgacatgaattcatcagaattaagttattagtgttttcctgatatgaacaagggagtaagggactgtggtaataagttagctgggggatatacggtttttttattgggtattcacttagccttggatgtaagggactagaaagtaaacttgttttgtttcagttctgtttgaatcaatggcagcggtataaccttctgcaacgttctcacctgagttttccagtgctcataaaaaaattcttgtgctcagtcagcacacaggtgtaactactgtttctaatcagggatgaacgcgtccatgagcactcatcggcacagtgtaacacgagactagaaaataatatcgcactttgcccgttccataaaaaaacgaacttaatttttcatttggtgcaataaaagggcatctgtttcatgtgttttcaattcctataagattaaagatacatgctactctctcggtccctaaatatttgatgctgttgtcttttttaaacatgtttgaccgttcgtcttattaaaaaaaatttaagatttttttcctatcatttgattcattgttaaatatactactaccactactactcaagtagcttaggataggttagctgttggtgtggtgttgtagttatggttttcgctcagtttcctaattaaccgtgcgctgtaaggtttgatcctgttttctccttaaaatggaatatcttcttcttaatataaaaagtcagcaatggcctgatcgtttgaaaaaaaaagatagaaggtgttgagaggattaaattttaatatatatattttttcatcgatttttgtatatatttacatgcctttgaaatatatttacataaatatacactctccgcgggatagaaacgagccaccgcaccgtcgacgtcacgcggcacaaaaggcgcaggatcgatgggaggggcggtggtgcggcacccacacgcgtgaccgcatgtgtgtaacatggatggattaggtattaataatacaatatatttacaacaaactattatataaatagattattagattgattatcgatgatattttaattaaacttcctcttcagagaaagaaactactatttgtttcaaagggacctagcccataagaaaatgaggcccaacccaacccaactcaaaccggcgaatctctgcgcgcggcccgatataaaagggctcgcaacatacagcacccaccatcccctaacccctgaccacccccccgcctccgcacccgcctccggttgcctcctcccctctcggcgggcggcggcagcagcggcggcagagtcagcagacctcgccgggaagctaaagccctaaagctcgcggaagggtttatcgcaacgggcgatggcggcggcggagcagaaggggaagaagccgaggaccgacggcgcggaggccgagcccgtcgacgccgccctgctgcagtccatcgagaagctccaggagatccaggacgagatcgagaaggtgagtcggcgttggatcctctagcacggcgtggttgctgctgctggggcgtttgtatttttttttagggggctggggttttgggggtttatgggttcgcggagcggtcgcggctcagggggcgcgcgggatttaggagaagttcgactcccgattctgattctgttgtgtttatgatatcgtttcactgcggaacgaacggttgatgaatgattggtttactatggctgggtagacatatggtttgggagatcgggttttcaatttttcggttctctctatggctcaagttgggacataagtgctatgttagatgctagatagcttgtccatgttctctctatggcttgacctgtttggaggcctgatattgtggaattgtgaaagttagcagtagatgttgtgcctgttttgttctgtcagatacttaaaatcagttgactgtgaacccatggccattgaactgtagacgtctagaatagattgtgctacagttaaatgctttatgagcactttgagatgcatgtggagctcattggagagtagttagctgcaaaagttttttcacattcaacttagaggttggaggcttcaaaatgtggtcagaaatgctttaggaaactcgtctgtctttgttcaattcctctggcaatttaaattagttctataatgtaatcgcagaactgtacaagctaaattgggtgctctaatgtccagaaactccacatattctcagacaaagctaataggtgcaaattctcggtttctctggaatgagaaaaattcttgcatgacttggttcatgattacctgatctgcacaacattgcattccagactcccttgtctaccagatattgtgcatcatggattcagcttcgtttcaggctttttatttgacttcataattactccattctattagttttagtatcaggattagtgatttaattgaactaagtgaaaattatcataatcaatgatgcaatctctaaaattgtactgctaacaaagtgttcctttccagaattattgtttgagtacctacaattccaatttcatatgttgattggacctgatacaatcagctggaatgtttagtgggttttgaatgttaggctcttagttcattgcattaactgagttcaggttaatgaggaagcatgtgataaagttctggagttggaacagaaatacaacgaggttcgcagaccagtttatgttcgacggaataaaattatcaagcaaattcctgacttctggctgacagcggtctgtaatatgtttctacaatgatttttatttcatgctctttcggattgaattgttgattgattaaaacctttcatctacttattaattatgctatctactgttcatcttgcagtttcttagccatcctatgcttggtgaactattaactgaagatgatcaaaaggtacctttcttttgtggactactaacattaactttgatatacttttaaatcaaaagtagtatgaggcgtactaaagcaaggaaatattgattttctcagtagtcctatgggaacaatcgacgcacaatgaacacaatgaaatatattactagaactacgtcatgagctttcttattttttattatagattttcaaacacttggagtctatcgacgtggatgactcagaagatatcaaatcaggctactccattactctcgtgagcttctttgcacttgcaagatattatttccttatttcttttaccgtgattacaattgcttgtcattgaactgtagacattctcccccaatccatattttgaagatacaaagcttacaaaaacatattcctttagtgacgatgaagcagtcaaagtaaaggctacctccatcaggtggaagaaaggaatggtatggtacccttttgatcgatctaagtgtttctgttgctatgcttgtgcaaagagaacctattaacctaataacatttttaacatttaaggatattgccaatgatcgtgcgtacacgaagaaaggggacaagcgaatcttaattgatgaaaggttgttatttctatctgtttcacaattttggtcttctcttttctacttggaagttggaagaaatagtagggaccttctataaagtaatcttagcatgctagctttattccttgtttcattcctggtaaacctgctggttatgttgcttgatataattcgataaccgactagcaactgccaaaggcacatgatagcattcttttcactattttgttagctatcatttatatgaactatctgttttttgggtgcggtggaggctttctgccatgtctatatccatttcttacttttatataatattgtgttctttgtttgtcacaactgggttcttggcagttaagttgttaacacgtcttcattttcctttgcagtttctttacttggttcaatagtgaaaagaacagaagttttgctcatggagctatggatgaggtataatcgtcccactggctcgtgctaaaccatgattgtttgaaactttgtttagttgtaaattattcgaagttctatcacaagagttttggaatatcctatgctctgtgaagatgttctctgagaactttatttgcacaggtggcagatgtcatcaaggaagatctgtggcctaatcctttgaagtacttcaacaatgttagtctttctaccgtaataagtggtttgttttatttctgttattcctaaatcctaatatcttgtcctatccgacatctcatttgcaggaatttgaagaagaattagagctactggatgacgatgacgaggtaatcctacctcacatttgtaaatatataaagcgtgatagcttatcagtgtgctcataatggttactcccagtacaacattgcatgtcatcctttcttatgctggtgatattttaacttttcagtaaggttattttagcaatatttttttgcgcttgactggtaggtgaattattactgttgaactttaaccattgtatatctgtatttatcctccactcgcaacatttttaggtatctgatgatgacgatgaggaggaggatgatgaagaccaaggtgaaggagaggaggatggagaggagaactgagctctctgtcatgtcagattcttttggcctggacaacttatgtctgcagaaagcggagaccgggcctcctggagggctgaaacagcagggcgtccccttttgcggcgttgtggtgctcgacttagctggcagtgtagggacttgctccgaaaaactttgttctatggagaaataactcgagttcaatagatgattttgttgcatgcgcgatcgaaatgttgcgtgttgtttggaagtgttatttaccttgccgttggattagtgtttataacgctattatatatagagaatgatcaaattaaattttgcagcctctcacgcgccgactgccagagttaattttccagaatacctgaatctgaatggcacacccttgcctttttgctctgttctgagtttccctgcgcggcgtatctggagcattcagtaggttccattccaagctgaacaatgttaccaggaatgccgtgaatcgggatgccgacggatgacgaatcctctccgaaaatactgtttcttctctttccaacaagatgtcatatgattatattatgttaaaagaaaaacatgtgtttcaaattattagaactcaaagtttcatatgtgatagtaatatgtttcaatgcaaatctttagcgtgtttcataaaactatctgccactcctctctctcgtctctcttcacctcatccatatatgcatgtatgtatttagtgaccttcaaaacttttttctcctaaactacttatctaatctacgatccgatcccactgttatattcgttgcaattaaatctttagaacaagttatcgtatgattatattctgataaaagaaaaacatatgtttcagtctgttaatacgtaatgtttcatacgtgataagtacatgtttttaacatgtgtctccactgtgtttcagtgattaaagttttttgtttcgtttcactagtgatcaactacaacatttaaccgaccgatatttttttaaaagaagatagggcgccccattcaaggaattcttcccaacgctacgtgagaatgtgagatgggcggttttgtccctaaattttttgctggaagcagttgaattcaggcggccgcgtgagatgggccgctcgcttcgccggcccgtccgggcctccgagcgtccccgctcgtcgcctcgtcccctgcctgcgccgcagtggagcaaccggcactaccgaaccgctcggcgtagcatccacgcagcgcaggggaaggaaagccgaagcgcggccgccgcgcgtgagatcgacgcgcggcgacttcgccaaccttccctataaagcgctgccccaatcgccaagcccaccgacctcctcctcctctccagtctccaccaccgacttcttcgtttgatctcgggctccggaggaccggaggatgtccggcgagagatgcgccgggcggccgctgttcggcggcgccatctccagtaccttccccgtccggttccaggtactccctcgcctcccccaccatcctccttgcgaggcggcggcttctcgttccttcacgctgtactgcgcttaccccccccccccc

SEQ ID NO: 27227 - DNA, 31626 bp, Oryza sativa
  unsure (1)..(31626): unsure at all n locations
ccccccccccccccccccccccccccccgttttcctttggttttttttttttggtcaggatgtgagcaacatcaggcaagtccccgaccatcaggttcgtgcacctctcgcttttgatcccttttgagtttggttttgtgttcggggggggggggggggggggtggcggagtttctgcgggtggctgatgcgtatactttgattgggttggggtttgctgcgcaggaggtgttcgttgacccggcccgcgacgagagcctcatcttcgagctgctcgacctcaagggcgaggtagaggacggcggcagcgcgctctggttcctgcgcgacatcgccaacgagcaggacgcgggggacaacttggtgaggataacctgttagtgcttcagcatactacttcgtcaaacattagagttaggagtcgatgtaacgtaatcaggagttcctgactgtttgtgttaagattcgagggctcatgcctttaaactgagttaaattcatgtttgttggctaggtagttgagcattctgggacgatcgagctaggtggtctgcgatttggagatgctcctgcagtggctggaactgcggttggtcagctggtaagattatttcctctttgtgttgtgctttgccaactccagattattctgcaccttgcgataaatcaatatccagcacattagattttcaccttctttttcaacaatacaaatatatgatggcacaatattgctggagttgtataggtttaggtgatcacacttcatacttgaacagctgcacattacagagaatggaaacagattttggtagcaattggcatgcctaagaaaaataacaatgatgtatggataaatactagggattactggacgttttgttggttgaactgtaggtgggctgaaccattctcatataattgatgacccctttaaatcatagtgttggaggtatatgtttctaggttctacatccttctctttccagataagtagtaatgcagatgtctaagtggaaaataaagtttgggagaaattaatgatcaagaatcctccataacataaatagatccatgaaacattatgatttgtgcaaaattatcgaactactgtgtatcatgatttcattaactctggtagttcagttcattgatgcacattgatacttgatagcttggatatgctgtataatcaacactggatggtgaattgaccaggaaagtgcaaaatcttgtgcttaattttcttcctttttgtaggctatctcaaaaggaaggcaaggcagagaagcacagaacattgttcgagtgagtgcatccattccttcattagtatgtacaacaggaaaattgtgaaatcttggttcttcaaactgagttcttggattacctattgcagctttacttggccaatatacgcctcaagaatgcagctactgatgtagttattactgcatatgagccactgttgataaagtaagcgcagtatatcactaattacgtatactttctgttagacaggtcatttctattagtttgtacttaagcagggtgaaaagctcatttggacttcccatcacagaaactaccattcagtgtcatctgttggtcatagcttggctaatatttgattatgcattctaagaactacggattgtctgtatcagtctttcctttttaaagtctggtcgcatcttgacatgtttgtggtgagtgttgataatcttgtttggtgaaacatgcttactgtttaggaacacacctgtgcttacaaaatgaaacagccctattgtgttcagcctgatgtttgaattttcttgtcatactgattgctagtgcactggtggatagttaaacaagacgaaactagatttgtagttaaattctgataaacagcattaggtggtaatgttagattgttagaggttattgaagactttattacagcttttctgcccttctatatcaaagtttacagcataatccttcagatattgtttttgtaaattgagaatttgatgttgtttctgttgctattcattcagccccttgagtgaaagcgccagtgcagttgcagccggtccagcagtaccagcagaacaagcaggatgcttagcaatgtctgagatcttcaagctcgccgtgatgaacttcaatgtccatgactggaatcttttcaatggcagcagttgaaacagggtggatagtttatcatagtaccactactgagcatcgcatgaacttttccttggtctagtatctgaacattattttagatcggcaacattcgttttgttaatgtagtgtcatcagcagacccctgttgaacttgagtatcatgttagcttcaggaatttactcatttggcccatgatagttaatagtaagcactaaatcagtaaagaagaattatgtgtatctatcaagttagctatgagttctggacttctagttagctagagttctggacttcttcatttttgagtccacaggttcgaaaagttcgttctgaaatcaattggatttccgaaggaaaatgtcgtcctccctacattgtatggactggaatatttgtcctacacagtaccatatattcttgatccttgctcattgcaacaggcaccaaggatcaggatgacgaacatgtgaactatgagttaccaaatgaacacgccccacgttgaccaggtcatgatccatttggattggggcaatttgtttcaaccattcatcgcgcatttgacgcatcgtctcgatcgtggtaagatcctctggtcaccgttaaattttgtatctaaaggcggtctcgctcctaattcattacgtatttaatttccctgtgagttttacctttaaaagtcatttacatttcctcatgttataagttaattaagattcacgcatcacagaaaaactaacaaaaatggtcccaagcaacatgctgaaattctataccagaacctggcaaccggtgtccggtagtatatacggtattacacatgaacattacacagcattgcgatttccaattgccggaagtcgataataatccgtgccggacagtgaaaagtcagatgaggtggggaagaaaagcaaagaaagaaacaagaaactgtgttgggcgctcgaaacttcgaaattctcattacaaaggatcgagaggaagaaggaagaagtctggggaaaatttttggagcgaggtggagttacaaaggcagcagcagcagcagcttctacgttctcacttccactggttggcgacgatgtcggcgaggtcgacgaccctctgcgagtatccccactcgttgtcgtaccaggcgatgaccttcaccatgtcgtcgcccatgaccatgctgagcgacgcgtcgatggtgcacgacacgtcggagcacctgaagtcgacggacacgagcggcacgtcgcagacctcgaggatgcccttgagctcgttggcggcgctgtcgcggaacgcctggttcacctcctcggcgagggtcttcttggacacctgcaccacgaggtcgaccacggacacgttcggcgtcggcacccggagcgcgatcccgttgagcttccccttgaggttcgggagcaccagcgccacggccttggccgcgccggtggacgtcggcacgatgttcagcgccgccgcacgcgcgcgccggaggtcacggtggctcgcgtcgagcagcctctggtcgccggtgtaggagtgggtggtggtcatcgtccccttgatgatgcctgcgccattgattggttaagcatcagagagagagagagagagtaaaattggtcgaggatcgctgatgcgcgcgtgtgcgcacgtaccgaacttctggtcgaggatcttcacgaagggggcgaggcagttggtggtgcaggaggcgttgctgatgatgggctcgtcggggctgtactggtcggcattgacgccgacgacgtaggtggggatgtcacccttgccgggggcggtgatgagcaccttcttggcgccggcctggatgtgcttgcccgcgccgtcgcggtcgacgaacacaccggtgccctcgatgacgaggtcgatgccgagctcgccccacggcaggttggacgggttgcggtcggagacgaccttgatcaccttgccgtcgacggagatggcgttgtcgcccacgggcttgacgtcggcgtcgaagatgccgagcgtggagtcgtacttgaggaggtgcgacgcctgcttcacgcctccggtgtcgttgatggcgatgacgtcgaggggcgagctgtcgccgcgcccgtgccagcaccgcaggaagttgcgcccgatgcggccgaacccgttgatcgccaccttcagcttcgcctccgtcggcgcccgccgcgccccgccgctcgtgccaacctgcgcccgccgcaacacaaacttcaacaccccgcgtcacgcacacgccgcctcgacgacgcaacaaaagttttccggtgcattgcttcacgcacgtaccgcgtgggtcctgaaggagaccgcgttcatgaagtcgtcggaggtggcattccgccgcagcggcagcgacgacgagctcctcaggccggagaactccgacaagccgcctccctgcacacataaccacacacacagacaccaaacacaatctttcagagcgattcttgcaaccaggagagacgagcagtaagcaactaaccaaacttacctggagtggcacggtggcggcggagagcatgggcgacgccatgtccgacgatcagatcaagaagaatgcagcagcagcaagctaggacggcgaggccgggaagtgtgtatatatgagtgtgggattgggcgcgccaggggtttgtggtgcgcggtgcagcgaggtgtcatcgtgaggcccggattgggcgagagatgagatttcggatagcccaacgtatggctcccagcgttctcgcacagccatcgcgtcacccacacaaacacatgtgtgtcacacacatctcaaagttcagctgctccatccattatgtgtccgccgttttttctttttcccctcggtgattcttgtcgcggtgaagaactgagcgttccagcctttcaggtagtacgtgatattgtacgcggtactgcatgggaggccctctctgcgacgcaggcggtgatggctacgcagctgatggatattcggcgttcgattctgtcattcttgaggaggtcgagctcgctttcggaggtaaaaatgccaaggttggctgctcgtggaccgagcggtacagctcttgcgaatgcgagattggcagattgcgtcggtaaacgatgggcgagggggaggggaagcgaggatttgcgagatgtggccatgcgggctcgcgcctgctgcaatgcatcttgcggtggccctcgcccccggtccatcatcagttcagtctcccggatcctcttgtttttctgaggcctggagtaagcttaacatccacgtcgctctccggtctcggccaacgtagcgctgttcttacgttccgggatgttcagaaattcagatttcgttgggcgcccacgttgccgctgccgttctttttctttcttttttccccctgttacacagaaaacacacgtgcactgtgcattgtgcacatacactatagttacacatttgcgggtagatctctaacacacgtttaagaaaaagaaagatagatgataaatcctctcaacattactaaattcctattaaaaacacacccgcacatgtggtgtgggatatgcgctagccatgcactgaactcatgactagcggttaaaaaaaaagccgatggtttcgaacggcttgaactcatagccatagtatattgagtcgagctaggtttttagctcattagcttaataagatataccgttagctacttgtgtagcttgctaggccatgaggtcaatatatatttttatacattttatacataagtacattagtccattaattgcttataaattatttggattcaatgagttatttatcatttggtgtttattcattatattaatatatgataaattggtaaatcaattcaaagatgcaaatgtgatattaatgagagaactcgttaacgagtcaagttgtgagtcgagccaagctgagttatgcttttagatcgttaaggttaccaaaccgagttaagataacaaacccaaacgcactaagctagctcaatatcctcccttcccacgactccaccatcgcatactgctccaccattctcttccggacgacttcaatgttcacgacttaaccatcacacgccctgctactgtcattctcttccggacagtttttaatcttcaattctataaaaatagtgaaataggacctacttggtaaaatttctatcttataaactgaactttaaaaacagatcgatatagtttgcgtctaaattgttcactttatgttttaattagcacaaaattgcaacggtttttattcattgtggcaattcacacgctgagtggtatagtgaagttaaaattttaactgtcattcacagttaaaatttaagttttaaaacttaattttagttccaggttgatttggggtttcttattcatagtctatctttcaaccttaacttttaaatcacaaactttgctggtttcttcatttatatttttttatagcctgtcactcgtggctgaaccaatcagagctatgattgtattaggtaccacggcaatacttgtgacaattgtatgttttcttggcaccttcctcacaacaatgatacaagaggaaatgtgacggttttgtcccttacttattgctagctaaagtttggctctgattttcctagccaaaccttatactaggacttcatgttagcttaaagagattattgtgggctcctccatctaaacgggctcttatctccttcctagcaatacaaagcccatctagatgacccacacaatccaaactgagacgagccggacataggtttgtccagggaaataagttcacttaggctcccttaactagtggtcgaatctaattcatatccctgaaccacgataccggatatctcgacccccaactattaaaaccagtgcaatttgactccctcagcggttttgaagggcagtttcgttgacgtggcgcctacgtggcggcattgaacagcggcgggtcgctgctgaccaaagaggggatcatcgacaccgccatggtcaccctcttcgccggccacgacacctcctccatctccggaggggtgagggccggagagatggtgtcgccgctccggctctcgcccgctcgctgccgaaggggagaggaagagaaacagagagggagggagaaggaaggatgagagaggggggatgacatgtcggccccacatgtcagtgagcctaaattttttgttgtgtgaatgacgaacgagtccacatatatgtttttcactagttaagcggctgaatctaattcgtatatctaaccacaataccagatttctcaaccatccaactattaaaaccggtataatttgacttcctcgatagtttggatgacagtttcagctgatgtgaaggtgttgacctggtcttcgttcaatatggtattgatatggtattagaatttaaaagtcatatgtgacctatttatcattaaaaaaattattatggggcccacaatcatcctctccttcccataaagctgaggttgagcggtggcaataagagatggagcggcgacgacggcatcaaagagctgggcggcggattcaagcggtgccgcgacgaggagagcaggagcggcagcagcgcgtctcgcggctggtggcggtgactgcaattgaggatgccggagacgagagcggcgacggtgggtgggcgggcgagagccctctcccttctccatcccccggcatagcctcggactgcagcagtgcttcagtaggcgacaacgcggaggtagaggagtagctcgacggcgcggatgatgctcacgagctcggcagcgccacctctctcctctcctttctagcccttgcccgcccgcccaccttcgtcgctccagccctcgcccgctgccgctgccactctcgtctccggcctcctcggccacggccatggccaccagccaagagacgcgctgccgctccagctctccccacaaatggcaaagggggagagaaagaaaggaaagaatggaaagggagggaggaggaagaagggaaggagaggatggttgtgggccccacgtgtaagtgggtctcacaatattttttttgtgaatgacaaatgagtctcatatgtatatatttaaaattcaaatgctatataaacgccacgtcaatgccacgctggatgaagatcggatcaatatcgtcatgtagacactacgtcagcgaaatcgttccctagaagcaccaagggagtgaaattgcattggttttaatagttagaaagacaatatatttagtattatggtttagaaatacgaatcagattcccgcggcgtttctcaccactcgtgggccgtggtgcgtccgaagaatgaacctgtgcgctgtacgagtgcgagagtttgcggagccgaagaaacacccagcgccccttttgatctaccccacaggccacagcagcagcagccaccctcctcgcaaaaatgaaagaccaaagaaagcggccactcgttcgaagttctcgtaagcattggttaactaatcacaagcttggtttccttatcaaaaaaccacaagcgtatggttcacccagtaaccatgcatgtatatcgagagcttcacggtcgcatgtgcccttggaattctttatccaaacttggcagcacggaatctttctggaactgcgccaacgaccaagctagtgccaaaacgttccgcacaaaattctgtcacacgctcacaccacctccagctccaaaccacacgcacatatgcccccgcgcctcctccgcccaaccgtgccgccgtgtgtgaaccgaacaggctcgcggcggcgcctttgcgtcccggcggccgcgcagcgcacagcgctccaggccagcgcacgccgaacacggggcggattcccccgcctcctgcctgcagctgcaggctgccgttcaggtggttcggttcggagctagcagcagcagctgctgctgctgctgctgcctgacgcctgccacggcacgcgcggctgccggccggagcggggcgcggtacacgggcagagtccatctgcgccgagcccatctgcgctccacgtgacggcgtgcagaactactcctaaaaaccggcacatgcgagggcctgcccttctagctttgggctgggtcggatgatcgtgttcgcgtcggacgcgacgcacctcggtcggtcgggccctaccgtggactacttggtcacatcactgactctcactgacccagtcgctccctccccagctcgtgccagccagccaccatcattcgaccatgcgagtgcgttgcatttgcacatatactatgctccaccctgatgtgcccaggacatggcccttcctgtcacacaccggcctgatcaccgggcacgggcagcctttcgttcgtgggtcactcacaggctcgactgttcaagcaggatcggccaggcccatgcatcccggagaaattttaaaaggaaccactggtggtctctctgcctacgtacaccggtacacgaccttttgttctgctgcggagtgagtgaccctacacagtggtacttggattcgtacgtgacaatagatgagtagaagtaactcgatcggtattcaatccgatatctcttcacgtagtgtaggatactggaagatgtggggcacatgaccggcccagggagtagttatgatatcgtacgttgtgtttaacgttactcgcaaaataatgatcgagcattcgagctgcccgttatggtgctggggcaatcagcctatgtacacggaccgttttataaaattgttgccttgtagtctgaataatccgtatctcccacctccacggttcgttctcatgcatgttgccattcagcggcatacggcggcattattcgttcgctggaaaatcattcgatcgagcggcatctcctccttggaggtcatgggcgacatgcatggtcctggtcgacaagctaggtagccagattatggtttgtgagggatggccatggtggaggcaggaggcagctcgatggtaccagtaagtgcctcttgataagcctttttttaaaaaaaaaataaaatcaggaaattataaacatattaaaaaaaatgtttgtacagtgaaagagaagatatctttccttctgttgggcttaaacgtgcttcatgacttttttttttcatttttgtcatttccacttcggtttggctaaaaaaaagttaacttaatttgtatttttcacataaggtttccactatagagcactagactttatgcactacttctatgattttttttttcaaatttgaaacaaaacaatttttaccaaaccataattatagtttacccaccccacggtaacaacatttaccgcggttgatgtggcgggaaccgttgctatactgtcaaccctatcatagagccattcgaaaggaatatcatatggtccaaaaaaaaaaagtacaagcctttgttccatagggccgtctaggaaaaattctatggaagcaaggagccctctcggacctctcgagttaaaggcaaaaggtaaacactagacatacaaaacgaaaacttccatctttgaagccatgccgaaatcctcaaaggcttctagaaggcttgaagatcactcgaggcagattgtaaaggcgcctcaaaggctcaaaggtgctagaagagactttcttatcaatggaggtttgccctggaccatgggatgatggaagaaaatgatgttgaatgtctcatatgcaaattgaagcacttcaaaacattccttgttggtatccaaggaccacagctagctagttggcgtcgtgattcgtgaaaatggcttgatccatgggccaaaccaaatggagatttaccacgatatcattaggttatacccccatgcaagggcaagcttgtacttcctctagtcataaatatttgaggaattaacttttgaaatgatgtttgacaattcatctcatcttattcaaaaatttacttcaaattgcaaaatgtaagtaaaggatagagtaacattagtaaaaacacaacttacaatagaataaagagtaatttcatattattatatgttattttttaataagatggatagtcaaaagttatatccaaaatcaattgcgagaaatatttatgaccaggtagagtaacttccctacatgcatcatttaggcttcgttcggattagcggttcgattgagatatttagcagcatgcgaaatgagacaagttattagcttataattaattgattattaattatacaaacttaaaaaatggattttataaaaaaaaacttctatgtatagtttgataaacgtgcttatagtctcacgtggaataaggaagttgccatttcgaatagctatttagagcgcattattaatcttaatatatcatattttatccattgtattagccctatacatataagcggacccgagaaatatttaataaacaaagataattttctcacactataagaggagttttagtcttcgaatactccttgtatcactactacgaaaaccatttttcgtggcggccattttagggtttttgctggcgaaatttagagccgccacaaagcaaaggccagtcaagatcttcgaccgctagcgaaaatgaatttttgctagcggtcgtcttaagccagccgccagcaaagatccatttttgctggctgttgtcttccaccaaccgccagcaaaaattcattttcgctgacggctgtgttaaatcgaccgccagcaaaaatcaaaaccatgcagctgccctagccgccagcgaagaggcggaaatttaaaaagcaaaaatatattttaaaaaaaacactgctccgtccacctccgtctgcgctccatccacacataaatttacatgtacaatttacagctaaaaatttccattctcccaagcattcaagcatcaaaaatatccacacatttaacaaaaaatttgaacaccaagcatcaatccaaatacaatgcttcacaaatatcatcacaaatattacaagcatcacaaatacagagaaccgctgtcgccggcgtcgtcgtccttgaagtcccctgcaccatcaccgttgccactaccgagccccgtcggcctcaaccgcctccgcctcgacgacgctgctgccgagccccggcgacctccaccgcctcgacgaccctgctgccgagccccggcgacctccaccgcctccgcctcgccaccaccgctgcaaagccacgcaacgctagatttgagagagggagagggggtggtggcggcgggggaagaggaggagtgaggagtgggggagagagacctgtggatccgccgccttgcgccttcccgtcgccggatccgccacctcgcacctccccatcgccggatccgccacctcgcgcctccccgtcgccggatccgccgcctcgcgcctccctgtcgccgagcgccgccgcccgggccgcctacgcctgacctcacgccgtcctctcctccgtcacccgtgcccgagcgccgccgcccacgcctgacctcaccacccgcgccccgagctcgccgccgcactctcctccgtcgcccgcacccgagcgctatcgcccacacccgagcacgccgcccgcgccccgagcccgccaccaccctctcctccgatcgcccgcggtgctgccgcctgtggatctgagggaggaggtgttggatctggagggactaggaaggaagagagggctggatatggagggaggagggaggagggaggaggagagaggataaggacgggtaggtggatgcgcggtgatttcttaatggcttgattttttatcctaagctctgcattatccgccagcgaaaattgtaacaacttcgccagcaaaaataggctattttgctggcggttttcttaacctaacaccagcgaaaataccaatttttgctggcgtcaagttaagagggccgccagcgaaaataacatatcttcgatggcggtcggcttaaggcgaccgctagcgaagatgtgtttccgctggcggcccgtgacccccgacccccgccattttctgcgctggcggttttttcacttagcctccatgaaaaatattttccaaatgccataaaaaatcgtttttctagtagggtattcctcatagaggagccttcgcttctctcgtatatagcccattctatccattgtatcatataggatacaaatccctataaaacactatatgttcctgttgtccaaaggaggattaacgcgagttcgagcactacaatgctatattttcctgttgtccaaaggaggattaatgtaagttcgagcactacaatatggaggcttaacgcaagttcgagcactacaaagataattttctcatgccataagaggagttttagtcttcgaatactccttgtattcctggagagaggagccttcgcttctctcgtatatatcccattttatccattgtatcatataggatacaaatccctacaaaacactatatattcttgttgtccaaaggaggattaacgcaagttcgagcactacaatgctatatgttcctgttgtccaaaggaggcctaacgcaagttcgagcactacaatatgacatgtgtttagaccatattgatgtaacatgaataagttaagctatggatattctaataactacaaattatttttaaaaaaaacacatggggatgtctctaatttattgtgttattgcacacctgacactgttagtggatccatccactggtggagaaaccatctttggtcagtctggcaaaatccacaatagtcccagatgcaaaaaaaaaaacggaactaaagattgtttttagtcccggttataaaaattttgatctttagtgatctttagtcccggttcatcccttgttagatgtatgtcagggggccgaggatctttagtcccggttgttagtaccacccgggactaaaattaaacacatagtatataatccctaacacttatcctctcctccacagttacaacttagacatatcgaatctcaccccctcttcttagatctatcctctctaactctcttctccaactcttccccttcctcctctcctcccccttctctccccttcctcctccccttcctggccagcctccccttcctatccggcgggccggccggcggtggggccacgcgcggcggcagccagcggcgggcggcggggcggcgcccggcggggtcgcgcgtggcagagggcggcggggcgacggccggcgaggccgcgcccggcggcgggcggcggcagtcggcggggccgcgccggcagccggcggccggcggggccgtgcccgtcgttcgtggcgaccggcagcgatagcgcattctttttttttaatttgtgatgattcaaattcactgagatgtatttgattgagatgttacaaatttgtgattcattgtttagatctgtgatgtatttgagtaatttcttaggatattgtgatgtatctgatttgtgtgtataagtaactttatttgtgatgtggattcagtgatgtgaatttgggatgttagttagatttggggattaattttgggatttgcctacttgattcgggagaaaataaaaaggaaaaaagaaaaagaaaaagggaccatctgtactgacgctattgtctctttagtcccggttggtaacatcaaccgagactaaagatccactctctttagttccggttggtggtaccaaccgggaataaagatatatctttagtcctagttatttcaaccgggattaaagatgtccatctttagtcccggatccttactttcggttggaaaaccgagattaaagggggttcccaaccgggagtaaagatggtttctccaccagtgatcctgaatcttgatcatagccaaaactatctaaggatgcatatgtttcatgatccgtacaaagacaaggccagtcactaagcaataaggacctgagatcaagtaaaaaagcaaacaaaaataatagtgccattagttccaaatggataaaacaaacatgatagaccatacgtacaagaaaacgtaaaatggtgcaccgtagagtactgaagccataggcgtcaagccgcaggaatctggtcgcgccatcaagaccggagcgtatgtgaatatgtgaccccactcttgacacatggcctgtcagcctctagccaaagccccgcgattagagcatctctaacggtatagctatctcactctttaaactaaaatttgataattttgaaaaaaaaacgagctccaacagactagctatcccactatcccactttccaagctatatggctggccaaataacctccctggccagccaaaacaggctctccaacggtgggattgtaggacccacgttctctctatctgtatcagcgatggtggacaacggcgacgacaacgacgcggctgccatccatgcgcgcatcctctcctatgcgaggcggcgttgcagccgccgacctccgctcgccgcgccccgcctactccgctcgcagcgacagccggcgccactccctcctacctccgcccccatcccaatgcccgacgagccgccttcaggctgctgccgcgccgacgccgccctctgcgccgcctccgccgcgcgccgccccaccgcgcagctcctcgccgccggcctccgctcgccgcgaccgccggccagccgccgtcctccgctcgccgcgacagccggcgccacaccctcctacctctgctcccatccccgacgccgacgagccgtcttcaggccgcggccgcggccgcgccggccggcgcccggctgggcacggttgtgctgacgccgccctctacgccgcctccaccgcacgctgcccaaccgcagctccccgccgccgtcgccccaaggccaccgccccgccgccatcacgccagaccaccgccccaccaccgcgcgccatgcctagctgcgccgccgcactcagccatcgacccgccgcgcgccacgccgcccggccccagcctccttccaccggcgccccggcctcctcctccccggtgcgccgccctgcaccaacccaccaccaccattcagacgcacaggagcagaggagaggaggaagaacaagaaaggaataaaattagttttggtggggaagaggggaagaaagaggattaagaagaagggagaggctgacatatgggtctcggtgtcatagagtcaaaatagagagggtagatgaagatactgttggagtgaacaattagtttgactagctaaatcggatgaagagttggctatataagtgtttgaagagtttgatctgaaaagactgttggagatgctcttaggctacacaaccggagagcgcgggacaaaagctacaagaacacaggctcgatcggcaatttgccgaaccggccggcaactcggcaaccatacggccagagtggaatccagtcacggagaactgttcgatctaacgtgaaacgagctgggccagcccttgaccgcagcctccctggcccgtgaccgcgcacgcgcgcgtgctcaccacaccacccgtcacccgccccgcactcgcccgtacgtgaaatttttcgcttgccaaagcgctatcgcgccaccggactcgccacgctacgcagcacgtacgcgcggtagcagagcagcagcatccgccgcccgcgtcgccgcgttgctcgtgtcgcgcttggggggcagcatgtgccgcggcctagagattcacgcttggcgtttgcggtttccgctcgtttcttgggcccgtgccgttctcgtcgtgcagctacggccacattgtttaaccggcgcggctgcttcagggagacagagaaaaaattgccccggcaaattgtggcctgtgagtgcgtgcgcctgcttccacgttctcgccatcctgttccccggaaatgacccaatcatttgcggcgcgcatcgggcatactgtactaatgccaatcttcaagacaagacttgcttggatgcagtacaaatacaaggcggccaaattggccttctattagtaattattgtagtataccgacagttccgttttggtataaacctagcacgtccaaggtgtaaaacgttagagccagctagtaaaactggccactggaagagacagagccagccaagcagaaggaagagcaaggaaaagatactactgtactacatgggggacactcgaattactaccaagatacgagccacagtttggcgtcatgtactcatttgtctgctagcttcgcttggccggagtggtccactgatttgcagcgtgtgcatgcaaggctgcggcgctgcgccatgaaaagtgctttcctctccccgcaagctggtccctaacctggacggattatctaccccgccatcgaaatagagaaggctaatcccgattgagttatatctatccccttcgtaagcaaacaaatcgaagataccctccactttgcaaagcatccccgtttccctgcgaggtgtctcctttgcacccattcacacacacgtatatatggactaatcatagtactatccctcccttatttattccaagggggacattgcagtagttggcaccttggcatcctcccggagcaaacatagaaccgtgcagttgtttttacctttgctagatgctatcactaccactctactaccgctcgatcagttaatagttcattcggttattactataccatctctacaggctacagcgttgttccaaactctttaataaggcggcagcagcagaagcaaacagtatggcgaggcgatcgccgttaactttggtccgcactacgctgcatatcactactgaaacgaaggcaacatatggatgcacgcatatgatccgcaacccggcgtcgctcctgcgaacttgcaggcttgcagcggcgcagatagcctgaccagctaagccagagacgcatctgccgccggccgtcgccgcgccgcccgcgcgccggcgagaggcgatcgactcacgctgacgatcactgcccttttggcgggtaccgcactatggaactgagcgggtgggccccacctgccgcaggccccaagggcatagtaggagtctcgtgatgccaaaatttcccgggcgcatcgcggccgtcggtgcgttctcctctgaccgatccggcggtcgcccttaattgcctccccggtgccagcgtttcgtgctcctaggattctttgaccgccacgatgaaacttttttttaataaaaaagagatttgaaaaagaaaagaaaaacaaagtgtgatccccacccaccgccacatcttgagaaattccggttttaatcttgttttgctccgctaatcccgtttccacatgctaattcctctcctccgtgcaaatgtctaatgacgtagagtagctgcttaggctgtatactttggatctgacgacatgtgggacgatcaagcagcagtttgaattactgccaagtttttcatcaagttggttttttcagtttctttgatctcgctcacatgctctacgcagaaagaccatgttttacctcggttattctatccaactccctgcatctgaatctggctgtgagcagtacatgtcgacgggttgactagaattttctatccacctcgagtttactgggagcataaaaatatggagatgcagtcgacttattgcttcgataaaaatatcgagtagtttatgcataatgccttgttatcttcaaacaagcttatcaatcatgttataatttgaaatgtgagtctgtgagttggaatataaagaccgaatatatgacgttatacagttatacaccaatttttgtcgccatgttccattttttttccaagctcaaatgatgtccaatagctcattgataaggttcggaattttcttcttgattgttatatagtacaagggcatcagtaggagtatttagtattttggcgggagagctagcatatcaatttagaacagcattaaccgaaactgtttctgtctcaggccgatgcacatgaataaaaatcctttgccgcactctcgaagctgttgcccacgcctgcgggtcccaccttctctgcgctcccaaggcgtggtccccagttcctgccaaggggtagcgggtaacttttcggtgggtgcggtctcagactggggctcttgtgttttttacctccagtaaataacatttctatttttttttgagaaaattgcatcctgggccacttttattgaccattgttacatgttggactagaggtagaacattcttttcagtttgaaccagaaatctttgcaaaaattttcatattgaactagtcttgttcttcctctagatctccccctcttctcttctcttccctcttttggttcaagctcaccacactttctcaggttccatctacgtgcttgacctacgtcagcgcctgagcttgagtgtgtggtagtctccgtcttaagctcaacacggcacacggcagagctccagcttaagctcaagcacatagccaatgaatcacggtggcacggtgggaaattctaacaccatatattatcactccacacttatactccaccaactagtcaataggtcacattctagcccaagtttatccatggcagcactagcttaattggagctagggcacttaatcaaggttgcatattaaatcttgagcacgaatgaatgtggcaggggcagcgaaggctgactggctgagtagagctcgagcatgactgtactggtgaagcttgagctctatctctactaaaaccaactagccaggtatgtgaatctcaaactgaaggtagagagagtgagaaagcagagctggaagaagaacactaggtcctaagtgtaacatattgtaaaaattactagcctaaagtgaaaataatagcttgttcctagtccaagctgcgaacatagtaaagaaagccagtccaatatgcaattaactattttttttttcaacccaagtccagtagtagtatactgcaatcgaaaggggagaaaagtaaaatcgatcgcaaaacccgtgtcacggtgtcatgtacattcacggaatacgctggcgtgtagtcgtacacgtaccattaccatacatggctgctagaccctacacacgtactgtacgtccagcggttgtactgtacgttgcgctcgtctcactcgcgcgtaacgtatacgatcaggagttctgacatgcgagccccaccgtccagtggcagccacaaatacaaaaaccttcgcagccctcccgtgcggcgtacggtcaccgaaaatcaccgcactgaaaactgcatcggacccctgcttagccgtgcggcccgtgcggcgtcaatggcgtggcgcacggcgtagcctaggctcacatccggtgacctgatcctctccgtctccaactcctatgcttccctctccccgagaaatgcagtttggttaagcacacccaaccaaaataatccgcagttgcgctgcttgcgttgcgcacactggaatagccgctctctcagtataagacgaggagggagcagccggagcgcgagagggagagaagcggcggcttgggagaggctgcgtttgggtgagctgagagatccaatgccaaggccgtgaggtgatcctgtggctcgggagagggggagaggaagagagagcgagagagagaggtgagcgtgcgtggcggcgatggcggatgagtcagggagctgcggcggcggcggcggtggcggagggggatgcgaggcggtgaagaagagggtggaccagagcgtggcgttccatgagctgttcgggttcgcggacccgctcgactggctgctcatggcggccgggagcgccggggcggtggtgcacggcgccgccatgccggtgttcttcctcctcttcggcgagctcatcaatggcttcggcaagaaccagcacagcctccgccggatgaccgacgaggtgtccaaggcacgtatcctgcgtcccatgtcccgctgcttgatagctctcgtctttcctcctgtgccattccgtgctctcgccattgacgcttaatcccgtggccttttgtttgctcgttccagtactcgctctacttcgtctacctgggcctcgtggtgtgcgcctcgtcttaccttggtgggtttcccctgctgctcgcgcgttcttgccggtgatgtcgttaatgtggccggcctcactcaccgcgtgtgtccttgtgtgcagagatcgcttgctggatgtacaccggggagcgccaggtgggcgcgctgcggcggcgatacctggaggccgtgctgcggcaggacgtggggttcttcgacaccgacgcgcgcaccggcgacgtcgtcttcagcgtctccacggacaccctccttgtccaggacgccatcggcgagaaggtgaccagcttcttaaactcgtcgctctcttgggctccggccacctcccgggcgtggccaatgacctgattgggacggttcgtcggtgcaggtcggcaacttcatccactacctatcgacgttcctggcgggtctcgtcgtcgggttcgtctccgcctggcggctcgcgctgctcagcatcgccgtcatcccgggcatcgccttcgccggcgggctgtacgcctacacgctcaccggcctcacgtccaagagccgggactcctacgccaacgccggaatcatagccgagcaggtagcatcactctcatcctactgtttctggatacccattttcattcagggaaaccaagatgcctcacaaggcgtggggaagaggagcagtgggctctagcggtctagccccgtagcccgtgccggtcaaagtgtagcacatgctatcaaaatgatgccattttgtattccttttagcttcttattagatccaatcaaccttttggataagatgatttcttgtttgatgtcgttttgcccttttcttgatgagtgattaacatggtacctcctcaagaacaggaaaaatagaggtttcttgatagataggtctcgttacccatgtacttttttcaatgtcaaccataaatgtaggataaaatgatatctttctcctttattgtgcaaatatgcgagtaattttgatgatcaagtgtgactgttgaacaggcgattgcccaagtcaggacagtgtattcctatgtgggggagtccaaggccctcaactcgtactcggaggcgattcagaacacattgaagctggggtacaaagcagggatggccaagggtcttggcattggctgcacttacggtatcgcctgcatgtcctgggcgctggtgttctggtacgcaggagtgttcatccggaatggccagaccgatggtggaaaggcattcaccgcgattttctctgcaattgtcggcggcctgtgagtactgaactttcattttctgtacaattctgtacctttaatgtttccgataaaaatatatgattgatatgtgtatgtggatctgatgatttcaggagtttgggacaatcgttctcgaatctaggcgctttcagtaaaggaaagattgccggatacaagctgttggaggtgataaggcagaggccgacaattgttcaggacccagcagatggaaggtgcctggatgaagtccatggcaacatagagtttaaggaagtggcctttagttatccgtcccgtccggatgtcatgatattccgtgacttttccctcttctttcctgccggtaaaactgcagctgttgttggaggtagtgggtctggaaagagtacagttgtggctctgattgaaagattttacgatcctaatcagggtaagcagatgaaatccacacggcacacctgatgttgattgttatcccaaccatttggttaattgctgattgctattttttgcaggtcaagttttgctggacaatgtggacatcaagacactacaattgaagtggctgagagatcagattggtttggtgaatcaagaacctgcactctttgctaccaccattcttgaaaatattctttacggcaagcctgatgccacaatggctgaggttgaggctgcggctacatctgccaatgcccatagcttcattgctcttcttcctaatggctataacactcaggtgggttctttgtctgttggtatgccaatgatatttgtactacttaaagaccgatattttggttagcagtacaattttcttctggtttggctaactattgcattactatattgatcttgcaactttgcatatacaaatttgctccatccaatgattaatccactatatttataacacaggtcggggagagaggacttcaactctctggcggtcagaagcaacgtattgccattgctcgtgcaatgctaaagaacccgaagatccttctcttagatgaggcgactagtgcacttgatgctggttcggagaatattgttcaagaagcccttgaccgcctgatggtcggtaggacaactgtcgtggtcgcgcataggctgtcaactatacggtgcgttgacatgattgctgtgatccagcaagggcaggttgttgagaccggtacccatgacgagctccttgcgaaaggaagctcaggagcttatgctgctctcattagattccaggagatggccagaaaccgtgacttccgtggcccatccacccgcaagtcccggtcatcccgcttgagcaattcgctgtccactcggtcattgagccttaggtcggggagcttgaggaacttgagctactcatacagcactggtgcagatggccgtattgaaatggtttccaatgccgacaatgaccggaagtacccagcacctaagggttattttttcaaactccttaagctaaatgcacccgagtggccctataccatactgggagccatcgggtccatcctatctggcttcatcggccctacatttgctattgtgatgagcaacatgattgaagtgttctatttccgggacccgaatgcaatggagaggaagactagggagtatgtgtttatctacattggaactgggttatatgcggttgtcgcgtacctcgttcaacattacttcttcagcatcatgggcgaaaatctgaccaccagggtgcggaggatgatgcttgctggtatgaatcgataggttgctcttaaactgttcaaatttcaccagttgcattgtttgatcagagactattttcagctatcttgaggaatgatgtggggtggtttgatcaagaggagaacaattcaagcctcgtggcggcacgcctttccacagacgcagccgatgtgaagtcggccatagcggaacggatatcagtcatcctgcagaacatgacctcacttctcgtgtccttcgttgtgggcttcatcatcgaatggcgggtggccgtcctcattcttgtcaccttccctctccttgtccttgccaactttgcccaggtaaaacaactctcaactcacaatattttcgttaacatggaggtgtcattctattatgtgccttttacgttctaacctggattagacaacgtgctaggaatctttggtggaataggagaattaccctttcacattaaaccgaatagtactttgcacgacgaactcactgagctcactgcaccgttgcgacgccgttttcggcgcagacaaccgtttgctgctcaattactccctccggagataggatgccagattaaatccatcagcattgctatggtaggatccgtggcccatgccactgccactgcttctgccgccgcagctgccataaattactgtgcgcggcatgtgcaaccctgccaagatgctccttggcctcctctctgcaaaggcaaagcggccgtgctaatcatagaactcggcgttaacaacggcaagtaaagctccaggacgtgcgctatttatcgcaacagatgcttgcttcctccgttcctctgatgcctaatggctttcgtgtttctgagactgggaggaagcaaagcaatagcatggccaactgccccaatctgtcgtctttctttcctgctgctcattagctgcccccagtggtagggttgtttttggtttcttgccgctcgtccccctggtggtcccgttgttcgcgacactgtctgcattgcacggccgccttgtgcacgggaatctggggcttcgcaatccgcagtgccgcacatggcgatcttgcagttgcagggcaggcaggcagtgtcgtgttgccgtggtcgcatggcgtggcgtacgttccgcgaggacagtgtcgccccagaatgccatgccaagccatatattttttgatcgtgttccagctgcattgcagagcccctcatgattccttgcgtgcaatgatgtccctctggcgattcgtaaaggattgcgtggtgcatgaacgaaccccattctctctgtcacttggccatgggctgcaagcctgcaaggtcttccgaaaactgtaactgccatcactggcgactttaactcgttgcaataggtcacgtgtatttacgctttgcactgtgaaatgatgggtacgtgaggtaggagtctgtctctctgtgcatgacgaacgagactggccgatactgtgatgactgatgactgcttgtgtggttgcagcaactgtccatgaagggcttcgccggcgacacggccaaggcgcacgccaagacgagcatgatcgccggggagggcgtcagcaacatccgcaccgtggctgcgttcaacgcgcaggacaaggtcctgtccctcttctgcaccgagctgcgcgtcccgcagatgcacagcctccgccggagccagatctccggcgcgctcttcggcctgtcgcagctgtcgctgtacgcctccgaggcgctcatcctctggtacggcgcgcacctcgtccgacaccacgtgtccaccttctccaaggtcatcaaggtcttcgtcgtgctcgtcatcacggcgaacaccgtcgccgagaccgtcagcctcgctccggagatcgtgcgtggcggcgagtccatccggtccgtctttgccatcctcaactacaggacgcgcattgacccggatgaaccggaaaccgagcccgtcgagtccgtccgtggcgacatcgacttccggcacgtcgacttcgcctacccgtcgcgccctgacgtcatggtcttcaaggatttcagcctcaggatccgagctgggcagagtcaggcgctcgttggagcgagcgggtcagggaagagcaccgtcatcgctctcatcgagcgtttctacgaccctctcgccgggaaggtcatgatcgacggcaaggacatccggcggctgaacgtgaggtcgctgcgtctcaagatcggcctggtgcagcaggagcccgtgctgttcgccaccagcatctttgagaacatcgcctacggcaaggacggcgcgacggaggaggaggtgatcgaggccgccaaggtggccaacatgcacggcttcgtcagcgcgctcccggagggctacaagacccccgtcggcgagcgcggggtgcagctctcgggcgggcagaagcagcggatcgccatcgcgcgcgccgtgctcaaggaccccgccgtgctcctcctcgacgaggcgacgagcgcgctggacgcggagtccgagtgcgtgctgcaggaggcgctcgagcggatcatgaagggccggaccgcggtgctggtggcgcaccggctgtcgaccatccgcggcgtcgactcgatcgccgtggtgcaggacgggcgcgtcgtcgagcagggcagccacggcgagctcgtgtcgcggcccgacggcgcctactcgcggctgctgcagctgcagctacaccacggctgatcgtatcagttcagggcctaggttccgggtgtacagaagtgggcgaggccagtaatcgtcatggtgctgtgcgggtggtcagatgatgtgcttgggtacaactgttttcttcttcctgtaaccgatcaggattatgccggatgtgttttggcactaatggcggctctggcaattttagatgttcacaagaatcccggtttttttcccatgtttgatttcctcgccactacaaactgacgagaattggcaacaacgctttgcgtcgatccgtccacggatcagagacgaactacactagatgaagctaaaacatgaaatcaagaaggataagcttcacctccaaatacggggcagttgaggaggagcggcaccgaggcctcgcgccctcgccgatgattgggaccctgtcagatctgcggccaccggtcgccggctcgccgccgccatctctctctgatctccaattgagcaaggcaagttcaaggcttcgagaggctgtgggcccgcggccgaggatgaggacgtgaggtgatacctgggccttcatagatagtacagcccatatgatgtggcctgcacctgtaattccatgactagacaatcctgggcaaaatcttttaaaaagggaataagtccacattgactcccttaaaagtgacccgaatctaatacatgaccctcaaccgcaaaactgaataggacgactcaccgaactattgaaaccaatgcaatttaactccctatgaagggtcgttttgaccaatatatacacacttgacacccgcccagagaccactccttcacaagaacattggattttcacaagggtgttgtaccaagatcttgggacgtcaatttatattcctatttagttgatttccatcgttgcattgccctggtataaatgatgcatattatatcctagttgattgtagtgtatcatatataaatacacaacgcacccagcataacataattattggtgattagtactccctccattccaaaatataaggcacaaccaccttagacccaaagaccaagaaataattattatcacctctttgtttgaataatcccaactaatactatacatgcacccaatagaattaagcatcttgatttaaaaattaataatctaggtgagagaatttgctattaattgtcatgcatacatgcacgctttatattatgaaacacctttaaaaagtagttgcgccctatattttgaaacggagggagtaaatgcattgtatatttataagtaataattttacatattatttattaatggcatttaacttccttaaattggccttattgttttgatgtttcctttatactattttccattgtcttcccaccttcctgtttaccaataaataattcttgtatgttgatttactaaaaaagctataggaagttgtgaattttaaattatgaatcatatatgctatatgctcaaaatgattatctaaagagaccgcacttatttactatgaatattcacatttgacaactcacatactttttaaagaaatccatccaaatgattaagtagcttaacaaaatagaggattagaaggggaacgattttcactattacgtgagaagagaacggaagaggagagaagagtttggatctgagagaattgaggaaaaatgaacctatcttgctttgcccatctgaaaattcaggacttgaggacaactacggtgggcaccagcactggtgcggcgacacgatggaggaaggcgcgagctgctggtggagttggcggtggattagagcagcagtggtggtagatgacaacgatggcattggtggcgacggcggatttgggcaagcgatagcaccggtggtggaagtggatgacgatggctgatggatttgggcgagaaatagatagcgatggtgctgatggtgaatctaaccgagcgatggagatatcgttagctggggattaattgacgtgcatgtttaggagtagtgaccttctccttttttactgccctatgtttggatgggatactaaatggtcacctttcttgagtatacaaaagttacctcttcatcttctctaaggtaacctctttacttttttagagaattcaggggccagctaatatacttgattttcttccctcgtagagcattcacgggatatagtacactgtatctccttggacacgtggcagtttttggagagggctttgcctaatttctaggacgccacgcgacccaacaggatgcaagatcttagtccctgaattaggtctttaagatttccttgttagaaaagagcctgacaatggtcaattgcaaaacaaagataacaatgcattgaccaggccaaagaccagaaatagacactgctcttctgtacgtcaaatgataaccacagaacacgatagaccacaacaacggtcaaaccatccacgcccgtacgtgcgtagccaaactgcatgcacggccattctcgagtcgaccaccctataaattgagcgtccctgcggttccactccaaccttgcgggccaagatggcgcagaagtttctcctcgggggcgtgggcgcgatcctcgtcgtcgcggtcgtcgtcggcgtggtcgccaccgtcacccgctccggcaacaaggccggggacaacttcaccgtcccgggggaggccaacctcgccacctccggcaagtccgtcgagtccctgtgcgcgcccacgctgtacaaggagtcgtgcgagaagacgctcaccacggccaccagtggcaccgagaaccccaaggaggtgttctctaccgtcgccaagtcggcgctcgagtcgatcaagtcggcggtggagaagtcgaaggcgatcggcgaagccaagacgagcgacagcatgacggagagcgcgcgcgaggactgcaaggccctcctggaggactccgtggacgacctcaggggcatggtcgagatggccggcggcgacgtcaaggtgctgttcagccgctccgacgacctcgagcactggctcaccggcgtcatgacattcatggacacctgcgccgacgggttcgccgacgagaagctcaaggccgacatgcacagtgtgctgcgcaacgccagcgagctcagcagcaacgcgctcgccatcaccaacaccctcggcgccatcttcaagaagctcgacctcgacatgttcaagggtgagaatcccattcaccggagcctcatcgcggagcaggaaacggtgggcggcttcccgtcgtggatgaaggcgcccgacaggaagctgctcgcctccggcgaccgcaaccggccgcagcccaacgcggtggtggcccaggacggcagcggccagttcaagaccatccaggaggccgtgaacagcatgcccaagggccaccagggccggtacgtcatctacgtgaaggccggcctgtacgacgagatcgtcatggtccccaaggacaaggtgaacatcttcatgtacggcgacgggcccaagcgcagccgcgtcaccggccgcaagagcttcgccgacggcatcaccaccatgaagaccgccaccttctccgtcgaggcggccgggttcatctgcaagaacatggggttccacaacaccgccggcgcggagcggcaccaggcggtggcgctgcgcatcaacggcgacctcggggccttctacaactgccggttcgacgcgttccaggacaccctgtacgtgcacgcccggcgccagttcttccgcaactgcgtcatctccggcaccatcgacttcatcttcggcaactccgccgccgtcttccagaactgcctcatcatcacccgccgccccatggacaaccagcagaactcggtgacggcgcacggccgcaccgaccccaacatgaagtccggcctcgtcatccagaactgccgcctcgtgcccgaccagaagctcttcccggacaggttcaagatcccctcctacctcggccgcccatggaaggagtactcccgcctcgtcatcatggagagcaccatcgccgacttcatcaagccggagggctacatgccatggaacggcgaattcgcgctcaacacgctctactacgccgagttcaacaaccgcggccccggcgccggcaccagcaagcgcgtcaactggaaggggttccgcgtcatcggccagaaggaggccgagcagttcaccgccgggccgttcgtcgacggcgggacctggctcaagttcaccggcacgccgcacttcctcggcttcaaggtctaaagaccctagccccctacatggcgtgaagggtgggatcgatgcatggacgtgtgcatgggagatttgcacgagaggatccgaggtgacattcatgcatgcgtacgttcgtgtgtgtaccaaatatgtgtgatggctgagacgtgcaggacacctgatcagggtgggcgtgctgcatgcgctggggggcagggctaacatttgtgcttttaactctttccggtttcttttttctcgaacagattttcttggagaatttcttctgtataagtatatgttgcaaaacgattgttgtacaatggcttggttggaaaagcgctgttcaaatgtcccgtttgttgctggcaatcttcacccatccgttcatcagaaacagtcaaaactcaaaannnnnnnnnnnnnnnnnnnnnnnnnnnnnnnnnnn

SEQ ID NO: 27228 - DNA, 552 bp, Oryza sativa
cagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcacatgaaacgtaagtccaaagtaccggacac

SEQ ID NO: 27229 - DNA, 710 bp, Oryza sativa
acacgtcggagcacctgaagtcgacggacacgagcggcacgtcgcagacctcgaggatgcccttgagctcgttggcggcgctgtcgcggaacgcctggttcacctcctcggcgagggtcttcttggacacctgcaccacgaggtcgaccacggacacgttcggcgtcggcacccggagcgcgatcccgttgagcttccccttgaggttcgggagcaccagcgccacggccttggccgcgccggtggacgtcggcacgatgttcagcgccgccgcacgcgcgcgccggaggtcacggtggctcgcgtcgagcagcctctggtcgccggtgtaggagtgggtggtggtcatcgtccccttgatgatgcctgcgccattgattggttaagcatcagagagagagagagagagtaaaattggtcgaggatcgctgatgcgcgcgtgtgcgcacgtaccgaacttctggtcgaggatcttcacgaagggggcgaggcagttggtggtgcaggaggcgttgctgatgatgggctcgtcggggctgtactggtcggcattgacgccgacgacgtaggtggggatgtcacccttgccgggggcggtgatgagcaccttcttggcgccggcctggatgtgcttgcccgcgctgtcgcggtcgacgcaacacaccggtgccctcgatgacgaggtctatgccgagctcgcccccggcagg

SEQ ID NO: 27230 - DNA, 215 bp, Oryza sativa
aattttactctctctctctctctctgatgcttaaccaatcaatggcgcaggcatcatcaaggggacgatgaccaccacccactcctacaccggcgaccagaggctgctcgacgcgagccaccgtgacctccggcgcgcgcgtgcggcggcgctgaacatcgtgccgacgtccaccggcgcggccaaggccgtggcgctggtgctcccgaacctca

SEQ ID NO: 27231 - DNA, 1052 bp, Oryza sativa
tttaggtgccctaaaatccttcgatcacgagcaaataaaaaggtcaaattaactagcgagcacaacagtacacaacatgcagatcggaatgaacccattgcaaacgcagtaccaggtaacaaatcaacttcacctctccggaaagacttctctctttatgggaagtaaggcagcgttcgagagggtgagagagtgagtttgtttgtttcgttttccgcgcgcacatttcccaaactactgtgtttttttacaaaaattttctatagaaaagttgctttaaaaaatcatattaatccatttttgaaatttaaaatagttaatactcaattaatcatgagctaatagctcacctcattttgcgtatcttcctaatctcctcaatccccttctcctcaaacacaccctaaacacaccctaagacatgtactaataatgagtgtgactgattagtcgcacgtgcaacaagaaatataattattatatgattaattaataaaaatgaaaaataaatttatttgattttttaaaccaacttctacataaaattttttatactaaattaacaattggagaaacatgctaatagaaatcgaaatcgaagaagtaaccaatccgttcactttagaacagagtaacagactccctaaggaaaggagatcaagaattcaacagagatgggccgacccaaaaatatagggtatgttcactttaatatcatttttaaccttaccaaatttgagtattaccaattttagcatagttaccaaaattttggcaggatttcttatatagttatcaaaatttgacagcaaactaaatgtaaccacttttttgacaattttactaaaatttggtaaggttgaaaatggcatcaaagtgaacatgcccatattagcctacaaaatttcaggtactgtgtcctagtggattccagatccgacaaagaaacaaaagctcatattcgtgcacaaatcttgaagagaaatggacggccacaaaattcaactaaaatttgtcagttcccagtcacctgaacactagcaaataccaaa

SEQ ID NO: 27232 - DNA, 595 bp, Oryza sativa
  unsure (1)..(595): unsure at all n locations
atggctatacaaaatgattgctggctgcagaaggtcatccagcaataaatatggccaacttttagaagagcattccagcactagcaggtcagtaaataatgcatgtacacaaagtacacaaggcatccctgccaaaaagttctaagatgacctcattttcttttgctttcgatttgggcttgatgattccttgaaagctgaagggcagatgttgtttatgccgcacatgtcacatttgggcctaagtggagtacagattgtttgcccaaatccaacctgcatgattttaaaaacaataatttcaatttacataagacttacatttctgcagtttaggtaggattcagatatgtagtgttaaaagcaaatgacactatcttatgtagttatttacatggtagaaattgaacatcagcggtggaaaaaagaaccgattcataccagtaatgggttgataggttcccactcatcctttggtagccacttctcaagagacattcttgtttgctcgggtgttgtagttttctgagcaaagtaaacaaggggcaatttgtcannnnnnnnnnnnnnnnnnnnnnnnnnnnnnnnnnnnnnn

SEQ ID NO: 27233 - DNA, 695 bp, Oryza sativa
ataagaataagtaataactgctattagcaacaccaaacacggcgataagcaagaaaacaaagtgaagtgcaggatgaaaaactcacgaatttctcgggacccctcgaaaccaccgtgccctcctccgctaaatcgggggcacacacagcccctcgaaaccgtggcgctggcgcggatcaacgccgcttctcggagcgagcgatggggccgattcgatccaaaagaaaaagaaaaaaagaaaaaaaaacagaatccagagagatacctgtatacaccggccgccggcggctgtacggctagctgcaggtggccggggctccgtcgcgcgcccaacaccggccggctgccgccggagcccaagaactcgatcggcgccgcggttgctggggaattggatggacaccggaagtggctgacgagtgacatgagtgagcgagcgagatggagtataaaactagagagcactagagcaggggacgccggacttcacgacttcaggggacaaagtcttcgtttttaattcagtaataattgcgtcccataatgattgcacattcaaaatttggtccaaaaaaatcatatatactcgccctaaatataagcattttaagcatagtgacaagtcaaacattttaaaccttaagtattaatagcaaaaatataaaaaagataaatcatgtaaaattgatatttct

SEQ ID NO: 27234 - DNA, 959 bp, Oryza sativa
  unsure (1)..(959): unsure at all n locations
nnnnnnnnnnnnnnnnnnnnnnnnnnnnnnnnnnnnnnnaactggtctagctaccttcaacttcagcacatctgtttccttggtctgtccaacatgagtgcaaaatttaggaaacaacttgccaaacccaggattatacgtaatagagaaaattcaaacttactcttgaaggatttaagcagcaagaaacacaatattcataagaatcacagcactgtaaatcgagtttgcaacccctggttggtgccatgaagattgttaaatttataactgtacccatttattgcggtgcagagctgaaagtgaagtgagcaacaaaagataagaaactcactgacaggaaaaacgtgaccctgttcttgggcaacaccgagaccatggatcgatagataaggaagaacatacataacctaaaaaggaagtaattatcagcgggggaagtctagaaggcaaatacactgcttaccaggcagtatatgtgagcaaaatgagatgggcagggtgtcctaccattatcatctgatatcaggtgccgcccttgcacagtgctcctgcacatgatgggtgctgcaagaccaatgtccttcctgcacaatattcaaaatcaagccgcatcattagatatactgaaataaatactccaacatccatcctatattcaggatggaaagaaagcatgaatggcgtaacagtttgggcacgctaataagcttgacacacatgggtcatgggttcaaaggccacatgatgccatatacaatgaactctgtcccaggctactcccagttccagaattcagttgaaagcacaattagataagacaacccgttaactcgtagtctcgtaccacagtatttaactgaacacctgcacttctataactctattctgcactttgtagaggtcatgtattagtcagcaagaaaatgtaggcacaaaattgcattttgtgcactggt

SEQ ID NO: 27235 - DNA, 881 bp, Oryza sativa
  unsure (1)..(881): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttcgtgtctctgaatgccacatcacaatgcccaaatgccacggttgcaccgattttattccgtttctcactgtccaaatgccgcatcacgatcgcgccatgattattttttttttagccctcctcaccagctaacttttattcagataaaagggaatgattttttacagggatgggttattgggggaactacaatacaacatcactggtgaaactgaaaacaaccaagagacaggctaactaaaacatgttcagaaacatcatcaagctaaaccggatttttattcagacagaagggatttgttttctgatttgagattgcagccacatcaacatcaaagataggagatatttcagagcacacaatcttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 27236 - DNA, 352 bp, Oryza sativa
attatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagagctattgaaatattgcaacctttattttgtgtgtatgctcaatcttttctactccatcagcgttgtgcatgtcatataattaatttgattggtaagactggcatgaagagggtaggtgaccacatcgatgctgttcgtcaagcaatcgcgtggttaac

SEQ ID NO: 27237 - DNA, 484 bp, Oryza sativa
cctccagcagggaaatgctcttttccaggccaatagctccaagcgcttccgcagcctaatgaatgaataaacatacaaagcttctcaaaattgaaagtaaatcactataagcagaagatggcattagtccgtcgtagcaattacctcgtgtcggacaattggatgaagtgaaagatctttgagaactgcctctaatgcagggatagcctcagcatcttgcatttgtcctagtgcaaatgcagcctcatgggcaagcaagtttgaagagtcccttgcagctgagcattgcagcaaacacatcaggtattcttaagcccgttcattaacaaaacattgacaggcaattggatctaacagctctatatgacagtagaaacataaacaatcattctcagttcaatgttaaacactgttttcagacttcaaggatgattcataaatcataagagagcataaattagcacagaattaactagtacaagaa

SEQ ID NO: 27238 - DNA, 642 bp, Oryza sativa
  unsure (1)..(642): unsure at all n locations
tgacgaggagttcttccaggagcaagtcggctacgatgagttttagggtttcggcctagttcccaagtcgcgcctgtgatgattggtccaagtcctggcttccgctttccttttgtaatgcagttgtgagctcgggatctgtccgcagcccaacatgactgtacttctactctataataaagagacctctgttgctgtgatactctgtctccctgtgataccagcactgtttcctgggactggtatcgattaacaggttaatttggagcgtcacgggctagttccggtcgggactagttcggggcgtgacagtcaccgacccaataaaattgcttgaagattatatcaagccaatgggagaagatttggcatatcgtactattcggcccacacaaggtatctctcaaccattagtgcagcaacacattaggtcatatgtcttggatgaattagacaaattactcaaagattctggatatagcctaggtcacttcaacttgccagagccagaacaccatgattacaatgttttgaacaacaggttggtagtggatgagcaaacttatgaccttgatgctactttagtagnnnnnnnnnnnnnnnnnnnnnnnnnnnnnnnnnnnnnnnnnnnnnnnnnnnnnn

SEQ ID NO: 27239 - DNA, 682 bp, Oryza sativa
  unsure (1)..(682): unsure at all n locations
tttgagggtgatttttttgtgtgtgtgtgtgtgttcttgatttttgtttttaatttggtttgttccagattcctgacggaataatgggtgagaccatcgccaaggatgtcaccgaggtgagcgagcgccaaaatggtttcttgttcttcatcgtggtggcatttttttggattggtattgggatgtgatttgagagagaaaaagaagaagattgaatcttttttgtgatgtgctgtagttgattgggaacacgctgttggtgtacctcaaccgggtgacggatgggtgcgtcgggcgcgtcgcggccaagctcgagtccatggagccatgctccagcgtcaaggataggtgaagctctactgaaatttatcatcttgtcatgttagggtggtggattatgtctgaaaaatcggttatttgtggttgtttccggaatggagatgtgatttttctctgtttagttctcagctgtttatgattagagctcttacttgcatcttggattttgagatgaaattttgatgtgtggttgtgttgggtttgtacaggattggatacagtatgatctctgatgcagagcagaaggggctgatcactccaggcaagataaggattttttttaatgatttcggtgttctnnnnnnnnnnnnnnnnnnnnnnnnnnnnnnnnnnnnnnnnnnnn

SEQ ID NO: 27240 - DNA, 305 bp, Oryza sativa
  unsure (1)..(305): unsure at all n locations
gatggagacgagccgaacgagccttcaatctacaccgatgccggatgtaagcgcatgcgtttgtttgctttcgagtgttaggtagttggtgagtttagtggtgtgagagtcttcagttctgtaataatgaaactcagttaagatcaataaaagttaagttagtagaaaaaataattctctgtcataagtagttttccccggtttctcttcttgtgctcatgcccatgccatatggtgctcacannnnnnnnnnnnnnnnnnnnnnnnnnnnnnnnnnnnnnnnnnnnnnnnnnnnnnnnnnnnnn

SEQ ID NO: 27241 - DNA, 197 bp, Oryza sativa
aattcctatgttcttgtttggatgggctcagtttggcccatataaactgatgggccgagattgaagcccatcaagcaaagcctgggtggggtaaggcgtgtgtgcatacttgtacaactgcgtggttgaacgtaacgctcccgacgacgtcttctgacgattcggggcctcatagcggcgtttttggtgaacgcgta

SEQ ID NO: 27242 - DNA, 746 bp, Oryza sativa
  unsure (1)..(746): unsure at all n locations
tttgccacagtcaccgcttagacttccacggcgacaatatctgcaacgtcgtggagctccctctcagccatgatcacatcttccttgcgtacggccacgacggtgtcgacctcgctcccgaccacatcaacaatagcgtcctggagcttgctctccatcaacccatggagctcgagctcggtcacggccaccgcttggacgtccacggcaacttgggtatcaggaaattctgtatcaccggcaaaggagtcctccacgacatgaacctcgtcgaaatcatacaaaatcacctcggcaccatggtgttcgcttagagagttcacttcctcgcaagtcatggcattggaaacgtattgctgtggttattaggatggagcgaagcggagaagagtttgtcttgtagaagaataggaaggagcaattgatctactcgatgatctgttgctgcgcacgcggagcaatggtgcaatgcattggccgggcaacggcgcgtagtactcccgagacacatgtgcagtgatggattaactccatgagcaaactgaaatggcgagcacggagtactattttaaatttgcattctcgaatacctttgaaatttcaatcgagatctacttccgtcctgcgttaaaacctcaaaatttcgtggttagctatatgcggtataactaatgaggaattnnnnnnnnnnnnnnnnnnnnnnnnnnnnnnnnnnnnnnnnnnnnnnnnnnnnnnnnnnnnnnnnn

SEQ ID NO: 27243 - DNA, 889 bp, Oryza sativa
  unsure (1)..(889): unsure at all n locations
nnnnnnnnnnnnnnnnnnnnnnnnnnnnnnnnnnnnnnatgtatgcctttgttagtataaccctttcacaagtgaagaactaattacattagtcctctgatactgtagtcctaatgctctttttaggtgaggatagttgtactctaactcttgtatattactgattttatttttgtggttgtatgctaagttatttatttgctcaagcatgcagtttgtttttttttttgacagaaacatgccgttcaattttgtatatgcggccggcaaccctgtgaaagaatatcatgaactgactgaaactgaaatagaacatggctgaatgctaaaacaaggattaccattacaaaatccctgaaatgttgattatgcattcatgaatcatgtagttggcatatgacctcgatcagtatcctatttttgtatgtagcatcttcgtagctttattgatctttacaaatatagcttcaatgatcttagctcgtacaaaagaacaacattttcatggtcatgtaaatctcttgtgattttagttgggtgaatagttccatatttcattaaatcaagaaatgaaacaagttaaagagtgaattgcttgcaacgatttcttaaccttgctacttttggttctgtagatgttctgatctaatgatgattacagttagcgtgtagctggacggtgtggtttcctgtgaaaatacaacagggactcggaccttgatttatacatgtatttgcttcataaaatttatacgcccacagacaaatattaaactttcatatggatgaaattatatacttcgaatcctactgaaacatcaatttttctagccgtcgtcgacggaactaannnnnnnnnnnnnnnnnnnnnnnnnnnnnnnnnnnnnnn

SEQ ID NO: 27244 - DNA, 485 bp, Oryza sativa
  unsure (1)..(485): unsure at all n locations
aaagtcaagcctgatgtcaaacccaaggctgcaaccaactttaagaacaaaggcaagggaaaggcaaagggagactgctttgtgtgtggcaagtctgggcattgggccaaggactgtcctgagcgcaaagacaggaagtctgccaacatggtcattagcgagggcggaggaacatcggggtacggtaaaatattacctacagttctctctgtttttcactcacctgattggtgggtggatactggtgctaatattcatgtatgtgctgacatttctctattttcttcttatcaggtcgggagaggttcctccttgttgatgggaaacgggtcgcttgcggctgttcatggtgttggtacggtcgatctgaagtttacttcggaaaagaccgtgcagctgaagaacgtgcagcatgtcccttcaataaannnnnnnnnnnnnnnnnnnnnnnnnnnnnnnnnnnnnnnnnnnnnnnnnnnnnnnnn

SEQ ID NO: 27245 - DNA, 1172 bp, Oryza sativa
  unsure (1)..(1172): unsure at all n locations
nnnnnnnnnnnnnnnnnnnnnnnnnnnnnnnnnnnnnnnnnnnnnnnnnnnnnnnnnnnnnnnncctactccactcacttaatttattccaattgtttcactaattgcaaaatttaactattttcttctatgatatatcgtgaagtgtcacaagcaacctagaggcactgtcctttgcgggtattacgcgtgcgaattcctcagtgttaatgggaggtacagagttaacacaaaggatgtaagtctctagactatggactagacagcttcacatatttatgatactaacatattgtttatcttccatgcatgcagttgccaagaatagaacttcgaacaagctttgacgatacaggcatcacaaatgttcagcgcgatctatgccacttcatccaccgtgagtgctgtcatatgcgaggagaattcttcgacccaaagggtgccctaactacaagtgacgaattcaagcaacttcgggagtggaacaatgctatgccataatgtaactagatggtgtatttgaagtgacaatgtaaaaaaatattgtaatatatatattttgataacacttttcacttatgcaatatatgtagttttctcagtactaaatgcttgataattactaataatcttcctgcatcaatttctattaaataactaaaaagtaatatttgggcaaattattattgtatcaaatttcaaaattttctacctatcttcgcaggcggatgtttttattttttgcaggcagccacttcctatttccgcaggtggacctgactagctttttatccacctgcgaaaattgtcttcacaggcggacggctgccccgcctgcgaagatcggtgatcttcatagtcgtttgcttacaggcaaatggctgccccgcctgcgaagaccggtttccatcaccgatgataatgctttttctagtagtgaagataagtattgttatcacggagtggttaggtggacttgcttgtcgtgataaacacacggggtatcatatcttgcatgatatatatatcctagcgagtggtcatcactgtacacaatgagaaaatactgcagcaacatttgaagaacctaacatatatagtctagaatatttcagtaggaaatggaggcactaggtagtaattcacatcagaatcaaatatatttcggcttg

SEQ ID NO: 27246 - DNA, 728 bp, Oryza sativa
  unsure (1)..(728): unsure at all n locations
cttgaattcgtcacttgtagttaaggcaccctctgggtcgaagaattctcttcgcatatgacagcactcacggtggatgaagtggcatagatcgcgctgaacatttgtgatgcctgtatcgtcaaagcttgttcgaagttctattcttggcaactgcatgcatggaagataaacaatatgttagtatcataaatatgtgaagctgtctagtccatagtctagagacttacatcctttgtgttaactctgtacctcccattaacactgaggaattcgcacgcgtaatacccgcaaaggacagtgcctctaggttgcttgtgacacttcacgatatatcatagaagaaaatagttaaattttgcaattagtgaaacaattggaataaattaagtgagtggagtattactggccaatatgtatgtgctagtagcttctcccttgttcgggtctgttctccacccttgaacttgtagtagttgtatgcactgtatggatgtcgtatcgttttgcattaaggaggatatttaattataatacattcatattaaaaaaatgcaagagtcagaataacttactactataagattgttagaaattctttgtatgactggtgactgaaatcgagagggtccaagactaccacggttccgtccttcgggtggatgattaaannnnnnnnnnnnnnnnnnnnnnnnnnnnnnnnnnnnnnnnnnnnnnnnnnnnnnnnn

SEQ ID NO: 27247 - DNA, 784 bp, Oryza sativa
  unsure (1)..(784): unsure at all n locations
cagcatttagaaaaaagttcgcttaacactttgtggtaagtcaatgtggaaaatgacgtggtgggtggtgttgcttgcatgacacacacaccaaagcatgtttcacccaagtttgcccaagcaatcactttctttagtcagcaagcccagaaaccacctcaagtgctatttgtacttcttctccaagctattctgctagttaaaaaatatttaactgaatccatcaccatgtcactgttctcgtcatcgtccacatggggaaaacacttacaatacaactccaggggggagggggggtttcaaatagttgttcatgcgttggggagtagaatatcaggttttgtacttcagggggttaagtagaggttttggctttttgccattatttataaatcatatggtcctaattatcatttgttccatgcttaattgaacgctagaaacatgtaatagtgaaacagaacttcaaaatgaagcaaatcggctacttacatcattatgaacagcaacatcttcaatcatcaggtaaaactttattgcatactcatattgtcctaaattttcgagagtgctagcaacctccttgatcacatcggtgttatcttttgaacgctccagatgcacattctgaagaaacacctgcacaagtaataccaattcaataactaagaaactcaaaactatacgttgaagtagtcttggatacagtatatacacaagcacaatctaatcttgcagagtacannnnnnnnnnnnnnnnnnnnnnnnnnnnnnnnnnnnnnnn

SEQ ID NO: 27248 - DNA, 736 bp, Oryza sativa
atccccgcaacagtgcttttcgattttggtgctacacattcatttttatctatgagttttgcgggaaatcatgggatggaagtagaagatcttagatgtcctttgatggttagtaccccaagtaatcaagcactctctttgcaacgtagcccctcggtcagaatagaaattcaaggagtaccatttctggccaatcttattctgttagaatccaaagaccttgatgtcatcctagggatggactggttagccagatataaaggtgtgatagactgtgccaacagaaaagtaactctcaccagcaatgatggtcgagttgtaactgttcatgcattgtcttctgagtttttaaggtcaagtctgaaccaaatagctttggaagagattcccatagtacaggaatacccggacgtgttcccggacgatttacctggtatgccgcctaaaagagatattgaattcagaatagatctggtaccaggaacaactccgatccattagagaccttatagaatggcagccaatgaattagcagaagtcaagaggcaagtagatgatttggttcagaaaggatacattagaccaagttcgtctccatgggggagctcagttatttttgtggaaaaagaaagatcatacccagaggatgtgtgtggactatcgtgcactaaatgatgtgactatcaagaataagtacccgctgcccaggggtaccgagctcgaattcgcctatagt

SEQ ID NO: 27249 - DNA, 22763 bp, Oryza sativa
  unsure (1)..(22763): unsure at all n locations
ttcggagtggtatttcgaattcttagttgatctggtgactaaagtacaggcattttcagctcaaaatttaagagggaactattggtgattaattgaaagttttttttttcatatgtttgtcagttctgcaatcccaccatttttttccactgcttgtttgaaacagctgttctctgttgctattaatgctccagtgcaccgcactaacactctgttcccactgatgataagaaatttgaatgcagaacatccaatttgcctgctttcttcgtgtttgggaaaacaccattggataccgatgcttgtggccgctcattgttggagtgctcgagagaaagtgataaacgcatcctggtatggtaaacctatttctaatgttctgaaaattatgcttcaattcatggaataagctataactctgatttgttattaccaaagtacagccaaattatggcattacgctttaatttttcctctacactataaaatcaaatcaaatgtaccaaaaaaaaaatctcctttgatttcaattatcgtgaaaaaaaaaagttaaaaatcatagggtagttcttcatacatcatcttcaattttcatggattcaaatatttagaagtgagtgcactatattggtagtcttaaaagcaacctcaattggatcatgaatgagaacttgtcgttttatcatttatgcagtggacacgaattcgatatagacctacagtagctcctgcttgtgtctcatgttgtctacctgtcagtatgttgtgtagacagtgatggttaattaattagctatatctactggatgttatcctatttccaagtaattggttagggttttatatttgtacttctcagtattgttttttttattgagcatttgactcatcgactgttactatttgcatatttgaccatgaaatagctaatgtaagatgtgtatggctagaaatttttatcttcattaatttacttttaatagtctatgatactcttgtcaaacaggttttttatggattagagtatgcacatgcattggatgatcttaaagcagtagttgcggaattatacaaatcacattctcgcagtgttgaagttcagtatgcagatgttctctgttcagttatgagcccaagctctgctgcagaagtggaacacggtcaatccgatggaagcactcatagtgatgatttatctatacaaagtgatgtagcgacatttgtgaataattgttgcaacgtggaaggatccacacgcaagtatagccttggaggactaacatggtctacatccatagatgataatatggaggactatttgttatattggataggacaagataactcagcatttgccaacattgtgcttaccttcaataaatgtgatataggttcgttatcttttcaatagccagtggggaaattatttgaatttgtgttagtcatgttttccttctattgtagtttgcctctagaatctattttggttttcgtaagataagtacgaaccattagttggacaatatgaagtactacatggcatacatcttgctttggaagttattgtattctcatttggctttaaatatctctatccttaacgtttagttatcatgtaacttccagtcaatgctttatattgtaaatgtagctattctaattcccttcttcatatgaatgatctgacaggaggtacaatccgtccagtgtcatgtcataacataattgctttaaagcagagacctttataatgaaatgcattctaatattaatgaacatttttaattttattatgcagttaggtatgatacagtagcaaatcaaccatcaagggatgtctctcatctgatgaaaatacttaggcgcaggtcatcttatgcagcatatataatactttatttttgcgtgaaatgaaagattttttttttgtcattgtagcattatttacaaaatagtttgtatatgcagatattaccttgtggagaaggcgaaggatgcaaatattgttggcattttggtggggaccctgggtgttggtatgtattcctttggcgtgttttattttttgatttgtttcccattgtaaagtacacataggaactgttgaccctattaaatctgtcaagttacgaattaacaaaccccattcaaaatttgccagcagttcagcactatgcaatgttgtattggagaaagaaagggggacactacaattgcagataacagtgcttgattaatatgtcactcagtcagaatagtcttttcctttactcaatccttgtgctgaggctaaattaacacccctaagaaaattaaatggagtatgttgctaatcacaagattattaatcgttatgctatgttaggttgttgagctagaaaatataggctgggcttgtctctaccttgtgaaattgaggtgttatttgaatggtgaaaaaaaaggttatttgtgggctctaaatttctactacatttgaagtttactttggtcaacctggtcgaagaccaaggttgattcaactggatttgaagtagttccacacatgacctatgtaggaaccatccaattacttcgatgttggttctacctgttttaagtaaattgtgctcacggtacaacaacttggtgagtgggtgcgatttagtgcaagaaataaaaaatatgtacaacaacttggtaatggggtgcacatttggtgcctaggaggtgccacacatgcaaactggctgtgtcagctggccagctcgtcaactaggtcacccattatgtgccttcaaccaagattcgaacagactagtagacaatcgctggcagcaaagcttccattgtcttcttcctactcttcataaagttgcacatccatctcatctcactgactgcatcaccccacctcacctttggtgatcaccttgccattgattcgagaagccagaatggcaaagaacttcaaccaaataataagatgttggtgattatgcagagaaacacattgttgaaggcctcagcgtgcccatcgtgcaccacatggcacctcctagaactataagatcaacaataagccaacttgttatagttgatcgtacaatttctaagttgtattcaatctcatctagccatcaagttgttgtactgtgaccgttatttactctgttttggtttgataccaaaaccaaccttaccaaattttggtaatgccaaattttggcactgccaatttttggtgacatagaagcgtgcggtagttgcttgggttgacaccttaacaaatgcaaggtgttaggtgtgatgttttagaattaccaaattttgatgtggtagaagtatttagagtctgtttggtttgtttccttattgtaatgactaaaaatggtgacagatcaaacatacccctattccttttattttcaactgaactgtctatttgttttgatttttatattataaatgctttcactgaacctcactgccactatagctttagcttgcacattattgtcttttaactttattacacactacatctaaatgatattatgtggtacatggcatcattttcatatgcagctggttatcttcacatcattgagcaaatgaaagatctgatcaaggctgctggaaagaaatcatatacgttagtcatgggccgacctaattccgcaaaacttgctaatttccctgaggtgctactgagttctaatatgttttctctgcttttcatgttaaggataactgactcaccattctttttttttttttggtatggcagtgtgaagtttttgtttatgtttcttgtgcccaaactgctctattggatagcaaagattttttagctccagtcattacgcctttcgaagctgtattagcttttagcaggtacacaccattattgcctccgatagtgctgttgacatacttgtgctgttcatttatcaatcatgactttatattaagttgtgtatggtggtctggcctcatgtggatgcaagttcgaagattttttcttacattcttattaagcagtatcacatttatcactttttcaggggaagggaatggacaggagagtatcttctagatttcaaggatttgatcactacagataaaccagaaatttcaagcacaactgaagaagcaagattttcctttatcaaaggtggctatgtggaagataattgccttgaaggtatagcatctactcttgggttttgaaatgatcatgtcaattaattatttgtcgacttccgagtacatataacatgacccgatattctgcattagtacccccgttctcatggctgatgcattcctttacctttttcttccctgttccgcaccatttggtcccacagataacgaggaacagccagagacatcgcttgcacttgctgaggtaacagagaaggcgctaagtataaaaaatcagaataatgatgcagttctttaccaaggaggagcaaagtctgcgatcgactatctcaaggcacgatcctaccgtggtctcaccggagaatacgagggtccagcaccagactcggtcttgacaggcagaacagggagagctgccggttacaacaacgagaaaaaggagattacacagtgaatgaatgacataccttgagtgggaaaatatatatatatatatatatatatatatatatatatatatatatatatatatatatatatatatatatatatatatatttgacttgtttgccctcgatgggcgattgatggagaggcaattttgtacttcagaaagtactgtcagatgcctcagttttgttgtgagccatgaactatgtgttcctttttttttttcttttatgatggaagggaaactccccagcctctgctcctactagggaactgtgtttcatcaaactgttatatgttcagaacgatgttgtacatctcctgccaacatactgtacagtattccatatttgcaaatctgcaatttggttcctctgtaccaaggtggctgtaaatactggcagaaacagccagcaagatcacattgttttgcaaagccggctagatgctccatatgctgattgtaagtttgtaatcatgctatgataatttagcaaagctcatgactgctggaaaaaagaacatgatcacaccacttattggaaatgaaatggtaattaggatcaaccagcaggagcacacctgtcacaaagaaagtaaccgatcgagatataaattaaatccacaaaaatggaaaaaaaaatgttgtctggttgatgtgtcaaggacaacaaatctggttgccatcagctgaaatcagcactaggaaagcaaacaataggactgcactgtacttcttcccttcccttgtatcatggtgatgtaatcgactgatttttaaaagagcttccatgttcttaaaaatgaaaaaaaaaactcagcttcaaggacctagattggcatgaatgcatgaaacacaaaccacacacttcatcattgcagaacccaatcaaatattcaaagcatatgtagtgtacattgtagcacatagtacatttacaaatcaaatgtgcacacacaagcactgcacttattacatgagaccacattatcactcgatatacagataggaaagccacacaagtccaaatccatgagcatagacacaaccattatgctcaaccatagtgccaaaacacacacagaggcagaatatatacaaatgcacaccacacatatatagcagacagaaacacacaattaagtagtagcaaaccaaacctcatgagcacccaaatgcaaaccgataatgggagggacacgatggtgattcccttcagctcgacgtccggtgccgacgcttgtccttggggatgaataggcagcatggcgcaccgtgtagtttgcttccgcgttcccttgtgttttctcatgaatttcccatttgtagtatgtataatgaattttatctttatgcttatcaatggcttctttcacctggttagggagagactcgccgttgaactcaagctccttcaatatctcggaaggttgcattatattgtcgatgccagagaaagacgagttcatcccggtgaaggtccacatgatcttttcgagcttagggacaagccccattgtggaactcgatctcagtgattttaaagcagtgcacaataagatcgcagagttttgggaactcatctttgttgaaggcaagatggctttcatcaaaagactcatccaagagctccaggcagcggatatttgatgtattcacgaggagccatgacgataaggcggcacaggaccagacgaggcccgcgaggagcaactaggctagctcagagcaagttcaaatagtatagccaactactagctccaattcatttatagctaatctaatagctcattcatacaatagttacatactacactattaatacctggtcccacctgtcatacacacactgtgtcttggagtccgtgctatagctggctacaaatctgtagcccgctgctcttttctctcctcatttatcttcttaaaatatgtttgcagctggcttatagcctgctattgtacctgctctaagtggtgagctcattgcctcatcgccgccaccgccgcccaactcccaagttccacggagcaggcggccaccagatctcaagctcgagcttgtcccttctttccacagctccacatggcagaagaacgactgtcctacttcccctacctcgccgcctcttagcctccgcgcagcggcctgtggtgggtgagaattggaactctctaggctatggaaagaaaggaggaagaaggagggagagggactgacgtgtgggtcccactgctaaaatggagagggtagatgaagaagctgttggaatgaaaaacaaaattaactctctattcggttggcaagctagctaaatgagtatttggagaggcaaatttggagactgatggagatgctcttaattagacttgggaccctaggtgccaggacttgtacctgcatggtatgaagtatcaagtaccaacgcctcctctcctcttcttccttcccctcgttttaacccatgttccctactgctactgctgtgaccagcgttgctgcctacaccgttgtaggctctggctcaagaagcgaggacgccgaatgcgtggagtgggggtaggatgactctaaacttacaggaaaaaaagcaaatacgtgggatgacgtcagcctccctaaagtggtatcccatcctctagcagccctgtatcctccattaataacaaataaaaagatattagtcactacaaacactcttcattacctagactcaaaactatcagtttccctgcatagttcagttacactgcttggccaccgcccccgacgtttcccctctcatgaaccctcgccgctgcccctcatcttcctcaactcggcaacgccagagctcgccaccgggtccccgcatggcagctagggcgacggcagcggggcttcgatgtcgggatctgacagggcattgcgtagatggggttttagtttaggtgaccgactggggtggtgccaaagggtggcggtgaggactagcagcgtcggcaaacttggtggtggcgtcggggaggcattgggcggagacggggctagtcctccatccttttctttgtcaacgttggcgagggctagcggtgtcggcggcggtagactttgaggtggcgataggtggtggcaatgttgggtgagatggggctagtcctccagccctccctttgtcaccggtggcgacggcggtgggagaggctcttggaagcgccattctagagatggcaattgccaagcgagcgtcagcaccaaggtttggctgcggataggtgtcgacgacggtggagcatctccaacaagctcatagcagtaagggcatgagcatatcgtgctggacggctccgcgatgctctaaaaacggaggggagttcgatagtttctgaaagatggtggtgatgtggtagatgggctttgcgacgcactagtggcattcagaatacggcgtcggcgtaaggtgttatggacagtgatggtggacaacgaacgaagcagttgatagtatgtggtggttgtgatccgtagaggtgaaaatggtacgacgacgagcggcacggactagttccgactctcccctgcccgacctcttatgctgtggcagaaagaataagtcgccgatggagtttgagagtttgaagctaaacttctatcttttctttttgtgtttgtacgtgcgctttcttgctactctgtgtaagtttggaagttgaaaaactcgtgtattattttggatgcgtatgctcttcgtggatatagatgcaagattaataaaaatcaatttattaaaaaatagagtcaaacttatatcagtggctccaccaccaatctcatggatatatatattgacatgcatgccgaggaagaagcacgcagtagctttcatatcaacagcctactgacatggccaacatgcatggcagcatcccaaggattgacttcgccggaataatcgacctagccgcgttgccgccgccggcagcgccgcctccccccggcgccgaccacctacggccacggtgggccgccgtgcgcgccgccgtcatggacgcgctccgcgcgcacggctgcttcgaggcggtcgtggacggcctcatctccccggagctccgcgccgccgtgctcggcccgggcggcgcggcggagtccgtgctgtcgctgccggcgagcgccaaggcgcgcggcaacgaccccggcgagggcaagccgtaccacggctacgtcggcggcatccccggcctgccctacgagagcgtggccatctccgacccgctctcccccaccgccgtccgcgccttcgccgcccgggtgtggccggccgccgccgccgcgttcccggaggaggcggtggtcgcgtacgcggggaggctggcggcggtggaggcggcggtgcggcggatggtgctggagagcgtgggcgcgacggcgtcgtcggcgggggccgtggaggcgcaggcggcggcgacggcgttcaagctccggctgtcggagtacgcggcgcccggcggtggggaagatgcgaggctggggctccccgcgcaccgggacacgagcttcctcgccgtggtgacgcagaacggcgtggacggcgtcgaggtggagtgcggccgcggcgacggcggctgggctcgcccaacgctctcgccgagctccttcctcgtcttctccggcgacacgctcaaggtatctgtgcatgtgcacgcatgtcacatctctctatctctttcttctttttttttaaaaaaaaaatggattaaaagaaacctggcgatcgatctagctacatccaaatgcatgttgctggaatagaaaatactaaatagtacacaaacttccttaactttcacatttcaaattaagtcaaagtctataccataatttaactagccgaatacaatgtgcgttacaacggttttagataaaatattgtcagttgtaaacttgaaaatattgtgaatatatatgtatcatggaataacaatgttattatacaatcaatttccaacaaaagattcccgccaccaactcaattaggtggtggtagctagttttgcataagactcctccctgctattaccgttggtcaattacattattttcgtgcggaacgtgacgaaacatagacataagatattaatcgaaaaccagttaatcgaaaaccagagtaccacaatatatagcaaaagtattgattttggaaaactaataagtgatgcgcgcattcacagttatatattcgaacctgagttttaaatcaacatttaacgatcagccttcttaaacagctaaatagcagggtaaatgggaaatagattttaattctttgagggaataggttcactcgttattgcatgtcctccaaatagtaaaaaaaattaaaaaaataaaaataaattaatacgtgatgcatgaccggtgatgaccggcagtctgaccagctctgcatggccggtctgaccatgcagacagggcggtctgaccggcattgcgtggccggtccgcccggtcccagagaggaagctgggggcacgttacaattgattaaaaggccggattaattgtgaatttggacatttgtgcccataagtcagaaatagattggagaatccctttgaatagaatatttgaaagatcctagtttcaggattgatcggaaaatttggcggcaagcgttcaaatacattttgcttgatagagaattatatcgccgaaaaatagatagagtacttttgaagtgcttagataatgatcaatctaagattgctatgggagaagtacacatgaagggatttgtggaactcatcaattggcccgcaagatggattggttgcttaggagagttggattctattggccgaaagtgattgatgattgtttcaagtactatagaggatgtgaagtttgtcaacggatcggcaatgttcaattagcgcttaccactgtgttgaatcctatcattaaaccatggccgttccgaggttgggctttgaatttcattggtcaaatttatcctttgtcatcaaaagggcatcggttcgtgctaattgcgatgaattagttcaccaagtgggccgaagccgtgctgttcatgaatattacttacacggatgtaattgactttatcttgaagcatattgtttatagatttggtatttcataaactttgatcaaggagcttcttttgtgtccaaagatgtgagaagttttactgaatcttatgatattaagttgttgagttcttctccttactatgctcaggctaatggataagccgagtctagtaataagatattgttgaaattagtcaagagggatattgaagaacactcaaagaactggcatgaggtgctttcagaggcattatgggttcataggatatctaaacatgatgctactaaagtcactccttttgagttggtttatgaaaaaaagccgttttgccagttgaggtaaaacttggctctcttcggtatttcaagcaagacgacttgttaattgaagatcacaagaccttgatgggaggcaattttgaagacgtcatcgacaagcatttgaggactttgaaagagatggaggcacttcaagacggtgtttacagagaacaatctatgggaaatacttgaagaaatactttcctagcgtttggcaagatgcttaggagatcccgtggccggtaattggattatcgccctaagacaacatgttctatgcttttagatttgcgatgttcataaaaaaggcaggggggcatgtgtttacacccaaatttagcacttatggacgaaataggggaaaattgccaaagtttggaaagtgccggctttctttcacagggccggtcataccgcaagtatgtgggcagtctgaccggctagtagggccggtctgaccgcaggtatgtgggtggtcggatcgtcagggtccgagtccgagtctatttccgtcgggtctcggatttccttgctcgagaaggctatgtttcgtgtttcctttgtttctatcccgagttggacgtagagaagggcctgtagagggcaagactaacccctatataagggacaaggccggttcattgtaatcccccgaataaaatctacttgaatagttcttttaccatgttttctattttaccctagtttagtccatctttgtcggtttgcgccgtaaaccgtccgccgctgctgcgagagtgcgacacctctttgtaggtttgtcctgaaaaccttccgttttgcccacgagatgggtagctatcctcatatcgatctaaatcggcctagaggctgattttgatatctaaatcggctccgctagctggtttagctatttttctataaaacccatcttgatttggccgtttggctagatcgaggtggttggcgactccatatcaccgcaaggcgtttaggtgttgcgatcgtacttgtcgacttgtcacaaaagttgccaacatggggttcgaccgaaccccctggttcgaccgaaccatgggctggcccaaaccagcccatcttcggctggcaacctactggacttcttctctttgtagatttgtgaattttgggccaattgatcgtgtcaattctgagttcttagcccattcatgcataagtccgattctcgacatcgtccgattgatttatcgtctgatttgatgtcgattctcctccacttaatgattattctctgtaaaaggttagtgatccaaatactagtggaatattattattctaacatgtatatgcattacaagtataactagttctcctctattgataatattgacggtcgaaactgatcgctaacgaccgtcaacggcggagcagaaacccagtgaagaggtgagcaaacaccggctaaaaaaccagtgacgctcaccacaccaccaggacgaggagcgtcggagccgacagccaccttgagcaccaaaagataagggacacactagtacaacgagaagacaagaaaataagactactacttacactactaaacaagaggagatggccgccctccccccacatgccccacttccatccttcgtcggcgtcagcggtaagccgccgaagaggaggaagaggggtcggagaaggcgagtctactgtagcggtgagtcacgagagctcgagagagagactggttgagtgtggacgagttccacgagcgtcgagtgtcaagttatccgttctcgtttttgattcttttccgattcctcctctctcctgtctcaccatctttgtctcctctccctcatctcctctcacatggcggcggcggtgacagctgcggaggacgaggagaggctgctgcggctggagtagtaggcggagcactgtggcaccagcggtggcggcttgtgagactatctctgcctcgccggcaagctccgcacacgctgctcgcaggccatccaccaccttggcctagccctcaaattacaacgtaaagctgttggtgtcaatcacaaaacgcacacgctcacgcaaatcacagagaaatcacctaggaactcagtaggaacacacagtcgaacacttggcgggcactctcgtcctacgagaacagagtagagagctagcagagcagagaaacgcagggactatatatttgcgctgctcaactgaattttctggtttttgtctccttttatcatagcaagaacatgaaatgatgtaaacgtgcacctggtagcggactactcctgccaaaatgtaaggattttagatggatggtctcacactgatactacgaatctaaacatatctatccaaatttatattatgcctgctcagatttctaatattagaatatgcctcgtccatttaaaatctcttatattttagatggagagagtaaaatacaagacataatcatatgcgtgctccgtatgatgcccaggttcaagatgctctcccaatgtggaaatagcacgtcttaacatgatgcgaaactgtaaaactgaaaaaaaaataaaggggaaatatgtagtagaaatatggaaactactattggatccaatatgggacgcctgagagtaaaatttttactcttgataaaaagaaatcttacacgttcatttatagattcaccggtaatttacaggttttgcactacatatgtagtttgcactatatatttccccaaaacaagaaactctgcaaaaaaaaaagagacaacttggtacaaaacactaaaagatcgtggtctttgttggacacccaaaaatgtgtatctattcatggaaaccgtaaaaacattatgttctatggacggccaatgtattttattatattatgttcaaatggagagggaaaatttcataaaagataagttgcccatggggcctcctcctcctcacctccgctgccgccaacagtgccaccgtcccttgcccccaccaccctccctactaacaaccactgccaccacctccttctcgccactgcagcgagcactgccataacccggcttgctgctcaacgcactccacctacagggctgcgccaccactatcgttggaccactcgtgccctctctatcaatactcctattgtgccctccaccattgccatgcgcgcgccggcgggggaggggggggggttccacccgtctagcttcgattgtggtgccacttcgctggtctacctcgacactattccagagaatttcttggaaaggaattcagattttttttctctcttcctcaacttgctcgtatattcctccttccatgccattgcatcactcggcactcatgcgcaaccacactctcttcctcaattcgttcatacaattttttctccgttataattagcgggtatattatattatttctaggtatatatagctaggacaatattcaatctcatgtacgggcagttttttaactagggctgaaagccccccatttccattactagaaatgaaacgacgagtacaaaagagttcggaaataaataacaaaagaaaagccaggctagcgcaacccccttactggagcagcaccctgacaggaaagactagcatttttctgcagggcaagctttacagagatcaacagatcagagacaacaaaatgagaaggggaaacctaactgactgccagagcaaaacaaagaactcagcatcactaaactcctaaacttttcattccaagcgtcttgtataaattctccatccaaatctggaactgaagacttcatttgccacttgtctcgccagcttggctcccaacattaagcttctttgtcttgcctccgatttctgcaagttagcccagttttcaatcaaatgacatgtaagatatatcagctcaattggatcattaggccatttttttttatcaaaacacactttgtttctggatttccaaatagcccataatacagctgccacccccaccatcacaagttgtttagaatgtttgtcaaaattggaaagcatatggtttttattcctagcaggtgttatattcagggcgcacaacttcacattccagatcaatctagcaacaggacattcaaaaaataaatgctgtatggactcctctttatcacaaaactggcacaatttatcaccctttctccagcctctcttgtagaggttatcttcagtaagaattttgttttttaaaaccaaccacataaaaatcttgattttcataggtattttgaacttccaattttttttatgggaatgccacttgctcccttttaagagctttataaaaggatttgacagtaaaatagccattcttttccaagttccaccacattctatcttttattccttcttgcagattcaaaagcctccacatctgtttaatcccattccagtctctaagtttgtctccatgcaaagtcctgaatttgatagtctcccagcctttctccttcagttttgcaagagtaatatgtctagtatgggtaatgttgtataaagcagggaatctcatttacgggcatatatgcattcagtttagtaatactaatattactgctatgcacgcaggcactgacaaacgggcaagtgtacaaccctctgcaccgggtggtggtgtccggcgacgaggcccgctactccgccatcctcttctccctcccggtggacggcgccgccgtccgcccgctcgacgaggcggtcgacggcgaccacccggccatgtacaggccattcgactacggcgagtacgccgtgttctgctacttgccggagaacatgacgccggaggtcatgaagcacgcccacaagctggaggccttcgccgccgtgcgcaccactactactgcatctgcatctgcatctgccccttaattagatggtgtagcagcattatattcgcacagagatttttaaaaagaaatgtttcatcgtcggatcaccgttgattatttgtttgttgatttttgtagtacgatatgtggtctccatttatgtatgttatagcttaaaatattgaacaaaaggtctaatgttcgtggttttatgtcttgctgaaaaatatatataccttctcacccagggtttcccttgccgccggtaatcgtggggtaccgtaggggttaccagtggtagtgtttggtgaattttatctaaatttaaaattccgaaaaaaacaaaaaagatcaaaaaaattcatggatgtagttcttgatttgtagtggcagatggtgaagaaatttttgaaaaaagagtaagataaatccaaatttgtgggcaaaaccaaaagtatggaagaaaatagaaaaaggaaataatgtaatgggccttaggttgcattgtttatccgtcacattaaggtccataagtggagaaaatatctccttggtcctctcatctttctctatccctctctctcatttcagcttcacgtggacatcataatgcttttaaaatgtgaggctgttgaattgttgttgttgaactattatgatatgaatgtatcataatattgaattgcttcgaagtctataatatagaaaaaggtcatgccgattttcttttattttacacctaaaagttaggtttgcaagtatcatactatatattcttcttattatctcgtttttttaatgaatcatttctcatgcattacgaagaacaatgaaaacaagaacatatgcatatgaaagtagaggaaaagataagtaaatggatggggatttattttaaagaaatatagtttccaggaaaactatcgagaagtttttggacaatgctgcaaaaaggtattccgttcggactgaatgatacattagttaccggatagcaagcgatatctaagaggtatcatcctgtctgaacaaagtatcagccgatatgtactactccctccgtcccagaatataagcatttttagagttggacacgtttattaagaaagtaggtagaaatgaatggtggagggttgtaattggttgagtagtggaggtaggtggaaaaggtgaatggtgaagagttgggattggttgggaagaaaatgttggtggagaagttgttatattttgggacaaatcttgagggctaaaagttattatattttgggacggagtgagtaggtatcaaacgaaatctctgagatatcatcctatccgaatgtaatactgtttggtagcatttgggttggaatcgccatccaaatttaggcttttttcttacataaactcatttaaaacatactactccctccattttaggttataatatgttttaactttgatcaaagtcaaactgctttaagtttgatcaagtttatataaaaataagtaatactttcgacccacaataaatttattataaaaataaatttaataaaactaatttggtaatgtaaatattactatatcaaatatataaacttaatcaagcttgaaacaatttaactttgaccaaagttaaaatatcttgtaacctgaaacggaactgagggagtaacaaaatttgccacgtaaaagtcagggatgatcacacgttctcacggtctcatcttttcgtttatacttatgtttatcagccaaaatttaaattttcaatcttaaatttaaagttgattttgaggtttttttcgtcgaggtttatcttttagatcgctaagaacacgtatataaaagttttattcacaaattattttgagtaaagtgcattggtggtccttaaacttgtaaggttgtgtcatataggttcttaaactctcaaaatgcatatccaagcctcataacttatcaaagtgtatcatctaggtcccaaattgacacatcctctctaggatcctacgtggcgctgatgtgacatcctctctaggatcctacgtggcgctgatgtgacatgctacctggacgtgacatgtcatttttttttctttttcgttttcgttttcttctcattattctttttttccattcttctgctcgggttacggagaaaggagaacaaagggaaaaaaaggaagaaaaaaagaaaaaggaaaaaaatttaaattggtctcatttgtcagtcaaaatgatgccatgtcatgtccgtgtggtataccacatcaacgccacgtaggatccggaagggattgtgatgatttgggacctaaatgacacactatgacaaattctgggacttgaatatatatttcgagagtttagggacctaaatgatatatccctacaagtttaagaaccgtcggtccactttactcttatttttatttttagtttgcaaatatgtactgtagtttaaacgatgaaacgctcagtgccacagcttactgctggtccggtcctcgcctgctgagtgctggctgctgcagctccaaggcaacaatggtgagtgggaggtccatcacctccggcgccgccgcgccgtgccacctgcgaccgacggaccggcacaccatggccgcgtgccgctcgcggcagcgaccacctctgccccccaaaacaagggcaaagggcccggcgcgccgctccggtaagctccatcgtcaaccgtctccgcgaggcacgcatcgtcatcccctctcctctcctcttctccgccgaggatctgctgtctcgggctcttttttttagggtttagggtacagtgctcgatcctgtaataattctgaaaaaaggcagtgcttttcgtgtctctgaatgccacatcacaatgcccaaatgccacggttgcaccgattttattccgtttctcactgtccaaatgccgcatcacgatcgcgccatgattattttttttttagccctcctcaccagctaacttttattcagataaaagggaatgattttttacagggatgggttattgggggaactacaatacaacatcactggtgaaactgaaaacaaccaagagacaggctaactaaaacatgttcagaaacatcatcaagctaaaccggatttttattcagacagaagggatttgttttctgatttgagattgcagccacatcaacatcaaagataggagatatttcagagcacacaatcttttcgttgaagactgggccacatgatgttggcaagagcaaccacactgttagttagggagaaagtgagcaattaatttaaatatataaattgcccctctgaatcttctagccgattttgtaaataaacgcacttctgtaaaaaaaaaaagatttctaacacctgggtgggtagattgaattgcaggcagaacaagtccaagtttgcaaatccaggagagaccaggattagtgaaaagccaaccaattgatgcttgtcttgacttgacctggcaataaggttaggtagccaaggagtccaatactggagggttgatcggtccgtgttctcttccacacaaatcttcttaatcatcttctttcctagctgttgatattgttcttcctgttgagaaattgacaggaattcatggcgggtgcactggtgagcgcctctacgggggtcatggagtctctccttggcaagctatccagtatgttggagaaagagtacgccaaaaaaaagcggtagagaagaatgtgctgtcctgcgaaacgagctgagcagcatgaacaccgtgatgcagaagtacgcgatgttgagtgagcccgacttgcaagtgaaggcttggatgaaagaggtaagggagctggcctacgacatcgaggacaccattgacgctttcatggctcggagtgaaaaatccaatgagcctacaggtatcagaggatttatcatcaacaatatcctgaaactgagagagctgctctcaagctgtactatttctcaagagattgaaaaactcaagaaccaagttctcgaggtgaacgatcgtagaaaaaggtataagcttgatgtatctgtgtccatgggtaccggctgtgaatcaattgaccctcgcctgccagcgttttattccgaggtaggtggacttgtcgggatcgatgggccgagggacaaaattatcaagttgctaagggagaatgcagctgatgaagattgtggatttgtgaatcgacttaagatggtgtctatcgcagggtttggaggtttggggaaaactactcttgccaaacaagtttatgagaaaatcaaatggcagtttgattgtgctgctttcgtgtttgtatctcaaatcccagatatgaagagggttcttttggatttgctttgtggacttggggcttctggtaatacatgggatgatgagaagcaactcattgacaagatcagagaatttcttcatgacaagaggtttgtgtttatatagagtaacttctactacctttctgttatttcgtatccagacttattgtatgaaacttggcccataggtatataattgtcattgatgatatctggagcatatcttcttgggagatcttgaagtgtgtattgcctgagaacaattctggcagtagaataattacaactacacgtattcttgacgtatccatgatatgttgctctactttcaatggaagtatttaccgcatcaaaccattaagtgacgacgactccagaaggttgttttgtagaagaattttccacggtgagcattcgtgtccatcacatctagaagagctttcaaaagcaattttaagaaaatgtggtggtttgccattggccatacttcatattgctagtttgttggcaaccaaatctaacacaaaggaagagtgggagttggtgctaaattcaattggctcagcacttgaaaatagccatactctacaaggtctgaaaaagatactgttactcagtttctatgatttaccaccacaattgaagacttgcttactatatctcagtatatatccagaagattgcatgatcaactccaaagagttgataaggaaatggatagctgaaggatttatcgcggaagacagtgggaagagattggaccaagtagcagagagttatcttaatgatcttatcaacagaagcatgatcttacctttcgacattactcatgctgatggtgtacaatattatcaagtccatgacgttgtccttaacattatcatatctatgtcgaaagaagagaattttgtcacgataatagatgggcataagtgcagttctttgcaggaaaagatccgtcgagtatccctccagttcaatgattcagaagatgttgtagtgccaacaaacataacaaacagaagttgtgtccgttcactcagtatatttgggattactaagcaagtgccatattttatggatcttcaatctttgcgagtgttggacttaggttattgtacattgttacagaatcagcacattgaatgtttaggaagtatgcttcaacttaggtatctggttctccattctcaattaatcactgaacttcctgatgaaattgggaacttgcaacatctagagatgttagatgtcacattatgttccatacaagctcttccagataccattgttcgattacagaaactcgtgtgtctatatgtgagtactaaagtgaaactaccagaaatgattggaactatgcaatgtttagaggagctgttccacatatcaagcaactctataagattggctggagatcttaaatgtctgaaaaaactgagagatcttgcaatagctgttgaagaccctgttgggacaaagagctctacattgagatacagggaagtagttcggtcatcccttactgaattgggcagacacaacctgcagtcactctcactgaattacaaaggtgatgagaatttcattctggattcgtcgatgggttcatgcttctcaactcagcgtctccggaaacttatcattgggaaaactctttccagggtgccagagtggatgagtatatttgacaatctcacacacttacaactgtgcatctcaaggatggaacagagtgatattaacatactcaaaggaattgactctctgatctttctccgcctcgtatttacagggcatgctcctgatggaaggatagtcatcgacaaccgaggatttcaagctctcaaggaattatatcttctatgtttcattcctgggatgtggccagtgttcgagccaggagctatgcaagaattacagaagtatcacctcactttcaagctacagaaagtacattgcaagaatagtgttttggactttggtctccagcatctttcaagcctccagcacataagtgcgataattattccatctggtgctaccagtgaggacacattggttgcagaggatgccatcaggagtgctacaagtatccatcccaaccaaccaatagctgaaatttttgtcgagtaaaaaaaatggtaaccggccagttataggttttctacgagtcaaaattctccccgaaacaagtagacctcattttcatgtgtctttgtgttatatgctcctctgttctggttgcatttgagaatgtatgcctttgttagtataaccctttcacaagtgaagaactaattacattagtcctctgatactgtagtcctaatgctctttttaggtgaggatagttgtactctaactcttgtatattactgattttatttttgtggttgtatgctaagttatttatttgctcaagcatgcagtttgtttttttttttgacagaaacatgccgttcaattttgtatatgcggccggcaaccctgtgaaagaatatcatgaactgactgaaactgaaatagaacatggctgaatnnnnnnnnnnnnnnnnnnnnnnnnnnnnnnnnnnnnnnn

SEQ ID NO: 27250 - DNA, 9012 bp, Oryza sativa
ttttttgacagaaacatgccgttcaattttgtatatgcggccggcaaccctgtgaaagaatatcatgaactgactgaaactgaaatagaacatggctgaatgctaaaacaaggattaccattacaaaatccctgaaatgttgattatgcattcatgaatcatgtagttggcatatgacctcgatcagtatcctatttttgtatgtagcatcttcgtagctttattgatctttacaaatatagcttcaatgatcttagctcgtacaaaagaacaacattttcatggtcatgtaaatctcttgtgattttagttgggtgaatagttccatatttcattaaatcaagaaatgaaacaagttaaagagtgaattgcttgcaacgatttcttaaccttgctacttttggttctgtagatgttctgatctaatgatgattacagttagcgtgtagctggacggtgtggtttcctgtgaaaatacaacagggactcggaccttgatttatacatgtatttgcttcataaaatttatacgcccacagacaaatattaaactttcatatggatgaaattatatacttcgaatcctactgaaacatcaatttttctagccgtcgtcgacggaactaagttgctgaacgtcagagaggttatttaagttagttagtccgatgtatgaagttatatatttttaaaaggcaattgttctttgtccggtttgagaagttcaaaaaaaaaatgacttcactaggaattcaaagaaagagaggtgcagtttaacctttaggtgtattttaaatctataacttggtttagctttttggcagcacgcaaaacggcatatgagtattaatcattacaaattctaacaattgatttatttgatttttttaaaagaaacttctatataatttttttcaagaaaacacactatctaaccatttaaaaaacatgctaacgaaaaaagggaaagaaaattgcagtttgaagttaaagaaaagaaagcagcattaggccttcttcgaaacgcagcatagaaaaaaaaagaataggaaaaattctattaaaaacaaaggaaagtagtggagctcacaaagtaataaaggaaaataatttccaagaggttggacaacttgcccgtgccgtgcattagccatcacattcatcaatgcatgaaacaatgataagaaaacttaacttgcaaatttgaaccaaatatcgctttacaatgtcaataacaagaacacgacttcaaagcacaggaacattgtcccaaatgctgcttcaactcactcaggtgaatctattgcctattcctcatcagaagagtcgtccaaagggatctccgtttgttcattcacaacatcagaggtctactcattgaatagaaagtttagttagatcttcaggcaaaggagttaccagtgtcgcctaatgcaaataatgctaaatcaggaggctttacctgcattttatcccaatctttcaatttcgacccaagcatgtatgtctcgcgtaggggtgcccacccaggttcgtcttcgtctttgctattgttctgaagcacatcaagtgtgagaaatatccaagagcttcttaagttccaaatacataaaaatatgtataaaatatgttccgaaataaaatgaaattcagatatggcgcacaagagcagccaacttgtcacaggttaaatcattttacatctgatttagttaacttatggcatgagaaacagtagatagtttattatatatctgatgaatcacaggtacacatacagaaacacagtccaacttgtatattcttaacacgtatattcttaatgctaatgctgaggatacgggtgcttatttaaatgatgtcagatttactcattgttgaacactccctcatatgaaatccctccaactgtaaatagatgtgttgaagacctatgttgccccctcattacctcaagtttagcacaagacccaccttactaccaaatcttaaaataaaacatgaatctactcccttgagctactgaactaattggactaatgagctggtcgcttactagacccaatcaacatccggaacttattattatgatttagattaccactaaattaatcaacatctcttattgccttatggctcaaggaaaatccatttttttcaaatttgaaacttcaaaaaagtagcatcatgtcatttctggatgcaatgaatagacgtgggagacagacagctgagatactgaatgggcagtactataacaacacatcgacggtgtcaatagaaaggtgctgcccgacacaaaatagaatcgaaactctgtaccgaaacaaaaagagccccttacatagaggggtttcacacagattgaactagattatgatgtgtccacaataccatcggcacgatcatggttgttaaggcgtcgctgtagcagtaaggcggttgcggaggtcaaggcgtccactccgccttatgtttcctccaccttagaggcaaaacgagtagagaaagggaaagaacaggaaaaaccagtagagaaaggaaaggaagaagaggtaagctcatcatggaacctagttggcttgtagagaaagagaaagaagaagcggccagagacattgatggcggctggtgcctcttctcgtcatggcggctggtgcctggtggtgtacgatgtctcttagggcataaaacacgtgggtatgaagactaatgttggtctttggtgggctggttgcctggcttagtgggccttttaccaatttcctttttttttcttcctaatttctctaccatatcctccactaatcacgcctcaatcatctcataaggcgtcgcaatgttacgcctcagcgctatggcgctaaggcagtggtgggtcgccttaaaccgccttaacaacactgggcacgattcaagtgcacaacaaaatttggggtgactttgctagacgatttcaattctcatgttaaatcgcataatggacaatatgtcaagcactacagctatcaactaatacatttggacaatgaagtgtatttgcacgttgaggttactttaattgctacggtcttgatgtcaaaaaataattgctattgtcttctgtcacgcaacatcttgtattgcagttgtccgttttgatttatttgaggctgtaatttgcatcaaatttagcataactaatttgaacaacagttccaccagatatgcctctgagaacaactaatttgaatttgaagatacaacacaaatacttagcaacagaagtctataaaatgaaatggagtgtttttgagtaaagagagaattatcatagctaccttagaaaagttggaagatgccttgcccttttgactttggttagatgttttgcttaattctgtgaggaaggcctgctttgtttcttttgccaacactgttaggattaacacaaaatgttcagaatattttcgttagtagcaaaaaaatgcatatatacatcaaaataaaatacaaaacataagtacggtgtgcagaatgacaatgtcatatgatagtatttgctgtcaatgaaaagatcatgacacatggtgtttccagctggcctcaattatgcttaacttccgcattttgtgtcaaacaaaaggaggtatttcatgcagtcagaagcacataaacaaagaggtcctattcaaaccatcttgagttgatagtagtcttgcactcttgtgtgtctcccaccttttattttttagatgtaacgccccaacactcgttgtttttatcaggctaactagtagggaggaaggatgcaaagaaaatgcaccatcaaggatgcaaagaaaatgcaccatccaatgaataaagagtacatgctgaaccagtagttttactttttcataaatgtagaatcgatttctttcatatttattgattttttgaagtctaaaatccaaactatcaacctagtcacaacaggttcctaaattattagaggtagaatgatggattacatggtaagtaaaccaacacacctttggcgtctttactccttgatgggttcaaacctttccgacaattctgcgccttgcttacctggaaggaataaagtaaaggcctatcaaatcaatcatcaaatagctgctattttattagtcctgctattacatggaaaaggtacatgcacatgtccgtgagtgtgttcccttaacacaagctcatcaaatattcaatataaagcttcgaaagcacctcacatatacattttcactgtgctaagtaggtaaatacagaattaaatgtgctttacagcagtaaaattaaaattttctttcttcaatgtacttcagtaataaaaactaagaagacaagcaagagctgtcttcaaaaataaacaaatatgagatacatctgtatcatggaaagcttgatgtatcctatgatatggagagtaactgagcctcagtgtgacgttataagcagaatggcaggataaacaaggagacaataaggtttcaccattgtagggtcagtcgaagctcagtaaaacaaagaaccatgatgtaaaaagctatacatgcatacttcacgaaaatataagatagccgtgtgcttaccgagttgaacaacctgacgactgaatcaccagcagcaagacaatcggtgtaaaaaaaatcaacaggagaggcatccaattagctaacaaataatatgtagtttgtgatatgcaaaataacagagtagaaaacagaagattacccccttgggttgcgattttgatgagctccttctctttactatctaaatgatttgtgggaatgacatggcccttctctgcagcctaagcaaatcaaacgcattcaatccaattcagcatttcagcacagaaacttctacaaggggatgtagaaattatcgagcgaaacaagccgtaccatgcgcttttccctgcggccttctcccttgggcttgtgttcttctgcgtcctcggccaacttggcggcgaccagcttcttgtgcgccgaaagaattggaccctaatgcggcggcgcgaaattcatcagtccattgaaaagaaaagtaaagaaaagaaaagcattattcttcttttgtagagagagatggatcgaaccagtgggtcgtcggggagcttcttggccatgatcttcgtgaaggcgacgcggaacgcgcggcacccctgctcgaacctggtcaccgcgccggcggcctcgtcgtcaccggagccggaagccccctcctcctcctcgtcctcatccgagaggcgctcctcgtcgtcggagtcgtcggagttgtagtcgcgggcgcgcttgcggagcagcttgaggaacctgtcgctgggcttgctgcggcggcgggggaggtcgccggggtcatcggagcgcctgggcgtcttggcgaggcggccctttcccttgcccttccccttccccctcgccgccggcttcttgcgcttgtgggggttgttcgacgcggcgccggctgcggcggatggagaggacacaggctgcggggcggtggcggaggccatggggctcttccaccgggagagcaaccgacccctcgattttgttgaggatggggctagctggccggcgaaatccctcgccgccgccgccgccgtacgccggtggggaatcgcgtcgtcggcgaggaaagaagagaggaagggaggaggcggcggctgggccttggggtggaggggattctagggtttatggtaggattttggggttattgggccggtttggttcgatgatccggtgagacgtgtgaacaaatggacttctttcttgtatctcctcccaacaaaatgcattttcaatattgctaaaagtattgccctaaataaaatatttgtatacttatgtttttttagtaaatggtactagaaaaaatatctgtgcattacaacaagtaaaaatctttttttatgatagattaaaatgttgggatcggtacacattataattgaaaaagttaataaaaatccttactttgttttgggctaaaagaccattctttcgttcttttttcagccctaacattgtccaatacctacccccgctcggtctgtctcttcggcctggtgctctgtcatgccggagctgatcctcccatcaaatccgaccgaatctttctcgatatcccaaaattggttgattttttatccactttatattctctttccgttttttctaaaatcggagataattcgcaaaacttattaaaagactcgatattaaaaccggagataattcgcaaaactcaataaaagactcgatattctctttccgttttttctgaaatgggagataattcgcaaaactcactaaaagaccaaagaagcttattggttggccatcttcaatagagattaaattcgatgaattaaagccgaattgaaaggggaaattatgagaaaaatgataagagaggagtgaggaatcgatttgcaatcaattggaggagaaaacagtggaggcagatcgacgttaggattgtgctagggttcagcccaggaacgaacggtgcataggatctcgtgggaggagacagaagaaaaaatttcggaatacctacatatttatttcttaaagtagggtcgtgtttagtttgtgtgccaaaatttttttagtatatggacacacatttgaagtattaaacgtagactaataacaaaacaaattataaattccgcctgtaaactgcgagacgaatttattaagcctaattaatctgtcattagcaaatgtttacggtagcattacattgtcaaatcatggcgtaattaggctcaaaagattcgtctcgcaatttacatgcaaactgtgcaattggtttttttatccacatttaatgctctattcatgtgtctaaatatttgatgtgacagaatttttggaagtttgaagagaaacactacctaggtatagatttaaatttcttcaagagtaaattacacaagactatagttattctgactaaactatcacaaaactcaaagatttaatactaaatttgttaaaaatatataaatttaaggacaagtaacataaaactacatatttaatattgaagttatcacatcactacaaattttagagtttaaatccctagaaccatcgatacgttggaactatatattatagttttgtgactaaatttgttctaaatctgtaattttgagataattttcttactaaatgtgctgttttttgacactccatgttaaatatgtagttttgtgatactatctatagttttgtgaaatttactctttctgaaatttgatattatctaagcaggatggtaaataatagaaacccattttatatcattttggaccctcgaacttcacaccgaaattggagccctgtcaaataggtcataaactaccaaaaattttttaccatcaactttcaaaactagataattaacaccctgcaatatatttttttgttttttaaataaaggtggttttcctggttcatatatttattatccatgttcttctatgtaaatgtcacttaattaggtacagagccatgaaagcctattgaagttcatattattgaaaaccactttcacatagtagttcaaaccatcatgaaacttggtttataatgttatttgctcggttttgaaatgttgagggtttgaagttcacattgctgagaaaccaccatcatatccatcaaaccatcacgaaacatggaatacggtgttatttgctaggttttgaaaagttgagaatgaaaaacagccggtttgcagtttagggtgaaagtacactttgagcaaagctgaagggacaaaatggatttgtcttctttcccctcttcattttttacgcacagcaacacgagaataatgtaccaagatgaaacttaattgctttttaagttatagataataattcatataacatctacaaagattggcacaactaaatagaactacggagtactcaggggcggaggcaagcctagggcaaatcatgataaattaggttaaatcaccatataattttaaagaaaaatcaacaactcgttagttgagccctaggttagcccactctttagtaattgctagctccgccactgggagtacttatttaaaggagcattagaagggtgattgtctaacaaaatttttaggtgtcaaagagtgtacatctatatatatatgtaacaagatggatatgatagatatatatcatccatctcgagaaggagtgttggactgtgtgcatgtgtgtattgtggctcaagatgcccatgtacccatatgcttgtatatgtactagagtaagcaatttagaatagtacactggtactgaagcttctagaaaaagagctatctaagttttcaactattactgactcctttgaaatttaagattaccatataaattatggataattcagccttttgatgtatttttcggattcattagaaaaggacaggaaatttgccataagattgtatgtctatcagtctatggcttaatttgattggaaaataagcaagttgtctaacttcttgcaaattattttccttttactatttgagatccactacttttctatcctgcgtttcaaagagggcctaaaggttaattgcacctctctctttcttttttatacatagtgaagtcgattttcactgtaaacttttcaaacaggacgaacaacaattgcctttcaaaaatagataacttcgtacatcagactaagggggagtttggatgggactaaaaaattttagtctctgtcatatcggatgtttgagcactaattagaagtattaaacgtaaactaatgacaaaactcattccataaccctggactaattcgcaagacgaatttattgagcctaattaattaatccatgattagactatgtgatgctacagtaaacattctctaattatgaattaattaggcttaaaaaaattgtctcgcagattagctctcatttatataattagttttataagtaggatatggttaa

SEQ ID NO: 27251 - DNA, 87866 bp, Oryza sativa
ctaacttaacctctgacgttcagcaacttgatgtttcagcaggattcaaagtatagaatttccatatactttgtatccctatgcgaaaattctgaaagctaaatattttctatggacgcatcattgatgaagcaaatacatgaatcatgaagggtctgagactctgagtgactgctgtatttcacgagaagccataccaaccagctaggcactcgctgaaaatcatcattagacaagaacatctacagaactaaaaataatactcccctgtttttttaatacataatgctgcaccgttgacttttaacacgatgtttgaccaatcctcctactattaaaaaaatttatataaatggcatttattttgttgtgatatgttttatcattaaaaaaaacttcaagaatgacttacacttcagcaaatttacactaattttttttaataaaacgaataatcaaacaaaaaagtcaatagcatcatctattttaaaaacagagatagtataggttgagaaatcgttacaaattcacattttaacttgtttcatctcttgatttaatcaaatatagaactattgaccaggaaacactcaaccaaaatcaccaagaggtttcgaaacagttgttcttttatacgaacaaagatcattgaatttatatttgtaaagatcaataaagctacgaagatgcaacatacagaaataggatatatactaatcgagctcatatgccaagtacataattcatgaatgcataaccaacagagtgacccggttttttcaggactttgtaatggtaatccttgtttcaacactcagccatgttttatttgagtttcagtcagctcatgatatttctttcacaaggttgctgtgcatacaaaaattgaactacatgtttgagcaaacaacttaatgtacaaccacaagacatcaataatgtagaagagtagaattatacttagataaaaagagcatttgactatgactatatagtatcacaggactgaagagatcagttgttcccttgaaaaaaacaacctgatcaaaggggcatataacgcaaacaccaacaaggccacaacaaaagacacatctatctatctatctatctatctatctatctatctatctatctatctatctattatctattatattatatatactaaaagtccattacattaaactccctataaacgctctcaagccgccacgtgagcctcctaaaatccctcctaagctgccacgccgcacttttataatttcatggtgtagcaggtgtgggcccccaaggagcaagcccaaactgccatcgctcttctgccgctagcggcgtgcgtatagtagacgaggaggttgcgaagcgatcgcctgttcccaaatccaagggatacgcgagattgtcgccgtgacctagcagtctagatgaacccggctcgccgccgccttgcctctccgttgcaacggctgcctcgcgccgtcgtcacccccatcgctgccggcccgccggctgctgtgagtccgtgaccgcatgcaactgcaagacgagcatgcagtcgatcgatgatcgatctgctcttgcttatctgcatgtgaagaggaggtgatcaggtgatgatcggagcagatagcagcaagacaagccaccaacaccacgttgcctatttgccttgccatagttgcctatctgcctcttgccaattgtactatttagtgacagacacatttgcctttgactaattttctgattgactccatcgaggttagcttggagccttgcaggcttggacgaatcgatcagtcaatcggcgacaatcgactgaactaactggtaagatctagagtagtttcaattaacccgatctttttgttgtttcgtaactttgtaatacatatgagttcaatcactaacatgttaatagtttcagttatcagttcattctaaatatcaagtcatcgagaatgtattcataaggtagcgtaaaagggggaaaaaaagaaattgctctaaattgttgaacaaccactacttgagatctaccatgtcccaataaagattaaatggtttggcaattttatgcattgaaaagaaattggtagatgagatttttcatatgtagaaatgtccaaagaaaattctatggtaacacgtagaacgtttttcatataaatattgcttttagatacattttaagtgtttattggtaatcatgtttcttgattattattttggggttgtattaagggcctccatgtttagtttcgcactaggccactaaaaccctagaaccgggcctgcacacattagaagtatatatcatcctacctataatacagacgtacatatcctctctcccactgtcccacattgcaagtgcaagtacgtacgtatacttatagtacgtacattttctccttcctctaatcctccctttgtgctacttatataatcttattctatagctaataaaatttcaagcatagcaaccaatcttactatagaaaatataaaaaaatgaaacatctaatgaaaccatcgatttttacttaaattgatgtgtccaatattttaaactattagattagatatattatttaaaaagtaacaccttcctcctgtattcgtataaatgacaaatgtattactgttggcccaagaaaacaatactccatacgtacgtacgattgaagaaagaaacactattgttcgccacgagaaaaaaaatcataagcatgtacttccaataaaacacgatgaaggcaaaaaaaaaagtacgttctatgtgtacaattggaaaaaaaatcaacgtgttctaaaataagatttatacaatttagagataaaatatattactttacaacttacgcagttgaacctgatctacatataatacaaatataaaatatccaatcaatgcttttaaatgctctatcttttaaattattttaaaattatatatctaatttatgatcttatatttatttagttaaataaactactgatgtctatggtcctaaatacatcataacaatgtagtggtagcatgtaataattaatatcataatagttttttgaataattttacatcatattttagtttagggtgtatgcaatgctaatttaaatctacatatgtggaaaaaaatgaaaacaacataatttagttattgctaagtacatatgatttaatttcaatttgtcaaaaaatcacattttttaagactatttgattggtatttgaaaagtgagatcataaatgttacatagatgcgaaaagaattatcaaaaaaattttcagctaatgatcttgctatagtacaacccctcgatacatcatgatatttatggccattatgtatgtgttttcttttccatatagttttaataacaaatgaataatcaagcaacatgtgtgtaataatctactcatgcatgatatattttcttatggttgagaaattctaacatgtcaggtataattgatggaggtatgtcatacaccacactgacgtggctataagtatacttcaactaattagttattgtaaataagtttgaaaaataaatgcatccttcaaattagtaaaaatgtctcatatgattatgaacaataggtgtagaaaacaatcctgacattgcactatagatatttataaaaaatataaacaataaatggtgctttggaatcttgatgatatttcaaaaaatgactttgtcctggttacatataaattcctctaattttgacataaaatttgactcctcggatttatgcgacggagggagtataagcaatataagtctatctttagttagataaagtagtctgctacattttaatgaaaaataatttcattaatatataataaatcaataaagtcatctatagcacacaagaaaaatgttagtcaaattttggaaactgatacgctaaatattctaaaaaaatcacacatagtacaaacaaatatgaaccaactccattattgtgacacaatttttttcataaatttaaggttgtacggttgccaataattttagtatagactttatacattgtaagggtaatcaaaagaaaatcataactaatgtccaaaccaattattagccaaaacatgtttaaaatggagtaaaaaaaatttcaacaatgtcatcctaacatttataataaaaattaaagcaatattaaacaaggtacccgtgcatatgcgtaggctatcttcctacaaacgctctcaaatcatcacatggaactcctacagacgctcctaagtcgccacttgacaatataataaattggtcgacccattatctgtctatccatttgtcgtgtgatttctaacaaaaatcacccagattttttctacctttagattacatctaacgaactacaaaagaaaaaaaatacatatttacttacacattatttttttcaaaattacagtgcacttacatgtcatatcaactgaatttataaatgtaattttagttatataggactgtaattttatatttcaaaatatagttttaggtatacaatactctaattttatattttaaagaaaataacaaatacatatttatatataccaaaattatagtacacttacatgtcatatcaactgaaattacaaatgtaattttagctatataggactgtaatattatattttaaagaaataacaaatacatatttacttacacattatttttatcaaaattacaatacacttacatatcatatcaactaaatatacaaatataattttagttatataggattgtaattttatatttcacgatgacgagagggatggtgtcgcttgccgaatagcattggccgtactgccggcggccggctcgccagtcagaggccgcgttgccaccatgtttctccatcatagtgaatgcatgggctagctgacacaggccgtgagctaccgctcacatcacaagtggtgcatagcggccaaaaaaaatgtcaaatgccatagaaaaaatcacacgggagatggacatcaaaatcaattaaatttatcagatttatctttaaaaaaatccatggcccacctccctctcctcttcttgcaccggcccacagcccacccttcgaatacgttccgtacgtaacatacgtacgtgctcctccctccccttctatctgctctccccttcttcctttcctttagttattaaaattttaaataaccataatttctcaaaaaatgtagtcataacttttaattacacataaatatttttactcttctatattattgtatccgttgcagttcattaacaattaaaaggcaatataacctgtaatttaacttgcgtttttatcatatccatgccattaaaattgttatataaaatagaaaatatgataatgtatcacttcacaaaacgtgcataaataagttagatctatgatatgacaaatataaaaagaacttaaatggcgagtaacattaaaaaaaatcctatcctaacctccttttgatataccatctcagttgtaaaaaggtttacgaagaacatgataatgtggatcatatcatcatatatcacttaaaaatataattagatattaactgtaatatcacaaaataaaataaattaattgtaataagcactccactcccaaaaaaaacacctccattctaaatatcggtatatcaaaataatgttatcttttatgaaacaaaataatgttaattaaatctaccatgaaaaatattttgacatcattatatgtttaatattaaaagaaatctatgatattgtaaaataaaaatattttaattgcgattagcatttcaaaaaaaatattaccatcattctaaaatatccatatatccaaacaatattaattagatttgtcatgacaaatatttggatatgattttaataattaaagtgaattcattataaaaagaaatcatcaaatgttttcttcaaaactttatcgatatatcttaattaggcagaatatggagcatgtatgtcagtattttcctcttcattctttggagtttaagccttattaatctaatctttgtataaagtatataacatctagcgtactcgacccatatatggcttaccttacgtactaattttgtatgacactcaaacccattttatcaattctacttacaaaccgctattctccaataagtcaagtatattgataagcttattgtgtatcaaaatgactatgtgagatccgatgaacagctatgctatcatgtagtgtaggagaagggcaactggcaatatagattataagagatataattgtatatcagttcataaacataaataattatattaggtgtacaatctcatggtataaaattaaaactatgtcttcatgacttttctttaaattggaaaaaatacatgtataaaacaaaatgataaacaaaaattgaaaaacctcaataatatacaccctacatacaattaaaaacgcaaggctaatctatgtggcatataatctatgtatttattggtcgattaacacatataattaaatagagaaagtcttgaaaactttcgttatgtaagcacaacattctacatgtaacttatcattagttaagtggtcatgttattcttagatattggattatttgtacatctctattatgttaatacatattatagctaaacaaattagaaaaaaaatcaaggaatttcacaggtagtagtgaaccatcgtaaggtatttgggttatagctaacgaggaggaaaaaaagactatgatatccattattaattaaaggtatatatagtttcaaagaaaccaacttcatggcggcaacacaatatttctcataggttcaaaactgcatggtttcacacaattttagtttacaaattttttttgctgcaaggataattagaaaatcatagccaacattcaaagtaatcccaaataaattgtaatacagtagaaaagatattttaattaaagctcaccaacacaaacatttgtaataaaatttcaaacacattatacaagatgcccgcgcacctttctagtgaaactaaagtctcaaatactgtttcccaaaaaaaaaaagcagttaccaattttttttactggataaaaatttgttggttggttgggatggatacttgtagcactcctgatggcatcctctgcagcaaatgtgtcctcactggtagcaccagatggaacgataatcgcactcatgtgctggaggcttgaaaggtgctgcagaccgaagtccaaaacaccactactgcaatgaactttcagtagcttgaaggtgaggtgatacttctgtaattcttgcatagctcctggctcgaacactggccatatcccaggaacgaaacatagaagatataattccttgagagcttgaaatcctcggttgtcgatgactatccttccatgaggagcatgccctgtaaatacgaggcggagaaagagcagagtggagattcctttgagtatgttaatgtcactcttctccattcctgagatgtacagttgcaggtgtatgagattgtcaaatatgctaatccactctggcaccctggcaagagttttcccaatgataagtttccggagacgctgagttgagaagcatgaacccatcgatgaatctagaatgaaattctcatctcctttgtaattaattcagtgagagtgactgcaggttgtgtcagcccaattcagtaagggatgatagcactgcttccctgcatcgcaacttataaccctctgtcccgacagggtcttcaacagaaatcgcaagatctctcagtttggtcagacatttaagatcctcaacgaatcttattgagttgcttgagatgtggaacagctcctctaaactttgcatagttccaatcctttctggtagtctcgctttagtactcacatataggcacacgagtttctataatcgaacaatggtatctggaagggcttgtatggaacataatgtgacatctaacatctctaaatgttgcaagttcccaatttcaccaggaagttcagtgataaattgagaatgaagaaccagatacctaagttgaagcatacttcctaaacattcaatgtggtgattctgtaacaatgtacaataacctaagtccaacactcgcaaagattgaagattcataaaatatggtacttgcttagtagacccaaacacactgattgaacggacagaatttttgtttgttatgttggctgggattacagcatcttcagaatcgttgaactggagggacagtcgatggatcttttccggcaaagagctgcacttttgtccatctattactgtgacgaaattatcttctttcgacatggaaatgataatgttaagaaccaagtcatgaacttgacaaatttgtatactgccatcatatgcaatgctcacaggtaagatcatacttctattgataagctcgttaaagtaactctccgctacttggtccaatctgttacacctgtcttcagcaataaatccttcagctatccatttccttattaactttttggggctaatcttctagtcctctggatatatactgagatatagtaagcaagtcttcaaatgtggaggcaaatcatagaaactaagtaatactccgttcatttcaaaatgtttgacaccattgactttttagcacatgtttgaccgttcgtcttattaaaaaaatttgtgaaatatgtaaaactatatgtgtacataaaaatatatttaacaatgaatcaaattgatatgaaaagaataaataattacttaaattttttgaataagacaaatggtcaaacacatataaaaaaaagtcaacggtgtcaaatattttaaaacggagggagtggtatctttttcagaccttgtagagtatggctattttccagtgctgagccaatagaatttagcaccaactcccactcttcctttgtgttagatttggttgccaacaaactagcaatatgaagtatggccaaaggcaaaccaccacattttcttaaaactaggaaggaagcccgcgcagatgcgcaggcaatttatttttgtttatataaaaaactactgaaaaaagtcttatatcatcatattaactataggaacaatagattacctcgtaaccttaccataaaaagaagggaatatttatattgtgaaatagaccatataatttgatatagtaaatgatagtgtctatcatattcaaacaaaaatcactttgttttggttatatgtaaacttaccatcatcatcctttgcaaacataatatgagttttgatgttttttcttttattatacatctaattcacctatgcatgttcatgggtaatgtacaaggaaatactctatattatcaaaattatttttactaattgttaacacaatttatatgagaatgacataattaaaaaggataaaatatgattccatatgacatttttgattgtacatatgtacataagtttttttcgaatggtagtctctcgtatgttcattctttttcatgttttttttgacaaatatttttctctcaaaggaggtagggtgttcatatgtgtattcatagtgtgggtgtgcacacgtttatatgaccgcgtatagttgcctttcacattgctagtcaaaaaaaatactttcaagaaaattggcgagggtggcaataagcggcgacatggcagcgtggcttcttcgtgaacctcgcaaagattggtcgctacatatatgcataatttgaggaaaacattagggccacaaagaaagaaatagaaaactacaagatggggtggaccatatacacacacttcttcgttatttttgacatctattgtatatgtacgtgcatagagagagattagctagttttaaggagcgagggcttatctgaataaatctaatttaatggttgaagataatggattcaccagtttaagtgcaaatcgatggctagatgttttgtttttcccttatattttttctaaaatttcctcctatttattagagcatcacatgacattttacaagtatttgtagaagtataggaacgctattgctcatactcacaatcaacttgcagtcaactattggttgttgtgattttgtggcatcctctatatatccatcatctttttgttaatgggttcccacttagtatcatcctaattattaagtgaattgtgcatgtatgtatcataaacaatataacttgacgattgtgacactggtttgtatatagaacttattacatactataggatttatcggagacatacgattgatatattatactattcttgattcacaaagtatattatgtactacatatttagttttagtgcataggtaataaatttatggttaagttctgaagtgcttatcagagtggctacttcgttatttatcatgaccacgtttaccaaattgctaaatggtgcgtattttacaaaatatttattattatagattttttttctaaaaatacaaataaacccattttgaagcttgtaatatttaatactcaattgatcttgtgctaatgacttgtgtcttttcgtgtgccctagataagctacgtcaatgagctagatcgaacgaaggctatgtaggaggaaaaggatattgacatggtgttaaatgaatatatttaaacttcaattttctaataatgtatgaaaagagtaaacataatatgtaaaaatatatttatgataaatttagtaacatccttttcccatatcagtattttttacaatagagagtgagtaatttttcaaattctacacacacttgaagttgtttttattttggaaaatgtaattttaatttaacaatcacataaactatgctttttatttatttatatttttatgggtgtttcaatgacatgcgcttaatttgaatacaactcgaaatagcatatatttttacaacttaaagtatagttaatattaatttaaattattagtttgattttccatctaatctaaatgatgataagagaaaaataaggatgtgggacccggcatgtgtatgtactgtacatagaaatagttgcgtacgtactctacgtaggtacttaagaaggaatacctacaaacctgtgcatgtataggcattaagatgtgggcctttttacagataaatataataactagtttctaagatagatctaatagttgaaaataatgggtccaccagattaaatgaaaaccgattaattagtagatttgcttttttttatataatttctatgatttattagagtgctatatgtcggtctatgagcaattatagagtactatgtggcggattagaagcgtttgttgaaagtttatcctcttgattactttttctccctttttctctttatgaaaatatttacaacaataatttataaataaccacaaccttctaaattatatatttatttgtaacaatatattttaatttgtcataatttttaacttttaattcgtacgttcaattttttacctattttggaccattgtgttatttatgataaaaatcacaattagaatttaagtgtatgttatctacttcactcgtaaaatgtatattcttctaagttctatttactatcctttgtatgtcatttaaacggatatgaaaaactataaaaagaaagtgactatatattatttcatccagtaccacttcacttgcatgcataaataaaagatcgactttttaaagcctcaccaataagaagaatgcccgcgcagctgaaaacatatattattttttttattgtacgttttttaccatatttgtagagtaataagttttgtttttctactatagaaaatactattttaaaaaactatctatttttgtctactaacgcatcgcatacgtacatttttttttctagtgaaccgtacctttttaatagttttttttatcgtacgtacgtatgttcttttaaattttaaataatcagtacctaaagtttttgttttcttttcaattatgtgctcgtacgtagattttctggtatagacggttccactcgtgtgcactttccggtatatacggtttcaacgtacagtgtagtactcttttttggctttatagctgcacgtatgtttgtttgttctttttaagccaacagtacttaagggtttatatatccgatcgaaatataagttaattgttctcgtaaaaattctcatgtataaagcttatatgttactccctctggttctatattaattgacgttttggacaaagttaaggttaaacttttatagctttcaccatcaataactttaaaaatatttagtttaaagaaactagaaaaacatatatagatttgtctttcaaaacactataataaaagtaaacatgcatttatttatttattgtatatattataatagaaaaataaggtcaaaggtatatagtgtgtcattgtccaaagcgtcaattaaaatgaaaccggagggagtaagggtgtagcaatgactttttaaatagatctaatctaatggtctaaaataacgggcccaccaatttaagtgaaaatcaacggttagattggaaaataccatgtggcggcttaagagcgtttgtaggaacgccacatggcggcttaggagtatttgtagggagattaatggacttttagtatgtagtagataatagatagatagataagagataatagatagatagattgcttttgaaagttctactagatgtgatggacaggagtgctcaccatggaaaattcttttacaaaacaaccttctggagtcactttcacttaatggttccaggcggtaaatactgcctttgaaggtagagcaacataacgccgctatatcaagaatacgtgtagttgtaattattctactgccagaattattctcaggcaatacacacttcaagatttcccaagctgataagctccagatatcatcaatgacaattaaatacctatggcccaagttcatacaataagtccggatacgaaatagcaggaagaaataacagaaaggtagtagaaataacacaaacctcttgtcatggagaaattctctgatcttgtcaatgagttgcctctcatcatccctattaccagaagccccaagtccagaaagcaaatccaaaagaatcctcttcatgtctggcatttgagatacaaacacgaaagcagcacaatcaaactgccatttgattttctgataaacttgtttggcaagagtagttttccccaaacctccaaaccctgcgatagacaccatcttaagtcaattaacaaatccacaatcttcatcagctgcattctcccttagcaactttataattttgtccctcggcccatcaatcccaacaagtccacctacctcggaataaagagtctcactccggtgtcttctacctagagtagaaaaaaatctgaaccgttgatcttatttgatccaatggttcagatctatttctactaccaccacacttagtggtagtagaatcgtggaggggtacttttatccaggaaaaattatctgcggagggatattttcgtccttcccgaatcgcgcatctggagccgatgcggagagaaccctgcggctcccatcaccaccttgacgacctcgcctgctccaccgccctcgacgcctcctacttcctcgcctccgtcgcactggctgcctcagccgccctcgacgagctcgcatctccgtctgggatcgccagagctgcgccctctctgccgctcccccgcgtcggcccaccttccgacgagttcgcctcccggatctccgcctccgacccagcaccgtgccaccggccgccgccaagacctcgtccacctcgctatccccttcctcgtcgtcggcctcctcccccacgctcggctccagccctgtccatctccgcccgccgttgatcccacagccgcgagggcgagcccccaatccatcgcctcccaagcggaacccgcagcctccagagccaatgaccaccaatctctcgacctccgaatcatcatccaagactcctctcgctggctatagcgctgctctccaacggattagctgacatgagaagactctttttctgctttgcaagtcagatttgatttgtttttcttgctgcttgtaggtttgcagctcgaacatctgcactgaatcttcttttttgttggcctctagttctcgaatagtttttctgcttgtctacttaagttctgcagttcttggtcataatttttcctcctagaagaagggattcaagttgaatgccagtaaactgaatccggagcaagtgagcttgttcagaatggctgagcatgacaaggtggacaagctaatgatcactacgtcaatcaacgcttgagagattcctggtgtgctatgtcctgtaattcctgtgaattcattatctcaagatggctttgggtggctttggcttgttactgatggccatgtttttttttcaaaactatagcttattaacagcttgtggttttgaaagtgcctatctgtatatatcatcgtttttgtacgtggttcaatgtatattacttgttgtaattgcaattgtaaagtctacgtaaaaaacataccggattattcttccgttgccttgtatctgtcattgctggattggagtgtttcgatttgtccatcgtgtgtaatattcagatatataactaatatatttaaatttcacatgaaacaatcaagctgaatggaaaccaaatacctacagcaagaaacatctatggaacgcgatgcacaagcgccggcggtggccggacctcgcgatctgcttttctttttctttccctgcgctctcctttttgatggagagcgactctgctcttcgatggagagggatcgagcgacgcttgaccataggacgcacaaatgagaaaaaaattaagtgtcagatttacccctattcggttttagcactttactaatttaccctttaaaataaacggtcgagattaattctacttggagtagaatactgcaagtagagggcaccggagcgtctctccggaataaaacgctggcaggcgagggtcaatggattcacagccggtacccatggacacagatacatcaagcttatacctttttctacgatcgttcacctcgagaacttggttcttgagtttttcaatctcttgagaaatagtacagcttgagagcagctctctcagtttcaggatattgttgatgataaatcctctgatacctgtaggctcattggatttttcactccgagccatgaaagcgtcaatggtgtcctcgatgtcgtaggccagctcccttacctctttcatccaagccttcacttgcaagtggggctcactcaacatcgcgtacttctgcatcacggtgttcatgctgctcagctcgtttcgcaggaacagcacatccttctctactgttttcttcttggcatactctttttccagcatactggatagcttgccgaggagagactccatgactcctgtagaggcgctcaccagtgcacccgccatgaattgcctcggtttcttgacaggaaggacaatatcaacagctaggaaagaagataatcaagaagagttgtgtggaagagaagataatccactactgggctcccaggctatcaaacttattatgaagtcaagtcaagtgaacccatctcatggagacttggacttgttgtgcctgcaattcaatctatccacccaggtgttgaatagaaatcattttattttaactgagcgcgtttagtttggaaaatatatggtggtatatagtggaaacatagaaactaccattagatcgaaaaatagactttcgagattcgtttacgtcatcataagtaaaagttttacttgcaaatacacccatgagtaaaaattttactggtgatatgaacaaatctccgatgttcattttttgatccaacggtagtttctaagtttccacttcatatgtggtttacaccacatattttccccgttttgtttaccagatcagcttgaagattgaaatggacaactttatatctttaaattcatagttcactttctctataacattgtggctaccaatttccaaaatcatgtggtctagtcttggacgaaaagattgtgtgctctgaaatatctcccatctttgacgttgatgtgtctcctgcaatctcaaatcacaaaacaatcccttctatctgaataaatttcggttagctttgatgattttttctgaacaaattcagttaagcttgtttcttttgttttcagtctcaccagtgatgttgcagttcccccaataaccatgctgttgtagcctgtaaaaaaaaatgatcccttttacctgaacaaaattcagccgttgaggaggggagaaaaaaacaaatcaggaaacattaggcgagtaataatggacaaacttggtgcagttgtgatgcgcaatattgggcagtaagaatgagaaacgaaataaaatcgatgcaatttaactgctgctatgtgggattggagggatttgggcatcgagaaacgaaataagaaaccgacgcgattgtgatgttgcggtcacagatcggcggcggcggagaggagaaggggatgatgtggacctcaagatggcaaaattgcgattacggcggcggccggcgattgggttagggtggggtttgtgttgtgtgcttgggtgggtgggtgggtgtgggggggggtgctgggctagcacatgagttcatcaaacattctatgcagacgttattgtacatttgtactccctccatctatgtttatgtttttaggatatgtcacatccacctaaaatcccttatattttagatcacacccacccaaaattccatatagtttgggagggagggagtaaccaacacttagttcatcacaatatcaaacattccagattgattggatattccaacttctaggtaagatcgagttagcttgcgtttcggatattccgggatgatgaacattctgaactcaatgtggtaagtttccgataaaagttaaaagcaaggggaaaacttcaatttgccagaattgcagacaatccaaaacattggatattccaatatttcttgaaagctcacagcagagagttgggttggcccttaaaaaaagaagaggaaattccgaatgatagatactccgacaagattgttgggtattccgaccagaaaagcaatggcactttaagaaaattagtcattgagcactagtgtcaaactcaattatatatatgtggcatcccttttaatagtatagcatatcctaactctataaagataaagagtaaaatggtttaccaagaagacatgcctggatacttattttcgtgctaacaattggacaaaataaagcattagataattctagttgtgttgtcattaattgtccaaatcaaatagtgggggcttgcatgcactttcgattatcttagtaagaaaaagcattgttattttggcattgcattagtgatatagacctaaccaactatttcatcacatcctttaattgagaacttgtagctagttgtgttgtggtcatccactcaacttcgcagcttcaaatgtctttgtgttgactttgtgtttggttgagttagctttcctcccttgggagatgctctattttaagcccctaaggacctgtttgggggagttttagattctgagaagcagctgtttggcagccagcttctgagaatctggaaaagctctgaaacctagcttctccagcttctggcttcttagttcatttttcaaaatctaaactgtggactgtttgaggcagtttctagcagaagcagctgggacaagctcccctaaacagggcctaagactatctccaacaggctaggctaggcatagcagtacccaaacccaaaatacgtgctccaggggctactgtagcaggaaaaaacatggtccaacaggctaccatacaaaggacctattttgcgtgccaggcgaggcggaacccaaatatgagcgtcctctctcctcgaccgaaacttcatcgcaagcccgcgaaggaaactatctgcattgcagggttttcttttgcgttccctgttggagaaggcaagaaataggtgcatgaccttttgccgcagcgtgacgcataacgtccaatgggtctcctgttaagggcagtattgttggagatagtctaagttgccctttgtctaaatagactttgaggggctagttaggatacaaatcaaacattttaatcacccgatgaactatttcttacttttaagtgaggggatttatttagtatttatttagcacatgtttataagtatatcattgacattacccaaattaaggatttatggatttctaatctaccgctaaaatagatatatggatcatatatattatttatatggtatttagaaatacggttaattatattattgtaaaaccgataatttctataaaaaatacgacaaaagcagttggtacaacatcaaaatcattccatttcgcatatttcactattttgttttttgtgtttgtcagttattgtttccacatggtttaattagtataacattttttttaaaaaaagtataaacgtagacactcacaataaatgcacactcatctcgcacccaagcacattctacctctatgaccacatccggaaaactagaccgacatatcttgagattgataaagtcaccacagacacctcactgttcacgggtacgttatttatcattaaaaataattagcagtaaatataaacacccgtgttaaatttagaacttgaacttggatgaattgattccaccataagtaatctagctgttaaactacactcacttcgttaattagtagaataccaaaaatgactgtcagtaggttaggaacttctgctaccattttcggcccctttgattcaaaggaaattcataggaattttggtggatttcaatcctataggaaaattttctataaagccctttgaaacaaaggattgaatcatatccaatcctttgaaattcctatggaatggacaatcctatagaaattttagagaaaatttagcaagagcttcaacctcttggtaatttttctttaagactatctctctcatccaattcctgcgtttttcctgcggttcaatcaaacggtaattcctgtatttttcctacgttttgcaatcctccgttttatacttatattcctatcgaaattctacgtttttcctattcctacattttctcaaaccttcaattcaaagagcccttcacctctggatgcaaggatcgaggaggttgcccatctccgataaacttcaggggaaagaaatttaagcctaatgttagtgcctatcggctatcatcttatcatctatgtgccttcaagtttaagaccggagtatacttgtcaacagtcaaccttcttcctcttttgccgtgtcctgctcctccaccaaactcacctttttcatagctataggttcgaatcttccactgcaatgatatggttaattaacaatgcatatggccaaatatttgcaacacccgtttctttttcttcttgtgcaccacggcaccaagtcaagtcaaggaggcacactatcatataaataaggggacaattgcgttttttactctattttaaagactaacggctaatttggcccctgttttttcgagtttgctcatttgatccttttttagaaacgaagataagacttggccctattccgtgaaggcaacatgatgttgttaactcaagacaaatattccatttgtacccttatgaatttaacccaatttctcaaagtattttattcaatgcagttttgtgcacttattagtatatattaaattgcctcaaacacaaatacatggcacaaatttatgtctaccaaaaacaaaaataggcaaaaaaaaacatgtcaagtggcaggacaccgcgcagctgacgatgatcacctgagcccatccgtgcggagcagctgccgccaccactcctcactccgcccaccggctctgctgctccgaccctccgcgagccaccatgcgccgccgccgccggtgctccctccctccccacagaaccgctgtctccccactaaagtccaccaccgccacgccgccttcgccgaaccgtcggagcaagatccatcgcacgcgtgtctcggcactgcgcgcatgcctcagcgccaccggatccgtcgtctcatcaccgagtctccgccggatccaccctgccgccttcgcccctcctcctcatcgtcgagacgccgctgtcactcctccgcctcgtcgagccgccgccggcccttctcctcgtcaagccaccgccgctcctcctcttcgtcgagccaccaccatccctcccatgtcgccgccgctgtcgctcctccgcctcggtgagccgtcgctcctcctcctcctcttcatctagccacttccatccctcccatgccatcgccccgtggctgtcattgcacgaggagggtggcgggaggaagttcctctcaaggtctggtgagagagaggagaggcagaggataaggatttcaagctctggtgagagagaagagagggagaggataagggaacaatattgatgtgtacaaagggtattttggtcaactgtggctcataaaaaacttttttttttctattttctaaatgaaaccctaactgttttatgaatccacggtcagatggcaactcaaattttaaaaagtagggtcaaacaagcaaattttaaaaagtatggtcaaattagtagttatgcttcagaacagagtcaaagaagcaattgccccaaatataaatggagggagtaactaagagttgtcctacaatgccagtgagaataattcggccaaaagattcgcgtctgaaaataggttttagaataattaaaacttaattaatcatatactaatagcttttcgttttaagtgcgctaacttaatcttcatcttcgtgagtttcaaacaccactaatttgtttccaaatgagctctccatttttagtttaaacaacacacatttggggctagaggtaatcgttgggggtctgcttttcatcactatcttggttcgtggataatcagggagacagtgagaccgaggagtcgtctaaacgttaacgaggcaaacaaaaagagcaaagtttagaaaatcctaagctccatgattaaagtatgaaaaatattgtaacgtgtggcacataatcgcaggtatcatttcagtatatcaaatagaattttgaaaacaatacaaatttaaactatcaatcttagtgaagaacttaattatgaaaactctcatatatacttatgttttttaatgttaagtaaattcatactcaaaataagtgtcaagttctgtgcatctttaaaactataatacctaatgatgtcacacgccatgcaacataatggttttacgaatttaatcacaaaacataggttttctgaaatattacttccatcatatagtaattgcatttctagacaaattaaccgcaaacgcaatttagcacactaaccctaataattacaccgctgtacatttgaaaggaatgtttttcatatgtaaacttaattaaaaagaaagattggagtgcacattctatttgtttgttgtgttccatgttatcgtaaactagatgaatatcccgctgcgttactgcgattattaaaactaaaacaaattaatacttatgaattttgaaaataaaaataattaagagtgcatggtgttatcagaaaagaaataagagataatttgaaccatagatttatcattcaaaggctataaataattgaggtgatgtggcttaatgagataagagagaaatgacattaactgcacttaatgaggatgaactatataagtattccctccatctcaaaatataagcatttttttttactctggcacggtctccgagatgctactttgattaaccatatcgatgttctaataaaaaaaagttatatattatgatagtttgtttaatgataaatttagaaatatcaattttacatgatttatcttttttatatttttgctattaatacttaaagtttaaaatgtttgacttgtcactatgctaaaaatgcttatatttagggcgagtatatatgattttttttggacaaattttgaatgtgcaatcattatgggacgcaattattactgaattaaaaacgaagactttgtcccctgaagtcgtgaagtccggcgtcccctgctctagtgctctctagttttatactccatctcgctcgctcactcatgtcactcgtcagccacttccggtgtccatccaattccccagcaaccgcggcgccgatcgagttcttgggctccggcggcagccggccggtgttgggcgcgcgacggagccccggccacctgcagctagccgtacagccgccggcggccggtgtatacaggtatctctctggattctgtttttttttctttttttctttttcttttggatcgaatcggccccatcgctcgctccgagaaggcggcgttgatccgcgccagcgccacggtttcgaggggctgtgtgtgcccccgatttagcggaggagggcacggtggtttcgaggggtcccgagaaattcgtgagtttttcatcctgcacttcactttgttttcttgcttatcgccgtgtttggtgttgctaatagcagttattacttattcttattactattactattattattattactcactccgttttataatgtatgtgtttagatttattagtatctaaattaatgtaggcaatgttagaaagtcttacattgtgaaacggagcaggtattatttttggagtaaatttcagaaatgggacaaagttatgaaaaaccacgggtattaatgacgagtggcacataaccacatatgacatatttatggtctcattgttttctaaaacccaacctttattggaattttgataaattccagcatatctatggtttagaactttaagtaaattcacgcttaaagtgcataagggtgatattttgtgaaactttaaaatcataatacctgacagcggcggagccaaggcccggccagcacaggcaggcgcctaggctccgccacatgcatccatgcattagagctaaatatagcgtttagccattagcctagcttcacatacaccattagattagcactaattatcatacttggttattagccagcggcctaatttcgcttcttattcatgataaaatgctatatgtatttttgtttacttgttaatttgttatctatcgttaggtttgcccatgcctaaaaaaaattctagatctgccactgatacctgaggttgtgtcatgttataaaacctgtggttatttacaacttcaccaaaaaacacaatgttttctgaaatttgttcttatttttattataaagatgcatagccaccactacggggtttcccaaaccaccggggccggggttaccgcgacccagcggtaagcacggttaccgcgcagtaaccacggtaaccgtgaaaaaccgtacaaaaccgtgcaaaatttatcaaaaattcaaattatattttaaatttatttcaatttaaggaggttaccgtggtatttatattaccgtaccccgcggtaagcccggtaaccgtggtaaccgcgcggttacagtcggtaagtcgaaccctgccactacccactgttctatatgcacacacctgtaagcaagtccacttaataaacacaaagtgacggatgtcagaagcaaatttccaacctcactataaaatagtattaaaagggtacttgtgtgcttgcaatattgtaggtataagtattgatccctggtgtgtgaagtcatgtatgaaatattttgttatatgccattttcgaagatggcattcagatgtgcaagtgcacaaacaaactatagttgtggtatattaacctgtcaagctattagctaaacttgaggggagggacctaatgtttttctttgaaccaagtgatgggacctaacctttacagcctgtttggcaacaattgggaggaggaatgagagttcagttaaccagtaaaatactctctgtgtatcttacactggttttgggccaaaataaaaagaaaagaaaagaaaagcttccaagcaggtcctagtatgtttccgacattttctagcttatgtgagctagaaagtagacatgttcaaacgttattctccttgtgatctgaaacttaaagactctgtgtactcaatcaagtaggattataggaagctacttagtttgcttcaccttgaggtcttgtgaaaatgttgttcatcattttctttttgttcacatacatgatggatgtccactattactgttttcgcattttggattgagttagcaattattctgaatattttgcaaaaaactcaacatgaatagaattccccttacatggtgagtgattaaacagctagatgatggtgggagcaacggtttcagcttcagcgggggtgatgaactctctgcttgggaagctctccaccttgctggacaaagagtatacaaagcacaaaaatgtggaaaaggatgtgatgttcctgcaaagggagctacccagcatggaggctgtgctgcagaaacatgcaatgcaggacgagcttgatgttcaattgaaggcctgggtgagtgagttgagagagctggcatatgacattgaggactccattgatgctttcatggtgcgcattgagcactatagtgatgagtctgctggaattaaggggtttatgagtaagaaaatccacaagctcaagaagctccgttgtcaccataaattttcggcggtgtttcttgaactaaaagagcgtgtcgttgaagcaaacgagcggcgaagaagatatgaggttgatgggtccacatctggaaccacaaccagtgattgcttgttgattcccggttgccagcactctattctggtttagatgagcttgtaggaatcaagggtccaagggattgtataatcaagttgctaacttatgaagctgatagtggcccatcaagacagcaactcaaagtagtgtccattgtgggatgtggaggtctgggcaagacaacacttgccaatcaagtctataaggaaatcaatggccaatttgattgtaaggcttttgtgtctatgtcccagaaaccagacatgaggaagatcttaatggatctactatctcaaatactggggaatggtagccccatgtgctttgatgaacagcgactcattgacaagcttcgggagttcctaaaagataagaggtattaaaactgaactttattgtttcataattgcaagataataataaaattattgaaaaaaaactgcaatttttaaaagtatcaggtgttaacattctgtaaaaaagtccaagtcaagacaaacagagagagatattaaatgtgaactatacacaatacacatatgtgtatacatcccttacatggtagaagagtccttaaaatcttcatttgtgccttaatctttggacatgtctgagacatattagatctgtctggtctatgtaatttcaccttatcaatacttaattttccttcttttttaaatgacctattggattagtgttaaccatgccattttgtagtttcgtatttttatactcttgtttcttcttcggatcttaaatttttttttccgtagattcaactggattgtagtttttatttataagcaagtgacattgtgacatggggatactgtgaaatagctattgacaataaatcaaatattaaagtccctacaagagatgataacaggaaattaggagtgaactttgaacagtttttgaaaatgacttggttttgcgccttatctaaagcaatatgaaatatggttttcaacggaaacgtacacagctagttgtcatgtgccatggaatattaggtacagagcttatttgtattccagttaagtataggccctatacttttagagtaaggcgtctagtgaaaacgatggcatctgcggagtcatgtgaaggagattgacttgagtttttagcaattacattgttaagttcactatgacagcccggccaaaaaaagttcactatgaccattgtatttgttttaaagctccatggaagccccaattgatgcaaaagacaaggcattgtgttcagttagctgtttgggagggcaatgtgtgctttattttgtgtagaaggactgctatatttttttgtgttgtctgcatactgcttattcccaatttcaaacagatgcatcaataacaattttgcgtcttaagtcaccttagagaatttggtcagggcttcccctcatatacaagtttcggtaaaccttgggacattttgtatgccattcagatatgtcatgagaaaatcagacctacataaaacaagtacacacacagatgcagtattattttagtaaaaatatatacatgtaataaaaacagttcttataaactgttcacaaatttatgcaaataggttgtgatgtttatatcataagaataataatatagtttttaatatttcagaaacaccattggcaccttgtaactgctgatatatctctcaattctgctaagttctacctaacgcttgataaaatgtcaccaaaatctgtacaggtacctgatcgttattgatgatatttggagcacatcagcatgggagattgtgaagtctgcatttcctgataataatcttcgcagcagaataattacaacaacgcgcatcatggatgtagctaaatcatgttctgctaatctccaggaatatgtttacaccatcaaaccacttaatcatcaagactctagcaagctgtttgttaaaaaaattttcccttctgggtgtggtgttcctcaacatctgaaagaagtttcgaatgcaatactgaaaaaatgtggtggtttgccactggctatacttattatagctggtttgttggctagtaagtatgataggaaggatgagtgggaggcagtgcataattctattggctctgaacttggcaaaaatcatactttggaaggattcagaaggattttgatgcttagtttttatgacctgcctcatgatttgaaaacctgcttcttatatctaagtatattcccggaggatgacctgattgtaagaaaacaattggtgtggaaatgggttgcggaagggtttattagaaaagtgcgtggtaaaagaccagatcaagttgcagagagctacttttacgatcttatcaatagaaacatgatccaagcagtgggtgttcagtacaaaggtaacatatatggttgtcgagttcatgatttagtgcttgaccttatcagatctctatcagcacaaatcaactttgttatcgcgattgatgataaagggtatgaatcttctcctaggaagattcgtcggctgtccttgcaagctagtaatttggaagatcaagaaatgcagaaacttgtgagtaatcaatcccatatccgctcactcattatgttcagggcctttaagaaagcacctgatcttttcaagttccatgctctgcgtattttggatttatccgagtgcaattgtttggaggaccaccacattacatgtatagtgaatatgtttcagctgaggtatctgagcctcccttgcagaatcactgaactccccgagcaaaccgggaacttgcaacatctagaggtactgaacatcaggcgttgcatgatcaaaacattgccagaacccattgttaaacttgggaaactcatgtgcctacacgtgaagtctggggtgaaactgccggatgagattgggagaatgcaagctctccaggagctggagagtatctccatcccatgtaactctgtgaggttaattgaggagattggtaggctgacaagattgcgaagacttactgttgaaacaacaagcactactgagaaaatgggagaccaagaagtgaggttcagggaaatgttggtcagttccctcaccgagttgggcagaaatggccttgagtcactctgtatcagctaccctcatggacagaacttcatcctggattcattgtttggctctggctgctctcttccaaagtttcatgagcttgacataaagaattacctttgttgggttccaaggtggataactatgcttagtagccttgtgcacttatgcctatccatgtatgatattgacgaggaagatatgcgagttctgaatggcatctccaccctgctatttctccatttagaattaaggaatccacctgaagagaggctagtcattggttgcgatggactcagacatctgaacgagctacatgtgttctgccaacattccacaatgccattgacgttcgcgcctggagcaatgccagagctccaccgtttacgcctcgaattcggggcgagggagacgttgcgcatgtatggtgattttgatttcggcatcgagcatctttcgggactccgggatatcagagttgacattaactactactctggtggcactgacatggatgcagaagcagtggctgccaaggatgctatcaccactgcttccatcatccatccaaaccgccccttacatgatgtccgaatgcatgtcaccatgatgtttaccctgaaggaggctgctcagtcggttgggctccaaagcgccacgaaagaattgaatttagggacggattttcagcgcactttcgtccaaattggtaatgaaacctctttgccaacttactaccaatatatgtctttcctgcttgttcagtttagttacaattccttttgtttttaaatccatcagaagaccttgataatccagaagttctgcgaaaactacagcagctattatcacctgagtcttcgacacggaaccagtagcttgggacttgaagaaacaacgtatgtatcttctggaaatctggccatcaagatcaggtgcgagtatggcaaattgattgaaattcgtataaaaatccaggagattcgcaatgttaatgtgaggtatctaagaatctggcttggaaatactccctccttttcatattataagtcattttgtctttttttcctagtcaaatttatttatatttgaccaagtttctagaaaaatttatcaacatctacaacaccaaatcagtttcattaaatataatattaaatatattttgataatatgtttgttttatgtaaacatgttactatatttttctataaatttaattgaacttaaagaagttcgactaggaaaaaaatcaaaacttataatatgaaatggagggattatcttgatgtgggataaaggcaggagctctaccatatcaattgaagtagggcggaaaaaatgagtgtcatttttcttttacaaaatagaagtcaagaggagagccaaagtactttttttttataaaggaagcttttattaatcgtctgagattacaaaactatctttatcagttgtacttttacagaatagaagtcacggtgatttgaggtttcagccaatgatggttacaagcggccattatgagctctccgtaaatttgcatccccatttagcttttgtgcgctttctagattaatgttcttttttcaaagtcttctagtataaacttgcatgaccatttatcatcatacaatatttgtgtatatggaaaacgataggaaatgtgatattctggtccaattaggatacggcatgtgtgacccataaaagttgtgtgtgcatgttaagtatcatattgctagtttagtaagagtaaaaccaacttataagggtttgtctctcccaacgtaacacttctgagttaatctttttacacaaaatgaaaacgaaagtataagtggggtggtatatattggccctctttgtttaggcttaggcttattggcctagacttttaagtcagcttattggcttatatgatttataagccaatggatttaatgtcctaagtttagtggtggagtcatacatctatctcatataagccaaaaaagcttctccaacctagcttttggcttaatagtgttagagtggcttatggcttcaaaaaagccaaatgaaaaagctgcttgtttgttttgacttagacttttcaacttataagtaggcttataagcctaaacaaagagggccataaatgagtccatccgtcggataggctagactgtgcggttttggagggtaggtagttacaggggtaggtagttacagggattgtgccggataatgttcttgtcttacaatggacttgtcactgccttctgcaaactgatccctagtctgatgttttctggataatactagggattgggtgatcaaaatgttttatttgaccgtctgaaacatcgaactttttgcatttgtctcgtgaaacgaagagttagtcattcaaacatttaaaagaaatgcgaaacacaggtgaacgattttgctcttgcgcataagacattgaattgtttatgcatcaggggctctccttttcttctcgatgattctcttcttcccttcaagcagctgtaggagctccttagaaatcaatcttgatataatcagaaaataaaatacttagaacttgtaaggaacattagatgcatctcatgaaaagagacttgttgtgatggacacatgttgctttcctctgagaaaaagtcagtgtctgcacatttcctgtttatgcattccttgacaaaaacgaagatgcatctacatttcgacagatcacaagagtaaataactcgacacatgcgtataggaacaagcttggcatcctgttcggcaactcattgtctggattttttatattttggctattttcaaaaacttattttgtaaatagatctaaaaaaaattatcgtaggaatagacccttttcgcgatgccagtaaccatgcatcaagattcaatatctaggcgccagcgccgatatccttgtcccccagcagctgagatgtggagggtcggtgccaaacatattggcactaaagatctatttgtaaaatatatttttttaaaaaagggttaaaatgtaaaaagtttttcttacaaataggttcatatcaccaaagagactgagtgtctatttgtaagaaaaaaatatttacattttgacccttttaaaacttttatttgcaaatagatccttgataccgatctcttttgcactaatcccttcacatcagcgacttagctaccaaggatggtgaggacatcaccatcagtgccattgacactgagacattaaacctgagcatcaataactctggcgtcgagaagcctcaccccttctaattatttaatattaggtccttctctaatattcgcgttttttatatcctcgaattttggtatggatcattttcataccctttttgttagttgaccatttaattcctatgaaaaggtctattttgtccataggtacagaaaaagcatataaattttgtagagtatattgtttgaatgtaaaaaatatgttgtacgagactattaaatttataagtttgttatgcgatatatttatgacaacatttatttttagatgtgcataaaaataatatttgttttttaattattaaaaaaatgtacatatagcatattttcttacactagtacaacagattttccatctgttttatattttatttaaaagaaatattgtactacaaggctaattgtttttaacattaaaaaaatgctacacataattttcttgaatactatattaaattttctacatttaatgttttctcatacaacaaacttattatggatattacattcacgcaacaaatcaccatcagtagttttctcaaatttcaaacattccatgcatgtccaagggtacaattgattttttttaagagagaatctactccatggcactaagtttaccacagttcaacgattttcactaacattatctctttctaaaatataccagtgactttctcaattgttctacaatatatcattgggatagattttttaataaaaaaatccaaaatacccttagatacatacaaggttaacaattaatttatcttattataagttttaaaaaatatgaaaaaaaatgtagcctccttacaaaacatggaaacttgtatataagattttcaagttttttttggtatatttattttttagaacaaatatttttctgtggtataagagagagaatttgtttacacaaaatataatagcacaaaaatatcttatgtaccatatgaaagattatttatattaaatacaccgacaaaaaatattttatatagcatataacagataagtgatatttaaaaaaatagaaatgcaaaaaacttgaaacttaaatacaaaattccatgttgtgtaagaaggctacatgaaaattttcatattttttttgaaacttctaatgagataaaccaattgttaatgttatatgtccatacagatatttttgggtatttttgaaaagaaaacccggttcaatggcgtattgtagaataatttgtaaagtagccaatatattataggaagagacaaagtcaatggtaaatttttaaactcggacaaactcagtggtatagaatagattctctcttttttacttgttaaacggttaactaacaaaaaggatatagaaaagatcaaaagtaaaattaaaattcgagagtatataaaagaatgagtaaaactcaacgacattgactaatttaacaatatacaagggattttctctaattagaatatcctaagaacattctaaccaatagtctatgcagcatggaccctctcactctccctttcatttccaattttctgccacaaagttttgcaacacagttctattgtttctctaataaaaacaaaagctatctacttcaaatatggaatatttactctttccatccactaaatagtccttgattggataacaaaggtaaatgctatctactgcaatctgaaaaagaaaaaaaacacctaatcatgctgcactagcacgtgaagctgctgagcttttttttttttttgagaactgctgctgagcctgaaactcggcgaacaatcctagaatgctggagcagcaaaaaaatcagccaagtagccaaatgctgacgaaaattcaatcttacacaaacactaatcccatcaagccaccaagttgccagctctctgaatgcgttttttttttaacaaacactacaatacaagtgtaaaaataaaaacaatttgctctgcgaatcaaattatggaaacaataaggtttgattactttttccatatatcaaattcagaaatatattttccatttcaacttatcatccatttgtaattgtttcatacttcgatctacccaaaaaaaaaatgagctcccaagtagtgggagaggaaagtgatcgtaatgagccgatgactcataagcaatggtttggttaagagagcgtaacctgtcggaattgtagcgaaagcgactcttaataggacaattttcactacttacggagatccgaacttaggtgatttatccatgactaggataaaagtcagattgaaactatcctgcttgatgtatggacatgctcttaactgggaaaaaaaatcagggagcacatctaaaaattaggaatcatgaactgattgtggcctaaaatcgtagcatgcacctccctaaaatggtctccaagaaaataagatgcatgctgttgattttaggtgccctaaaatccttcgatcacgagcaaataaaaaggtcaaattaactagcgagcacaacagtacacaacatgcagatcggaatgaacccattgcaaacgcagtaccaggtaacaaatcaacttcacctctccggaaagacttctctctttatgggaagtaaggcagcgttcgagagggtgagagagtgagtttgtttgtttcgttttccgcgcgcacatttcccaaactactgtgtttttttacaaaaattttctatagaaaagttgctttaaaaaatcatattaatccatttttgaaatttaaaatagttaatactcaattaatcatgagctaatagctcacctcattttgagtatcttcctaatctcctcaatccccttcttctcaaacacaccctaaacacaccctaagacatgtactaataatgagtgtgactgattagtcgcacgtgcaacaagaaatataattattatatgattaattaataaaaatgaaaaataaatttatttgattttttaaaccaacttctacataaaattttttatactaaattaacaattggagaaacatgctatagaaatcgaaatcgaagaagtaaccaatccgttcactttagaacagagtaacagactccctaaggaaaggagatcaagaattcaacagagatgggccgacccaaaaatatagggtatgttcactttaatatcatttttaaccttaccaaatttgagtattaccaattttagcatagttaccaaaattttggcaggatttcttatatagttatcaaaatttgacagcaaactaaatgtaaccacttttttgacaattttactaaaatttggtaaggttgaaaatggcatcaaagtgaacatgcccatattagcctacaaaatttcaggtactgtgtcctagtggattccagatccgacaaagaaacaaaagctcatattcgtgcacaaatcttgaagagaaatggacggccacaaaattcaactaaaatttgtgcagttcccagtcacctgaacactagcaaataccaaatatatacatgtataattctatctactactaaatagtacagtaagtcctaagaatccgtctggcgagatcatctgctccgcttttcttgtaaatcagatgcaaattgaacgcagcctctcttcgtacatcgcaataccctggcttgagatcctgctgggcacaggaattctcctcgtatggaagcctgggaatagggtaatctttcacctcaacggctaaagccttctcgtagtaaattgctgccaaggtgttgaggccaacatgatgatacgcccgagcgatgttgtacaaggcttcctacaaggcgaaaacatgattaacaatgtaccttaatttatctgtaactgctatttattcaacttgaagtcctgtttaactgacaagctagttttctgttttttgtggttgcaagagaacaaaataacgatatcaccccaagcacctaaacctcaaatatccaaaataaaggtgtgctctaccatctatttccagactcctagccaactaacaaccatgagatttgattatggatttgcggcgtagcaatgaacactgaacaagatggatgcaaggtggcccataagcccatgtggatgggaaggttgggcattgcgcacatttcgcaaattttggcaagcacccgtgcatggaacaacacaagaagccagatttaagcaaagaaaagagtaacagagtggatgtaaaacaattctgtgtttcttatcccacttgcattatattaaccaaaaatgtcagaaatggtaaaaaatggtaaactttgaaagtaattgtcctgaaggaatagaagatctttttggtggtacatagagagtttggttaacaattgatggtaaatagggcatttgttttgtgtaaagaccaagtgtaaacaattctctctttttttttgtgtgtaaatagggcatatcaagcttggtgtagcaaccaagagtgcaagaaggatttagaattcctatgtatggccttatttcagtgtgcattagtattgcatactgaaaatcaaaggcaaacccaaccgaaaccaaatgcaggaccagaccaggtcaccttcctcgattcctcgattgctgctgtaagccttaacaccagcttttaaccatgggctcctataagtaggtcagctgaggtgctcccagtctggtgttataaattattccacccaggcactgaagtacggaaagcaagtaacggatgcatatgcttctgccctgtgatttgtttaatcctgtggacctgacctgccttttggggcgacatgcatcacaaagcgcttacagcccaggcccaaatgatgcaagtgctcagcactgcaggctaaccccagccattaaatttggtaaaaaaggaaaaaagctcggccactaaacccataaggaaacagttgagccttactagcagcttagatgctgaaaatactagagcattatccatatggattataaggacaaaacctggctgttgtcacaaagacgcagatatcgaaagaggaatgccaaagcttgaacgatgcactggttcttattctgaagcctaaagccaagggctaaattaattagagcagatcctgcaaatgattgaacagctacagttagtactcttatatgttgatacgtgttaatgttaatacttaatgccattgttttggtggcataccaacacagagatttataaatggattttctgggttcaatttataagcttccagataatcacgagcagctgactgatgctggctgatagccgtaaatcgatggccagatatgattataggaggcacacagtcagtcttttcttctcttgtccgtagaagaaatttatgatgacgtgagaacctatcttctattctgcaaagaaaatgtgaaattagaacaagtgaacagctgcttttgatttcaaaattttcatggtgcaactcgatatatacagactatattgtttgagtattatcagagagtagtacaacggaaactggaaactgaggagcctagcagggcaagagcaatgtcatacaacaccagaagggctattggggaagtcctagtggatattgcatataaaaaaaataaaaatgtgttgaacaaaagcatgttctaacgaaagtggagattaaagcactacctgttttttttttgaaagcagggattggaaaactaggactgaccaacaatcagcattttaacaagccaggtgagaggtttcaaattcggagttgattaggattcaactgaatatgctaggtataccattttcaaatactctgtcaaaacatgaagaattgacaacacaactcagccctttttcatggtgtttatgccaaaaagtgcaaaaaggcaaaaaccaatcagccagctctaggataccttcacccaattcacagctgggttttgtggctacataagattgttcaacactgtttatcgctataatctaactgaaacgaaattactaatgctggcaaaaaaaaaagtaaaaggtctttcaaccggacaaaaaggaaccaaaggcctatgccccacaaattgtatacaacatgcaaaatacagaacatatgtagtgtgaccagtataaataaatgcaaaaaaaaatcaatcataatcattccaactaataaatgcaaaaattcaatcataatcattccaactattaccttgatgtcaccttgtagtatgagttccatgcagcaagggaatatggatgctgctgaactacatagcggacataattaaagccatgtctagggtctggagctctataagctatttctgcaaaattgcaagaacaataatatcaagtcaaacgaactgtcataaatattaccaaataacctgtctcgattttcataatataataagaaatcgatgaagtgtcagtgcgtgctactcaatcactcattaagagtgtcaacaaaatgacactaatatagttgcaattggcaaccagattcactcatacaatatcaccctggtctcattctttaccatttcctgccccagcagcacctctccattgggcctacccgccactcctaggtacagccagaacatagcacttacggcagaaggcatgggaattccaatgtggagaacttcaagaccagctctgtgtcccacatcagttaacttttattatgaggtgtgaggtcattctgatggttgcaaatcacataattgaatggaagttcctagttgcaatagttgcttgtttggttttcccacactgccaaattctatatgtttttctctagctgtttggttaattgccacaattctgacgtgatagtctttttgccctagagccccctttcatacacctgtatgcctaaggtgtggccagcaattagttttatttaccaaaccttttttttagaacatgcaggagatctgcgattaaccaaacctttgacaacatgtgaaagggaaaaaaaattaggaaggttcaaacccatcacttcttgacatccgtatggatggatggtgagcttacatcaactgggctactgcacttagatgattagaaagggagttaacttttttcagaacagagcaaaggatttgattcttttactggacctttatctgggtgagccaatctgtcacatttcccagactgaagcaaaccatgttaatagacagtttggcccaatctgaccagtggaaaggatgatcatcacatggggaaaaaagaggttaatcatttgaaatgagaataatggaaatgttggatcaaaaactgaaatctatagtatgtcgtcagttacaatgaactaactgcatgtagcattttatcaattgaataatacatagagctgggaatagatcttacgagcacccaaggatctgagctcctctttgttctcatcagcgagagtatcatttccaagtttaagagtacggttgataacttgtagagcctcccagtatcggtgaagcaaagctaatgtttggcaaagctacaaaaccaaggcgaagttaatagccagagtatgatcagaaaagcagcatcaagaagtgagctatgtcaatgtagaacagacatcatggaaacaatcaaacagttggccaaaataacagggtacatataaaacatgcctgctattatgtagaatcttattttaccattgcacattaagctatgagcactaaaatgtacaccacaacttagtgtttgtgatgtaagcagtatgtctttgatggggcaatcacaataggcctataatggtgaactaagacacgatttactgaggtccacaaacttgcatggatgtgacatctaggtccttgtactcgaatttaggtgtggtgggtccctaaatttgcattacagtagcacttagaaccccatagttgtaggcatatcaatttccaagtcaactaatgtttgtagttgacataaccttgcaaagactaccaatgtgagcagctcatgcatgtacaaaattaatcacaagccgggaataattacatctccaattccttcagtgcaatacctcaaaagctcagaatcacagcttcaaatcaagtacgagaggggatttagaaatacaaagaggcaaacattagtggttagcacctaaaactgaacacagtaccagcaagatattcgaatatgattatatgaataaggtgcgaggaacaaatggaaccgaaacttatttaagactgaaattgtgctgcaaagggcctacagtctattaagtaggacttgctcaaaatgttatgaataaagcgaagtgtcaattgcaaaataaaacattagcaaaaaggggtagggaaaggcatctgccaggtacggacatgtaacacaagttgatggttctctgcattcgtaagtagaccagatatcggaggtatttgcttcgacctttgctaaaaatatcaaacaaggaaggcatgagtaatttggtttggggaagaaatacttccaagtagaaacaccagcatagaaggaaacagataccagatcatcttttatcgtatcttcattcgaagctgctcttttctctagcaacttctttgctctgcttgccttttgtctagtaaaaagtttaacaagcgtcaatacaaacacagaaaaaagatacgtcaggcaaaggtgaggtcaataataaacatggccctaagtaattgttgaatgtaatcaaatcagaaggcagcatgataactgataaagaactaaagactggtgaatatagtacatgaattcacagttgccactttcctggcatctgggtcaagtggaggtcaagatataaggtcatgggaccaggtcacgggttgctaaaaatgtgggccatatgggggtattagtcttcagtattcacgacagtagtgcaggatgcaggacgtgatcctcatgaattagtgaccgaattatcaagcaagtagttacaatatgatccaagaaaatttctacaaaaaagacaacaatagcaaaggaatagctaggaatagattgttctagattgtgtgcatcatcagaactgacatggaactccacctgctaccatgcgtgcaaaatacatttgtggactgtggttctgtgtattctacctaaaaggccaaagcctatttatggctctcaaactattcccaactccttttttcatccttagtttctaaaaccacgcaaataacaccttacaccctattctgtggtggtttttgttgataaatattttcggttgcatggacttgtgataaactagtctgataaaaataaaagataagtaaattgcatcgccggcacacgaacttgtcaggtgggtgcaatctagtgcacgaacttgtaaaatgctcgttttggtgcataaacttgtctggtgcgtgtggaggaaggcgacacggctaatcttattgatttaggggctgattaggatacgatgtaaacatatatctgagaaggttgctagacatatacctcttcaataaaaaatagaataagatatagtgatagtagaaaaagattaaaaaaactgagcaatgatataagggttagaaatatacgaaattcatcatttccatgatgaatgataaagtagagaccaaatttataaatattgcatgtcttatacatactcactactatgcacgtaatatcttaataaacatcaacttcgtaaataacattgccaagttatttttatcctcgtttggacaaactagacaagttcgtgtactgaaacgagtattttacaagtttatgtactaaattgcacccacctaacaagtttgtgtaccactaatgcaatttactcaagataagtaaattatgaaataatagcatgcttacaactctgccggtgatgctattggccttaatccttgaaacacgctttctggacgttgttcagctaacactttggctctttcatatagaacattagttggaagttttttagctttcctcacctgattgaaatgtcacagaaaatacataacatgaccttaacacattaagcttcataccccaagagcaaaccataaaccgctgggcatttagacatattgttatcaagaaacataaaaataacttgtatatctctaccacatattaaaggaagaataaacaaagatgtatgagaggaccacatcatcctatctctccaccacctgttattcatccattaagggcaaatagaaaagcactacattgcaaataaaattatctagaaaagcgtaaaagtgcacaatagaaaagtgtaggttcctgaacctaccatggttgccatgccatgtgccaatgtgtaccccgtttggtcaaccaaaaaaagcattacacgtatataaaatttacagaaaaaatagttgcttcatagtcaacacatgaacaaaatcctagtttacaaaatgtcaactcaactattgcagtagtacccaaaaaaaaaagtgccccaagtctcacaggtctacacaaattctgtattaaaaagcaacacaatttgatctcataacaagaaaaatatttggaagaacaaacaaaattattaaaaactaacacaatattaaacccagcatatgtgccttcctaatcaaattcctggaaagccaagaaacaaatcaaacacataaagctatttaacaaatttcaaagtgattcaacttcaattaatcttagtagaaagttgttgtgcgcctggctaaaaaagaaaaagaaaaagaaagttgttgtgcatgagttacacaaaagcaagcaggctgatttcatagctcatataattgataagacagtaaaggaaaaaaacatcaggtggaatacagatcagcaagaacaaaaacaaatactaacactgtcccaaaatatagcaacttttccacctaccgcttcttctcaaccaatcacaactatcccccattcaatttcccctatctccttaatccccatgaaaaactctagaagtgcttatatcttgggacagagggagtagatgtgcaatcattgatcaagtaaactaaatgtgaatcaatgtctctacctttcgattagcatactcaatattcagtgtttcaagaatgggtataagaatggtgcccacaaagtcctcgaacatgcctttattgtaatatatgttcgcaaggtgcatctttactttcccatcaagccaccatggcttcggttgatctgtagcagactttgaccctacaaatgccattaaaaaaaactgaacaacgaaagcagctaattgcattgaacaagctagggatagtatacctgaattgttaggaggagaaagcaaaacaatagcttcgtcactcttatccacatcaacaaaaagagaggataaagttattcgcacatcaatgttgtcctccattctttgcaaggctatgaaagaataaagaaaactacatcaaagattcaaaattgataataatggaaaaaactaactcaaaagaaattaaataaacaaaacctcatgccgaggatgttgaattcccagcattaggggtaaccgctcctttacatagattcaaacctcacatatgttctaaaaattctaaatgaatataccttccaaattcacaatcttatatgttatggacattgattcatggataggataagggtctgaaacagggataaaggtgagatcgctctcatcggtgttagccttgtcccgatcatcaggagacactaatacataagtttaggcctagcttgatcagagtctcctagtgatcaggacgagcccagcaccaacaatagcaatattgtttacatcccaactttgaataattgtcatttctattgcacaaatctcagagcaattcaaatggatagtatagcaggagtacatgaaagtccagaaatgtggacttacatttctcaaaagaaccttagaaatacatgtaacaccccagcaactacaataagcctgagacgttactaaacaaccatgaaacaatgccaaaacattgaaattctgcagaatcttctcacaaagaaaagtattatggaagcatcaatatatatatatatgatataatctagagccaacagcatgctaacaagtaaaaacaaactaagcaaagttagataaaccaagttttacgtctcaagtgttcatttaaactattaactccataagtacatctattcttcataaatatgatagcacaacatttaaaaattaaataggaacatggcgtgcaaaagttttggtactcccaacctctaaagtaggcatgccacatcaaatacctggaaaggctgtaagggtgtgaggataaatctcaactagcgaacagctttaacaaattctttaaactacaagttcattaggtcatgatataaatacaggagtacaagatcattttaagtaattgtcattctgtcagaccataatgaaaacgaaatttccgtttttcttctagacgaatacgatattgctatcttttaaagatactttaggatctaggtattttactagttagtcctggtaaagctcccagacggcgtatttttcgaaacgaggtcctcagtaacgagacataaagactcctttttttttccttttttttctttttcgtataaaatccaaatgaaaactgaaaaaacaagttaaaacttgcaaataaacaaacttcataacttcatgagtgaaaataaagcaacattgtgagaagcaaacacatctcaaatataactccaattgtataacttccataggagaattgcaataagttatgtagagtggcttccataggaaaacacctattgcagttttgctagatgttatacaatcggggttatctttgagaagagttgcttcttgagaagttatgcagatgtggctttactttcaccaatgaagttataaagtttatgtaaaagtttaacttaatttttttaatgaggttgcactctcgtatttaaataatcacctaatgaacttgtagcttaaataaactgttaaagcagtttgcttgctgagcaatccttctaggtacttgatgtggcatgcttgcttgaggggatgggagtagcaacacacttctgcacgtcatgttcacatttaatctttaaatgttaagttgtcattttaataaaccataatgtatttattgagttaataggctaaatgaacacttgagatgtaaaacttagtctatttatctttgtttaggttgttttacttgttagcatgttttttgctcctgattatattaccagcatcttaggcttgttgtaattgctagggtgttacaatattttttttatatttgttctgttttgtcttaggcttgttgtaatacaatttttttttcatttgttctgatttgtcttttctgtatggccatgtcatgtctgcatttctcagaatcctagaatgtctcgtgactcttgtctatgatttaagaaactcaatctccataaagtccattcaaataacagtcaccacccctgacaatagaatttattctctcttttgtaataccatattctaacgattttgagaacaatgcatagaatctggtgtagggaatgcaaagcagaacaattatggaatattatgagaatatcagaaagcaaattgattcagaaaagaagagacagggcataagatcctctccatgtaatactactttcaaagctccaacaaaacattgctgtgacggattttcaccagcattatctttttatgtatatcttaacttcttaagcaatctcaagtttgctaccaaagaggaagggtttcatgaaggaaatagaacagaacctttctgaaagtaaggaattgctttccttttctcccctatgaccatgtagcattgaccaactttcacatatgaactaccctgaaacaagttatagtatatcaaactagagaagggtgaaggaaataaaatatacatacaacttcctcaatcccttaatggactaggtgattgcgatggtgtgctttacacccatcctttcatttccaaaatatcatttattgatggatttctgtaggcatgtatttatagaatcttttatgaaggattgcatcctttgtacatgtgtaagcaagtgactagttgatccattgtgaattagaatgttttctgtagatttttaaataccttttttttatgaagcattaaagcagacaaagcccattccccattcctgatcatggtaccattatcaagccttctaaagagcatgtacattctaatcaaatttggaacatttgtggctagctagaagatctacatgctgttaaaagcacattctcaaatgattaattgatttttttatcatatttatgttcaaatcagctaataggaactgctttgcccccaacttctttcagtagcagttgcctggcttcacctcttctgggttacgtagttacataattttattccactataactcacgactaatggataggttcaaatttattatgttgagatgggcttccttccccttccaaaaattatactcattggaatcaaaccagatgtttgtttccaattaccaagtctatcataatcgtattatgcacttatagcattaccttgataagttatatatgtcaaaagattcacaggattgaattgatcttctgaagacttcacagcatttaggaaaaagttcgcttaacactttgtggttagtcaatgtggacaatgacgtggtgggtggtgttgcttgcatgacacacacaccaaagcatgtttcacccaagtttgcccaagcaatcactttctttagtcagcaagcccagaaaccacctccagtgctatttgtacttcttctccaagctattctgctagttaaaaaatatttaactgaatccatcaccatgtcactgttctcgtcatcgtccacatggggaaaacacttacaatacaactccaggggggagggggggtttcaaatagttgttcatgcgttggggagtagaatatcaggttttgtacttcagggggttaagtagaggttttggctttttgccattatttataaatcatatggtcctaattatcatttgttccatgcttaattgaacgctagaaacatgtaatagtgaaacagaacttcaaaatgaagcaaatcggctacttacatcattatgaacagcaacatcttcaatcatcaggtaaaactttattgcatactcatattgtcctaaattttcgagagtgctagcaacctccttgatcacatcggtgttatcttttgaacgctccagatgcacattctgaagaaacacctgcacaagtaataccaattcaataactaagaaactcaaaactatacgttgaagtagtcttggatacagtatatacacaagcacaatctaatcttgcagagtacaacctgttatcagagcaatttatagtcatatcgaggatttatagtgtctaataaaccaatggtagcaaaaggtgggttttgactaatcaaggataaattatgtcaagtgtgtgctataatggaacagaactgggacaaacctcggcatgcttcatatctccaagataagcatggcagattacagcttttgcctgcaattgtactggcaaattgtgttgagatccaaacactatatgtgctctctcaatcagcctcaatgcttcattataggcattatttctcagataaagggatatcagtagatccagatgattcgagtcgatgtttgtagtttgagcattcacataatcctccaataaattaatagctttatcaatttgaccacagtccctgtacatctggacaaaaaagtcacaaagcaataagtggaagtctagaactaactcagcagtccatattgttatgtactggcttcagtgattagatagcagttcagatatatgagttcttagttgtgtcatgtgcatccaggtgtctagagtcaagtcttagcagttggcatccaggagtccaagagtctatagaagttaagagccctcatacttgcttgtgccttaagctaaatagagataagtgtcctgtttggatggtgctaattggtcttgtttacatgcatgtctagggacctatatgtttgtattcattgactcaaatagaggcatgaaagatcattatatctgtatctccctcttgtccctgactacaatggttccctgccgctggctaccaggaagaacctcattcaccaacgctactagcccataaaagctaaaatcaatttgtaatttatatgcaccacaaaataacgcaagaattgttataagcaaataaacctgtgctgctgctttacgagcaacaatgtttgaaggataaattctgactatctgctcgtatatctctccagctttctgatagtcatgcaaagcgcgatatatattagcacaatcaaacttcagtcctacatcttcaggatctgctctcatcgcttttaaaacacagtgtcttgctaaagcagcatcttcctttttcctgacaaatataataaagtagtcaatatggtccgttatattattatttctggccattgtatgccttacctccaagaaaaaattatgctaggtaatcagcaattaaggtactttgggttcatgtattaacaagaactagaggcttcctgaaaattagtatcataaaacataaaagcaaaattgaggtctgaggatgagaccatattactgaatgcaacatttgtactctgcataaatcaagctaactactgtaacaaattaaaagtttatgaatagaattaaaaaaatgaaacatagaaaaaggaaaaaggattagcattaactcacaatgccatgtcaatgagtttcttccacaaaaatacatcctttggagaaacatatgcagcgagcattagaaagtttatggctttatctagttcaccgcactctttataaatgctaccaagtagatggtatgaatttgacaaattcggcgcgatccgcacaacctcatgtaatataggaattgcctgcagtttagtagagtagacaaggtaaaggttactgtcatcctaatcaaacaacataatagaaattgataaagttagattgtaaaaatttctaaaaattctatagtgttgaaatcacatattttatggtcataactgcacagaaccctatctttcatgcctaatgttactaaaccccaggtttcttggtcataaggttctggaacaaatgagtctgtaacaactagattagtcaaactggcagtgatactatttacactgctggtttttctgatgaaccggactttccttacatcaacaattagtttcacctagcaacccccattgctaccacaataaattgtagtttggttaaaggtgggatttcacaaaggattatgagtcttaacaagctaaggctgtgtatttgacaacctgccctttcattgatctgttggttgtagttgaaggttttgaaatttctgaaataccctcaatcaaacggatggctgtcttgtttgatgattaaggattaacattacctgattttttgttaatcttcatttacttgaaattattggtatatgtaaattgactgcaaagataatggttgaatgcggaatctcatgaatttaacattttctgtcttgttccaagaacagtatatctgagctgtgttttatccaagaaaccaacaggaaatcaataagaaaacttatagtatgtgttataaagcaattcttgcaacacaggaaactcatctccagtaagaatctgaccaaatggagcaaaactcttaattgttctaatcatcagcgagcaattgcatctattcttataaacaaaggaaacttctaactcaaatggatataataaaccaagcctattttttggtgttccacaaatctgtttcttcagaagtggttcatcagatgctcataagaactccagaatcagaaatccgctctgtatttcagcgacttccaatatctaaacttgaatagtcaagaaatagcaagacgaaaagtcacaactttatgttcattgatcatctccagttcctaaggaaagatgggaacaggaattacaacaagagttaaacatgacacacaagccttggagaacagaaatgtgttcacatggcattcacatctttgatgaagatgaggtgactgcatgatggtgcagaccttatcaccccttgaaactgccatgccccgatctagtttctagaataactaaaaaaaggttgttcgttctcaatcttgtttccttagtaaaatatcctgcctgttacgcttcctagccaagttttcatgcctagcgcacctaatcaatagttaggcacagagccccagcctgccacctgaccagcgcctagtacttggattaacacgactacacaagattataatcaagcataagcagatcaattactaataatccttgtggagaccagctcatataatctttgaagacactgagaacttggacagattaaggtgaaaacaattccaaagcatactccataacaaaagtttgtaccaatagtagacaacgaggtcaaatgaacatgcaaaattccaaatcatccagctgatccatttagtgatcatgcaacttatgaatgacaagaagaaaaaagagaacttccagtctttagctaaatcagaagcaacagtcacaatattgccactagaaaaattgagtttgccacaacaacacaaatacacaataaacgtccttcaaaccacttatccaaacatagagcatgtaattaatatcccccaacaactattgattagactaagaaagatagagattagacctccttaaatctgctctctgtaaaaagcagtgtggcatcacccaattttttagtaacttcaggactgtacttattccttgttcctttctttcttccccttttcctggcctgatgaaaatgaaaatataaaaagtaaaaaattatgttgatcacttatgaactgcattgagaacaacactcaatctcaagtgtaaattaaaacttaggcatttacaccaaatattttccaaatcaactcaagaatagtttctacaaagatttcatttctataagattcaagacaaaaatatacttgtgttgtgcacatcgtagtcaatgctacaagggaattttttttgcatcatttgtgctgacaaattaaaaaaatggtaccatacatctttggaccttcttttcctacgaaggccaaagccttccattagttggtcaaacacagtcgctgcttccacttctgaaagcccatcctgccttggcttctttgaagatgcatccctggatgatgaccaagacattgaaatgtatactcaggaaatgcaattgctttgcaacacggtatgtgatgaggaggtgatacaatgcctggaacagacaacttaaaacagaacgcaaagacaaaaacaagctttaattatacttcgcaagttcaaagatcatgacatgaggagaggtgattgataaaactaaatagaaaagaaaaaaacaaagatatattttaagaagaaatgcacgatttgctcatgaaaccactactagactagaagattagagtatagaaaaacagtagcatcagtggaattacaccaaactgtaacgaaatataattataaagctacttagcaaagagaaattatcttagggagcaggttcaacgagatcacctttcggttcgctcctcggcgagggccttgcgcttgcgcgcggcgagcgcctcgtagtcatgcacgccggcgtcgggggcactccgctccgccatctccacgcactgcatcgcctcctcggcgtcgcagaactcgtactcctcctcctcctcttcctcttcctcctcatccccgtcagggtcctcctgcccatcggcccccgcctccgcccccgccgacccgcgccctagacggcgctcctcctccgtgtccgacatcaccggagtgcgacggaatagagggttcggcgcagcagcggcgagctaccggggccccggaggccggagctgcggttaccaatgttagtgaaacctaaaggcgggaggcgcggtggtgcaggcgagacgccggggagggagaagacgagaggtcgacggcgatgctgcggcggcggaggacggcggcggcggcggctggctagtgtgggggcggtgcgaggcgggggagagcaaatatgggccggatttagtgggcttatgggccgtaaagccatgcggattgatgcgaggcgccagatcggaatggtttaattactaagttgatcgaaaatattttaatcttttaaaaagctaaaacacaaccaaatcatcttcatgaaacattttgctacaatgtatgaaacaaacggtttaaaaaaatcgggtgttgtttcaccatatataaaacaatgtttcagcaaatagcgaaaggatgttttaattcacggcaacatttaatccatacaaagtgaaacattataagtacacttgctgaatcattgttagcggaacaaagattgaaatagattcccttagtagagagttttcataatatgtgggtaatttgttgcaacggggcacgtggtgggaacggcacggaggcccgggaggcgcgggaaggggcggacgcccgatttttctggcactgatcgggtgcctgatccctagcattttcgagattgatagcctcaacggatcttcaagtgctcattcggaattcggaatggagaagcaacagggaaaaattgagggctttttttagtttggaggacaaaaataaagctcaagaattaattttatgtgagtgttattcgttttgtataggaaaaattacgaattaccccctaactattgcgacagtatgaattacccccctaaccacaaagagaaaattcccttcatacccttgaaattttagccaatcctttctatgcccctgaattttcttcactcccttgtatacctctgaattttgatttggatcccttccatacctttgccgtcaattgaccgttagttgaccgtttaataggtataaaaagtcagttttaccctttaatacgtgaggaatatgtagaaatttgtaaactatattgttggtagtatagaaatttattgtgtgattataatatttgtaagtttgttgtacatagaaattttaatatatattaaaaaagtatgtgtagcattttttctaaatgatagacatagttttggaaagcattcctatataatatatacaacatgaaaaaatgttcaactaccataaaaatgctacatatactcttttaataagtaaataaatattagtttttatgtcattatgtaaaaataaacttagccatgaataatacctcatacaataaaatcataaatataatagtcttatatgacaaaattatacacttcaaacaatatagctagtctacaatttccagatttccttcatgtgtaagggcaaaatggtcagtttcatagaaattaaacattcaactaactaaataggcatgaaagggatcaaaaccaaaattcaggggcataaagggggtgggcaaaactcaggggcatagaaatgattggttaaactttcaggggtgtagaagaaattttctcaaccacaaaaccagacatattaaacctcgaactattgtaaccggacaaattacccccccccccctcgactcaatccagagtggttttgatcgtacgtggcgccgatgtggaaatccaatcagcaaaaataaaataaaaaatatagggcccacaggtcatactaagcccttctatctgtgtgttgttggcgttggaggcggcagcgagcagcagtgggcgcggctctggtcggcggcgggcgcggcagggagggggaaccggtcggtggcgacggacgcggctaggcgagtggcggcgggctaggcaaggagggagaatcggtcggcggtgagcggcgacgagtgtggctgggagtgtgctccaagcgacgactggagcggcggagaggaagctttggtcgtcttcccctccgatctccctcccctcccaccccccaaatggcggatcccggtgacgccgccatgcgcgccgacctccccttcaacctccacctccatctccatctccacgccgcttccgccgttgtcccatcgagcccgccaccagtcggagccgcccagtcacggccgccaccgctcaccacccagcttcgaccacggccgccgctgtgcgcggcgccgcgtcgtgcgtgacgctatgagcaccaccgtccacgccaactgcctgcctgcccgcccccgcccaccgctcgtccgcgtgctgtcatgcgcaccatcttgcgccgccgcccacctccagctccaacgtgtcggcctgtgagagagtgtgtgtgaagagagatggaaggggagtatgacaggtgggtctcacattttttttaataaataaaatgctgactacattgccacacgtacgccacataagacaaaaccgctctagattgggtcgaggggggtaatttgtccgatattgaaagttcaggatgagcaatgtctggttttcgggttcagggggtaattcggtcgaccgcgatagttcagggggtagtttgtattttttccttttatttttatatgaatgtaagtatagtaagactaaaagaaattttctttcctataagtcgtagaagtgtgcatgcataactatttctctatttttcactgtagcattactcggatcactgaaaatcggttctatacgttggaaaattttctaccctagcgatatcacgggaagaccacagggaataaacctcactaggctatgtgcagttgtgtccaaaatgcttgggtgggatagtagctactagctagcctcacgtgagtattgtgactcgctctggaattcacgcctcagctggacggacacagccacaggaaatgtcaagaatcaaaatcaaatgcaaaatactgcataattcaaatcagaacaattcggaactctcctaaaagcaaccaactaaatactgtattttagttcagacagcggatgcaattggcttcagttttgtctcacagtggtgaaagagattatctgcatgttaagtatagggaaaatatcttcgttcctgaatatagcaaattacggcctcatggagaataagcgaaacggtatatttacaaacaaaaataatttatgaataaaacttttatatacgtattcttagcgatctaaaagcaaaggctgaaaaataaacttcgataaaaaaaaccctaaaatcaacttcaaatttaaagttgaaaattcaaattttagttgataaatataagtataagcgaaaagataaggccattagtactgatgggatgtagtatatatactagtacttattattttaaaaaaatatgtgactgatggtgtgtttgcgagtgaccagcataattgtagtgtaagttttaattaaattgtaaaagtaggatttgactgttttctgttcttttgcaaaatgtggagccatgatacagctagtcccaaaatatttatcgctgaatcttaaaatatgcatgcataatttccatgttattctattcatattgtttgtttcaatagtcacactataaattttgtataatacacatcatatatgagaattaggaagtaattacttacctactaggaaggagataagagagtagataacaatcacaaagagaaagatcaagcaaaatgactgaaatcaagaaaaaaatgatgcgccatatttttagctaaaccgattaatttttctatactttagagcttattaaacttaggaccgagcctatcaacattcacagggaaattattgaacgtgaaaaaaaaacatgtgaacagaaatactagagctacctgcaaaaggaactaaactcattgccttaaaaaaaagcaataaacaaacatgaggccagcaaggctctactagagttcaagcatcaaaccaagcacaacaaaacaaggtataaaactatataacagtagcacagaaaaaaaaaatctatggacaaggcctacccagtacccacctcaccctgccctgccatccccccttgtgatgtgtgaatgtctctatcttacttgtgatagccagtatcctcacctcacccacagcccaccaatcacagcactcctttgtattctctctcctacatgcactcccctctacaaaaccacaaccagcatttttttcttttttcacaatccccttgacagcacagaggcaacagcaaaacacactctcatcagtgtcaggtctccacaccacacccaagtacaggtacacacaagacaatcctcccactgaactgaatcccatccactcctttatcatcatcaccatttccctccttcccttttcctcccctcatttccatttccagttgcagcaagagctgcctcctagctctcttcctgccatccatggcaaatgcttccctccaatcctttcttcttcaccaccaccattctttccttagcaatggtatccatgagggctcctccccttctataattctcaagctcacaacaaacagcaacagcagcatttcattcaagctcttctccaacaccacctcctcctcatcatcatcagtgaccaccacagcatcaacccccaactcaccggtgacccctgctccggtaacagcctcgtctccgccaccgccttcgctggagctcctgggcgcccagctcgccgagagggattaccggcaggccgacgagaccacccgcgcgctcctcatcgagctcgcgggcgagccagctcggcgccgagggtacgtcttcttctcggaggtgcagttcatctccgccgatgacctccgggccatcgacgcgctctggcaggagcacagcggtggccggttcgggtacagcgtgcagcggcggctgtgggagaagtcgcggcgcgacttcacccgcttcttcatcagggttgggtggatgaagaagcttgacaccgaggtggagcagttcaactacagggccttccctgatgagttcatctgggagctgaatgatgacacgccagaggggcatctccctctcaccaatgccctcagagggacacagctcctgggcaacatcttcacacatcctgcctttgaagaggagcaagaagatgaattagcagcagaggagaatgacacacctgataacactggtcagagtaaggatggcagcaaagggaaggagaggccaaagttcatgagagatttcttcaagcctgactactccttttgagattggggggtaattaaaaagcatgggagtttgtgatgcagagatgctggtcatggtgcaattgatttagaaaaaaaaaaaaaggaaacatgtatccgtagttcatctggattgttatgtcctgtaaacatgcgtgggaaactgcacaatatattatgaatataattgtttgagatgtttgctctgcacatgaatgatgcatgtaaagaagagagaaaaaaatagaatattctaagggatgcatggatgcaatgcatttgcatcctgcactcttgcatgtatatagattgtagggcaatgggccaatggcacttgaaatgcatgcatttcctttcgatgtgtaacatcctagcaaataccataggatgattcacaggtatccatattcccttcttttgcatcaaccgttgcacagtttgcaaaatggcgatttcttgttgggacaaacaacagggacaaagtttgctttgctcatcaaggagagccatcagttttaagctgatcatctccacttgtttcctggcaagtgattgtgattgatgtgacctagactgaccttggtgatatctcaggaattaaacgagtctcaaaaaaatggaagagccttttcagggaaaatacctcttatgagttatgacagcaacaacttttttacatttcacgcacaaggacacagccttcgggtatgttgatgtgaaccatcacatgtgagccgctcatccatctgcatgtacaagcatgctcctggattctgaaatagaagtaaaataaaattagttctatgtttttaccatggaaatgatgtgttatatcagcaatgtaaagcatcactatgtaactgacatgcaagtgaacattgatattacctatctcatgtgagatttaatgcttaaaatttaaagtttcatgtgttaataaataagtattgaccattttcaaaatagtacatgcgtaaggacttccaatgatgcaaagtaagaaatgtagaattctggaatgattaagaatctaaattagttcaataaacagataaccattacagcactactactacctagcaaacaaaaaatcagttcattgctcataccaaattgcttggagcctcatctacaacttgagcaggttgatctggtccaagattgctgaaacaaccacttttgcatctcatatatttctgcaaactggtttgaggaataaaatatgagcaaatatatttctacaacaagtatgatctgataatgccagagaaataaagtgtccacacgaaaaaagttgtgttgcgctagtgtgtgcatgggaaattgtttataatcaacatgaggatgtgctatcaacctgttgaatgtaatcccgtagcaagaaccatatggaaatatgtagcatgatactatttggcaagccagtatgaagataaacacaaccaaatatctcattcataaatagtgttgttaacagagtgatcaattatcaagttgatgctagcaaaatctcagaaaaaaggttttttttttcctgaagaatactgcggatcagcagttcagcacaacttcgttttccagccaagctgtcacacacgatgttaaatccattatgaataaacaactacagtgcaaaatattcagattctgcaggaattaggctgtactacgctactttcttagctttcgtagttccattacagcattacatatattgcaacaagcagaatttttgtctctgaagtcttcaatagttatgttgtgctccatttgttattttcctagtcacatgtgcatcacaacacgatatgaagatttacatggctgtctataactaaattactccaacaaggaaaatgataacaccacattctaatagaactgggaatagcaagtaaccactgtggctctaggatagagcaaaacagctaggagacaattggtcacccacaaagactaactacattcagacaatcgaaagttcaaaaaatacaaaatatagacaagttatgaagtataaataagtggggaacaactttgttacattatgttttcaaagtcaggctacaaaagcaaaatgtgttggtgatggcagattgatcatttgatggcaattgaaacttgaaaggccatgtaaatacaaaacgatattcaaaggttttcagttagacagattaaatgctccaatttaagtagtctaatactaactctttcaagttactttcaccgtagaaacattccaatacaaattaagttgctgattattcaaccacagaccaaaaaactgggtgtacatgtaatcatgcaaaatcattattaaaatattatttacttcaaaaactcaagacaatcaaaatggagctagctacttcgactagtcagttaaacttcagttattctggcaggattagccattttaaggacaataaaaaaaactacaattttctactgtgacacataatttgaagatatatcatgaacaaaagaaaagagacaagtaaacttacatctcacatttgttcagaacagaaagcctgcttggaacacatgattgtccttttgctctgcacacagaactacaagattcgcccctcctgaaatcaacattgatatcatagagcaattgtgagggtgttccattcactcttcctatatagtatctcttaaattggaaaaggccttaccttcctatgctgatgttaatgccatccagccttggtccagaaccagaatcagctgatcctgcaaaataattttttataatcatttcccccctacgtaattaaagaaaattgcaattgtactagtagtgaataaatggtagcagcttttgtgctgcctgggcaagctcagctcagattaagctcgaaacttaaaacaacatgaatacaatgaatcttagttcatcgtaagtaattaacatactcagaggaccagggatgaggcactagattggggatagggagaggtgatcatggagaggtagaccaattcacctttcttgcttacatcataactaatagcccaccaccttatctctaatataacaagagatagagatcttaaaaagatcatatattcaaccggactcatcttatctcaataaaccttactaatgctatctaaactaatgagcatacatcgaactagattactgtctaattcgctggtgaatttcccagacctgcatcctgttatggcccaatggactgcaagtgttttaccagactattggcctgccataacatgcaagcgacatgttctgatatcttggttccttcattctgtgaagttaaaatactgttgtctcggttcttatttagtgttgtaacttagttttccccacaaaaatgttacagggtcacacattctctcgccttgaaggggaatggagcccctgactttgttttggacttgttggccagtgatctagctgtcacatccatttaatggacttattgctgaaagaaggtgatttacatataaataccggaaaagattatgatttatgtagtatagccacaaaatacagtgccaaggctcatatccacccctactgggcagttatgtttgaatctcacagggtaactgtaatcccatctacctgaccaattaatatatcccttcatttcaaagaacaagaactactttgagggatacaaggactgaggaaaggatgaaaccaagagataaaggacttaaaatgaccatattacctaaactaaagcaccttggaaatatgagaggatgagcagtgatatgtttctaatcaatacagtagtaagactgaaaagaatcaacaacttcacatgaatgtcttctattttgcaataaaaaaatctaagctttataaaaagaaacagagagggcaccggacattatcatgaacagtaatataccaagatagctagcattgtaatataaccaatcaaaatgtgcatacctgaagaattctgctgcagcaagaagcaatgatggaagtcacttgcatacgcattttcatgtacctggttgattaaacaaaactttgattgaagaaaatgctgtttatcagaacattctagcacatagattttgtgaattgttgatttataacatgctagcatgacaagcaccaccaggatgtaactgcaccctgaaccttggttccttatttcatatatggcaggtaaaagtggaaaaccatttcatagaatattatgaaccgttacaatagaacactgcaaaaaaaaaaaagaacagtaccacacttgcagaactatggcggcatcttcccatgcagaaatcgaagacatttctgtaagttcctggagataaataaattgtgaactcccagcacattctagtatgctacatccaccaatcgatatcaacgagatcttaccagaagtaactggtctagctaccttcaacttcagcacatctgtttccttggtctgtccaacatgagtgcaaaatttaggaaacaacttgccaaacccaggattatacgtaatagagaaaattcaaacttactcttgaaggatttaagcagcaagaaacacaatattcataagaatcacagcactgtaaatcgagtttgcaacccctggttggtgccatgaagattgttaaatttataactgtacccatttattgcggtgcagagctgaaagtgaagtgagcaacaaaagataagaaactcactgacaggaaaaacgtgaccctgttcttgggcaacaccgagaccatggatcgatagataaggaagaacatacataacctaaaaaggaagtaattatcagcgggggaagtctagaaggcaaatacactgcttaccaggcagtatatgtgagcaaaatgagatgggcagggtgtcctaccattatcatctgatatcaggtgccgcccttgcacagtgctcctgcacatgatgggtgctgcaagaccaatgtccttcctgcacaatattcaaaatcaagccgcatcattagatatactgaaataaatactccaacatccatcctatattcaggatggaaagaaagcatgaatggcgtaacagtttgggcacgctaataagcttgacacacatgggtcatgggttcaaaggccacatgatgccatatacaatgaactctgtcccaggctactcccagttccagaattcagttgaaagcacaattagataagacaacccgttaactcgtagtctcgtaccacagtatttaactgaacacctgcacttctataactctattctgcactttgtagaggtcatgtattagtcagcaagaaaatgtaggcacaaaattgcattttgtgcactggtaaggtctgggcattactaacattcatcaggaaaccatggatgttagcaaggcactagtacatacacgaacccaacagagccaccattcctctttaacccaagcatatttctcccaaattttccctccatccttgccagctccatccatcatttcccactctttcactcccaatctaggttgatgtgtgcgttgaacacataaagctcacgattacagaaacaaaagaaaaaaaaaactttctgatttggctaggtatacatgccaagatttgaaaaaggatcatcgccaagccgagtaaatatcacaaggaatcacccgtgcgagctaagacggacgcacaacaatcggaacgcaccttagaccaaacagcaaacagggaggaaaaaataaattcaaattacgccgcattttcgggaatgctgaacgtggtgggggaagattaaacttgaacgggatctagctcaccgtatgccggcgacgaggccggggaggcaggcgaagaaggcggcgcatacgatccgagggaggaggtggaggagggggagggcggtggtcgccatctccgtcttggtcgaggagatcgggtgcagaggaggacgcaggacgccaaggaaacctacaagggttttgatgcaaagaaaaaaaaaacatgtgggccatctacgcgcaaaaaaagaagaagaaattccagttcagcttttcgacggagcgccggatccggatccctagactagtatgatatttttccgccaaatgattcgcaccgttttgccaaactttttgccatgttttgacaaattttaatcaaatttcgattgccttttactccctccattatcgtcatattttggcttgacaccaagactaaggcccttttgtttaggtctaggcttattgtcttaaacttttaagccggcttagtagcttatatgatttataagcaggtggatttaatatcctaagtttagaggtggagtcatacatctacctcacataagtcaaaaaagcttcttcaacctagcttttgacttaatagtgttagagtggcttatggtttcaaaaaaagtcaaatgaataagctgcttgtttgtttaggcttatactttttggcttataagttggcttataagcctcagcaaagagggcctaagaaaaacaatcgtgcttataattctactcgtaagcgcttatcagccaacgggccatgcatgcctcggcccacgcttcggcttcgcgtatttagcggcgtgtgcggcaacacttcagcttcacgaccgcagccaccacccccaaaacgcttcggctctgcaaaaatcaacacaaagtagatcaagtacatgaacatgtgttaaaaattaaagtagcaattcaaaaacactatcaatatgcctagatatattgttttcatataggaaaaggtaagtgattttcaacatggatagtttgacatcttcaaactcctcattgtcagaagccttggcaggaatcttggcaaatccaaatccatgatcatagccatggctgatccaaagtatgtccatcgctgcgtcgttcatgtcctgattgtgatctccatataagcaaggaaccatgataggaagcatcaaagttgagacgtgataagcctgcgttgtgctcaccttaggtgccatgatgatgtaaaagggcatgttccacgtctatatccatgactccttcgcatacacccccgacaacattgagctcgctctcggggacagcaactaggacaccattaagctccatctcggccacagccacaatcatcgccattgtttcatcatgtgtgccaagtacgatgttgacctcgctctcggtcacagcaacagcagcgtcatggagcttactctcgatcacatcatggacctcgagctttgccacagtcaccgcttagacttccacggcgacaatatctgcaacgtcgtggagctccctctcagccatgatcacatcttccttgcgtacggccacgacggtgtcgacctcgctcccgaccacatcaacaatagcgtcctggagcttgctctccatcaacccatggagctcgagctcggtcacggccaccgcttggacgtccacggcaacttgggtatcaggaaattctgtatcaccggcaaaggagtcctccacgacatgaacctcgtcgaaatcatacaaaatcacctcggcaccatggtgttcgcttagagagttcacttcctcgcaagtcatggcattggaaacgtattgctgtggttattaggatggagcgaagcggagaagagtttgtcttgtagaagaataggaaggagcaattgatctactcgatgatctgttgctgcgcacgcggagcaatggtgcaatgcattggccgggcaacggcgcgtagtactcccgagacacatgtgcagtgatggattaactccatgagcaaactgaaatggcgagcacggagtactattttaaatttgcattctcgaatacctttgaaatttcaatcgagatctacttccgtcctgcgttaaaacctcaaaatttcgtggttagctatatgcggtataactaatgaggaattattattattgattgagctgtgatatattttaataagaatacattaacaatatcataacttatgagttgcatttgatacctatcaaccatgtgacacacttgcacgctattttctaaatacaaatgttgatttatcgcgtgccatgaggctatttgctatcattaggtcatgcgacttgtgaatgtttcatttggtatgtttgtttgtttatatccgttctatttgtgttttgtctggaattatgcattagatgacataagcttactaatatctgccagatctattacaaccctatgcataattttacttatatccttaggcatcagaagaaatagaaactatatgaagttggcctgtgtcatataaatgcaacatagttgtcccatttagtgtaaacaacttgagtgacacatgctagatttacacatagagtgcctaataaaattaatgatacattaggataatttataaaaactaaggaattaaattgcacctatcttgcaactggaaatatcacagtacattttaagttgtacaatggcaatatgcatatataaattgatcttttcatactaactctgtgatctttaggttaaagtagagtgacattgggttggggtgaactatataacactatattttggcttagggcaacagtgtaaaactaaagtatagtttgaacctggtgtgagagagaaaaaataatgtataataaaatccacaaatgtatatatattgatatcaagttttataatagacatagattacttttcatacaagtcatctatgataatccaaatgtctcgtggcctaaagaattaagtttctagtgtttgatatttttttaaaaaaaaatcatatgactcatatgaactaatcacacccacatcacaattaatttctaataattatacgtctgaccttattctgaagattaaccatcagcttgactcaattttctttaactttgctcatctcttttttaaaatgaagctgacattttgccctattctaattacaacgtgggggaatacaattagaaaataatttagagaatgaagaaaaatgaaatatcccttgacataaaatacaactcatccttcaaaatatcgtcaaacatacaattttcctttaattttttttacctattctcatcatcgtcaaaatagcttctagagttttaatcgctaacacgacctccactaattaacaaaaggaaatagtaatacccaagcgaaaaggaaacagaaatacccagcatgaaaaaaatcagttgctattcgaatataataagtactcaatgccttttgttcgattacagataactaaaccccgttgaattcaatgttgtgcaaattcgtttcaatcgtactttacaaggagaagaaggtacaatgttctgaacgtgtgaaagaacaatgtcccacgctgcaaaccgcagcaccacaagccaagggccacgattccagatcaaacgccacaaactaaaaaataaaaaaaaaatcggaagaatagagagagagagagagaaaaagaacgatgagagcctccccgagcgcgcccacctcccacggctccggctaaaaccctagagcgcgcgcgcgcgagcgcggatgcccctcgctctcctcgcccgcgccgctctctcctccacctcctcctccatcgccatggccaccacgcgctcctcctcctccagggtgcttcgtgcctcccgtgcggagctcaacccaggtgaaacgctcgtttctttcttcttctcctctagtagtaccttttcttggggagggcggggaggaggaggaagctcttgtagcctgtttccattcattgttgccattaggggtattctagattgacaggtcagattagtatccgaatatatttgggcatttaggtattccttttctggataaaaatgtgaaaaagttgaggtatttctaccttggtgaggttatttcttgaaatgtggcagatagatgcttcttccagtctttattgaagggttgctactgatgggaggggtggattgtccattttgtttagtttctgtttataaagctgcgttgattaagtgttggaagttttgtggtgttattgtgcgtttgcttctggaaagtcatcctagaaggggaattttaggaagggtcatctcatgatttttttttctttaattgccaacgaaaactagcttttagtatgatatatgtattttattctgcttgttcttgatggaaaaaaaaatgaaatgaaagttcctgattcgataacaaaggcgcgagcaaacatggtggctaggtgagacctgctcagagaagcctcacagcagaggttagatgcagttttgggaggtcggtcaactgttatgcacccatttcacttgtttatgtggtttagcagcccttcctagatacatttgtgcttcccttcagccctcacatggtctgcaactgcaagaggcaaaccacaattacgaattggggccagaggagctcacaataagaagcataaagtccaaggcggaggctggagttaactgtgttgaccctgatggagatttaccactcatggttctttgctcgaatgcttgggcagctttcctctgtttgagcaacgaatgggttgggttcctttgcttttgttttgggttgatgatattcatgcgtttctcaaagtgtccaattatttatcagggcattactcacataacatagtttgcttgatgcatgttatttcctgaaagttcaactttaattcccatgacttcaatgtagtcgaattacctaacagtttcatactgactctgggaaagtatacatccattaactgccaacttaatctatctgccaactctgggaaagtacatatatggatttttaaagcaagtttagtgtaaatgtgtaattgattatttggtagtatgccttttcaggtgctaaagaagtgaaacgtgaatccagtgtttcttttgacttgaccaaaactgaagcggttgcttccatgagaagcaaaaatgtgaaacgggtgcttgaagtaactggggaaaatattaagaaagaggttggtgtgcacctcttcttggattggtgatgtttttctctctatcaatgaaacaaggcagagcttctgtcttttttttttcaaaaagaagaaaggaagacgtgcctactgaccaaacaccaggccatgtctttggtagttctattttaaaaaagtttcctgcatttctattatttctgtcggcttttttgtccccacaatttaaattctagtctccttaagaccagtcactctaagatagtatgatgtaaatacaccttttctcttcaactgcagttgtgcatttagcactcactttagtagttgctccttttctgccctgttggttggtgaactgaacagaacaattttgcccatatgcaggttgatatcgttcctgacattgaagattttcgatatggcaaggcatcgccatctttaggtaagaactaagaacagttataccatatagttaccaaattataatattcttaacactttgttccatgtcttgcaaaaaagcttacttttgctttcttcagttaggttggagaaaaaggtgagagtttcatctgctataaaaggtactcagaagactacctgatgagagaagctatgcatttcttgtttaacatctttgtaattttcttgttatgtgttagtttctttctctgccagctgatatcaagttaaatctgtacaaacaatattgacaatactttactgaagttttcagttatatattttatatattgctaaaatgtttatgctgctctggattgcaaaaataaacaatcactagattatgacttgcatcatcttaaccagaaggcaatatagtactacatattggttcatacatgatggctattcattcctcaatttcccacacacatcattcatggaatatctaaatctgttgttaagttcaaaattttcattgcatgttcacctactattaacaaaaataacaatcctagctgccaaaaagctgccaggttggtagcagaatgttcaacatcagattcagtgtatccttgtgacacatattagtgattatgtggccattatggcattatcaattgctctaccgtttaaacacaatatatgtcaagacaatgatttgttgtctattgtgtgaaatttttttcatacatttatgcagttggagctccagaaaattgggaggcaatccttaagggtattaaaaacatgaggttatctggcgaggcccctgtagatacaaagggctgtgaaaaagctggttctcttcttccacccaaggtaggttttgtgtttgcatcatctttctttttttgaccaaatccttgcatcatctttcaacctgagtgtagtatctagtgcagagcctatttattgtggtcagacccaagttctccaaatgctcattgtaggtcttgcacaggcatagtgcatatgtgattcccctattttattgtgctatgttgccatatcaaaattttagtgcaagcggtacacttgtcacacttcactactatgagtgtttcctgccacagaaatcatctgcatattaatatattattactcccccatccatttaactccattttttcattgttaaaaggttttcagccaactactattgtgtaactcttcttcatccatgtaatcatatacacatttctttcccaggaaaggagattcgcagttttgatatcaaccatgatgtcaagccaaacaaaagatgaagttacacatggtatgtctcatgaagatttcttttttggaattggttatacactatttttgctagccttgttatagttttcctatagctaaaatgtgaaaaatgaaaaagagcatgtgatctattctgattggagtgttatgcatactctgctgtgcaatggttcagatgataatatgttcttaataattgattggtagtacagaacttcatgctatgtgaccatcctgtgtctatacccttccatttgtttccccattgaactaaccttgtcataaacatcactttatgtaccacaactatgtctgtttgctgcatctgtactatattctttcatataaatgattattgtattttggatcaattgttatcagctgctgttgaacgtctatctgagaaaggtttacttgatccggatgctattgtccgaacagatgaggccacactagcgaatcttatcaaacctgtaagttgcaagaactgtttggtgggaactttcccaactacaataaattactgctctgaactacccaatataaggattgatcctacaaatgtacaaaagaatatacatgatctgcatatcacagtatgggctctagcaaatggtaacaaaccaaactttgaatgcatgcaatttagttgaagcataaccttgatttggacctcagaagacaagaagctagctagagctgtacctgctttgttaattgtactgttatagtttcttgctggaaattactcagctcagcctttgacatcatactggttattgtttaatcaggttggattctatcagaggaaggccaaattcataaaagaagcttctaaaatttgccttgaacgttttggaggggatattccagattctctgaatgagcttcttgctctgaaaggagttggtcctaaaatggctcatctggtagtaatactcattatatagtcgaaatataagcctatttagcttcacaatccctttttaataacaaaaactaagcaggtgatgagcattgcatggaagaatactcagggaatttgcgttgacactcatgtacatcgcatatctaaccgtcttgggtgggttttccgagagggaacaaaacaggtaatttgtgagttatgtcttttgtgcctttgaagaaaacaaattatacatagggaacatccattttgtcactgacaaattgccccttgtttactttgctcagaaaactacaacacccgagcaaacaagaatgtctcttgagaagtggctaccaaaggatgagtgggaacctatcaacccattactggtatgaatcggttcttttttccaccgctgatgttcaatttctaccatgtaaataactacataagatagtgtcatttgcttttaacactacatatctgaatcctacctaaactgcagaaatgtaagtcttatgtaaattgaaattattgtttttaaaatcatgcaggttggatttgggcaaacaatctgtactccacttaggcccaaatgtgacatgtgcggcataaacaacatctgcccttcagctttcaaggaatcatcaagcccaaatccaaagcaaaagaaaatgaggtcatcttagaactttttggcagggatgccttgtgtactttgtgtacatgcattatttactgacctgctagtgctggaatgctcttctaaaaggttggcatatttattgcctggatgaccttcctgcagccatctatcattttgtatagccattatgtagcattttgtatagccgtaatctattgagacaatgggtagggacacattgatcttgccagttatttattatgggcaaacaactggcacttggtaggaaaaagcttttgtaaacagtataactagaacaaaacggaggacgttcatcaattaccctgcatttgcctctgtttattgcagatttgcagttctcatggcgatcaacattgccgatctcttgtagaaatgagagttaatccatggaaaatgtaagatatttgaataacaaaatgtgttcagttctcatggcgatcaacattgccgatctcttgtagaaatgagagttaatccatggaaaatgtaagatatttgaataacaaaatgtgttcaaatcagaaaaaaaaacaggatcttcgcaagcactaaaatgggactacaagaatatgaagataacttttgagattcctaacaaaggaattaaagtgcatcaaccataaaagaattgagtgcgtaagattaactaagctattcctaccatctgtctctctaccaagatgctaataataggtttttttttttcaaaaaaaaagataagaaatactatgacagtttatccctagctaatgtatacacaaacacaaaaagatagtaatagctgaaaatgcagcagccgtagtagtaatcctagacagtaaacgccggcgatttcaggtccggcaagccggcgctgcgccggccgaccacgacgacgttcccgtcaccgtcggcgtcgacgatcaccgagtcgccggcgcagatctccccggcgagcatcttgtccgtgagcgtgtcctccagcagccgcatgatggcccggcgcagcggccgcgcgccgtagctcgggtcgaagccttgctcgacgacgagctccttgaacctctccgtcacctgcagcccgatccccttcccgccgatccgcccggtgacctcggcgagcatgatcccggcgatctccttcacctccagcttcgtcagctgccggaacacgatcatctcgtccagccggttcaggaactccggcctgaagtagcgcttcatctcctcctccaccatgttcttgatcaccccgtacccgccgtcgccgctgccatcgccggcgaacccgagctgcctcccgcccttctcgatgacgccgctgccgacgttggatgtcatgatgatgagcgagttcttgaaatccaccgtcctccccttgctgtccgtgagccggccatcgtcgaggatctggagcatcatgttgaacacgtcggggtgcgccttctcgaccttgtcgaacagcacgacggcgtaggggcgccgccggatcgcctccgtcagctggccgccctcggcgtagccgacgtaccccggcggcgagcccaccagcttcgccaccgtgtgcttctccatgaactcgctcatgtcgagccgcaccatggcctccggcgagccgtagtagtacgccgccagcgccttggcgagctccgacttgccgacccccgtcggcccggcgaagatgaagctcgcgatcgggcggcgcgggtcgcggagcccgacgcgggcgcggcggatggcgcggctgatcgccgtcacggcctcgtcctggccgacgatgcgccggtgcagcgacgactccatggcgaggagacggctcgactcgtcgacggtgaccttctccacggggacgccggtccagctggagacgatgtgctggacgtccgcctccgtcaccgtcggccccggcgactcgccggagtccaccgccgccttgctcatctccttgctcttgtcgaccagcgacatgatctccgacttgagctccacctcctcgccgcgaagcgctcccgcctaatttttgtcgaattcaaatgaattaaattttgattcgatgttcttatataccaataaatttacaggttgattgattgattcaacgaattaaaatttgtatttataaaagaaaattaccttctcgaagtcttggcttcggatggcttcgctcttctctgccatgatcttcttgagcttcttctcgagttctttagcttcatcaggtagctgtcaatatggtaaaagtggtcagataaaaaaaattgtgaacattattaatatgatgattgtgcacattaggatcgattcatcaaaatatgatgattgtttctacctgggcatttcgcagcctgacaagagaacctgcttcatcaaccaagtcaattgctttatccgggaggaaacgatcactgcaaaccaacaagtctgtcagatgaaggcagtgaaaagaggcacatagcaaaaaaattgctcaaagatccacatttcgtaacttaagaagtcaaaagatgcaattcttacaacacatttagaagaacaaaaggcgtattcactgcaagctaaggctgtcagacgtgagaaggcagtgaaacaagggaatggaacagttgaatttataacttctcatgaatcatcatttcataactaacataaaaaggaaataaaaagatgcaattttcaagacatgaagaagaaaaaaaggcattctaaacctaatattcaactagttggtagtactatcatgggatccaagagtttacatgatccattaatcttaaattctggcgcctcatcttttcagtctagagtagccttgaagaaaatttcagtactatgacgagtaaaaatagcagaaaataaattaatatacattgtgagatgcttaaagccacactgattatcttgcatgagacctgctgctgtaacagttctgttatcacaattcacaaacctgatgtactggtatgagagccgagcagctgcgatcaacgactcatcagtatactggaccttatgatggatctcatatcgctcccggagacctttgagaattcctatggtctcatcaacagttggctcagggaccttgacaggctgaaaacgcctctccagtgctgggtctttctcaatgtgctttctgtattcatcaatggtagtggctccaatacactgacagtaacaaagttaccttgagcacttggcaaaaattaaatgaactagaagctcatgactgattttataatttgacaagtaattttaatgagattccagagtaaatattttagtgttaattagtggacctgtggtaacataactcagacaaggtaacaccggaggtataaaatttacactagaaatatggtacttcccaataccttctcaaggactgtgaaaaattctaatttgatagaaataaaaagaaacagatttcaataggtagttattgtgttttttacagagaggtcaaccatgtacctgtagttcacctcttgctagcgctggcttcaggatgttggcagcgtcgatggccccttcagctgctccagcacccaccagggtgtgaacttcatcaaggaagagaattatctcaccattctgcttcacttcgtccatcagcttcttcaatctctcctcaaactcaccacggtattttgtaccagcaacaagtagacccatatcaagggtgataacctggaaaggatttcctacagtgagtaatttttcatctctactaatgatgtcatcaattgttcagatgtgcatgcaggatagatatcaaatcaaggaaagtgtccaaggtactgtttaccatgcttcctttctggtaatctagaaaggtaactcttcgcaatctcatagtgctcaaattgtaaattctgatcagtgagaactgaaactacagtagaatgcctaattatgctgataaattccagttccatagataaagccaacatgaacaggaagcttacattgctacacattttagcttgcaagaaattggtaacaaacaaaaacagaagtatactgagtctcaagagataggacgatcacaaaccgttttcccatcgattgtttcaggcacatttcctgcagcaatgcgctgcgcgagcccttccgcgatcgctgttttccctactccaggctctccaatcaggcaggggttgttcttggtccgcctgccgagaatctgcactacacggtcaacctggttttgccttccgacaacaggatccagcttcccctacaaaaaaaaataataataaagaacatcaattctcggttacttaaatttgtccctgaaatgtcctcttgtattgcaacatgatacgtctgtcaaatctgatgtagaatgctacctcctctgctagttttgtcagattagtaccatactctaaaagtgtgggtatcttagttgtactgcttcctcccccaactgcagcactaacaggttgatgatcttcagaggtgtcactgatcattcggataacctaagaggcaaatatatgaattgatgatatgtgtcaacttggattgaatttataaggagaacctccttttctgtctaaattcacctcactgcggatgttgctgggatcagcctgaaagttcttcagcacaacaagcgcggcaccatgctcacggagcaacccaagtaggaggtgttcagatccaacatagttatgccctgaacaatgtaagtaggttcagtgctagagaaatgaaaaaaaaaatggaatactttccttttttttttccttcaacaggagtagtaaagatatactagcagtaaaaagaactaaaaagtcaccatgtttaatgtcagttcccattaaaaagtacagatgcaaatggtcattaattcctcatgatcagtgttggtagactgatacttaagatcgctcatgtacgactgtacgagctgtttggtgtaacgaagaataacaacacggtgaatatacaaaccacccattgctaattgcatactaactattcccctgtccatagaaaatcaagccaatctggacatcagcattatcttcgaaatgcaattttgactgcaataatttctattgcaacaatgtctgtgtaaaatcaaatgaactagtacaatactacacaaaacaagactgcactttgtagaaatcaaatctacacatctatgtaactcgcatgtgtccaatttttaaatgttttagaaatagctatgcataaattttaaatgtgcccacatttgatttgacaatatatacctagctggtgcgcttcttcttgggaggcctggaggacgttcttggcggcgggggtgaacttgatctccatggggaccatgccggggcccctcccggccatcttctccacctcggcgcgcgccgccttgaggctgagcccggcgcccctgagcaccttggcgccgatgccggtgccctccccgatgacgccgaggaggagctgctcgctgccggcggcgtggtgccccagccgccgcgcctcctcctgcgccatcatgatcgccttgatcgccttgtccgtgaacatgtcgaaccccatcctcgccaccacccgcgcccccctcctcctcccgccgccgccgctcgcacgcccgtacgacgccgccgcgggtgaacggaggccgagtaatattggcggcgcgatcgggggagcgtggagctctcgccggcccgcggccgatgccttgacgaggcgggcgtgccgcatcggcggaggcgttgggatcatagtagccatggaggaggagggcctgatcctggtggcggtggtggtacggcatgccggcgatcggagagacggcggcgggttcagtagggttctctccatggtcgccgaggagaagcttctactctacgcctcgatcaatctggacaagcattcaatccatgaaagatcattaggttaaacggatgcgattaggtattaagagaggagaggaggagacctgttgatggtcggggcaatggcggcgcgcggccgggcggacgtcgccgccggtgatggggcggcggcgggttcgccggcgacacggaggagagaggtacgcacgcgtgggtggcggcggcgcggcgcggcagattccggtctattaatatatcaagggaggatttcgcgaaatctgtggctggagtgcacgcgtggcgtccgtccgtgatgtggatcggacggctgagatttgtgcacctgccttggccgcggagggacacgcaataagtcctttttctctgttatactcctatttttctgttggactagcaaagcgcccgtgcgttgctactcgagggaaaaggtacaccaaattatagctagagaaaacgaaaaacatgaataaagctacaataaaagcaagtgagaggatcggagagacgaatatggacatattattttaatccatatacgtactcaaaattcgtgactacttacgtcaaactacgcatggactatcaatagtcaaatcattttaaatcaatatcgacaattgatccaaaacatgagttagagctatagatttttctgaatttatgtacctttgtcgtatgttgttttgaaatcgtgacttgacacaatttagatgatggagagaacagttgggtttgatatcaattttgagttcgatatatgtatttggctctaattaataatgggtatgaaaataatcagcccaccttccaatcgtggagattgcttttcaaaaaagaagttcttctgcatatgtgcagaatgaagaatcctctcaagcaactggtttatgattggatacaaactatataggaatcatgtttttctttctcttctgtttttttctgtaactttgtaaatattctctttcatttataaaattacactgctgggcaaagtcctagcagttttcctagtaaaaaataataataatgggtatatagagataaataagtttatttggaaacttaagatgccttttaagattaagatttttatgtggtatctctttaaggggattgttggaatggtagtttgagatattgtttctgtatgaaaaatgaatcgatttaccatcttttcctagattgccattttgccagatttctttggagatctatataattcgcgtttggattataccttccacatagtatatctcatgtgtttgggaattggctcgtggatgttaataaaaagataaggaacttattcttgtttgagcttccgctgtatgttggctctctgacttagtagaaatgaaatggtttttgatagatcactttcaaaatctttgcaggttcttttcagggcaacatattggcttcgggaataggttcaattataaagacatgatgatcatatcaagctaataaaagatgcgtgccgtaaacttgagtcgacgatcatgcagctctttgccaacattgggtggagattcaccaatagaatttagtagttgtggggtctttacattgtttgatttttattagtttgcttctacttttggttttgttcctttggctacatactatgtgagtttgcttttgtgtgaaccttgtaataattgactgtagctcttgagcaaagcccaacatgtttcattctattatctagaaataaaatcatgaaatagagggtagagacttggatacaaaagagttatttgttacggttttgaagatatcgcgatatagaaatatatatctcatcatgagttatgtatatctctgtctcgcaataactctagacatgagtgattgaagatactcgttgccaattatactttaattttcgattgaaagactatagagcaggagataattgactccgataagtagggcacagtaaaccaccgatttcacaacatcttgtgttctccactcctcgattgagtatgtatgttctaaaccaaatgttcaacggggcacgacccaaacctcgtgttaatactacctccgtccgtaaatataagggatattcactgttctcgtataacgtttgaccactcgtcttattctaaaaatttgtgcaaatataaaaacgaaaagttgtgcttaaagtactttggataataaagtaagtcacaaataaaataaataataattccaaattctttttgaataaaacgaatggtcaaacggtgcaagtaaaatatctaaatcccttatattcacggacggagggagtacttgataagcaacataacatgaagtgaggttgtgagtctgtgactatctgtccacttgctcatttctttctgttttgacccaattgatggctttgtcaagctccgcaggtagggaggagtgccatatttcagtggtaccagtcacggtctcgacgtaacatggttcgactatgtcagtgtggcaaagcactgatttcactcacttcctggccacccaccctagggactcgatcgtagaagcatagcccagacgcttgtcttcttttatttcttgcggtttctgttctctagctaggtattagctatatgttccttgaccatcatgatgaacaagcacatggagattgagcagattttttaagataatagaagcttttattaaactcagtcaattacattaaattaagatgataaaattatcctaagaacattttgcgcagataaactatctcgacttcctcgtgtctttatttcctacatgtccgcagtggctagccgcttgaataattctccactcggtggttatgtgatattctctccctaagatcaagaaacacttgaccgaaatgcgcacagagacgctagctcgacttcctggtgcctccatttcctacgtgctgccctagccacgactagttgctctcccattttaagatatttggatcatgcaattttatttgaaagagggggcttctttcaaaaagaatgtaattaagagggataagaagtttcatgttgcattgcctcgcctttgtgatatatatagatacaaatatatgtagaaaatgtttatcactagaagtagctgggtggatgaacaaatgtgcatgaagatgagaaagtatgaattactagctagcaggcactaattattatcagaactgcaaagtggacgacattaatttgggtatgtgcattagtctatcatggacatatactgtcccctggttgtaaacttctacgccctccgtttgatttattttaaagtcaaattttttatgtttgattgagtttatagaaaaatacagtaaataccaaattagttttattaaatctaatagtgaatatattttattaatagagcaattttaccattcagcattttgtacttccaggccgtatatatcacattttacacataaaattttggtaacattaggtactaagcatcttgaggtattaaattttacactagaaaatgattcgatgtatcaaaaatttatggtaccttaaggtagcaaaagttggatgttaaaattacttattttagtaacatatttcttttttgttgaaaatactactccatttttctataaatatggtttgactagctattgtgaaattgggaatgctacatacaatatatataaacattcaaaatgaaaagaggactgcaactattgataattgataccttcgtcctgcagttttttttcatggaatatccataaaggagatgagctgttaatttaacaccggtggtgttttcattagtaaaatactcaatttattacatgtcatcgcgcaattgtaacagcattgtacatgtacgatgacgatacataacagtaaattgttagaaggaaaaaaatccttggaaagttggatcttccaatgtccaaaatccttctgtcaagtaatcgtccattccgaaagggggtctaaactagtccaagtccataaatacctaattgctgcacaaaattgcaaaagtgatggtgtgagcctatgctgctgaacaggatgctggatcatctctgctcggaagagcacgtccactgttcagcttcaatcgttcaaccagcttgaattaaatttataaatatactgttaatttgtttttgacaaaaaataccgtcggtctcgcacaacggttacgcgagaatgacgtgacttgacgccgcagttggtctcacaagatagcatgagaccgcgcgtgagacagcaagaccaaacggtctcgctaaaataaaagagctagagcgaacggcttgcctagtgagcagccgcttaattagtgactaattaattacccaattagcaattaagcaataataattagtaattaattatcctgattagcttactaaataattaattaatcgataattaaacaacttgaactgccccagaccccagccattcggtctcgctatttcttcgcgcgaggtcgcgcgtgcgaaaccgcctgtgacatcgtgcccacgttattttcacgtaatgtttgtgtaaaaccgacagtatatttctataaaaaaaattgcattccgaatatttatgggaaaaaacaaatcaacagtatatttgcaaatttaattccaactatgttcttgggagtttcaagctttttgactttttatcgaagtaggggctttttgggagaactaattatctccatccattttatatataagtcgttttttatattctttttcaagttaaagttatttaagttcgatcaaactagtagaaaaatatagtagtattttcaacacaaaataaatatattatcaaaatatattcaaaatgctagaatcaataaaattaatttagtatttcataccacctacatttgactattcgtcttattaaaatatatataaatgttatttattttggtgtgacttgttttatcaataataaaactataatattaacttatacgtttacatatttatactaaatttttaataaaacgaatgatcaaatattatattatgcgaaaaatcatcaacgtcgtagtatgttgtgatatttttctacaaatttagttaaactaaaaaaggtttgactaaaaaatcaaaatgacttatcaaaatgaaacgaaaagtgtagataaagaaatatacagatgaactttaacattgtgaacataacatgtattgtacaggagctctcatggcgctcataagccacaaagtaaaactgatccaccaactatatataagcccgtctcatcaatcacaaaagtttaagcaatcgccttaactcttattctctctgtttgaattttgtcccttaaaaaatcaacttccaccatcctacctaactcttacattatctaaaaaaaaactttttaaaccagaagaaatataaaatggttttaatcctaagtagtacagtacataagctgttaatctaattgggtaacagtactcctgattagtacaaatggttctgaatttgcaaatgcttgattgataaattgcctgactcatgagctgaactgccggcgttgtcagaattctgaagcacaactgttttcaggttgcattcttcatactggcgactctgggaattcagtagcaagtgacaaactctgcagaaccaatagataaaagagcaaagcacacatataatttttgaatggaacaaaagcacgcatcctagcatgtgtcttcaacaattctgctgaaactgtatgcatttcagaacattagaatgcacaaaattaagacatccccacttgcacgttgctctattggctcaacgatttggtaatactgccacttttcgcacggttatgaaacggtgttgaacaagaaacataccaacacaaatttctgcataatgcaactttttttaatagataatagaaatgaggattacatttttggcctctgcccgtgggcatagttaaaaaatctcaaaagtaaataggaaggaattttaaaaaaaggcatgatgggacatactcctaacttctgccaataaaatgatttattaaaataacgttttcaaaatcacatacattttataacaaaattatgtagataccatgccatccaaactagaacaaaagttctttggctaccaatttcaatcgtattgtgtcagggttatggataccacatacccaatagtaatcgactaagcacggcggggtccaccacataccatgtcttatatgggaacaaacctcgtatatagaaggagttccggataaggaatgacgagtagagttctatatggaaacgacaaggactacttggatcgtatccatatttatctccctagttctacttggacaagagggcatctatgggtataaatacaagcccccctaggaggagaggggacacagccaacatgcaacacagacgccacaaatccacaagccaatacgccaccagatctcgacatcagagattagcctagccataacccatccggttcctacggaagtcggcaagagggatctagcgccatctctgatctcaccgagtacagattcgaggaggaagactgccctgtcatcaactacgagctggttatctagccgccaagttgacgatagttagataggttatcccaaatattgtatttgtgtaatccagatgaataaagagcaacaccggctttggccaacaggatgtagggctattacctgttagataaagggcccgaacatatataaaaatccctgtctccatctcttttacctcaatctcgtatataccttggtaccaacgatccccataccatctaaataccctagtcgcgatctcaaacgtcgacattgttagatttgttttatggttaaaaactacatcattacagtaacgtcagattaaccaacataaaacactagctccaaataaaatcatttcttttgtgggcctaggcactcccattagccagctaccaaaaatatcttttgcattgtgaagagggggatattgaaggcaaagaagacaaccaaacaaaacgtgtaacatggcaatcaaacaaaagatgttagatggtcacttgtgtattaaaaaacaacattgctgaatccccttcattttctctttgacaggatgctaaacatcattttgtactaaactgtagcacaaacggtcttgtgtctacctgcaagcatggggtggcattcatttggcatagcacatcttcggtcattcttcactagtaattttcttgcaaattagcaggaggtggagaaacttctcgagtttagtgactaggaagatgatatggtagtctaaggtcatgtttccgattgatgtgctatcaaaattttggtagtgccaaatcttgggtaaattttggcactaccaaaactttggtagggtagagttaaaaatgttcatttggattaaagccaaaatatgccgataagacacaagttcatgggcaaagctaaatttgtggcataaataatgctttgatagaggtgtttggtttgctaccctaacaaaatattggtagggcaaattttgatagggtagcaatccaaactagccctaagtattgtctcttgcttctgccaactggtgaaagcaaggccagtccacccgtacaaagccatgggccctaataacaagcatttcaacaaccggcaaataacacatcatgtcccgtttcatcgtgttgtgtgcatacggaaaaagcagtccaaatttgtaaatgttgaagtttggagtcgtatggggatgttgttttcctgatttgataggtttcctatgtgattaggagccatagttctagtcggattcgtggctatgggcaaccccgttatgggtataaatagaagaggggttgaggctagaagatattgactctttgggagagaaaagttaaagtttgcttcaaggttccaaccctaatttaaatgcactttgtaaaacacatattgatacaataaattttatctactttcaagaattttatcgatacatgtttttcttggtcttgacggtcaaatcggcatatgacgagcggtccaaccggtggcagggaggcggtctaaccggcagcaaggctggcggtcagaccgatggtgtgcaagccgccagaccggtgggagtactgtggtcagaccggtggtgatgtactagtgtgaccggtatagcttcgtcaagtttgcgggtaacttctattttcgctaaaagttatttgttttttttccttccattcgctcctctctagtaggcttggttctgtattcgattctacaaattaatccttgatttctttctcaaatcattcaaccctgtcacatactcagaatccattcctgtagaacattatttatgcttgcttaattgtccctagttaagcatgaagagatacttgatgttgcagggaaattggaaaaaggaaaacactacaaataagcggacggaaagttttaagtacccaagcaacatacctcgagtctttgatgttgagttttcatatactacctgttggaaatatggtcatatatcggcatattttaatccaaaatgttaagacaataatcatggcataaacagtgttggatgatctagtgacaacatgtagcataaccagtagcatgctaaaggtatcataagcatcatgaacatgaacatagtaagaacgcaattgacttgagactaacaggactaacagcgctatgaacgaatgagttaacagcaggagaaggatataccctgagaatggccctccgctagattgtgaggcagaattgcttccgttggtgttgacgttcgcaacggctctggctccagctccaggcgcgccatctccagctccagcagcagcggcgccagcggcagctccggctctaggcgctgctccttccgatctctcatgcacgcaagctatcagaagcgaggaggcgagaacagcacatgcgcagaggaggaagaactaacacccgggaaagaagcaagcgaatcgttctgatcggactagcggcctccttctatagcaggagagaggcagtcgtgggaacgtgggatcgtggacgcgccgttgcggaggcagtcatgggaacgtgggatcgtggttgcaaaagaatagcgacgtgacgtgacgcacgcacgccagccagccagccacgcctcgcccacgccctcgccctcggccttggcccggcgcgcgtgcgcgcacgtgtggctttccgactcccacctcaaccggtcaacagggagcctccaataactccctatttaggttgagatactcctcgcttaaatcctgaggtggtattattatccttaacacttattatgggcctttaagattttaataggataaatcgggcctagcccaattattctaacaatccccaccaaatttcaaggctcataagactcaaggttgtgcctgtttgatataccagtgtttcggtggagactgttaagttgaacttccacctaggaaatgagctacatcagaccacaactgaacaatggactatgccttgaattgtcagttttgtgtgatcaggtttcactcaaacccttgactggtactgggctgccgttcgcatcccctctatttggagcatataagtcaaactccaggcctttcatgagtatctagaggtcgcccaaacctcatagactgtgactagcagtcgaactcatataggtgtgttccttctgagatgttctgcaggtcaacatctctgcttggaaaagccactcggatcacattaaggtatgagccatcctaccatgcaggaaagaagagaagtacatcatgaaaatgagcccttttcaagggtctcttctctcagtcacacaatagtttgtttcgccatccaaattcacgggatctccgatcacaatggacaggtttccactattgtgcaaccttaggtgggtatcatgcccatttccctcgatgcactgtctatcacattacgtggtagccccttggtaaactgatctgccagatttctagccatttggacatagtccaatgctatcactccggagtatttctgctttctgacagatttcgtcttctcttgatatgcctagatgacttcatgttgtcctttgaactattcactttaataatcactgtttgattatcacagttcattaggatacttggcactggttttttaaccaccggcaaatccatcaggagttcacgaagccactcggcctcaactgtcgcagtatctagtgctgtaagttctgcttccattgttgaccttgttaagatggtctgcttgcaagacttccaggaaacagcgccacctccaagtgtgaacacatatccacttgtggcttttatctcatcagcatcagatatccagtttgagtcactatacccttctagtacttttggatacctggtatagtgaattctatagctcatagtgccctttagatagcgcattattctttccagagcctgccaatgatcatcttccagatttgagacaaaccggctcagcttgcttacagcaaatgagatgtcaggcctcgttgcactagccaagtacatcaatgaaccaatgatttgagagtatctcagttgatcccttgctattcttcggtttttccttaatagcacgctgggatcataaggagtaggagctggcttgcagtcactatatccaaagcgactcaaaaccttgtccacatagtgggattgcacaagtgtaatcccaccctcatctcctctttgtagtttaatgttaagaataacatcagcctctcccaaatccttcatttcaaaactcttggacagatagtccttgacctcctcaatcacattgaggctggtcctaaagatcaatatgtcatcgacatataaacacaagatcactccttctctcccaccatagcgatagtatacacatttgtcagcttcgttcacaacaaagcctgcagatgtaagcgtggtgtcaaacttctcatgccattgcttaggtgcttgcttgaggccatacaaggatttcaacagtttacacaccattccctcctgaccttctagtacatacccgtctggttgatccatatagatctcttcctccaggtctacgtttaggaaagctgtcttaacgtccatctgatggacgagaagaccatgagaggctgccagagcaagtagtactctaatcgtggtcaagcgagcaactggtgaatatgtgtcaaaaagtcctcgccttccttttgggtataacccttggccacaagtcttgccttgtacttttcaattgtaccatcaggccgaagctttttcttgaaaactcatttgcatcctacgggcttgcacccatatggacgctca

SEQ ID NO: 27252 - DNA, 730 bp, Oryza sativa
  unsure (1)..(730): unsure at all n locations
tgtgattagagccatagtttctagtcggattcgtggctatgggcaaccccgttatgggtataaatagaagaggggttgaggctagaagatattgactctttggagagaaaagttaaagtttgctcaaggttccaaccctaatttaaatgcactttgtaaaacacatattgatacaataaattttatctactttcaagaattttatcgatacatgtttttcttggtcttgacggtcaaatcggcatatgacgagcggtccaaccggtggcagggaggcggtctaaccggcagcaaggctggcggtcagaccgatggtgtgcaagccgccagaccggtgggagtactgtggtcagaccggtggtgatgtactagtgtgaccggtatagcttcgtcaagtttgcgggtaacttctattttcgctaaaagttatttgttttttttccttccattcgctcctctctagtaggcttggttctgtattcgattctacaaattaatccttgatttctttctcaaatcattcaaccctgtcacatactcagaatccattcctgtagaacattatttatgcttgcttaattgtccctagttaagcatgaagagatacttgatgttgcagggaaattggaaaaaggaaaacactacaaataagcggacggaaagttttaagtacccaagcaacatacctcgannnnnnnnnnnnnnnnnnnnnnnnnnnnnnnnnnnnnnn

SEQ ID NO: 27253 - DNA, 810 bp, Oryza sativa
  unsure (1)..(810): unsure at all n locations
nnnnnnnnnnnnnnnnnnnnnnnnnnnnnnnnnnnnnnnnnnnnnnnnnnnnnnnnnnnnnnnnatagctatttcacagtatccccatgtcacaatgtcacttgcttataaataaaaactacaatccagttgaatctacggaaaaaaaaatttaaagatcgaaagaagaaacaagagtataaaaatacgaaactacaaaatggcatggttaacactaatccaataggtcatttaaaaaagaaggaaaattaagtattgataaggtgaaattacatagaccagacagatctaatatgtctcagacatgtccaaagattaaggcacaaatgaagattttaaggactcttctaccatgtaagggatgtatacacatatgtgtattgtgtatagttcacatttaatatctctctctgtttgtcttgacttggacttttttacagaatgttaacacctgatacttttaaaaattgcagttttttttcaataattttattattatcttgcaattatgaaacaataaagttcagttttaatacctcttatcttttaggaactcccgaagcttgtcaatgagtcgctgttcatcaaagcacatggggctaccattccccagtatttgagatagtagatccattaagatcttcctcatgtctggtttctgggacatagacacaaaagccttacaatcaaattggccattgatttccttatagacttgattgcaagtgttgtcttgcccagacctccacatcccacaatggacactactttgagttgctgtcttgatgggccactatcagcttcataagt

SEQ ID NO: 27254 - DNA, 693 bp, Oryza sativa
ggcgtcgtcggcggggcccgtgtaggctcagacggcggcgacggcgttcaagctccggctgtcggagtacgcggcgcccgccggtggggaagatgcgaggctggggctccccgcgcaccgggacacgagcttcctcgccgtggtgacgcagaacggcgtggacggcgtcgaggtggagtgcggccgcggcgacggcggctgggctcgcccaacgctctcgccgagctccttcctcgtcttctccggcgacacgctcaaggtatctgtgcatgtgcacgcatgtcacatctctctatctctttcttctttttttttaaaaaaaaaatggattaaaagaaacctggcgatcgatctagctacatccaaatgcatgttgctggaatagaaaatactaaatagtacacaaacttccttaactttcacatttcaaattaagtcaaagtctataccataatttaactagccgaatacaatgtgcgttacaacggttttagataaaatattgtcagttgtaaacttgaaaatattgtgaatatatatgtatcatgaataacaatgttattatacaatcaatttccaacaaaagattcccgccaccaactcaattaggtggtggtagctagttttgcataagactcctccctgctattaccgttggtcaattacattatttttgggcggaacgtgacgaaa

SEQ ID NO: 27255 - DNA, 684 bp, Oryza sativa
tgaatgaaatgctgctgttgctgtttgttgtgagcttgagaattatagaagggaggagccctcatggataccattgctaaagaaagaatggggggggtgaaaaaaaaaagattgaaaggaagcatttgccattgattgcaagaaaaaaactagaaggcacttttgctgcaacttgaaattgaaatgaggggaagaaaagggaaagagggaaatggtgatgatgataaaggagtggatgggattcagttcagtgggaggattgtcttgtgtgtacctgtacttgggtgtggtgtggagacctgacactgatgagagtgtgttttgctgttgcctctgtgctgtcaaggggattgtgaaaaaagaaaaaaatgctggttgtggttttgtagaggggagtgcatgtaggagagagaatacaaaggagtgctgtgattggtgggctgtgggtgaggtgaggatactggctatcacaagtaagatagagacattcacacatcacaaggggggatggcagggcagggtgaggtgggtactgggtaggccttgtccatagattttttttttctgtgctactgttatatagttttataccttgttttgttgtgcttggtttgatgcttgaactctagtagagccttgctggcctcatgtttgtttattgcttttttttaaggcaatgagttt

SEQ ID NO: 27256 - DNA, 765 bp, Oryza sativa
  unsure (1)..(765): unsure at all n locations
nnnnnnnnnnnnnnnnnnnnnnnnnnnnnnnnnnttgctcttgccaacatcatgtggcccagtcttcaacgaaaagattgtgtgctctgaaatatctcctatctttgatgttgatgtggctgcaatctcaaatcagaaaacaaatcccttctgtctgaataaaaatccggtttagcttgatgatgtttctgaacatgttttagttagcctgtctcttggttgttttcagtttcaccagtgatgttgtattgtagttcccccaataacccatccctgtaaaaaatcattcccttttatctgaataaaagttagctggtgaggagggctaaaaaaaaaataatcatggcgcgatcgtgatgcggcatttggacagtgagaaacggaataaaatcggtgcaaccgtggcatttgggcattgtgatgtggcattcagagacacgaaaagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 27257 - DNA, 740 bp, Oryza sativa
ggcgaattcgagctcggtacccttatctggctgcctactgatggtgacgccgaaaactttatgaagtcgcatgttgagccgacgattcgcgatattccgtcacttctggcgctggccccctggtatggaaaaaagcaccgggacaatacgctcagtatgaaacgcttctccaacggtcgcgggttctggtgtctgggtggtaaagcggcgaaaaactatcgtgagaaatcggtcgatgtcgccggttacgatgaactggcggcattcgatgaagatattgagaaagagggatccccgacgttcctgggtgataaacgtattgaggggtctgtctggcccaaatctattcgcggctcaacgccaaaaacaaaggggacctgccagattgagcgtgctgccagcgagtccgggcatttcatgcgttttcatgttgcctgtccgcactgtggtgaaaagcagtaccttaaattcggcgacaaagagaccccgttcgggctgaaatggacaccgggcgaacccttcaacgtcttttacctgtgtgaacataatgcctgcgtcattaaccagcaggagcttgatttcactgaaactcgttacatctgcgacaccaccgggatctggacgcgcgacggtttatcctggttttcataacaggcacccaaatcgacccgccagacagcgtgacgttttacatctggaccgcatacaaccccgttaccaactgggttcacatcggtaaa

SEQ ID NO: 27258 - DNA, 2271 bp, Oryza sativa
  unsure (1)..(2271): unsure at all n locations
gagctgcagctcagccaaacagtttcagctccaccaaaattgggagtggagctgggtggagctctctcacaaaatgaactagagttgtggagctaggtttaggcagcttcacagctccactccagacctaactcctggagctaaatttaggagttggagctgtaccaaacaggcccatagttatggtaggaaacaaacacatcatactacaagtggcaaagtgtgaagttcaaccaaacaaatatatactttctctgtcccctaaaacatgtcattttaaggtttctcacctagattaatgtctactaaaactgaccaatttaccctcattaatttgattcatcactactgtgcacgcactttagaagaacccaagaataatagagattgtagttaaatagtaaatgaaccacaccttgactgccatgtgggatttgcataagcacattggagccatggccataaaaattacacatgagaaaacaatcagtaccatagtttaaacatttaaattagcctatggaggatgtgcttcggcgcctaggagtgcctgtccatttctgaaagtgggccacttctttgattacggctatgatgatattttttctaggatattagttggacgggagaacgtctaatttttttaggacggaggtagtatatgcaccaagccaaaaaccactgtgctaagatagttccttcatgtcttaggaccaagagccgcactgtcagggatcctttgcgtcgaaccaagacacactggcacactgcagatgatcatgtgtggtccgtctcaatagagtagagtctactttctccatccaagaaaaaaaatcaatttctagagataaatcttaacatgcatttatctacattcatcttcaaaaactattatttttagatagaggtagtacatcgcatcaccataagctggacccatgtgcccttcaatccatagcaaccttgatccatatcattattgcaagtgccaacaggatgcagctgcttgatctagttcggcttcttctgtgaaccgctccatgtaccacacgtctcgtcgctcactctaggtcagcccgaccactattgctgagttgggccaagttgcgcaagtctctaaaccaaacttttaggacgccatctttgaataggttgcaccgagtcaggtcggtcaatggaggccggatagcccttgtttgcatggcccacctcatctctctccctcttttcttttttcctcacatgccattcaaatgtgatgatctcccccataggatatccattcataatagttttcagaacatatttcgcaaacctcatattagttaacacacatgtttatccgcaattctccaattttctataaaaaaataaaccaaaataccacttgggttcacagatgtttagtctatggaagtctaatgtggttcattcttttgcttggatgatggatttggttccttctagaatgatgatggtgaaaccttcctttctctatctttcttcttctggattatcaaacaaatagtttatcagataatttgtatatattatgctttaggatagacaaaattcgtcataggatattcaaatattatagtctttgctaatagacatcatcataacgcgacttggcttgagaacacaaaatatatggtaatttaattattttattattttcaacctgttgtgatgagggatgttaggtcccgatcttccgataggtattgataaacaatcgatttgggcggagtcgcgacacaactcgatccggcttctgaacgaacacgctattgagccccgcaatcacagcaccacgtctcctctggttatcaaccatgccgaaacccggttgacctcgccgagaaggctaatccctgcatgcgaatcgaagaacacaagtaagaacaaaatagattgcaaccaaattgcatatgaataattaagcactcaaatttggggttccacaaaccgatctagcggtgaaactgttcttgacagaataatctaagcaaaacccgactctaaacgatgacggctactgaataaatgtgattagggacgtcctagggttgccgtagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtnnnnnnnnnnnnnnnnnnnnnnnnnnnnnnnnnnnnnnnnnnnnnnnnnnnnnnnnnnnnnnn

SEQ ID NO: 27259 - DNA, 645 bp, Oryza sativa
  unsure (1)..(645): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagatgtatttacttttttttattttgctatcacatccacctcctagatctagatctagacatatatgtgagagagagaagaaaattttaaatgtctatttatttggtttaattaaaaaatagttgtattatttgtaatatgctaataactttgtttttcattaatgtataaatcaccttcaattagttttgaatagcgatacgtttttttaatgaaccctacaaatttggtattaatagtgcaaatattttttgttcatttttttgagatatggaaaggcggcaatggatgtaacattcgccgaggtttttgggtccatatagggataaagtgtctaaatttgttggtattgtgaaggcacacgctgaaaagaacaatatgaggaagataatttatccatgtgctagctataagaatgaaatagcctgggaagatgggtaccgagctcgaattcgccctatagt

SEQ ID NO: 27260 - DNA, 1351 bp, Oryza sativa
  unsure (1)..(1351): unsure at all n locations
nnnnnnnnnnnnnnnnnnnnnnnnnnnnnnnnnnnnnnnnnnnnnnnnnnnntacagtacagaagaggttgtcgagtgctgtatcgattacttcaaaaatggaaatacaattggagtacctatgccttgacacgagggcagattgagtggcaagggtactataggaaagaagagattcgtcacccatgatcacaaagcatttcaagaaactcacttcagcacgcttcatcagtttgctatcgttgagccttacaccgatcaacatatcaaactactacgagctaccaataaaggtcacacaaccgagtggataatgaaagaaaacaagagtctcttcatagattggttgcgagacctagacttacctgatggacaaacaaccgatgaaataactatgaagcggttggcttgtggtccatcaactacagtaaattcttgggagggatatgacattaatggatactcgtttagtacgagagcccgagatagtaagaccttaactgaaaacagcggtgtccgtgtggaggcaattgattcaccgggtgaaaaacaatcatacttcggatttattgaagaaatatgggaaatcgactaaggacacacaatgcaatttcccatatttaagtgccagtgggtaaaatacctgaacggggtcaatgttgataagtttggtcttactgttgttgaccttgcgaatgtgggtcacaaggatgacacttgggtactcgccaatcgcgtggcacaggtgttttatgtgaaagaccctcaaatttgaagaaagagataatgctaccaggaaacaaatagatattgggagtggatggggtcgaagatgttgaagattacaaccaatacgatagtatgccactttatactcaatttgtacaaaagattaggcatgtcgaggcatctacttagaagaccatgaagctttacatgcgcacgaacggtgtgggcaaaaattttaaagggtaatgattgttgagtggcatgtaagcctctaagaagttcttagttatgtaatgatggtatgtaaggggatatgtgtgctcatattgcaaatttgcatgttataattgacgaacaattgtacttaacattttgcaaattagtttgtactaaattttatgtgtaattaccatttgtagggcaaaattacagacatttacatttcaaagtttgtttaaatgaggtttcaaaattttgtagcattttttttatatacacttaccattgtctgaacaatattttaaaagtagtaatattaaggtttcaaacaaacatttaagtaagatttacattttaaaagtannnnnnnnnnnnnnnnnnnnnnnnnnnnnnnnnnnnnnnn

SEQ ID NO: 27261 - DNA, 1227 bp, Oryza sativa
  unsure (1)..(1227): unsure at all n locations
aagtgatcttgtcccaagccgaaaaaatgaaaacgggccgagggtgaaaaaggcgacaaagactacattccctctaaaaaaggggtaagtacacttaatatctaaactgtttgagtgataactgttagcccaagctaattataaactttgatacatactcatagaaaacggcgccatggcgatcaaaacagcagccgaagaaaaaagataagtcaaaagacgacgaggtcccagctaagaccaccggctcaaagaaaagcgaaccgtcatcaaaggcgaagaaaagaaggggcgagagaagcgtgaataaaaaggacgaagggttttatgttgttaccaatgttgggcctaaaggagagtcgctcgcccctcaaactgcacgtgccaaatttagttcacagtgtggcataatcgtaagggaaaagatccccatcacggtcaaggactgggatcatgtgtcgaatggggataaggaagtcctatggaaagagctgaagaaaagattccagttcccggattgagcagaggcagttgtgaggaattgtgcactgcaaacactggacaagccctggcgtggttggaaaaacacattgaacaacaaatttgtgaagacgggtcgtccaccttttgcgacatttgccaacataaccccgaagtagtgggacgactgtgacgttgaagaactccctggaagaaattgaagggagcaaaaagtatgcagagttggccaagaagaacagatttcctcatcacttaggctccggggggtacgcaccaaaggtggagcggtggtcaaaagaggaggaggaaatgaggaaggcggggcttccagtaccaatggaggaatggaaccagagatctaggaactgggtaaaagctagaactcctaagatcacagaagaaggcaaagtatcgtttgaaaatctggagctacagggggttgccgataaaatagagactttatccagtgcatagaagataggatcttttaagcctaagagggagaaagatgtgctaagtacggtgctgggtactcctgatcacgggggtacggttcgaggtgtgtcattcaatctgagttggaaggaagggttcaaacatgacccccacaagaaacgtgaaacctacaaggataaactaagggacgaaggggctcaggattttgaaaggaaaatgatggatttctgnnnnnnnnnnnnnnnnnnnnnnnnnnnnnnnnnnnnnnnn

SEQ ID NO: 27262 - DNA, 537 bp, Oryza sativa
  unsure (1)..(537): unsure at all n locations
nnnnnnnnnnnnnnnnnnnnnnnnnnnnnnnnnnnnnnnnnnnnnnnnnnnnnnnnnnnnnnnnnnnnntaattagctcgggctaacagttatcactcaaacagtttagatattaagtgtacttaccccttctttagagggaatgtagtctttgtcgcctttttcaccctcgcccgtttttcatctcttcgggcttggacaaggatcacttaacgacgagttctcatcatcatcgtcagctacgtcgttgtcggaaatatcttccggcgggactgttggttctggagcaaccagaataggaaggaatggctcttcctcccataaacccttctcttcattccctttagtactatcggccatcgtttcgaacttctaacataaaaaataaactgtattttaacaatctgtcatatgaacacatttaaattcatccacattgccatatattaacaatcaacgaaaatagaacactacttatcgtagttaaaaaaaatgataaatagtgtannnnnnnnnnnnnnnnnnnnnnnnnnnnnn

SEQ ID NO: 27263 - DNA, 742 bp, Oryza sativa
  unsure (1)..(742): unsure at all n locations
nnnnnnnnnnnnnnnnnnnnnnnnnnnnnnnnnnnnnnnnnnnnnnnnnnnnnnnnnaattttgcccatatgcaggttgatatcgttcctgacattgaagattttcgatatggcaaggcatcgccatctttaggtaagaactaagaacagttataccatatagttaccaaattataatattcttaacactttgttccatgtcttgcaaaaaagcttacttttgctttcttcagttaggttggagaaaaaggtgagagtttcatctgctataaaaggtactcagaagactacctgatgagagaagctatgcatttcttgtttaacatctttgtaattttcttgttatgtgttagtttctttctctgccagctgatatcaagttaaatctgtacaaacaatattgacaatactttactgaagttttcagttatatattttatatattgctaaaatgtttatgctgctctggattgcaaaaataaacaatcactagattatgacttgcatcatcttaaccagaaggcaatatagtactacatattggttcatacatgatggctattcattcctcaatttcccacacacatcattcatggaatatctaaatctgttgttaagttcaaaattttcattgcatgttcacctactattaacaaaaataacaatcctagctgccaaaaagctgccaggttggtagcagaatgttcaacatcagattcagtgtattcttgtgacacatatt

SEQ ID NO: 27264 - DNA, 577 bp, Oryza sativa
gagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagtcgtttttgctcacggatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaaggcgtggcaagccaacgttaagctgttgagtcgttttaagtgtaattcggggcagaattggtaaagagagtcgtgtaaaatatcgagttcgcacatcttgttgtctgattattgatttttcgcgaaaccatttgatcatatgacaagatgtgtatctaccttaacttaatgatttttaccaaaatcattaggggattcatca

SEQ ID NO: 27265 - DNA, 669 bp, Oryza sativa
  unsure (1)..(669): unsure at all n locations
ggcgaattcgagctcggtaccctagatctaaaaaaaattatcgtaggaatagacccttttcgcgatgccagtaaccatgcatcaagattcaatatctaggcgccagcgccgatatccttgtcccccagcagctgagatgtggagggtcggtgccaaacatattggcactaaagatctatttgtaaaatatatttttttaaaaaagggttaaaatgtaaaaagtttttcttacaaataggttcatatcaccaaagagactgagtgtctatttgtaagaaaaaaatatttacattttgacccttttaaaacttttatttgcaaatagatccttgataccgatctcttttgcactaatcccttcacatcagcgacttagctaccaaggatggtgaggacatcaccatcagtgccattgacactgagacattaaacctgagcatcaataactctggcgtcgagaagcctcaccccttctaattatttaatattaggtccttctctaatattcgcgttttttatatcctcgaattttggtatggatcattttcataccctttttgttagttgaccatttaattcctatgaaaaggtctattttgtccataggtacagaaaannnnnnnnnnnnnnnnnnnnnnnnnnnnnnnnnnnnnnnnnnnnnnnnnnnnn

SEQ ID NO: 27266 - DNA, 506 bp, Oryza sativa
tacagatgcaaatggtcattaattcctcatgatcagtgttggtagactgatacttaagatcgctcatgtacgactgtacgagctgtttggtgtaacgaagaataacaacacggtgaatatacaaaccacccattgctaattgcatactaactattcccctgtccatagaaaatcaagccaatctggacatcagcattatcttcgaaatgcaattttgactgcaataatttctattgcaacaatgtctgtgtaaaatcaaatgaactagtacaatactacacaaaacaagactgcactttgtagaaatcaaatctacacatctatgtaactcgcatgtgtccaatttttaaatgttttagaaatagctatgcataaattttaaatgtgcccacatttgatttgacaatatatacctagctggtgcgcttcttcttgggaggcctggaggacgttcttggcggcgggggtgaacttgatctccatggggaccatgccggggcccctcc

SEQ ID NO: 27267 - DNA, 595 bp, Oryza sativa
agtatacgactactataggcgaattccagctcggtacccaaaaaaattcaaatgtggcccggagaatttttgttaaattctccttggtctaaaaagagccctcaaattttagtggaattttcagagcacaaataataattattaagaaataaacaaagttaaaaaggtttataaaaagaaaaaccctaaaagaagtcttctttcccccccttcctctcttgggccggctcggcccacctcgctctttccctctctctcctccccgcggcccactcggcccctcccccgcgcgcgcgccgctgacaggcgggcccgcccgccaccctcgctgacgggtggggcccacctgtcatcgccttcctcgcgccgctcccgccgcccgcccgtgccctagcgccgccgccgccgcggattccgccgcatcccgccgtccccgcgcgcattaaagagggggaaatcactccccgtgattccctctccgtttccccccgcttttccctctgtctctccctcggattcgctcggaatctttcccctaaacctcggcggcatcaatggcgcccgagatcgccgcggccgtttccttcccctccgg

SEQ ID NO: 27268 - DNA, 5638 bp, Oryza sativa
  unsure (1)..(5638): unsure at all n locations
cattaatgtataaatcaccttcaattagttttgaatagcgatacgtttttttaatgaaccctacaaatttggtattaatagtgcaaatattttttgttcatttttttgagatatggaaaggcggcaatggatgtaacattcgccgaggtttttgggtccatatagggataaagtgtctaaatttgttggtattgtgaaggcacacgctgaaaagaacaatatgaggaagataatttatccatgtgctagctataagaatgaaatagcctgggaagatgcttctaaagtgatggagcaatttgtaactcgtggatttatggataagtatgtaatatggacacgtcatggcgaagaacaagtggacgggactgaaaatatagttccgacaaaagttgaagacatggtgtacaatgatggttctggtgaggacaaaatcaatctagaggaaatgctacgtcatgcagaacccgaggtgccgatggggtcggttagaggtttaaataactttgaagctttacaaaatgcagctaaggaagttatgtacgatgagtcaaagggttgtaacagtgagttcacaacactacggtcagttcttgatcttatgaggttaaaggcaagacatggatgatctgatagtagtttcaacagtctgctagaacttctgcagaaaatgctcccgaggcctaactcactaccatccagcacatatcaagtaaagaaactcatatgtcccctttcacttggtgtggaaaagattcatgtgtgcattaatcactacatactatataggaaagagtacgcttctttagatgaatgtctaacatgagatgctagtcagtacaaatcgaatagcaatactggcctagaaccgtctgacacaactgagggaactaagagaaaaatcctgtagttgtgatgtggtaccttcctgtcaaagaccgcattaaacagatatactcaaatccgcgagatgtggaactaatgcgttggcatcaagaagggcacaagaaggaagggatgattcgacacccgatagatgctcgtcagtggataaactttgatgctcagtatagagagtttgttaagacccacggaatattaggtttgccctaaatactgatggagttaatccttttggagacatgagcagctcacatagtacttggccagtgcttctcaccatgtataatcttcctacctacctttgtcaaaagtgaaaatgcttattactctgtatcctcatacagggaccccgtcagcttggtattgatattgacgtatttctggaaccattgttggaagatatggctgatttatggaaagagggattgaaagtgtgggacgagtacttaagagaatacttcacagtggaggccatcatcttggtgaccatcaatgattatccagcaatgtttttagtttcaggtcaaattaaaggtaaaacaggatgtgtgatctacttgaatggaacgtactataggtatctcccgggttccaacaagcttgtgttcatgcggcaccggtggttcctatgcacaaatcacaagtaccgcaagatgaaggcggagttcgatggcactaaagagagtgatcctgcaccaaaacctacatctggggaaaaagtgtgtgcaatgacagagaaaattgtttgcgaatttggaaaagttactaagaaaccatcaaaggggacaaagcgcaagaaactcgagaagactaagaaaccaaaagatagtaagaagccagatgatagtatgaagccagatgataaactccctcccccattcaagaagcattccatattctttaagggtctgtttggcacagctccagctccagctccagctccacccctcctagagctggagctcagccaaacagtttcagctccactaaaactgggagtggagttgggtggagctctctcacaagatgtactaaagttgtggaactgggtttaggtagctccacaactccactctagactcaactcctggagttaaatttaggagttggagctgtaccaaacaggccctaagtacctcccgtactggaaagatctggaggttcggcatgccatagacgtcatgcatctagagaagaatgtgtttgacaacatagttggaacattgttggacatgccaaagaagactaaagatggtctgcaatcacgaattgacctagttgagataggaattagggaagagttacacccttaagaaggagagaagaatggcaaagtatatcttacaccagcctatttcacgctgacacctgaggagaagaagtcattttgcaaatcactccgcgatgtcaaagtgcccataggtttctcatcaaacatcagtcgattagtttccatgaaagatttgtcggtatctggttataattcacacaactgtcatgtcttgctcaccgtgtttcttgcaattgcaataagagccataaaaccggaacattgaaaggatgctatcacaaggttgtgctactttttcaacgcagtgtcacagaaggtcattccttacgaagagttagcaaatctccgtccattcacacatgagacacagtgccaacttgagatgtgtttccctccgtcatttttttatatgatggagcacctcattgttcacatagtgccgcagatggttgtgcttggcccattgtacctccatcaaatgtggtcatacgagcgttacatggcagttttgaagggctacgtccgaaatcgtgcacatctagagggatcaatggttgagggttacagtacagaagaggttgtcgagtgctgtatcgattacttcaaaaatggaaatacaattggagtacctatgccttgacacgagggcagattgagtggcaagggtactataggaaagaagagattcgtcacccatgatcacaaagcatttcaagaaactcacttcagcacgcttcatcagtttgctatcgttgagccttacaccgatcaacatatcaaactactacgagctaccaataaaggtcacacaaccgagtggataatgaaagaaaacaagagtctcttcatagattggttgcgagacctagacttacctgatggacaaacaaccgatgaaataactatgaagcggttggcttgtggtccatcaactacagtaaattcttgggagggatatgacattaatggatactcgtttagtacgagagcccgagatagtaagaccttaactgaaaacagcggtgtccgtgtggaggcaattgattcaccgggtgaaaaacaatcatacttcggatttattgaagaaatatgggaaatcgactaaggacacacaatgcaattccccatatttaagtgccagtgggtaaaatacctgaacggggtcaatgttgataagtttggtcttactgttgttgaccttgcgaatgtgggtcacaaggatgacacttgggtactcgccaatcgcgtggcacaggtgttttatgtgaaagacccttcaaatttgaagaaagagataatgctaccaggaaaacaatagatattgggagtggatggggtcgaagatgttgaagattacaaccaatacgatagtatgccactttatactcaatttgtacaaaagattaggcatgtcgaggcatctacttagaagaccatgaagccttacatgcgcacgaacggtgtgggcaaaaattttaaagggtaatgattgttgagtggcatgtaagcctctaagaagttcttagttatgtaatgatggtatgtaaggggatatgtgtgctcatattgcaaatttgcatgttataattgacgaacaattgtacttaacattttgcaaattagtttgtactaaattttatgtgtaattaccatttgtagggcaaaattacagacatttacatttcaaagtttgtttaaatgaggtttcaaaattttgtagcattttttttatatacacttaccattgtctgaacaatattttaaaagtagtaatattaaggtttcaaacaaacatttaagtaagatttacattttaaaagtactaatattaaggtttgtatatttgtatgtacaattaccatttttattacaacttttgtaaacattttctattttaaaaaataaattaaaaaacattttcaactaaactattgtcaggtctctaacaatcttcgtaggcggacggtgcgccaccgcgcgcttcgccaccactgctccactgcgcacttcaccaccgcggtggctccactgctgcccgcgcttcgccgccggccgctcgtcggcgccaccactctctctctctctctctctctctatctctctctctctctctctccctccctcccagtctcagtctcggccgctccaccgaatgtcgtcccggtcgtcgtccacgagtgaactcgtcctcgaccgaacgacatcttcggccggtcgtcgtccacggccgaacctcgtcgtcggccgttcgtcgtccatgaccgaacgtgtgtgcatgtgggtgtttctatttatatgtgtgtgcatgtggatgtgaggggatatatatgtgtgcatgtgggtgtggatgggaatgagggatgggtggtatgtgaatgaggggtcatatgttgattgtgaatgtgaatgtgggaatgtgggtgatatgtgaatgaaaatgggtgattgttggtttttgttcatttttttttgtgtaacatgtgggagggtatgttcaaattttttttatataacatgtggaggatatgtccaattttttttataacatatgataagtagtacactatttatcattttttttaactacgataagtagtgttctattttcgttgattgttaatatatggcaatgtggatgaatttaaatgtgttcatatgacagattgttaaaatacagtttattttttatgttagaagttcgaaacgatggccgatagtactaaagggaatgaagagaagggtttatgggaggaagagccattccttcctattctggttgctccagaaccaacagtcccgccggaagatatttccgacaacgacgtagctgacgatgatgatgagaactcgtcgttaagtgatccttgtccaagcccgaagagatgaaaaacgggcgagggtgaaaaaggcgacaaagactacattccctctaaagaaggggtaagtacacttaatatctaaactgtttgagtgataactgttagcccgagctaattataaactttgatacatactcataggaaacggcgccatggcgatcaaaacagcagccgaagaaaaaagataagtcaaaagacgacgaggtcccagctaagaccaccggctcaaagaaaagcgaaccgtcatcaaaggcgaagaaaagaaggggcgagagaagcgtgaataaaaaggacgaagggttttatgttgttaccaatgttgggcctaaaggagagtcgctcgcccctcaaactgcacgtgccaaatttagttcacagtgtggcataatcgtaagggaaaagatccccatcacggtcaaggactgggatcatgtgtcgaatggggataaggaagtcctatggaaagagctgaagaaaagattccagttcccggattgaggnnnnnnnnnnnnnnnnnnnnnnnnnnnnnnnnnnnnnnnnnnnnnnnnnnnnnnnnnnnnnnnnn

SEQ ID NO: 27269 - DNA, 15988 bp, Oryza sativa
  unsure (1)..(15988): unsure at all n locations
nnnnnnnnnnnnnnnnnnnnnnnnnnnnnnnnnnnnnnnnnnnnnnnnnnnnnnnnnnnnnnnnatctaggaactgggtaaaagctagaactcctaagatcacagaagaaggcaaagtatcgtttgaaaatctggagctacagggggttgccgataaaatagagactttatccagtgcatagaagataggatcttttaagcctaagagggagaaagatgtgctaagtacggtgctgggtactcctgatcacgggggtacggttcgaggtgtgtcattcaatctgagttggaaggaagggttcaaacatgacccccacaagaaacgtgaaacctacaaggataaactaagggacgaaggggctcaggattttgaaaggaaaatgatggatttctgcagcaagcacatgcttttgcctgatcccgcaaccaaagaacctgagccagattaccccttcgatgacctaaaggagaatacatcctgtcgattgcatgttcccattggacgctccggaagaactcttgaggccactacaaccattgctatccctaggagaacatataataaagagtccatacccgatgagtatgcaaaagtgcagctgcaagtggtccacgaagggtttgagtcgtaagacatcgacatccctagtccagatggtgtatccgtacttggggatgcggttgatcttataattctttggcacaagaatgacaaatcctttggattgggcaccgacgccacgcgaaaacccttttggccaaaaccgggggttccaaaacctccgagaaattctccaaagaagcaggtgaatgataaggcggacaaacccgagatgcctaaggaaatttcggtgccggatgtcccaatggagagtgcagcgccggaggtgcccatggagatttcagtgccggatgtcccaatggagactacagtggcagaacaagatgtgcaaattgtggcttcagtcgggacagatatagaagatgtagcaggattagaatgggacggtacagagatagaagtatttgaaaacccttctcctgcgaaagaccccggggcgcaggaacccctagtctctgacaaggccactgacaagtctgaggtgcctaaagtgcttaggagccacaactccaagtccaaagatgataaaaaagagaagttcatggtaaccgtcttcagagggggtaaggaacatgccaaactcagaggtgatgacccccagaaggccgctgcactaaccgggaaaaaatacttcccaactaatgattgcccagaaaaatacgaatatgggaaagcacttttaccggaatgggcacttgacgaaggtctataggagatgggaaggtttcataccttctacatggatgccagcaagaaaggcttgggtaatataacagctcgatcaccaacagattgtttcggcagcaaaggttacgtttggctagatttcgaagatcttcacgccatatattgtcgggacaagatggacgtcaactatgtcgttgtttggtgcatgtgagtatgagttttaattaattacatgaaaaatatgtacaatacaaatccatgtgattattactaacaaacttcttttgtaggatgcaataaatggatgctaagaagaaaaaaaagaacctatcggattcttggatccaactcggatctgtgaaacacatcataccgtgaggctagcaccagggtcagactagatgaacggcaagactcccgaagagatagcttaatacaagcagataatgattactgtcgcacaatacattggacgagccttcttgcactttcaaaataagagagttgtcatggccgcttataattttaggtaagtccggtacatttatcttctacacacatgtcttattttagccgctactaactaactacgctgttgttaatatgtagcgatcattatatctgtttaatcatccacccgaaggacggaaccgtggtagtcttggaccctctcgatttcagtcaccagtcatacaaagaatttctaacaatcttatagtagtaagttattctgactcttgcatttttttaatatgaatgtattataattaaatatcctccttaatgcaaaacgatacgacatccatacagtgcatacaactactacaagttcaagggtggagaacagacccgaacaagggagaagctactagcacatacatattggccagtaatactccactcacttaatttattccaattgtttcactaattgcaaaatttaactattttcttctatgatatatcgtgaagtgtcacaagcaacctagaggcactgtcctttgcgggtattacgcgtgcgaattcctcagtgttaatgggaggtacagagttaacacaaaggatgtaagtctctagactatggactagacagcttcacatatttatgatactaacatattgtttatcttccatgcatgcagttgccaagaatagaacttcgaacaagctttgacgatacaggcatcacaaatgttcagcgcgatctatgccacttcatccaccgtgagtgctgtcatatgcgaggagaattcttcgacccagagggtgccctaactacaagtgacgaattcaagcaacttcgggagtggaacaatgctatgccataatgtaactagatggtgtatttgaagtgacaatgtaaaaaaatattgtaatatatatattttgataacacttttcacttatgcaatatatgtagttttctcagtactaaatgcttgataattactaataatcttcctgcatcaatttctattaaataactaaaaagtaatatttgggcaaattattattgtatcaaatttcaaaattttctacctatcttcgcaggcggatgtttttattttttgcaggcagccacttcctatttccgcaggtggacctgactagctttttatccacctgcgaaaattgtcttcacaggcggacggctgccccgcctgcgaagatcggtgatcttcatagtcgtttgcttacaggcaaatggctgccccgcctgcgaagaccggtttccatcaccgatgataatgctttttctagtagtgaagataagtattgttatcacggagtggttaggtggacttgcttgtcgtgataaacacacggggtatcatatcttgcatgatatatatatcctagcgagtggtcatcactgtacacaatgagaaaatactgcagcaacatttgaagaacctaacatatatagtctagaatatttcagtaggaaatggaggcactaggtagtaattcacatcagaatcaaatatatttcggcttgtgaatttgtgtttagtgagcccgtagttatccttggaattgactccgcttatgggaaggagacagcatgagcatttctgtaagtcgacagcatgtgactacttactggaagatcggtaagtgttgtgtagggtgtgtggggggggaggggggcattatatcttaactcttcaaaaaagaatcccaaaacagaacaagaatgagccacattatccggtgaataatagccgttagatcaaccagcagacaaaacaggtagaataaatctcaaccattggataaaaaagtgtgttctaaaactttccggtgtctctccttcatatgtgagaaagagatatagaacatagaagacacataagaaacaaagaaaaaaaaggaatgtttgtatgatagagagaaatgataaaaacattttttaaaaaaaaactaatatatattttatatatatttcacaacaaatttttcagtaacataatattagtaatggattattcttaaacacctatagaaaaagatagtgatagtcacgcaaatgcgcgacttcatgcactagtatatggtgaacttttctggtgatgcctacatattggctccgaaaaagctagaaaccacatcattcatattatgaggtatgactggtacactagcacgggataggtcatctgaaacggacgacaaacctcgtctatctaaatatatcttgataagcaaagagtactacattgagaccatcagcacagcagaatttgactcttttggatttgcacgcctatttgagagtatggatccataatatagttgacttctattcactgaaacaaacatgagtacatgcaggtccagaggacttttccccaatttgaacagcctaggttggtctaccgggggagaaagcttggtatctggattctggaggctggcgctgtgttatggccatcagggtccaaaacttgcagctgacaacagggggaaaatcgcgtttccgagctgagagattggagtagcagcagccaaacaactgcatatattgctatgcggcgccggccacgatatggagcagccggtggacggcgatatccaccagatgatggacagcatgtagcatctccagctcgccagaggcgcggcgtctctgcttcttcgtcgattgactctgtttggctcatctgtgcagcaccgcctgcgtcgactctgtttggctcgtatacctgcctcgtctcctcgccagcaaggtgctgccgagctgcacactgcactgcattgcggctgatggccacagccgaggtttaagttttcggtttcaccgaaattttgaacaaatgctggtcaagtttaaacaaaatattatcaaattcacaaaaaaaaattaaaaatttggccgaaataatatcatatcggggggtccgaaatttcattccggaattttgaacccgagcctcatccccccccccccccaaaaaaaaaaaattttttgttttttttaggaaatggctactggagtattactccatgctagagagtttcacatctcaattgtgtgtgtttctattcaccaacttgcacaaggcgttagtgtttcagtttacaaagctttttccttgcctcagcttctcccgcatggactaagctgttgtggaaggtgctcaattgatttttgtatgataattatgaaggcaaaatcaaaagcaattttcctaaatatatacactagaaaaaatgctaatgcgttgcaacggatgaaaactattttaatcttattattgttatacggtttagctatggtgaacttgactgtgtgaatttgcttggatatatttttcttttagaaattcatgagctgcaattaggagtctgactttcatctcaaattagtatgcgaatttttttaaagagatttcttatacgactccttttgtatatctaaaagcaaacaaacttaaaatctgactcaaacataaatatgtattttcaaaagagagcgaactttaaaacctactcaaatacgaatgacgtaccaaaataccgacaaaaacatttttaatttttataatagtagagatgtggatgacagaatcttaaacaaaaatgttgcacattttatataccatttaggtgttgcacataatgtgcgagcctgtgctatattaaataggtacattagcggatcagttatcttgttaccttctcaatgttttttatcagcaaagttcgtctgtctctctctatatatatatacatacatatatatatatatatatatatatatatatatatatatatatatatatatatatatatatatatatatgatagaatccaaacagagagaatgagaatagtccttcaaaaatatttggtttatattggtgagccgatatataggaaagggaggcaacagggaatcatgttgatgctctcatcactgtcttttccattcactgtcaaagcacataactgtttgtcaaacatcgtgtttagggtaaaacatgcatccgcagcatccggggattattagggaagtacgctgcctgaacttatgctatatcaaagatgggagtgtaatacttcaatgacatgctattgttttttctctatggcctatgactattgtgacgcagagagaagacaattgtgctgtattggtatcaagtatagtatctacatagagctttagtaatcgttccaagccagggtggatccagtgtgagtgtcagggcgactcaactccccaataccccgctagatcactattggtagaaggagagagggaagggggaagaagagggagaggaggaaaaaagagatgagtccccactataaatttattttagattaacccctgttccaagcagaatatcgttacaacttacgaagtgaataggaaaaaaaactgtgtaggagctcatgagcagggttgcatgcatggaagagatataatagattggataggtgtgcataaataaatttttatttacagtgggcctcatatctagggataagagaagtatcaacacactaatgtctaatggaataatgaccggttccaacctctcactattagttactatttcaagcagttccaaaaagattgtgatttatatttttcccattcacaaaaaatgtaacgactttaaaaggtagtatggcccattaagataaagaaaaccgattgtacacaatcgtaagcacacatctaggctgtgcaaatttcagttgattgacaaatagcaaagtcaatatatttctaacaagtgaaatatagcaaaacttacattttatgtgtttgcatgcagtttaacttatttcagtgtgaacattcttgctgcatgggcttttggatggctggacctgtcaatcaacattgaaactaacgtacatttatagttgtacacaataacattgccatgtgccatcatcaaagcaatgacatagttacattctgtacgtcaccggctcaccgcccagctgattcgaagttcaattctaattttaacactacatttacgacatccagctatcggaccaatatattcatttggaaggtgagcacaaaaaaatggctagctagattggatgccatatgttttctagctattctgaaatgcgatcgataacaacaccaatcatcctttctcatctctagaccctgtaataagtttgtccatctcttacaaagttaggataccaaatgccaacatgtgtgtagatcgactgtatagaacacatgcatgcagcccaccataggaaagggagacaccgagatatctggatgtgatgcacggttcatgatgaaataggacataaagtgcctcatttgcttgcacggcaggtgtagctaggtttaatttgttcgggtcaactagccacattctacaacacctcagttgccagaagcaaaagatggcactttgtgcagcatggcagaagacatgctatgccaaatgccacccctagtatgtataggtagacaccagacaatgggaaggaattgaaggcatgcatggatgaaacataaataatgtttcagcatcatatatgctacaaattgccaaattgcaggagagatgttaagcatgaatactggtttgtgcagggtttgcaagctaggcagaaccatctacaacgacttagattgaatgatggtgaatgacagccaatttaagactaaatatggtgttcatccaacaggctgcggtatagcccggtagcaagagataagaaatttagaatttagttcaggattcaccaatttgcactagcttctcaaactttttctttgttctgcccatcacagatgacctattgtcttgtagcaacggtcgacgcgttgagctgattttgtggaaaatatgtctgcccattgatttcctggttgataataaggtatcaaggtgaaagcagatggatagtgaacatatacataaattgatgtacatgttatagtggtaatttttacaaataatggtctctaccgacagtagtataactcataaggtatggacatgagtatactttacttaagctacaattttatttcacttatagacatagttggtgaatcagttatgttcaagcttaagagccatgatagatcctgtagatgttagataactcctggtcaccctttttatattaagagaaattaataatagttcagaaattacacaagcctggccggagctagtctccacagtgttccgtcaacatgatgcgcttggccacgcatgctgcactctgaatgtccatatcaaaaggtaaagttcatcgccttatatatttatgtctactatacaaaggcactcttaaaagcccccacatcaatcagaaaaagaactgaacgatgggcaccgtacaaacctagttaattaatttttgaagctaaattattatttttggaaagtacctcatcactgatgagtcataaacaaacaacgtctcagatgacctcagctatgatggcattggtatattagaccgtcataggtgagtcacctgtgataggtgtcgaagtagattcatcagagatagggttacctcttattggatcgtatgctttgaacccgtcacaagagaatcacctttaacgggccgataacaaccacacatgggctggtggtgagcctcacctttgacgagcagcggaaacacagcccgtcgtcagaggtgagtagagttatcgttgaccactcatctctaaccagggttgaacccatcaaaggtaaggctttgtacccgataaagatgacttgatccagcgtagtgcctcgcgttacttttgccattgtatatctgtttggatatgcatgggctcattcaggacgacaggacccttcggtatggtggattgacaaaacatttttcgaggattcaactcctagaaaaaattttcctgtaccaatttaatatattcatatatgttcaatgctgttacgagtactgtttgatgacatctatattaagcatcatctcctttatggatactccatgaagaaaaaccataggacaacatttaatatgaggaaagatgtgaatgaagagcaggtagtcacagctgtggaagcttagggtatgtgaaatggaggcactaggaattcaagtctctgctcccatctccacgtacgttcttgatcacagtgacatcacatactgggtacctagagaaaccgttagttacatactcgattgatgagcaaagaacacaaaatattattgcgatacatatagtagccaagtagtttcttcaattgtctctgtctagagtttttgggatgtacagatacacagacctcatgattaacactagcaagaagatatcccaataatatcgcaatatcatcaaaaaaaaactgtaaaaaaatctcctatatctaaggtaccaccggttaatttcatgatttcataaatttaaccatgtgtgttctatttaaatttatctttgtcatatcaaaattgattttaatatgataattagaatgtgtggttttacgtttgataccaggcttcggctatatagattcttcacaaaaataattgctatggaatacataggttgagtggattgccaacacctaaaagaactgcaaacgcgttaccatcatagacaatttgcagccgtttttagtgcattcattcacttagacatttcagcctattttttctcgaggaaaacctccaaaaaggacagggagctcatgcaatttcaccgttagaagaagagagtttatctagtttatcaggaaaaccgagtcaaaaatttactacagcacggttatttaaggaaaaccaatgaaaaccctaatattatcaaagtgagctaaccacgcagacctagatccactaacaaagtccaccaatccaataagaaaaatctcctaagacaaagcgttcaagaaggacacggaaacaaaagggtgacattggccgatccaagcaaatatgagattttcacccagagagatccattgaggctgaggataacatttgctacatagcaacgccttcaagaaggtgtacgacacctaagggcgtcgccgttgttagcgatggtaaggtgtgcaaggcttttgcccaccgcgtccacgatgaaagccacgcaatgccacctgcacacccaaagacttgcacaccaaaagccaccacttgtccaacacagccactgacgcacatatgctatatttttctagctaccaggtaccaagctgtcgaagatgtccgtccatcgccccggtcacattccactgccgcaccacaccatggagctgcacacgagaaagagggtgggagatccacatagagaagtggcccgagaaaagagcagccatagctccagcacagcttgccaagatgacatgcgccgccacctagcctgttctgcacgaagcttcatgccaaaccacggagttagcctgtcagaaccaccgaacgaccaccatctgaccagtctaatctgacaaaaatcatggatctagatctagatctggagaaaaacaaaagtggagacggagaaggatgaaagagagctaggaaaaaaatgataaagggagaggagaggtaaggcggagggggaaaggatgtgggagggaggagggcagaggtaggcgctggacaaggggagcctacagactcgccgttggtcacctcccatgtcgccccgagagagcggcatgggagcattgctggagaaaggtttttaaccctggtttgtaaaccccttagtcccagttatgcaaccgggactaaataaccgggattaaaaatccatatttagtcaagatggagccaagccaggtccggttggtagttttttttcttttttttattgtttttaactttgaatattgatttcactacatcctcaaatcatccccaaaacgtgaaatccccaaatcgatcatcacagaacaaaaatgatcatctcaaaatccccaaatcggtaatctccaaatacatcataaattctaaaaaaaaacatcgcaaatacatcatattcacatcacacacatatcaaatacatcacaaattttaaaagaaattcatcacaaatcaaatacatcacagattatacgtatcagatacatgcaatgaatcacaaattcttaaaaaaagtaagaataaaaacaatccggtgatgccgctgccgcctcccgcctcccctccggcagagaggacagcgccgcttgcacgccgcctaccgctgcccacccatccgcccgccacccgccttcttgcttcctgcagccgccttcctgccgccatcccctccgtctgcctctgcccgccacagccttcacggcgcgccgccgcgcgccactgcccgccaccgccatccccttcgcctgccgtcgcgcgccgctgcccgccgctgcccgccactaagaagaaaggaaggagagaaaatcgagaggaggagaggggaagggcgccggtatggaggaagagaggtgaagggataagaagagaggagaacgacgcggttgccgaggagatagcacgcggggaggcgtgcggctgcagttttttttcaattttggtcccagttgggataaacaaccgagattaaatatcattaaagatagcagtggggcccgacacggcctgaccacgttttgaaccgggactatcttagtcccggttggtgtcataaagtgtcgtgccgcttttgaaccggggttaaagatctctttagtcccggttcctattcgaaccgggactaatgtgatttttgccaacccagcaaagatggtttatctagtagtagagtcaaccctcatttcaatttaattagttggccctactataaattgggttgttccaaggccaacgtagtagcaatgttgagagtgatgacaaataattaggctcttccatgctatatatagatcgccctagctcctagctactcgccatcagcaaagcatgggcacaagaaacagccgtagccttcaatattccaataggagatggaggcatctggaattcacatcagagccgagaaattccgcctcgtgaattttccttcgaagagcctatagttatctttagcaatttattttggatagaaaaaggatacaccatggttcaggttctgtcttgctgtaaaaatttcgagccctgtgcacagggtcagcaagatcaagccggtgacggccaacaatacagcagtctaagcgatcggcaatacaacgtcactggcatgtgatactttgagaattgctcttgctgcaaggaatgcagcggcaacgttagcaggtgatttttttcctagagagggatgtatgttaatattgggagtacagcaaaatctaattagaactgcatgtatcatattgctaactactccctccggtttttttatatgacgctggttagtttaaactttaactagccagcatcatacaaacaaaaatggaggtagtgttagaataattaggctaggcccgatttatcctattaaaatctcaaaggcccataataagtgttaaggataataataccacctcaggatttaagcgaggagtatctcaacctaaatagggagttattagaggctccctgttgaccggttgaggtgggagtcggaaagccacacgcgcgcgcgccgggccgagggcgtggcgtggcttggctggctggctggcgtcacgtcgctattcttttgcaaccacgatcccacgttgcttctttcccgggtgttagttcttcctcctccgcgcctgtcctgttctcgcctcctcgcttctgatcacttgcgcgcacaagagatcggaaggagcagggcctccggaaccacaccttcgcctgatatctgcaccgggtaggcgggtgatcaggtttttggggagatcggaaggagcatggcctccggaacctcaccttcgcctgagatctgcacctgttctcgcctcctcgcttctgatcgcttgcgcgcacgagagatcggaaggagcagggcctccggaaccacaccttcgcctgatatctgcaccgggtaggcgggtgatcaggtttttggggagatcgaaaggagcatggcctccggaaccacaccttcgcctgagatctgcaccgggtaggcgggtgatcaggtttttggggagtgcttcccgcacgactgctcgtccaccatgtctgcgcctggagccggagctgccgccgccgccgctgctgctggagctggagatggcgtgcctggagctggagccggagccgttgcgaacgtcaacaccaacagaggcaattctgcctcacaatccagcggagggccattctcggggtatatccttctcctgctgttaactcattcgtttatagcgctgttagtcctgttagtcgcaagtcaattgcagcttttggggagtgcttcccgtacgattgctcgtccaccatgtatgcgcctggagccggagctgccgccggtgccactgctgctggagctagagatggcgcgcctggagctggagccggagctgttgcgaacgtcaacaccaacggaggcaattctgcctcacaatccaacggagggccattctcggggtatatccttttcctgctgttaactcattcgttcatagcgctgttagtcctgttagtcacaagtcaattgcgttcttgctatgttcatgttcatgatgcttatgatacctttagcatgctactggttatgctacatgttgtcactagatcacccaacactgtttatgccatgattattgtcttaacattttagattaaaatataccgatatatgaccatatttccaacaatccaaaaacctaataggtcattttcggtagttggctttgctgctgcactgaaaccacatgcttttgatggttctaactataagagatggaaagcacgtgcactattgtggttgacagcgatgcaatgcttctatgtttcacggggcaaacaaagtgaaccacctctttctcctgaggaagaggctaagttcgaggcttcggattgcctgttccgtggagcattgatcagtgtactcgctgacaacatagtggacgtgtacatgcacatgccttctgggaaggacatgtgggatgcacttgaggccaaattcggagtttccgacgccggcagtgagctgtatgtcatggagcagttctatgactacaagattgtcgatgaccgttctgtagtagaacaagctcatgagattcagatgctggctaaggaacttgagaacaacaactgtgagttgccagacaagtttgtggcgggtggcattattgccaaattgccaccttcttggtcggacttggccacttctctaaagcacaagagacaagagttcagtgtttctgatctcattggctctttgggtgttgaggagaaggcgaggacaaaggacgtccggggcaaaaaggttgagggaggttctagtgccaatatggtacagaagaagaaccctcatgcatcccacaacaacaagaaagtcaagcctgatgtcaaacccaaggctgcaaccaactttaagaacaaaggcaagggaaaggcaaagggagactgctttgtgtgtggcaagtctgggcattgggccaaggactgtcctgagcgcaaagacaggaagtctgccaacatggtcattagcgagggcggaggaacatcggggtacggtaaaatattacctacagttctctctgtttttcactcacctgattggtgggtggatactggtgctaatattcatgtatgtgctgacatttctctattttcttcttatcaggtcgggagaggttcctccttgttgatgggaaacgggtcgcttgcggctgttcatggtgttggtacggtcgatctgaagtttacttcggaaaagaccgtgcagctgaagaacgtgcagcatgtcccttcaataaagaagaatcttgttagcggctctctattgtgtagagaaggttttagacttgtgtttgaatccaataaatgtgtcgtatctaaatatgggacttttgttggaaaaggttatgacagcggaggcttgttccgcttttctttgaatgacatgtgtaataatcataatgttgtgaaccatattagcgaaaatgatgagtctgatgtgtggcattcgcgactctgtcatgtgaatttcggttgtatgacgtgcttagctaacatgagtttaattccaaaattcactttggtcaaaggttctaagtgccatacttgtgttcaatcgaaacaacctcgcaagcctcacaaggcatctgaggcgaggaatttggcacctctagaacttgttcattccgatttgtgcgaaatgaacggcgtgttgactaaaggggggaaagaaatatttcatgacactgatagatgattgcactaggttttgctatgtgtatctattgaaaacaaaggatgaagcattgcatttctttaagacctataaagctgaggtagaaaaccaacttgaaaggaaaatcaaacggttgaggtctgatagaggtggggagtatttttccaatgaatttgcatccttttgcgaagagtttggaattattcatgagaggacgcctccctattcaccccaatcaaatggggtggccgaaagaaagaaccgtactctaactgagatggtgaatgccatgttagacactgcagggctttctaaggaatggtggggtgaggcagttttgactgcgtgtcatgtcctgaataaaattccaatgaagcataaggaagtaacaccattcgaggaatgggaaaggaagaaattaaatctctcatacctacgaacatggggctgtttggccaaggtaaatgtacctatagccaaaaagcggaaacttggaccaaatactgttgattgtgtgttccttggttatgctattcacagtgtgggttataaattcttaatagtaaactctagagtacccgacatgcatgttggtacaattattgagtccagagatgctacattctttgagaatgaatttcccatgaaacatacacctagcacctctagtcaagaaactatcatgccccatgagcactttgcaccgatagaacacaatgatcaaacgcctgaggaaaatcctgaggaggacaacattgtagatactcgtaagagtaagagacaaagggttgcaaaatggagatgactnnnnnnnnnnnnnnnnnnnnnnnnnnnnnnnnnnnnnnnnnnnnnnnnnnnnnnnnnnnnnnnnn

SEQ ID NO: 27270 - DNA, 682 bp, Oryza sativa
  unsure (1)..(682): unsure at all n locations
nnnnnnnnnnnnnnnnnnnnnnnnnnnnnnnnnnnnnnnatgagcatttctgtaagtcgacagcatgtgactacttactggaagatcggtaagtgttgtgtaaggtgtgtggggggggaagggggcattatatcttaactcttcaaaaaagaatcccaaaacagaacaagaatgagccacattatccggcgaataatagccgttagatcaaccagcagacaaaacaggtagaataaatctcaaccattggataaaaaagtgtgttctaaaactttacggtgtctctccttcatatgtgagaaagagatattgaacatagaagacacatcttaaacatagaataaaaaggaatgtttgtatgatatagagaaatgatgaaaacattctttaaaaaaaactaatatatattttatatatatttcacaacaaatttttccattacataatattactaatggattattcttaaacacctatagaataagataatgatagttacgcacatgcgcgacttcatgcactaaaatatggngaacttttcctgtgatgcctacatattgccttccgaaaagctagaaaccacatcattcatattatgaggtattacttggacactagcaccggataagtcatcttgaaccggccacaaacctcgcatatctaaaatatcttgatagcaaag

SEQ ID NO: 27271 - DNA, 679 bp, Oryza sativa
aaaaagaatgaacatacgagagactaccattcgaaaaaaacttatgtacatatgtacaatcaaaaatgtcatatggaatcatattttatcctttttaattatgtcattctcatataaattgtgttaacaattagtaaaaataattttgataatatagagtatttccttgtacattacccatgaacatgcataggtgaattagatgtataataaaagaaaaaacatcaaaactcatattatgtttgcaaaggatgatgatggtaagtttacatataaccaaaacaaagtgatttttgtttgaatatgatagacactatcatttactatatcaaattatatggtctatttcacaatataaatattcccttctttttatggtaaggttacgaggtaatctattgttcctatagttaatatgatgatataagacttttttcagtagttttttatataaacaaaaataaattgcctgcgcatctgcgcgggcttccttcctagttttaagaaaatgtggtggtttgcctttggccatacttcatattgctagtttgttggcaaccaaatctaacacaaaggaagagtgggagttggtgctaaattctattggctcagcactggaaaatagccatactctacaaggtctgaaaaagataccactccctccgttttaaaatatttg

SEQ ID NO: 27272 - DNA, 497 bp, Oryza sativa
tggtggggattgttagaataattgggctaggcccgatttatcctattaaaatcttaaaggcccataataagtgttaaggataataataccacctcaggatttaagcgaggagtatctcaacctaaatagggagttattggaggctccctgttgaccggttgaggtgggagtcggaaagccacacgtgcgcgcacgcgcgccgggccaaggccgaaggcgagggcgtgggcgaagcgtggctggctggctggcgtgcgtgcgtcacgtcacgtcgctattcttttgcaaccacgatcccacgttcccatgactgcctccgcaacggcgcgtccacgatcccacgttcccacgactgcctctcttctgctatagaaggaggccgctagtccgatcagaacgattcgcttgcttctttcccgggtgttagttcttactcctctgcgcatgtgctgttctcgcctcctcgcttctgatagcttgcgtgcatgagagatcgg

SEQ ID NO: 27273 - DNA, 715 bp, Oryza sativa
  unsure (1)..(715): unsure at all n locations
nnnnnnnnnnnnnnnnnnnnnnnnnnnnnnnnnnnnnnnaacaaacatgaggccagcaaggctctactagagttcaagcatcaaaccaagcacaacaaaacaaggtataaaactatataacagtagcacagaaaaaaaaaatctatggacaaggcctacccagtacccacctcaccctgccctgccatccccccttgtgatgtgtgaatgtctctatcttacttgtgatagccagtatcctcacctcacccacagcccaccaatcacagcactcctttgtattctctctcctacatgcactcccctctacaaaaccacaaccagcatttttttcttttttcacaatccccttgacagcacagaggcaacagcaaaacacactctcatcagtgtcaggtctccacaccacacccaagtacaggtacacacaagacaatcctcccactgaactgaatcccatccactcctttatcatcatcaccatttccctccttcccttttcctcccctcatttccatttccagttgcagcaagagctgcctcctagctctcttcctgccatccatggcaaatgcttccctccaatcctttcttcttcaccaccaccattctttccttagcaatggtatccatgagggctccttcccttctataattctcaagctcacaacaaacagcaacagcagcatttcattcaagctcttctccaacacca

SEQ ID NO: 27274 - DNA, 1079 bp, Oryza sativa
  unsure (1)..(1079): unsure at all n locations
nnnnnnnnnnnnnnnnnnnnnnnnnnnnnnnnnnnnnnntacatgtaatcatgcaaaatcattattaaaatattatttacttcaaaaactcaagacaatcaaaatggagctagctacttcgactagtcagttaaacttcagttattctggcaggattagccattttaaggacaataaaaaaaactacaattttctactgtgacacataatttgaagatatatcatgaacaaaagaaaagagacaagtaaacttacatctcacatttgttcagaacagaaagcctgcttggaacacatgattgtccttttgctctgcacacagaactacaagattcgcccctcctgaaatcaacattgatatcatagagcaattgtgagggtgttccattcactcttcctatatagtatctcttaaattggaaaaggccttaccttcctatgctgatgttaatgccatccagccttggtccagaaccagaatcagctgatcctgcaaaataattttttataatcatttcccccctacgtaattaaagaaaattgcaattgtactagtagtgaataaatggtagcagcttttgtgctgcctgggcaagctcagctcagattaagctcgaaacttaaaacaacatgaatacaatgaatcttagttcatcgtaagtaattaacatactcagaggaccagggatgaggcactagattggggatagggagaggtgatcatggagaggtagaccaattcacctttcttgcttacatcataactaatagcccaccaccttatctctaatataacaagagatagagatcttaaaaagatcatatattcaaccggactcatcttatctcaataaaccttactaatgctatctaaactaatgagcatacatcgaactagattactgtctaattcgctggtgaatttcccagacctgcatcctgttatggcccaatggactgcaagtgttttaccagactattggcctgccataacatgcaagcgacatgttctgatatcttggttccttcattctgtgaagttaaaatactgttgtctcggttcttatttagtgttgtaa

SEQ ID NO: 27275 - DNA, 733 bp, Oryza sativa
  unsure (1)..(733): unsure at all n locations
nnnnnnnnnnnnnnnnnnnnnnnnnnnnnnnnnnnnnnnnnnnnnnnnnnnnnnnnnnnnnnncaacacggtgaatatacaaaccacccattgctaattgcatactaactattcccctgtccatagaaaatcaagccaatctggacatcagcattatcttcgaaatgcaattttgactgcaataatttctattgcaacaatgtctgtgtaaaatcaaatgaactagtacaatactacacaaaacaagactgcactttgtagaaatcaaatctacacatctatgtaactcgcatgtgtccaatttttaaatgttttagaaatagctatgcataaattttaaatgtgcccacatttgatttgacaatatatacctagctggtgcgcttcttcttgggaggcctggaggacgttcttggcggcgggggtgaacttgatctccatggggaccatgccggggcccctcccggccatcttctccacctcggcgcgcgccgccttgaggctgagcccggcgcccctgagcaccttggcgccgatgccggtgccctccccgatgacgccgaggaggagctgctcgctgccggcggcgtggtgccccagccgccgcgccttcttctgcgccatcatgatcgccttgatcgccttgtccgtgaacatggcgaaccccattcttgccaccacccgcgccccccttcttcttccgccgncgncgttcgcacgcncgtacgacgcc

SEQ ID NO: 27276 - DNA, 729 bp, Oryza sativa
  unsure (1)..(729): unsure at all n locations
nnnnnnnnnnnnnnnnnnnnnnnnnnnnnnnnnnnnnnnnnnnacgcgattgtgatgttgcggtcacagatcggcggcggcggagaggagaaggggatgatgtggacctcaagatggcaaaattgcgattacggcggcggccggcgattgggttagggtggggtttgtgttgtgtgcttgggtgggtgggtgggcgtggaagcnatataagtgtgcatttattgtgagtgtctacgtttatactttttttaaaaaaaatgttatactaattaaaccatgtggaaacaataactgacatacacaaaaaacaaaatagtgaaatatgcgaaatggaatgattttgatgttgtaccaactgcttttggcgtattttttatagaaattatcggttttacaataatataattaaccgtatttctaaataccatataaataatatatatgatccatatatctattttagcggccgattagaaatccataaatccttaatttgggtaatgtcaatgatatacttataaacatgtgctaaataaatactaaataaatcccctcacttaaaagtaagaaatagttcatcgggtgattaaaatggttggatttgatcctaactagccccttaaagtctattagaccaagggcaacttagactatctccaacatacttgcctttacaagagacccattggaccgtatgcgtcccgctgccgcaaaaggttctgcccctat

SEQ ID NO: 27277 - DNA, 718 bp, Oryza sativa
  unsure (1)..(718): unsure at all n locations
nnnnnnnnnnnnnnnnnnnnnnnnnnnnnnnnnnnnnnnnnnnnnnnnnnnnnnnagcaatattgaaaatgcattttgttgggaggagatacaagaaagaagtccatttgttcacacgtctcaccggatcatcgaaccaaaccggcccaataaccccaaaatcctaccataaaccctagaatcccctccaccccaaggcccagccgccgcctcctcccttcctctcttctttcctcgccgacgacgcgattccccaccggcgtacggcggcggcggcggcgagggatttcgccggccagctagccccatcctcaacaaaatcgaggggtcggttgctctcccggtggaagagccccatggccttcgccaccgccccgcagcctgtgtcctctccattcgccgcagccggcgccgcgtcgaacaacccccacaagcgcaagaagccggcggcgagggggaaggggaagggcaagggaaagggccgtctcgccaagacgcccaggcgctccgatgaccccggcgaccttccccgccgccgcagcaagcccagcgacaggttcctcaagctgctccgcaagcgcgcccgcgactacaactccgacgacttcgacgaccaggagcgcctctcggatgaggacgaggaggaggagggggcttccgcttcggtgacgacgaagcccgcggcgcggtgaccaggttcgagcaggggtgccgcgcg

SEQ ID NO: 27278 - DNA, 688 bp, Oryza sativa
  unsure (1)..(688): unsure at all n locations
nnnnnnnnnnnnnnnnnnnnnnnnnnnnnnnnnnnnnnnnnnnnnnnnnnnnnnnnnnnnnnnnttgttgtaattgcaattgtaaagtctacgtaaaaaacataccggattattcttccgttgccttgtatctgtcattgctggattggagtgtttcgatttgtccatcgtgtgtaatattcagatatataactaatatatttaaatttcacatgaaacaatcaagctgaatggaaaccaaatacctacagcaagaaacatctatggaacgcgatgcacaagcgccggcggtggccggacctcgcgatctgcttttctttttctttccctgcgctctcctttttgatggagagcgactctgctcttcgatggagagggatcgagcgacgcttgaccataggacgcacaaatgagaaaaaaattaagtgtcagatttacccctattcggttttagcactttactaatttaccctttaaaataaacggtcgagattaattctacttggagtagaatactgcaagtagagggcaccggagcgtctctccggaataaaacgctggcaggcgagggtcaatggattcacagccggtacccatggacacagatacatcaagcttatacctttttctacgatcgttcacctcgagaacttggttcttgaggttttcaatctcttgagaaatagta

SEQ ID NO: 27279 - DNA, 731 bp, Oryza sativa
  unsure (1)..(731): unsure at all n locations
nnnnnnnnnnnnnnnnnnnnnnnnnnnnnnnnnnnnnnnnnnnnnnnnnnnnnnnnnnnnnnnnnaaactctatccccaaacaaaaagagccccttacatagaggggtttcacacagattgaactagattatgatgtgtccacaataccatcggcacgatcatggttgttaaggcgtcgctgtagcagtaaggcggttgcggaggtcaaggcgtccactccgccttatgtttcctccaccttagaggcaaaacgagtagagaaagggaaagaacaggaaaaaccagtagagaaaggaaaggaagaagaggtaagctcatcatggaacctagttggcttgtagagaaagagaaagaagaagcggccagagacattgatggcggctggtgcctcttctcgtcatggcggctggtgcctggtggtgtacgatgtctcttagggcataaaacacgtgggtatgaagactaatgttggtctttggtgggctggttgcctggcttagtgggccttttaccaatttcctttttttttcttcctaatttctctaccatatcctccactaatcacgcctcaatcatctcataaggcgtcgcaatgttacgcctcagcgctatggcgctaaggcagtggtgggtcgccttaaaccgccttaacaacactgggcacgattcaagtgcacaacaaaatttggggtgactttgctagacgatttcaaatctcatgttaaatcgc

SEQ ID NO: 27280 - DNA, 352 bp, Oryza sativa
  unsure (1)..(352): unsure at all n locations
nnnnnnnnnnnnnnnnnnnnnnnnnnnnnnnnnnnnnnnaaaacggtgcgaatcatttggcggaaaaatatcatactagtctagggatccggatccggcgctccgtcgaaaagctgaactggaatttcttcttctttttttgcgcgtagatggcccacatgttttttttttctttgcatcaaaacccttgtaggtttccttggcgtcctgcgtcctcctctgcacccgatctcctcgaccaagacggagatggcgaccaccgcccttcccctcctacacctcctccctcggatcgtatgcgccgccttcttcgcctgcctccccggcctcgtcgccggcatacggcgagcta

SEQ ID NO: 27281 - DNA, 695 bp, Oryza sativa
  unsure (1)..(695): unsure at all n locations
nnnnnnnnnnnnnnnnnnnnnnnnnnnnnnnnnnnnnnnnnnnaagagagattagtggtgcatggattcgagaagtggacctgtatgggaggagatcggccgggacttagtggtggccggtcatggtggagagagaagagagagctcgtagagctcggatgatgtggggaaaagagagggcttcaccggctatttataggattcgggaagtcggttcaccggaggaggacgaggaaggcacggcgatggtagcgtgaggaggaggatgacggcgccggtctcgtcctctgattgggcatcgatctcagttcggctcgtgtttgatgtcagcgaagtgacatgcggccgacgtctgttggaaatttggtcataattcggcatattctaatccaaaatattaagacaataaacatgacatttttaatatgagtagatctagtgataatgcttgatgtatacaacttgagcatgcttaaaatgaaatacgcatcaacatttacatagtaacgcaatgctgccattgcgaagaacatcaacaaagaaacatcttatagaatcaggagaatgaaactataccctaagaacgtcccaccgctggattttgaggcagtattggctccgttgatgtcgttcaccttcttttcttcaatctccgtcgacatgttgacgaaagcgtcgatgcaccagtagtagtc

SEQ ID NO: 27282 - DNA, 1832 bp, Oryza sativa
  unsure (1)..(1832): unsure at all n locations
nnnnnnnnnnnnnnnnnnnnnnnnnnnnnnnnnnnnnnnattttgaggcagtattgcctccgttgatgtcgttcacctccttgtctccaatctccgtcgacatgttgacgaaggcgtcgatgcagcagtagtagtcgcgaagaacaggagcagtcgcgcttgaagcgctatctaaaaacttgatcgcccgtctacccgtgcaagttctcaagcggacggagttccggaggcacctgctcgtcctgtacacctgtgcgtgcaggtgaacagaaccggggaaggattctgcagctcaggaacagaggaggaggaactcgaagtacaagagtcgtgaagaactttgtcgtcgttctggtcgctgcggagtatatatatgcgagcgcgagagtaacgttcggagtcatcaaccgcggtgtttaatttcgtaaccgacgcgctcgttaatacagaatcaattcacggcgtttaattccgtaaccaacggaatcaaatcaattcacggcatttaattccgtaaccgacggaatcaattcacggcctttaattccgtaaccgacggaatcaaatcaattcacggcgtttaattccgtaaccgacggaatcaaatcaattcacggcgtttaattccgtaaccgacgcgttcattgatacgaaatcaattctccgtgtttattaccgtctgttacaaaatgagagagcgcagcagcaactgtctgcctcgcctcgcctcgccccgcctggttgtccgcgcaccatctcaaccggtcaacagagactctcgactagctccgtatttaagttgagacctcttcacttagatttcgaaggtggtattattacccatagcactttgacggagcgtggggctcctcaccgggagaccgcgcaggcccccctttgccggttcggccgggggcgctaagtgaggttcttcgccctcgatctaaggaacgtccgcgagagaggaagtgcacaagacacgggcgacgtagacaggttcgggccgctgagaagcgtaacaccctactcctgtgttctggtggatctgtgcgtgaaggaatacagagagccggagagcgagcgagagttcagggtctagaacccattcgctagagtcccaacccctcttcccttttttctccctccccctctcctctcctagcgagcgagagttcagggtctagaacccattcgctagagtcccaacccctcttcccttttttctccctccccctctcctctcctaggcctgggcctcctttttatctggtcaggggtcaccacaagggcctccagctgcctaagaaaggaaacatgctttttacaatgagggctagtctacagccggaagtgacctctgacaagcagagcacacgcctcctgcccccctcgccagctttcccggtggacgcccatttcaaccttcattcaatggccagcgacttccttgccatgcttgcgctgaagcctggaatggatctgaccgggactgacataccaactccaagagttagcacgccggctccggctagggacgagagccaggaagctcttatcattccgacgggacggggcgaggcgtgcgaaaggccgcctgttgccacctaacccgcgatctgaccggtctgtaaccggtcacacactgtgacctgtcacggaccgaacgagtgtgctgcgctgcattaaatgcggtgtgggacgctcgtccaacccgcgataaacgcggttaggtgagcgccgctgtgctcacctaacccacacacgtggcgccaaacccacagggggtcggggcgccccagccctcggggtcgaaacgggagcggcccgacccc

SEQ ID NO: 27283 - DNA, 1707 bp, Oryza sativa
  unsure (1)..(1707): unsure at all n locations
nnnnnnnnnnnnnnnnnnnnnnnnnnnnnnnnnnnnnnnnnnnnnnnnnnnnnttttcaaagtatcatttctctatttcttttcatcgacattgcttacataattttaccaaactattcgttagaatttaaatatgtaatatttaatacatccctataaacaattatctatcatctcttcttcatcgtaaagttagatttactttgtttgaaaaacatgtctaataaattaagtgtaaataaaaataaggtgatttgtcttgtttaattgaatgtttagtattttttaaaataaatcctaaagaactattactgttaataaatatgctttatttgtcccaccaaattagtcctccttctagatggttcagatttacacaaaatgttatatacttacatataaattaacaaagatgtatcataggcctcatttccttgtgatatgcatgatctatattatcctttttaaaagataatacctagttaacatgaatctgaaaacttaaatttaatagtaacaaataaaacttttcaacaactatatactgctatcttagtgtggcttatatatgcaattatatacaaataaactcataatgctacggagtaattataatcttaagaataataattagttaaaaatctaatatagttgattctgttgtttgtaattattgatcatttttactaattagttaaaaattagaagatggatgaattgaatgagagaggagacgaacagagtgaaaggggagagagtatgcttgcatataattacttgatatactattttagctgattactttattaactaaaaatagaactaaactctatcttttttacacgtctttttctacggtatattcacagtatgtgttaaaaatatgaacactataagtctaataatatcattttgactaattataatattagaatggggggatttaggttattttcactttatcattgtacatctaatttaactactgcgaagatatatacaatgataaaatcaatatcatttttttaataattttataattgtttgaatgacatgcaaaagttagaaaatatagccccaaagtgatatatttcttttcaaagttgaattaaggtaggtttgggtccctaaatgcaaaataatctaaagatataagcggatcaaatattggttggataattaacatgtgatagtgacctatattttagcattactttggctttcaaactaatatatgttggaaatatgagtgacagtgatatatattttattttatgattgtagctctaaaatcttcaggattatcatcatcatcatcatcatcatcatcatcatcatcatcatcatcatcatcatcatagttcatattgtttacaattgcttgaatggcatacaaaagttagaaaatataatccaaatgaaatttcttttcaaagttaaaatatagtgaaaattagcggataaaggttagttgtatgatttagacattatagttgcttaaattgtttaacgcatttttcttttctaactaacaaagcatgaaaataggaaaatgaataggtggaaaagaggcgaaagagattgagggaagatggcggcgccgccggctgggggggtgggggtggagggagggcgcgtttcccgtacttgcattnnnnnnnnnnnnnnnnnnnnnnnnnnnnnnnnnnnnnnnnnnnnnnnnnnnnn

SEQ ID NO: 27284 - DNA, 1211 bp, Oryza sativa
atagatctaatccagacgaacgtattttgacacacgggagattaattacaggaaggaattattattttaatagatctaatctaatggcggtaaataatgggtccaccaaatttaataaaaatcaatggtgagatgtttttcttttttctcagaatttatatatttttctatttttattagagtgtcacgtggcagtttgagagcgtttttagagcgccatgtgacggcatgagagcgtttgtagaaagtttaatggactttagtatataatagatggtgggtcaaaagatacaataccaatttatcacttttagatttagcgtttaataatttatcatccatatatctatatttatgacacgtgaattctcatgactatagatccggtgataaattgttaaacactatgtgcatcagagtgttaaatatctccctcccgagtcctatccgacgcttctcttctgtagtccgtggccatgtcgtcctcgagcaggtcgtgtcgctgcacggtggccgttgtggctttgaatccatcggatgagatcccaggcgcagcgcgtggcgaggaagcggggcagttcgggatcggggacgcgatgccgacgcggaactgggtaaagtcccctccgccgaatctcgcaaaattctgcgtgcgaaatgcggctgatggcatgaatcatgcgcggattctgttggtcatctcggtaggttcccggtgtgttcagattcagatcatgcggcagattacccctgttacacttacatcagctgccttgttttccagttcgttgaaacaatttgtggcactaacgttaaaattaaaaatttagttgaaattggaacgatgagacggaaaagttatgtgtaggaaagtttcgatgtgatggaagagttagaagtttgaaaaaaaactttgaatctaaacacggcataactcaacacgtgagcttgttgaacagtattatcaattggaattcggagagttgttgatctctctctctgttcctcgtagctatattcttgctatccacgatggctgattggaattggtttttgatgttaactggacctccgcaaaccctttgtagtactagtttgtaattttctttagtctcaggttgtaaattgggactataaatacatgactgaagatttttatccttagtctcggttaaaatacccagaactaaagatttttttttattttgctt

SEQ ID NO: 27285 - DNA, 2295 bp, Oryza sativa
  unsure (1)..(2295): unsure at all n locations
aattttctaaatccatgtcaggcagtttgtggctaaaaatcctatttatttcctttgttttcttacctcattcccaaaaatattttgaggaattatattaattccctcccatttgagtgctttaatatttagaccacattattgcactcaaatatttaggaaatatctcttttgaaagttatctccaaaaatagattcatttcaaaagttagccacctaaattccttccaaatattaatttggattcaaacttccttcttcaaatatcttccaaaattcaaaaataacttctatttgcttttgggccaaaattcccttttcttcttctatcggcccatctccctcttggcccaggacggcccagccaacccttccagctgagccgcccctctcctttctgtgggcaccgatgccaggtgccctaggcgggataagttcactttgggtctctctatttgtcgccagtccgattttcgtcccttggtcgcaaaaccgggtacaactggtcccccaacttaccaaacccgttaaataaaggccctcaacggtattggacctggtttttgctgacatggcgtccacctggcttctttgactagggtcttcgtcatacatggcattaaccgggcgcttacgtggtaatttgatccctgaaaaatattaaaacagtgggacccacatgtcagcttcatatccatatcttttcgagtcagcgaaaaagaacaagcgnccgagctggagcggacgacgccgacgaccgtagcaagctggcgacaagaaaggcggcgccaagggccgggagccactctcctcctccttgtcggccgcgggcgggaagatatcggcggcggcctcgacggggagccgctctcgctaacggtggccgcgcaagggaagatgtcgacggcggcctcggcgggcacaccccgctcctctcccgccgcttaccgcccaccgcaccccgctcctctcccgcagaagcccgtcggcgggcgcaccccgctcctctcccgccgcctaccgcccgccgcaccccgctcctctcccgctgtcagccgcccgccgcactccccctcctctcccgccgtcagccacccgccgcaccctgcttctctcccaccggcatcgttgaagcatacagagccacagaggtagatgaggttgaagaagtgggacccgctgacatgtgggtcccttttttattttttttactggcatgtgggtcccacaaattttgtataatttttttattttgaattttgatgtttttattttttttcggatctaattgccacgtaaacgccacttcaatgacatgtgagacaaagacccagtcaaaggagccacgtaggcgtcacttcagcaaaaaccgggcataataccgccgagagacctcacttacatggtttcacaagttgggggacctatcttacccggttttacgaccaagggacgaaaatcggactgggcgacaaatagagggacccagagtgaacttattccccctaggtgccgttgtcgtgcgccgtgatttgagccgccgctgacgccgtgccgtaccttcctctgccgctgccaacgtccttccgtcgccgctaagaaatcaaaaagacgtcagccgcacgtcacttcgctgacatcaaacacgagccgaaccgacatcgatgcccaatcagaggacgagaccgacgccgtcatcctccttctcacgctaccatcgccgtgccttcctcgtcctcctccggtgaaccgacttcccgactcctataaatagccggtgaaaccctctattttccccacatcatccgagctctacgagctctctcttctctctccaccatgaccggccaccactaagtcccggccgatctcctcccctacagctccacttctcgaatccttgcaccactagtctctcttcactccggcgaatccattttgtccatttcccccttctctctccctgcaaactaagccaccaccattaccaccttagccggccgaaggtgagctcgtgttgccgctgttccggctaactcaccctttctctcttccagccaccacccttcccgggtgcgcgttgctcgggaacacgttttcgcagcgacgtcggcgttccccattcactggagcaccgggggacctctcttcctcttctttcgtttactcggctggaaaagaagaaggaagataccggngggagaaaagagagaaagaaaagaaaagaaaacaaacactgacaggtgggcccctgcacagtaactcttcatattttccctattaaaatcaaatcca

SEQ ID NO: 27286 - DNA, 1502 bp, Oryza sativa
  unsure (1)..(1502): unsure at all n locations
cattgttgattaatataatagcttgctgagtacgttgtactcacccttgctttaacccccttctttcagagttaatttggaattcttgccgaagccgggagttcaattatataagttagtcttatataagttagtctcatctcaacctaattcgcaaatatagattagatagatggtttaagtctatagccaaacattagggtcaagtcattctatagcttctgttgtaatagttagccacaaccttgtaaataccctattatatcacataaagaagtctcctttggagccttgatcaaatgtatgcaatgaagatccagattgttgaacctgtatcaatctactgatccagggcttgatacagttaaacatgtcggtttccgaatcattagttctgggacccgacagcgttgatatcagagcatatgttttactagagccttaaacccataggttttctaacccccttcatgagtaactttcccacctatatagaataatttggttaaaaactaaaaatttgcctaataattttgctaaggcctttattagaatgaactccccttcaccgttggttttatttttttgcttttacttatgcatcatatctctctttcaaaagaataactattttaacaataaaagtatattcccctccgaagacccttgtccttgatatttcaagaaagtcagtgggtacaagcctttgattatgccagcatgagctgagtttattgcaatccaagcaactaagaatacaagttctgaggaattatttggtgaagcaaatatgtgtccatattgtcaatataatagaagaatattggaatataagtggatttctttaagggggggggtagttcaatataagaactatcaggattcaaggagccgttatatttgaacatgaacaaagtcttgaagctcatatcgtgaagaagaaagaagggatgcatattacgaaattttggaattttgataaaagaatcctttgagtagtatttatgaaaatattgtctattcaggcagaaatgatcgaagacattctaacagtttacaagacattatatatatatatatatatatatatatatatatatatatatatatatatatatatatattggactagggaaatatgtgcaagatgaaaaggggatgtcatattatatgttttgattttatgcgaagaaaggatagtcttgatccgttgatatctatcaagatctatcattgacatatatacaatcaagaagacatacaatatgaagccaagtgacagttcaagtacttgagaagcatccagatatttccaaacaaataagtgactcagaatgaaggattcccgagattatagaaatctagttgaagaacttccaaatatacaagactcagaataatttgaaagattccaagagcttcaatttcagggagtagaagnnnnnnnnnnnnnnnnnnnnnnnnnnnnnnnnnnnnnnnnnnnnnnnnnnnnnnnnnnnnnn

SEQ ID NO: 27287 - DNA, 1401 bp, Oryza sativa
tgcagtaatcaaacatgtgatataatttcttggagaaagagaagttctggaataaattcactactatttaaactctatggattctgaaatatttcatgatatttcctaagtacgggtagtgaattatgcacccggattgctatgacataccttcttatatgtgacacgcaataaggagctaacacatggatttgtactaaaggaaatggttagatatagttagagaatataacttcaatgctcgacactattcaacaagttgtaatcatagaaatacagcatgtagttaccgcaagaaatgccgcaagggaatgcataagaagaggatcggtgactacgaataattagagaattaagaaacaatacaaaactatgagtcagaaatctaagttagggagttacaaaaggttggaagaaaatattgtctaagaagacattgaagccatgaaacgaagaccattcatcagctctatttcgaggatacgagcggaagtccgaccaccccaatgaggagcagaactagaagatcatagtaaacctcatcgataggtatcatgactgcataggtgcaagaaagattcaaagtatacatccaagaatacaagttatctatcagcagttgaccaatcgggtatccgaaacttttgaaaggaataaggaaagaataaagttcctatacttctacttgtactcttcagaaatctcgaggacgagatttatttaagggggcaggtttgtaacatactgaaaattagctattttctaattatgcatcatgccggttcttatgttcttattaaccttctaaacctaggaaaatataattagagagagacctcctaaaactaacttgcataaaatccctctttgatatttaaaagcttttgtgattttcatttaaaattatcttgggatatttcttgatttggttttaatttaaaaccttctattgacaaaattccttttattcaaatttagtttaaaaaccctttccacttttatgaattatggtccaagaaattctccatcattgtcctagaacctaaaccaagtgattccaattttataggaattaattgtcgatccatcctttgattcgaaacctatccttaactttcttccaaatccaaattccttcctttcgatctagccactaatttaattcatgtggcttgataccctctttggcacaataataatatttttttgaataattgctcttgtgctaagaaggatatatttttattttatttccctcttccaaattaatctccttttagcctcaaataattttctaaatccatgtcaggcagtttgtggctaaaaatcctatttatttcctctctttgttttcttacctcattcccaaaaatattttgaggaattatattaattccctcc

SEQ ID NO: 27288 - DNA, 3526 bp, Oryza sativa
  unsure (1)..(3526): unsure at all n locations
tctattgacaaattccctttattcaaatttagttttaaaaaccctttccacttttatgaattatggtccaagaaattctccatcattgtcctagaacctaaaccaagtgattccaattttataggaattaattgtcgatccatcctttgattcgaaacctatccttaactttcttccaaatccaaattccttcctttcgatctagccactaatttaattcatgtggcttgataccctctttggcacaataataatatttttttgaataattgctcttgtgctaagaaggatatatttttattttatttccctcttccaaattaatctccttttagcctcaaataattttctaaatccatgtcaggcagtttgtggctaaaaatcctatttatttcctctctttgttttcttacctcattcccaaaaatattttgaggaattatattaattccctcccatttgagtctttaatatttagaccacattattgcactcaaatatttaggaaatatctcttttgaaagttatctccaaaaatagattcatttcaaaagttagccacctaaattccttccaaatattaatttggattcaaacttccttcctcaaatatcttccaaaattcaaaaataacttctatttgcttttgggccaaaattcccttttcttcttctatcggcccatctccctcttggcccaggacggcccagccaacccttccagctgagccgcccctctcctctctgtgggcgccaatgccaggtgccctgggcgccgttgtcgtgcgccgtgatttgcgccgccgccgacgccgtgccgtaccttcctctgccgccgccaacatccttccgtcgccgttaagaaatcaagtcggcgttgttagattaatgggctaggcccaattaaatcctaataaattccattggcccacattaagtgctatgggtaataataccagctttgaaatctaagtgaagagttctcaacttaaatacggagctagtggaaagtctctgttgaccggttgagatggtgcgcggacaaccaggaggggcgaggcgaggcgaggcgaggcagacaattgctgctgctgcgctctctcattttgtaacggacggtaataaacacggagaattgatttcgtatcaatgaacgcgtcggttacggaattaaacgccgtgaattaatttgattctgttggttacggaattaaatgccgtgaattgatttgattccgttggttacggaattaaacgccgtgaattgtttccgtattaacgagcgcgtcggttacgaaattaaacaccgcggttgatgactccgaacgttactctcgcgctcgcatatatatactccgcagcgaccagaacgacgacgaagttcttcacgactcttgcacttcgagttcctcctcctctgttcctgagctgcaaaatccttccccggttctgttcacctgcactcacaggtgtacaggacgagcaggtgcttctggaactccgtccgcttgagaacttgcacgggtaggcgggcgatcaagtttttaggtagcgcttcaagcgcgactgctcctgttcttcgcgactactactgctacatcgacgcctttgtcaacatgtcgacggagattggagacaaggaggtgaacgacatcaacggaggcaatactgcctcaaaatccagcggtgggacgttcttagggtatagtttcattctcctgattctattagatgtttctatgttgatgttctttgcaatggcagcgttgcgttactctgtaaatgttgatgcttatttcattttaagcatgctcaagttgtatacatctagcactatcgctagatctactcatattgcaaatgtcatgtttattgtcttaatattttggtttaaaatatgccgaattatgaccaaatttccaacaatcccaaaacttgataggtctttttcggtagttggctttgctgcatcactaaaaccacatgctttcgatggttcaaattataaaaaatggaaagcacgtacacttttatggttgacggcgatgcattgtttctttgtctcacggggcaaaccgagtgaaccgcctctctctccagaggaggaggctaagttcgaggcttcggattgcctgttccgtggagtattgatcagtgtactcgttgactatatagtggacgtgtacatgcacatgccttcagggaaggacatgtgggatgctcttgaggccaagttcggggtttccgacgccggcagtgagcggtatgtcatggagcagttctatgactacaacatggtcgatgaccgttctgtagtggaacaggctcatgaaattcagatgctggcaaaggaacttgggaacaacaactgcgagttgccggacaagtttgtggcggatggcattattgcaaaattgccactttcttggtcagactttgctacttctctaaaacacaagaggcaagagttcagtattactgatcttattggctctttgggtgttgaggagaaggcaagggcaaatgacaaccggggcaaaaagatcgagggaggttctagcgccaatttggtgcagaagaagaaccctcacacatcccacaacaacaacaagaaagtcaaacttgacgttaaacccaaggctacaaccaattttaagaagaaaggcaagggaaaggcaaaaggagattgctttgtgtgtggcaagcctgggcattaggccatggattgtcctgagcgcaaggacaagaagtctgcaaacatggttattagtgagggcggaggaacattgtggtatggtaaatttttacctacagttctctctgtctgtcactcacctgattggtgggttgatactggtgctaatattcatgtgtgtgcggatatttccctgttttcttcttatcaagtcgggagaggttcctccttggggatgggaaagagtcgacctgcaggcatgcatggtgttggtacggtcgatctgaagtttacttcgggaaagatcgtgcagctgaagaacgtgcagcatgtcccttcaataaagaagaatctagttagcggctctctactgtgtagagatggttttagacttgtgtttgaatacaataaatgtgtcatatctaaatatggaacgtttattggaaaaggttatgacagcggaggtttgtttcgcttttcctttgaatgatatgtgtaataaagttgtgaaccatgtaagcgatgataatgatgagtccaatgtgtggcattcgcgactttgtcatgtgaattttggttgtatgacaggcttagccaacatgagtttaattccaaaattcactttagtcaaaggctctaagtgccatacttgtgttcaattaaaacaacctcgcaaacctcacaaggcatctgaggcgagaaatttagcaccactagaacttgttcattccgatatgtgcgaaatgaacggcgtgttgactaaagggnnnnnnnnnnnnnnnnnnnnnnnnnnnnnnnnnnnnnnnnnnnnnnnnnnnnnnnnnnnnnnnnn

SEQ ID NO: 27289 - DNA, 3473 bp, Oryza sativa
  unsure (1)..(3473): unsure at all n locations
caataaatgtgtcatatctaaatatggacgtttatttgaaaaggttatgacagcgnaggtttgtttcgcttttccttgaatgatatgtgtaataaagttgtgaaccatgtaagcgatgataatgatgagtccaatgtgtggcattcgcgactttgtcatgtgaattttggttgtatgacaggcttagccaacatgagtttaattccaaaattcactttagtcaaaggctctaagtgccatacttgtgttcaattaaaacaacctcgcaaacctcacaaggcatctgaggcgagaaatttagcaccactagaacttgttcattccgatatgtgcgaaatgaacggcgtgttgactaaagggggaaagaaatatttcatgacattgatagatgattgcactagattctgctatgtgtacatattgaaaacaaaggatgaagcattacattactttaagatctataaggctgaggtaaaaaaccaactggaaaggaaaatcaaacggttaaggtctgataggggtggagagtatttttccaatgagtttacttctttctgcgaagagtatggaattattcatgagaggacgtctccctattcaccctagtcaaacagggtagccgaaagaaagaaccgcactctaactgagatggtgaatgccatgttagacactgcagaactttccaaggaatggtggggtgaggcaatattgactgcatgtcatgtcctgaatagaattcctactaagcataaggaagtaacaccattcgaggaatgggaaaggaagaaattaaatctctctcacctacgcacatggggctgtttggccaagataaatgtacctatagccaaaaagcgtaaacttggaccaaagaccgtagattgtgtattctttggttatgctatccacaatgtgggagataggttcttaatagtaaattctggagtacccgacatgcgtgttggtacaattactgagtctagagatgccacattttttgagaatgaatttcctatgaaaaatgcacctagcacttctagtcaagaacctattttatcccctgagcactttgtgccgataaaacacattgatcaaacgcttgaggaaaatcctaaggaggataacattgtagcaactcgaaagagtaagagacaaaggactgcaaagtcttttggagatgactacattgtatatcttgtggatgatacttcaagaaccattgaagaggcatattcatctcctgacgctgactattggaaggaagcgatacgctgtgagatgaactcaattatgtctaatggtacttgggaagtcgtcgagcgtatatatgggtgcaagcttgtaggatgcaaatgggttttcaagaaaaagcttaggcctgatggtacaattgaaaagtacaaggcaatgcttgtggccaagggttatacccaaaaagaaggtgaggattttttcgacacttattcaccggttgctcgcttgaccacgattcgagtactactcgctctggcagcctctcatggtctactcgtccatcaaatggatgttaagacagctttcctcaatggagagttggaggaggagatctatatggatcaatcagatgggtatgtactagaaggtcaggagggaatgatgtgcaagctgttaaagtccttgtatggtctcaaacaagcgcctaagcaatggcatgagaagtttgacaatacacttacatctgctggctttgttgtgaacgaagctgacaaatgtgtgtactatcgctatggtgggggagagggagtaatcttgtgtttatatgtcgatgacatattgatctttgggaccagcctcaatgtgattgaggaggtcaaggactttctatccaaaagctttgaaatgaaggatttgggagtggctgatgttattcttaacattaaactactgagaggagatgagggtgggattacacttgtgtaatctcactatgtggacaaggtcttgagtcgctttggttatagtgactgcaaggcagctcctactccttatgatcctagtgtgctattaaggaaaaaccgaagaatagcaagggatcaattgagatactcccagattattggttcattgatgtacttagctagtgcaacgaggcctgacatctcatttgctgtgagcaagttgagccggtttgtttcaaatccgggagatgatcattggcatgctcttgaaagagtaatgcgctatctaaaagggacaatgagctatggaattaactacgctgggtacccaaaagtactggagggctatagtgattcaaactggatatctgatgctgatgagataaaggccacaggtgggtatgtgttcacacttagagggggtgttgtttcctagaagtcttgcaagcagaccatcttaacgaggtcaacaatggaagcagaactcacagctttagatactgccacagttgaggccgaatggcttcgtgagctcctgatggacttgccggtggttgaaaaaccagtaccagcaatcctgatgagctgtgataatcaaacagtgattattaaagtgaacagtttgaaggacaagatgaagtcatccaggcatgttaaaagaagactgaagtctgtcagaaagcagaaaaactccggagtgatagcattagactatgtccagatggctaaaaatctggcagatcagtttaccaaggggctaccacgtaatgtgatagactgtgcatcaaggaagatgggtttgagacccacttagagttgcacaatggtggaaacctgtccattgtgatcggagatcccgtgaatttggatggcgaaacaaactattgtgtaactgagagaagagaccctaaaatgggcttatcttcatgatgcacttctcttctaatctgtatggtaggatggtatacaccttaatgtgatccgagtggctttccataaagcagagatgttggcctacagaacatcttagaaggaacacacctatatgagtctgattgctagtcacaatctatgagatctgggtgatctctagatactcatgaaaatgccaggagtatgacttatacgctccaaacagagaggatgcaaacggcagcctagtaccagttaacggtttgagtgaaacctgaatcacacaagactgacaattcaaggcatagtccattgtttagttgtgatctggtgtagttcttttcctaggtggaagttcaacttaacagtctccaccgaaacactggtataacaaacaggataagaatcgagagcatttcctgtgagccatgaaatttggtggggattgttagattaatgggctaggcccaattaaatcctaataaattccattggcccacattaagtgtgtcggtgacatggggccgggggtatcgtgactagaggcttgggtagccgcggtcacccacgtggcctgaccccctcgggggggggggggtcgggcccgagggtgacgtggccacc

SEQ ID NO: 27290 - DNA, 20900 bp, Oryza sativa
attccgtcggttacggaattaaaggccgtgaattgattccgtcggttacggaattaaatgccgtgaattgatttgattccgttggttacggaattaaacgccgtgaattgattctgtattaacgagcgcgtcggttacgaaattaaacaccgcggttgatgactccgaacgttactctcgcgctcgcatatatatactccgcagcgaccagaacgacgacaaagttcttcacgactcttgtacttcgagttcctcctcctctgttcctgagctgcagaatccttccccggttctgttcacctgcacgcacaggtgtacaggacgagcaggtgcctccggaactccgtccgcttgagaacttgcacgggtagacgggcgatcaagtttttagatagcgcttcaagcgcgactgctcctgttcttcgcgactactactgctgcatcgacgccttcgtcaacatgtcgacggagattggagacaaggaggtgaacgacatcaacggaggcaatactgcctcaaaatccagcggtgggacgttcttagggtatagtttcattctcctgattctattagatgtttctttgttgatgttcttcgcaatggcagcattgcgttactatgtaaatgttgatgcgtatttcattttaagcatgctcaagttgtatacatcaagcattatcactagatctactcatattaaaaatgtcatgtttattgtcttaatattttggattagaatatgccgaattatgaccaaatttccaacagacgtcggccgcatgtcacttcgctgacatcaaacacgagccgaactgagatcgatgcccaatcagaggacgagaccggcgccgtcatcctcctcctcacgctaccatcgccgtgccttcctcgtcctcctccggtgaaccgacttcccgaatcctataaatagccggtgaagccctctcttttccccacatcatccgagctctacgagctctctcttctctctccaccatgaccggccaccactaagtcccggccgatctcctcccatacaggtccacttctcgaatccatgcaccactaatctctcttcactccggcgaatccattttgtccatttcccccttctctctccctccaaactaagccaccaccattaccaccttagccggccgaaggtgagctagtgttgccgctgttccggccaacccacccttcctctctcccaaccaccaccctccccgggtgtgcgttgctcgggaacacgttccgccaccgacgtcaccgtcccccatccactggagcaccggcgtccctctctccctctcctctcgtttactcggctgaagaagaagaaggaagatacgggaggaagaagaagagaaagaaaaagaaaagaaaacaaacactgacaggtgggcccctgcacagtaactcttcctattttccctatttaattcaaatccaattctttagaagcccatatctcctaaaccgtagatccaattgcaatgaaacctagatctaaattcatctaaattcaaaagctatattttgatacctaatttgctattttataattttatttgaatttattcaaatatcatttgaatttatatttgcctttttcaaatactttcttttaccccaaaatacctattagccactaaaatgccgccgattggaactttacgccttccatggggacgtttgcggtctattggccctgacgtcgaaccgttggttgtaaagcctgacaaaacccaaaccaaaggtcgaagtgctgctcctggcaccctacgcctcgccgcgtacaacggtcggagcttcactattccctcgaccaccatagcacgccgcacagttagctttcgggccctgtgtgattctaaccgctctgccgccactcacggttgtcggagtaacacttccacctcgctaaacctgcacaaacctcccatccctctagccgttagattgtctattaataccggctagagaagataccaaacctagtcgtcatgctttagcgacgactagcgaacacccaaaccctagctgatatttatcttagctcgatatcggcttagacaattgaagccagacccccaccagctataatctcaaccatttaccctccaactacccatagcctatacatgaaatacgagccgatatgctatcgtatttcagcatcgactcgagaacaactaaatcctagccattcttctaccaaagccaacctcgataaatactagccacatatccacttaaccagttagattattcagtatatctcctactctccaagaaaccaaaacccacacatgaaatataagcgacattagttgtttaatcccctctagcctacaaccctttagaacctccacatataatattagctcaataatccctatgtcctataaaagagataggctatatcctaaaaccaagccctctttaccgtttatcgttttctcgttattttatgacttttattgaatttggttcttcgtctttcttagtagagtctattatcttttggatggcaacatgtggtatttcgaggatcggataatcaggttgcttatcttgaatttatttgcgttggagcaaggcaagttattatctctctcctttgagcataattatcctttattctatatctccattatctcatgcattagtcattcatgatttcgaatgcgtaacctgaacatagcaaaccagatatgctagctttgcttagccctgcctaattagactgcataaaatataatgaacttagattggaacaatatggtagaaatggttgatttccaggtggctagtactgttccaaccgacataaaactgctaagtacatgtgaagaacatacgagtacgaccgcaattcttgtatgggcatagacctagctgattaagttatctagcaaaggtggtacctctgtatagtggtttttcttaagtcctcgcgcaggaggcaaatttatgccgcgaagggcaactgtgatatttaccgaggcgcaggtaaatatatgagatgaattgtgcacaaattgtttgtgaaccctgattgcgatgacatggtgtcataaaatcagttctctctaaagacctcgggaacgccagaactcctctcgctgctgataacgttacgttcagagtgcatggggactagagttcatggaacaggtaccactaatgttagtaaccgaaaagctttgccatgacaaggctaatgtgtttggcacgtcatggattgtgggtaaagcgtacatctactgtttcttaaaactattcgaatagccgtgctcgcggttatcgggcattgggactcacaatggcatcttggttagaaacataattctagattttattaaatactgttgcattataaacattatagactttctacttctacattctcagctttctgcaattaaacctagctctacacatacattaccatttcatgcattcattgttgattaatataatagcttgctgagtacgttgtactcacccttgctttaacccccttctttcagagttaatttggaattcttgccgaagccgggagttcaattatataagttagtcttatataagttagtctcttctcaacctaattcgcaaatatagattagatagatggtttaagtctatagccaaacattagggtcaagtcattctatagcttctgttgtaatagttagccacaaccttgtaaataccctattatatcacataaagaaatctcctttggagccttgatcaaatgtatgcgatgaagatccagattgttgaacctatatcaatctactgattcaggacttgatacagttaaacatgtcggtttccgaatcattagttctgggacccgatagtctggaatgtaatttttatgttagcatttaaatatagtcaatatggatattaaagtattgttttcactaaaaaatatagtagttcaaacatatcacaagttgaatatgtgatttaaaaggttataattattttatttatattgttcctataaatgctagtaagaggagaaagagaagaaaaggaaccatggaagagctggctagacctgatatgtggaggtccattaatggttttctccccataaagataatttaaatttcaattatcataaggataaaactaagagaaaaggatgaacgacgcacaccacatggggatagggagggccggatatttttcttaaaaaaataattgatatgatgacctaaaataatgcgttgcatgtttaagtcgaaaccgatagtcaggtgttttgttttttatcataattttgtacgattcttttaacttatgagagacctgtatagtggcttagaaatatttataggatgtttaatgtataagtctttaacattgtttgggtggggagcgtggaaagaaggtttggtattgtcttaaataaaaatctaataacaacctaaatggtacgtccatcggtttaagtcgaaaccaatgattagatgttttgttctgaaatttttaagatttttctctaatttagaagtgtcacatagtgttttagaaacatttataaggatggctaatgggttttaatgctgcataggatcgcggtgggagtttaggatgttttttttttgtaagaaaaagatatatctaataacctaaaataatgtaaacgttactcgaatgttttatttttttagattttctctaatttagtagtcctatatggatgtttaggaatatcccttctttctataaagttaagacccaaagctgcctcttcaattcgccacgtcatcaacattatattagccgttcgatcaatatgtacatcagatatacaccattggatcccttatcctcttgcccagcatgcatggtaatcaccttgctccttcccattcccctcccttaatcacatgcattaatttacagtagaaacagccaaatcaattgagccaggaggtgcgatggttaataagattcatgtgcctcttgcgattctcttccaaaccttttaataagcccctttacaatccccactataaccaagtctcttcccctttgcatgaatcttttcatcgtatgttggattctatttggtaagcctgaatttaacatttattttaaccagattctatttgagtacacattatgatttgaaccaagcatgagcactatgaaagttttgtccattggtttctctgaacttcaagaaagaatccctatcctatgcatttattgttgttttagtttcttaagaaaagattcgtcatacttgcagccaatacttatatgtcctatcactaatttatttgagtagttgggaaggatatagaggattacaatatagctgtcctgacatagcgagaagcagcttaacttgctcggtatgtattttgttttcaggttcaaacaatacaatctaattgtccatactaatatgcatatttacatacgttctcaaatgtgcctgcagcgaagcgcggggtttcatctagtttatatgatgtgtaatgaacttattaggagaggctagaggaagagctaaatagatctagtaggttaatgcttttaaggcctgtaatttttttaattttaattattatggaaataaaaaaggaaaagaaaggaaatggagggatcgtacctacattgctgtgaagatgaataatgcgtacgttgtggaggcgtacggtagggatgaaaaccgatcgaatacggtcggaaactagctctatcatatttgttttcatattttttctcggaatcgaaatcggaatcggaaacccggatacgaaaacggaatcgaatattatcgaatacagatacggagcgaatacgaatcgaaatgaatacggtaacgaataattatcaaaatatcaagacccctcaaaataagcttcttaaaacgaggaagagatgtagccattagttttcaaaaacaaaacaatagtattctcaagctgttgactgagttttcagggtggtagatgtctaagctaatctaatctagcaaggcgatttagccaataccggcataaaccctaaaacgagaagcagccgatagagctaaattgatatgctaagactagattaacagagacatatgataaataggtaggcaaatatatcatccaaaccagagcaatccaagaggtcgaatgtactgatgcagccttgaacaacgccggcatagacgatacaattgcctaggccgacggaatattgaacttaccccttcgccggagatcgaacaccgatgcagccccgcatcaggtgccaagtcccgccggacgataaaataaagtagaaaaggtaaaagggtggcgatgcgccgaattgtattgatcgtcgagatagattacatagaccccgggtgtacatatttatacccatgggttgatacaagtccttgttggacaagaaagaaactttcctaaagataaaaggaaaagataaagtccttataactaaacacactttcctaaagataaaaggaaactaacaaactattcctaattaatagataacttgccatgccgcattctctttgaactcggtctcttctggataagcttcctttagtagatcaatttccttaaccgaatatagcaagaatccgacaactgacgacttgacaactctcatcggctaatctcaggacttcgaagccgatgctgactctaagccgatgactacttcgggctttccaaattccactgttaacagtcatgtatcaggtcatggatgaaaaaacgccgaaggaaatttgggacaagttggcaagcctgtatatgtccaagtcgctgacgagtaagttgtatctcaaacaatagctgtatggtttgcagatgcaagaggagtcagatcttaggaagcacgtggacgtcttcaatcagttggttgtggatctaagtaagttagatgtgaaactggatgatgaagacaaggccataattcttctgtgctcgcttccaccgtcgtatgaacatgtggtgactaccctgatgcacggcaaggatactatcaaaactgaggagataatttcgtcgttgcttgcacgagacttgagaagatcaaagaaaaacgaggcaatggaggcttctcaggctgagagtttgctggtcaaggcaaagcatgatcatgaagcgggggtgttgaagagcaaggagaagggggcacggtgctataagtgtcatgagtttggacatataaggaggaattgtccgttactgaagaagaggaaagatggcattgcaagtttagcagctcgtggtgatgattcagatagcagtagtcatgagattcttacagtgtctaacgagaagtctggagaagcgtggatgttggactcagctagttcctatcacgtgacatcggagcgggagtagttctcttcatacaaatctggtgattttggtgttgtttacttgggcgatgacacgagttatcgtgttgttggaatgggcgatgtcaagttcaagatgtgagacacgtgccgggactaaggaagagtttgatttcgcttgggagcctacatgagataggttggttgtatcaggtggattctgataggaagaccatgaatatcatgaaggacggcaagactgttatgattggtgagaggacaagctcatgtttgtacaagttacaagggagtgctgttgcaggtggagtcatggaagatgggtatgctggtgttgctgtgcacgatcctgaaggcggcgagcctggcgtaagctcgtcgggcggctcggcgtgagctgcggcagaaccaactcaagtcctggtacacgaaggttcgagctagtaacagattcggattggcgtggcatattcgccaaggtggagtttgttagagtttgtgtcgaatatgtgtacgtagtcggttacagtttaggacttggagttgtaataggtattaggactagagtatgagttggactctatcctaggttctctcataaatagaggagcgtgcctgttgtaaccgcatagcgacttagcatagcgagagggagcggctgccggcggcgaccggccgttagtcgttgtaactctgatacgctgtatatgctggatcggggaggagcgcccgtaatcagtaccccggagatgtaggccttggctgaactccgttaccaaatatcgtgtctcggtgtcgtcatcgttttggatctcctatggtgttttcttccgcggtttggtttccggtgtgatttcggggccggttttataacaccacgcatgccacacgctcgcacgcgcacgcacgaggacgaacgacgaacgaatgcacggacgacacctccagcttcccgcctccgtatttccttcgtttctcaactagaaggctcaagactggaggcaaaagaagcgcaatttcaacctatttcacctcctcaaatccgcccctactcccactaactcaatcgtcgtcaccggaggaaaattccccgaaactctaataccggcgccattgattgagctccaaaattcatcgcatacatcgccaatcctctgaaattgaaggtaaaattggattctccatgccgagtactccatttcccctctcattacacatccaatccatcgccggaatgctgccggcgctgcctcccggcgtcgccgctctgttcggccgcagccagccgcatggcgcgccgccgctccagggcgccctagctttggccgtcgccaccctgggactcctctcgcctcactaaacctcaccaggccgcctcccgcaccggagtttgccggagtcgccgccaccatggccgcctccgcctcctattactgcccgccgccgccagcctcgccaccggcgcttctctcgctgccgaccacaaaaacggaatcgcctcgacccctagataacaaaatcggcgcccccttgtccaaaaccggcctcctctgccgccggcaatgtgggattccggccagttcatgtgcagaacgagaagaacaggaaatccaattttcctattgaaaaataaatcagaaaaatcctttttatttttctatcaggttgaccatccgtttgaccttaaaatcgaaatctgagacctattccaaactcctagaattattctgaatccatcagtatcagttttgttgcaatccgagcacccgttgtcgcgaccctaattttagccctagggttcgccattctccgaaattccaaaaatccctaaatttaattatttaaaatcctttccacccattgttgcactttgtgatactattttcttttgtttatctttgtttttctgttatttattgtggtgatgattgttgcgtaaatagaaaacgctgacgttggtccggtagtcgaagcgagtgaaatctccgcaccaggaggagacgatttgtacgactacatcgcgcccgaaggttgcaagacatgcaccctcccttgaacaatttaatcccagcagttagagagttattttggtagcgtacttgtcctttggagtatgatagactgcacgaattattttaaattaagtatattactattattgcattatattttctgttgttgttataaacaccttaatgagccttagagtctaactaacttaggataaaatttgagaaacacttaaacaaactgttaattatttaatatgatattgatttaatatggatattattactgcatatgaaaacatgcttatggaactatttatggctatatgctaagaattgatcacaccacatgtgagcgggtggtacacatgatagagttcatgtgtttggttttatggacctgcttatggtcatgatggatatatggatatatttatggttatttcttatttaaaattgatataataatcaacccccttgtgtcaataagaatgacatagtttcgcccatccacacgatcgatttgtcgaacctgcccgtatattgctccaattgattgaacttctgcaggcctttcggtgcactggccattagctttcaagtatgtgaagcaaagtgacatggttcatgtttatatgatttatatatgtgggctcgatgggccccgagagttcagaattaccctatgggtccatgaagttctaggctgcccatcgagtaacgaacaatggtaagtggatgcggaggtaggttggcacacacctcggaccagatcactccgagcaacatcccgagcatcctttaacttataattactaggcagaagggagagatatatggagcaatattacaccttgttacttttcagcccggccagctgtgggtatcgtgtgggtaaagctgggcagacactgcagagtcgttgagtattcgaatacgccatgctcccggttaatggagatgtgtctatgggtgattcctgattatgggcacaagttaaactaaatggctatgaattaatatggttaacttatttattatttaatgttctattcatgttatttataagtaacattcatacttttatgctcgttattattgtttaaattaaatgttcaatagtgttgtttataacaaatgcttattaagataggctctatgaaataactgttaaggttagggtttaaaccttccagctctcaatactgcatgttgtatattgcaattattgtatttattatcataagcatgtcttgctgagtaccatttgtactcataaatgggttcagatcatgaagaggaagatgcatgtggagaacctgttgatctgttagagtgggacaactatggtttctaggtcatcctatgctcagacagttcctgtggtggagtctagcagtttatctgtttgtagaaataaggctttataggccatatatgtaatggtttgtatttatgttgtgttgtgaattaagtgacttaagtattgtatgatggaagtttatgcttttatatcatttcatgcgtaactgaacatcctgggcggttacgtattcgtgggtgcaccatgactttatcgggtgtccccacactcgagcggcgcgccgtgcggcggcggcgtcggcgggccccaacgggttgtggcgggcgtgctcgcgcggcgggagggctcgagcgacgcgccgcaaggcggcgacggtggcgggtgggagccgtggccggcgacggcgtcggccggcaacgggcggcggcagcgggcagttggcacggccggctagccggctaggatttctggtttttttttttgctgaaaaatatctccggatatccgatgaaaaatgccagatagtttccgaccgttttccaattccgtcggatatcacccttactgtattcgttttcatatctgagaaaaaaaatccgaattcatttctgaatccgagaaattccggatatttccgaccgaatttttccgaatccgaaaattggtccggacggacggaaagcatccgaaccactttcatccctaggcgtacgtggacggagggagattttattttaatggaaagaaaaatctaacattaaaattattgggttcaccaatttaaatgtaaatcgatggtcagattttttatatgatgtgtaatgaacttattaggagaggctagacgaagagctaaatagatctagtaggttaatgcacattttaggcctctattttttttaattttaattatcatggaaataaaaaaggaaaagaaaggaaacggagggatcgtacctacattgctgtgaagatgaatagtgcgtacgttgtggaggcgtatgtggacgaagggagattttattttagtggaaagaaaaatctaacataattattgggtccaccaatttatatgtaaattgatggtcagatttttctattttattaaagtgacatgtggcgactcggggagagagagagagagagagttcaaattaatggatccactagtttgaattatctacacttcaaatctaatgtttaagatagtaggtttctggaaatggaaatggacagtaagttgtttcatttcttttatattttttctacattaaaattagtagctaccttcagaaattattagctatagaatagaataggattatataggaaggagagatgtagtactagaggaggaagcgtacatactacgtgtatgtccgtacgtagttgtagtactgtgggccggtgggagaggggataggagggagttgggttgtgggcttctttttttaaagataatctaataataaaaaataatgggtccacccatctattaaaatgccacgtagcgattgaggagtatttatagaaataacacgtggcagtttaggaaagtttgtaggaagtttaatgtacttttagtatataatagatagataatagataataaacttgtagaagttgaattttaacttgcattttgtggattgatatattacatattgatctatcttattcatatttttttaattttttttataactatttagatgacgcgcaataaacgggtgtatgtccactcaagctgttaaaacagtttccctgtatacgtggcaacgtccttcgataagcagagagactgacttcctaccaaattttcttcccttgcgaagcgtggctgatacgcggacaaggctttaccatttttcaatgctatagctgttgtgtattaaccttcttgcgaaattagcttttccaatacaaaacccaaatgcgtgcgttattcaagaacacataataggttatttcaggcaccacgtttcaaggttgggcaaattgctaaaacagaaaattatttctctcggcgtcagcatttcatgagcataatgtgaccatgcagcttcaagaattcctccaatgctgtcttggacgaaccaccgtcctccagagttcgaccaatcatcccctgaatctgcttcacactctgtcgtatcttgtccgccttcgccgtaatccccatcaccatctccacgacctcgaccaccctctcacgctccagcgccggggagtccggccagttcccgcgggacacctccacgcacgcgccccactcctccagcatctgggcgttgaagaactggtccgccgtgagcggccacgcgatgattggcacgccgtgcgccatgctctccagcacagagttccagccgcagtggctcaggaacgcgccggtggacgcgtgcgcgaggatgctcacctgcggagcccacccgtggatgagaagcccaatgttcttggcacgcatcctctcctcgaacccttccggcaaccactcggcgctgaactcgcggccgttggtggtctcgatgtcaaacccgaacggcggacggatagcccaaatgaacggcctgccggtgagctccagtgccatggcgaggtcaaccatctggtcaggccttagcgagttattagacccgaatgagatgtacagcactgacctctcttctcgggtgtcgagccaccgcttgacgtcatcgtcgttatggtcaccgatgtgatcggagtgctccgtccggcgacgcactagagggccgatgggatagaccgggacgcccatcgttttccggagcatgcgcagcccggtcgtctccaactcctccatcgtgctgatgagaatcgcgtcggtgtcgtacccggccgatgtctgccggcggtggtgggccgaccaccggtccgtgccgtcggcgtggagtaggtaaggcggaagctgcgaccggtggacagtaacctccgggtggtccgggaggcagaacgcgtcgtcaccgggcgcacgcaggtgcggcaagtggttccacagcgagtggaacaccacgctgccgaacgcgccgcaggagacgaagatggcgtgcgcggcgccacgccggcgggcgacgtctgtcgtccacgcgaggaaggggtcggcgatgacgcagaccctggcaccgttcgctccggcgtcggtgatcaagtcacggacgaagctgtcgaagctgtcctgtagcgagcgcgactcggtggcctcgaacagcgtgatgaagtggaggagcggcacggcgtcggtcgactcgatgtctccgggcaggccgtgctcggctggcgcgaacggcagggcgtggaaccggaggtaccgcgtctgggagctcgaccggcggcggaggtcttccacgttgcgcggggtggagacgatggtgatgtcggccgtgggctgggcgtcgtggaggtgggcggcgagggagaggaaggcggagaagtggccctgcgccgggaacgggaagaggacgatgcggaagctgccatcgctgggcatggtgaacacgttgttctttgacttcgaggttctccactggaaggaaattaaatttttgctttgtctgaaaggagaggaagcacgacagcaccggtcggtgtgtgtgtggcaatggctctgggtggacaggatgaacgatagggtggggagcgaggctgggaaggatgcgcttggcagttggcagacaggctttgggatgaacgacgatctcgcggcgtggggcagttggtaaggcttccgacgcgggatggggcagggaagcaatggtgtcgtggacttgtcctttggtttcctgtccgtgagatcgtgacgtgaggtggggccgttggatttgatggtcggggtacgacgcagcgcgattccgggcagaaaaagggcccttgccctgtttgcgccacagggctgatgcgaatgcgagggaggcgtcggcgtcgctcgcggctcgggtgcgacgtggtgctttgcgtgcggcagcggcgcacggcaggctccggcttgaagggcgggcggtggtcaagagcgggaccggaggcgacgtgatgggacggagtcgtttgcccggcgtggtgtggcgacgagtgcgcaggagcagcacactggagtatagcaggcgcggcgctgcatcatgctcgcggtcgtgggcgtgcgtcggcgcgagactttggagggcgaccacggtcgacacggctcacggcactggcgctacagtccacacgattgagcgcgagactggttcgtcacggtgtagcggcggcagctcgtgctgctacgagcagcggcgcaaggcaaaggcaggcatggcccgcatgggcgcacggcttggctggcttggctggctgcttgaccagcaggcgtcctagccggcctggcttggctgtgggctgctagctgtgctgggctcggccagaaggtggcgacctggcctttttgtggttgccccgactggtattttaagaataactagcaatagtgccattgcgttgcaacggcaaaaacaccgtttgatagtgttgcaccttgaaaaccttaaatctgtaaaaatcaagtctaatttgatacattaataaataggtagaaccgagtctaatttgatcaattagcataggatttaggatttagttctagatttatttttctagactacttaagagtttatccaacggactttaatttgaaaaatgtgagccacattgtttgatcaattttgctttcggcctaggtcttcccaagccggcctaaacttgagctggcccatcttcagcgagttagagtcaattcgacggcccgcaagctgagcagctgagcgcggccgacgtatgcggggacggtccgatgcacttccgcggtccattgggcgcagcgtaatcaacggcagcaacggcctgacgctgggcgaatctgagtcgtccgatttaatggacggctccaatcgtccccgcaccggatgaagcgccgaccggggagaggggcaaaaccctagctcccaaatccctctctcttgatcacatttcctctccggcgacgagcgagcggaacgacggagcgagcggaggatgtttttttttctttttcatagtacaagttttttttctctttttttgttttttctcacctttatttttctccaccgaggagtcggatttttttagagtcggacattttttttgtcgatggaagttttttttctcttcgttttttgttttttctctctctttttttccaccggaggagttggacttttttttttctgatcttttgcttttatcgctttttttccggtctttttttcacctgtttttttttgcgcttgttttttagaatcggaaagattccctttttatttcttttcgcccttttttttttactgcggaatcggattcatttttcttttctttttttcgcgatttggtttctcttttcttttttttcgcccggttttttcggccgttttgttttggatcggacagattctttttgcccgttttttttttgacagtagagaatagtggtaaaactaaattttaagaagaaatagtggtaaaattaaattttaaaaataaacagtgcctcagcactatacttgatggcgccgagccgaggttgaacatcttagctttcaggtgttatattgaataaaatctggtggcaaggctgtgattataatcgatgtggtgtttgatgaacttgctcgagctaaccgatccttattaggaccaagcgctcagatgaaattcaagaagtgttgtgagtttttctctgtggttttattccagttggtataaaatatactcatacgtcccataatatatatatatatatatatatatatatatatatatatatatatatatatatatatatattgacggagcgttggggctcctcaccgggagaccgcgcgggcccccctttgccggttcggccgagggcgctaggtgaggttttaagccctcgatctgtggaatgtttcgcgagagagcaaatgcgcaagacacgggcgatgtagacaggttcgggccgctgagaagcgtaataccctactcctgtgttctggtggatctatgtacgaaggagttacaaggagctggagatcaaaagagttcaaactctagagaccctctcactctttctctctacgagctctgctctcctctttcttctttttcagctccctacagtccgttagtccgtcagtcccctctcttggtaggcatggaccttcttttatatctcaaggggataccacatataccatttctacctacccttcttttgggtggggactcatcctactttaaccaaaacttggctcgtaccttcgcatgccaccgggttaaccctgtccttccctcattaatgggcggagatttgcaatggctgctctccgaatgaccctccgatgggatgggtcataccaacctccactccgccggaagcaggtgcaacgtgggagcacggttgtttgctaatgacgtgaccggcgtcagactagtcacaaaccggtcattcttgtctaccacgcgtcagtttagcatgccacccatcagcccttcttcgtaaaatgacttccttgtaatggttgcgatgaagcctggtatgaatctagccgggactgacgtgctaactctaggagttcccacgccggctccggctagggacgagtgcctaggggctctcatcattccgacgggacggggcgaggcgtgcgaaaggccgcctgttgccacctaacccgcgatctgaccggtctgtaaccggtcacacactgtgacctgtcacggaccgaacgagtgtgctgcgctgcattaaatgcggtgtgggacgctcgtccaacccgcgataaacgcggttaggtgagcgccgctgtgctcacctaacccacacacgtggcgccaaacccacagggggtcggggcgccccagccctcggggtcgaaacgggagcggcccgacccctcggggagacagagggaggggcggccacatcaccctcgggcccgacccccccgagggggtcaggccacgtgggtgaccgcggctgccccaaacctctagtcaagataaccccggtcccatgtcaccgacagtagcccccggcgttatgccagggcgatcgccctccacgaggaaaacgctcgggcgtgacgccactccttaggcccggtgacaggtggggccggtctctacaggcgagcaggaatccagtggtcgcaaatcgcgcgcatcggcaagggaaaaccgaccgacaataatgagcggctttcttcaagaccgctacattacttgagtagcacgcaaatcgggacgagccggttcgtttcgcctagagatgtgatgatggtgcatcggttggcgagcgtagttaacgcgcgcacgatatgtcccatctcgactgtcacggccgcacatccgcctcgtgcgccgcaaacgggcgaacgggattagtggagtagtgggcgcgagaaacgagggggcgagatagtgggcgcgggaagcgaggagccgggcatagcgttggcaagggtataaagacgccaaggaagagattcgtttccttcctcttcgccattattccccttgccttcgccgcttgcgctctaacttctcgtttcctgtgccctaccctcgccgcactcactcgctctcaatcccctcctctgccggcgtcatggcacggggctccgcaccgctcgacggtagcgtgctgccgccttctcgcatcgtgagcgagaggcaggccgggctgccgcgccgattcatgccggaatctgccaccggccgggaggtggttgcgctgggtgagggacgcccggcgccacactacccggggcggtccgtattcttcctttccttcgcaatggcagggctggtcccgccattctcttctttcttcatggatgttctggagctttatgatctccagatggcgcacctcacccccaacgcggtaatgacgttggccatcttcgcgcacctgtgcgagatgttcatcggggtgcacccatctctccggctattccggtggttcttcaccgtacagccggtgtcgccaccgtcggtagtcggtggctgctacttcccgccgcgggggccggtgctgaaccgctacattccctgcgtccttcgcaagaagtgggacgactggaagagcgactagttctacacccctctcgccgacgaagcgcgcctccgacttctgagccagcccccggcgcaggcctccagctggcgggcgccggtagatctgggagacggctacgacgccgttcttgaccgcctggctagtctgcgatcccaggggctcacgagggccatggtgtacggcgattaccttcgtcgccggatcgcgccgctccagcggcgcgcccggggcgcctgggagtacaccgggtccgaggactacatgaggacccaccagggggtcaaatgggactgggtccctgaagacttcaaggtggtgatccaacgggtgctgaatctcagctccgtggaggcatccttcatcccccaaggtgtcctccccctctgcagcgatccagagcgcgccaacatcctgaccatcatgcaggcggtcggggcgtcaggggagcgggctcctcgaggccacgatggcgcgggcgggagccgaaggggggagcaatctaccccgggagggggtcgtgcttctgggccccgtgacgggggcccggggggcagccgccctgccgacgcccgggggaagaggaaacaggaggataccccctccccatctcctccccgagggggcggggcggtgcgtgccagcagcaggcgcccggagggtgctgtgccgacgtcgcagcccgagggggagcgaaaaaagaagcggctccgcaagataggggggaccgaaccatgccggggaaacctcatctcccccccaaggtggtcgtttagccgacctcctcgcaggttcgtccccgcgccaactgcggctgtattcattctcccatctcccaaggcaagtttttactcacccgtttttcatcttctggtttttcttctgcctcagcgagatcccgtcgcgcccttcccgccattccaagtccggccggtctgaggccgaggagacggcgaccgcggaggcccggaggcgggaagctgaccggcgagaagccgcagaccgcctccgggaagccgaggaagctgcccaggaggccgtccgggctcgccaggctgaggaagccgttcgggaggaggctagactccgccgggccgaggagtccgtccgggagacggaggcggcgcgcgcacgccaggcggcctgccaagcccccgacccgactccgcccgaggcgacgacgacttccgagtcctcccacgacgaggccgcgggcgcaccgctcgggcccgacccctcgggcgacgctcaggatgagccaacttcgggggacgtccccgagtccggcacgtcgatcggcaggccgagccgtgcggcatccttaccgaggcgactctcccccatgccttccgctgccccactgagcgcggagccccttctgcaggccttggccgccacgaacaccacggtgttggacgggttaagtgcccagatggaggtcctgcaggcagagcgggcggagctcgacgcggcgtgggcgcgtgtcgaagaggggcgacgctcggtggaggccatggtggagacgggccgcaaggcacaccgccggcacacctcagagctcgaggcccatcggagggagctggcggagatcgccagggaggtggaggaggagcgggagactgccctcatcgccaccgccgtgttcaacgcggcgcgagacgacttctacctccaatacgggagccgggcggcggagctagagaagaagctcgacgcgtcccggcagcgcgaagaggcccttgaggctcgcgccacggtgctggaggagcgcgcccgcgccctggacacgaaggagagggaactggcgggtcgcgaggccgccgtcgccatccaggaggcaacgctggcggcgcacgaggccgcctgcgccgaagaggagtccgcactccgcctccgcgaggacgagctcactgagcggaagcgagctctcgaggaggccgaggccgcgacgcagcggcgggaggagcaggcgcgcctgaatctggaaggcgcccgcgccgagagggccgcactggaccagcgggccgctgaattcgaggcgcgggcgaagg

SEQ ID NO: 27291 - DNA, 6573 bp, Oryza sativa
  unsure (1)..(6573): unsure at all n locations
cccccttcttgtataaactaatccaatctgcaatcaaataaagaggaaatttttgtgtcaactctgtttgttgtgtgtatgagacgagggtggtctgtgccgcggtccttctgtgtcttggcttgaacgagggctcgtgcccaggtcccaacctcaaatggcgcgggtcggggctagtgcctggggagatccacgtgtcgagactggccaggccgggaacatggtgaccgagggttatggatgacccgattgtgggcctttgccgattcccccccggagttcaccacgccccagggcacggctcggttctgggccccgtttggcgattttagccggcccgggccaccgagggtagggtcgagcacgagcgtgctaattcaagccaagattcttcaaaaggaaacgatggcacagacacagtcctcaggaaatcgaaaatgcttttattgaaatacggaagagaaaaaagataaggatatgcatgtggtagcccccggccaaccctgcacgccttgggggggcgcggggttggcccgagcccgagacctgacacccgacccccactaggggtagaagcgacgaaggtgttcgatgttccacgggttaggcagctctgtgccgtcgcccgtggccagccgaacggagcctggccgggggacgccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggaagcgcgcggctcggagggccgcgcgccgccttcgctcttccaagtagtcgaggtcatctctgcgacggcctgaggggacctcagggtgagctcggatgggagaaccgcctccgtgccgtagacgaggaagaaaggcgtttccccggttgctcggcttggcgtggttcggttcgcccagagcaccgctggcaactcctcgatccacgagtcgccgtgcttcttgaggatgttgaaggttttggttttgaggccctagaggatttctgcgttggcgcgctccacttggccattgcttctggggtgggcgggagaggcgaagcagagcttgatgcccatatcttcgcagtagtcgccgaagagctcactagtgaactgggtgccgttatccgtaatgatacggttaggcaccccaaaccgagcagtgatgcccttgatgaatttaagcgtggagtgcttatcgatcttgatgaccgggtaagcctcgggccacttagtgaacttgtcgacagcgacatacagatactcgaaaccgcccggggcccacctaaacggacccaggatatcgagcccccaaacagcaaacggccatgaaagaggtatggtctgcatggcctgggccggctgatgggtttgcttggcgtggaactggcacgccctgcaccgccggaccaggtcaaccgcatcgttgagagccgttggccaatagaaaccctggcgaaaggccttgccaaccaaggtgcgtgaggcggagtgggctccgcactcgccttcatggatatcggcaagaagctcgacgccttgttcccgaggaatgcacttcaggaggactccgttagccgcgcgccgatagagggtctcttccatcagcacgtagcgcttggagatgcgctggacgcgttccctcccttcgcggtcctcgggtagagtcttatctacgaggtatgcctggatctcagcgatccaagcaatcaatctaggagagccgggaacgctcccctcgggtcccgaggcctggactccgacgggcctcgggggccgttcaggcgcgtccgtctcccctagggggtcgggtcgcgccgacggctgagcaagcctttcttcaaaggcgcccggtggggtctgggctcgcgaggaagcgagccttgagagttcgtcggcgaccgcgttatcccgtctgggcacgtgccgaagctctatcccgtcgaaatggcgctccatacgccgcacctggcgcacataagcatccatctgcgggtcagagcactggtactccttggagacctggttgacgaccaactgggagtcgcctaacaccaggaggtggcggatccccagtccagctgccactctgagtcccgcaaggagtccctcgtactctgccatattgttggttgcccgaaaatcgaggcggaccaggtatctgaggacgtcacagctcgacgaggtcaacgtgacccccgcaccggcgccttgaagagacaaggagccgtcgaactgcatcacccagtaggcggtgtgaggcagctgcgaggggcccgagctggcctcgggggcggagacgggctcgggagctggggtccacttcgccacaaagtcggcgagggcctagctcttgatcgcgtggcgtggttcaaattgcaaatcgaactcagagagttcgatttcccatttcaccacccgtccagtaccctctcggttatgcaagatttggccgagggggtaagacgtaaccaccgtgacccgatgcgcctgaaaataatggcgcaatttcctcgaagccatcagaatagcgtaaagcatcttctgggcctgagggtatcgggtcttagcgtcccggagggcctcgctaacgaagtagacgggccgctgcacctttcggcggggccgatcctcttcgctaggggccgcatctccagggcgctcttcgtccgagaggccgcacggggcgcactcggcttctgtgccgacgacctcggggtcggagggcgactggcgcggccttcccgcagtggccccggggccatcctgggggtcgggggcacttggcaccgttggacaagcaggcggagggccagctccggccgtcgggggcctcgggccgccgttcggctcgggggcctctcctccctgctctctcccgggtcgagtcgacacagggtggggatgcgcgaggtgagggttgtcctcatcgcgctccacaaccaacgccgcgctgaccacctgcggggttgccgccaggtaaagtagcagcggctcatctggctccggggcgaccaggactgggggagaactgaggtacgccttcaaatgagtgaaggcccgctcagcctcctccgtccagataaacggcccggagcgtttgaggagcttaaataggggtagcgccttctctcccaacctcgatatgaaccgacttagggcagccatgcagccggtgacgcattgcacatccctaagcttgctgggggggcgcatccgctctatagctcgtatcttctcggggttggcctcgatgcctcgggcagagaccaagaacccgagaagcttgcccgcaggcacaccgaacacgcacttgtcagggttcagttttatgcgggcggagtggagactttcgaaagtttccgctagatccgagagtaaggtctcttggttgcgcgtcttcacaaccaagtcatcaacataggcctcaacattacgtcctatttgactacccaaagaaattcgagtagtacgctgaaaagtaggacctgcattctttaacccgaaaggcgttgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttaccgttcgccttgggaacgacgaccgggttcgccagccactccggatggataacctctcggatgaatccggcctccagaagtcgcgccacctcctcgcggatgaaggcttgacgttccggggcctgccgccgcactttctgccggaccggccttgcgcccggccgcacggtgagatggtgctcaatcacctctctggggaccccgggcatgtccgccggtctccaggcgaagacgtcggcgtttgcccgcaggaaggagacgagcgcgtcttcctatttgccgtccagaagaccactgattcgtgtggtcttcgacgggccgtcgcccaaggcaacctccttgaccgggacctcgtcgcacgtgatcatccgctgcctcggggcggctggaacggaggtgctgagcctctcgttgccaccctcgggcttggacgcggcggcgaggtggtccgcgcgctgctccatacaagcaagcgcgactttgaggtcgccatggacagagatggggccaccggggcccggcatcttcatctggaggtaggcgtagtggaccgccgccatgaacttcaccaacgcgggcctccccaggaccgcgttgtagggcagactgaggtccgccacatcaaagttcacccgctccgtgcggaagttggcggatccaccgaaggtgaccgggaggtcgatatgacctagcggccaagtgtaccccggcgtcacaccgataatcggttgggacggccgaagcaccatccccggggccttgatggcgtcaaaggctgcgggggaaaggatgttgagggctgcacccccgtctatgaggacacgccccaacttcacgttgcaaacggtgggggaaaccaccattgtgatctgtcctccccgggcaacgcacggcgggtggtcggtctggtcgaaggtgagggcaacctccgaccaccgcgcccgccgagtcgcctcatgggtaggggccgcggccagaagctctcgcttcatggccttgaggctccgacgagaagcgtgagcgcacgctcccccatcgacggtggcgatggtggccccaggctcctggaaccctaggtcatcgtcgccatcgtcgatgtcctcggcgggggccttctgcttggcctcatttcgccggttgccaaagggagccgccggggccttgccctcacggcgctcctgcctcctctcctcctcccacctcctcgtccgctcagtcaaacttttgaccacgcggcagtccgcgaggtcatggagggaggtgttgtgcacggtgcaccacttgctggtcgggcgctccctgctgggagcaccggcctccttctttttgtcgctcgcaggcctcccctttcgggtggcccgcgaagcgccctcgacggcgaggacgtgtccctcgtcgtcggaatgggccgacctcttcttcctcctcctgtcccgccgccctgaccgagcggtggatccgggggcggccgaagctgccacaccggaaccggtggagttccaggtccaggcctcctccttacgagccacacggtccgcgagctgaaaaagctccgcggtggtctggggctccttggaggcgatcttttcaagcatgcggttgtgccgcacgccccccctgaacgcgtagattaccgcgtgtgcggggatgcatggtatggtgttgcggacttgacagaaccgctgaatgtacgagcgaagagactcatcgtcccttcactgtaccgcatgcaagtccgcttcttcacctgggcgcggatatgtgccttggaagttcatggtgaactgctggcacaaatcctcccaagagtggaccgacgcgggcggcaagttcattagccaaccccgcgcctgtcccttcagggccatggggaagaagttcgccatgaccctgtcgtcacccccggcggcctcgatcccggtcgtgtagacctggagaaactcggcggggttgacgcttccgtcatatttttcggtgatggtgggccggaaccttgagggccaacggacgttccgaaggctcgccacaaaggctcgacagtcgacaccaccaaccgggggcacgtggggctggcccccgcgcccgaaccgaagtggcgctccggacgaggaagcgccttccgttgcgtgggcagcacgacgaccattgcgccggcgctcgatactgaggcgggcatccggccccctacgcacatcttcttgggtcggaggcgttgacgagggaatggctgacgaacggcgggtaacggccgccgctcgccgcgccctccgcctcgacgacacggagccggcggtagcagcgccggaggccttggtggcggaggaccgcccaccggcgcctaggcgctgctgcgccgtcatgaccaagtcggccacgtcatccagccaacgtcgggctggagtctctggatcggggacgacgggcgggtgacgcaagagcgcgcccgcagcttggagcgcgccctggggcgtgctaccatcgccgtagacgaggaggcgatgctccccgtctcgccgtccttctccatcgctcgtgggcggcgaagtcgcggatctttcaaccccctcgagcgcctcctcccgcctaagacttcggcgagaggggggcggtggagtacgagctcgacggcgcgggttctgctccccgtcgtcaccgctagcgctcggagagaggttgtgcgccactgcccgttcggccattgggctgaacgggagnnnnnnnnnnnnnnnnnnnnnnnnnnnnnnnnnnnnnnnnnnnnnnnnnnnnnnnnnnnnnn

SEQ ID NO: 27292 - DNA, 1702 bp, Oryza sativa
gcaccgtgcggcggcatgctagggtttgggatttttggatttaattttttttgtttgctgattatattttcgcatgtggttggtataagcacccccatgcaaaataggaattttcgcatgcggttgggccggccgcatgagaaaagggtgatttttgcagaccttctctcccatgaggttgcctcaaccgcatgatgccttttgcccgtatgcaaaaagcctttctgtactagtgtaacatctaagtatttaaaatttatcataaatataataccacctacattattttctcaaccgagatcacaactctctcctatttaatttttctacctacgtcttcttgttaaccaatcataatccaccactattcgatttcacatactttttatagttctcatgttcaaacctagaacttcttatatttggaatgaaggtagtaaatgcctatttacttacagataatcttagatgcaatcatttgtataattgtatgtcatctggtgtataattacatttaggatctatttggcagggctccaactcataaaattaactttatgaattgggtctaaaatatagttgtggagcagccaaaaactaggtctatttttctagtttattttgtgagagcaatgtagccaatttcactcccattttgaatggagttgaaactgtttggttgggctttagcttcaagagctctaccaaacagacccttaattcttgttccaatattaaagacatgtcagttgtaatagattaggcctaattagggatggactaggagcgtaattgaggaatattggatccggtggttacacaaatggagcaaacatgctgtgtgtggtgggcaaaagtggaaggaggacgatccaccagcgtatctaggatttacggtatgggtggtccgactaaaaaaaatagataaacaccgtaaatataataatgctaatatatacgaagtagactacaagtacaccatgatatattaataagacatcttaaaaacattttaaaattaacagttaagtaaaattttgagttagagaagcttatatacctagagaagtttgaaggagattgctatacaacaaacgaggacgaaggcaactcagaagcattcttctttcatgaatgtttccgaaaaaaagatacaatattttcaacaatagtataatttaacatcaaaactcagaagggttaaaactaaaaattaagagtaagtgtagaggccttaaatacctttgcatcgaccgtccatccatatacaaccataaaatagacactgtagtccaaagttggacaaaatgctaaaaatagtaaattattcctcttggtttcataatttcatgggcatagtacgatcccgcagcgtcagcaaggcgaagaattccttcaatgtgttcatggacgaaccaccgtcctccagtgctggagcaatcatttcctgaatcttcttcacgcactgtcgtgtcttggccgccatctccatgctccctatcaccatctccacgacctcggccaccctttcacgctccagcgccggtgagtccggcgcgttcccgcggcacagctcgacacacgagccccactcctccagcacttgggcgttgagtggccacgcgacgacgggcacgccgtgtgccgtgctctccagcaccgagttccagccgtagtggctcaggaacgtgccgatggacgc

SEQ ID NO: 27293 - DNA, 1265 bp, Oryza sativa
  unsure (1)..(1265): unsure at all n locations
tccttgcatatcattacatattccttctttggcatgaaggaggcattcggatttgctccttcctggctcttatggctgaggttagtaaagaagatatatcattatttaggacaaatttagagggaatgattttctttttctttcataactttttttcttaaacctggtgctgattttgtacaggtatagcacctttatggtattgtatcctactggtatcagcagtgaggtcggtttaatctacattgccttgccttacatgaaggtaacaagaatgaacttcagaaatgaagatctccacgttgttcattgcataatgcataatgcgtaatttaactgctcctttcttgtgactactatgcaggcatcagagaaatactgccttaggatgcccaacaaatggaacttctcctttgatttcttctatgcatccatcctttctctcgccatctacgtgcccggtatcccctcttgccttgcagtcatcctttattcagtggttgaaattaaaactagaattgcaatgttgttttttagtagctgggattaagataggatctgacaagaacactgcgttgcaggatcgcctcacatgttcacctacatgcttgcccaacggaagaaggcattggcaaaggctaaggctgcataatggtgatgctcaagagctttcttgaatttttcatgtgtggcttaaggatctgcctaaatagctcatatttgctactcttttagtacaagtctgtagatgaggaaatgttggaaagaactactatcttaatcccagcatttgttgtaactgtagtaactgcccatcatttgttgtaactgtagtcttctaccaagaattgtatgatattttacctggttaaattattgaatgattgatccaaaatttgccggcttgtttcaagttgcactctttctgcgtttgctgttagcctgttatgctgtatgttgcacactttgcactgcgggctatagagaattggcacatttgcatatttattactggtatgcaattatgagtcccattgtttcacttatgcttataagcagttttaaattttataacttaattttgaagttgattttgtggttttctcatcgtagcaacatttgcttttgaatcactaagaacacatataaaattttttatccatattatgtttatattgctaataactgattcaaataagcatannnnnnnnnnnnnnnnnnnnnnnnnnnnnnnnnnnnnnnnnnnnnnnnnnnnnnnnnnnnnn

SEQ ID NO: 27294 - DNA, 1545 bp, Oryza sativa
  unsure (1)..(1545): unsure at all n locations
nnnnnnnnnnnnnnnnnnnnnnnnnnnnnnnnnnnnnnntcgtattgcattttcgtaaaagaaaaaaggtaacatacatacgtacgtggcccaggtaagatcgggtttcaagagataaaagttttttaatgggttcatcaaatttaatgaaaatcaatggctagattttttttttttgcatttttctcaggatttttaggaagtctttgatttacctaggaaggtagcccatgcaaatgtgcaagcaccttattcaatactacttggatttttgttataaatgtttacgtgtggataaatttttctctaaatatatttatttactctattctaaatctgtttgttttgaataatttgtcttgggatagctttgaacaatggttataaattctttctaattaccctcgcaacgtataaatgaaactaaaattacttgaaaatatgctgtattgaatttatgagaaaatattctcacaaaatgaagttggttcatatgaaaattactaaaaattctttttttgggtaatatttagcatatattatttttggggtttataaacattaacctaatttttttttcttatatactatagatgttttgatggattttaggatatattaatttgaaaatattttctattaaaaatatggctaataggacagtttcatctaatcaaatactaacttctatttacttatactctcttttttcttcatatgctttcttattttgtttgaaatttaatttaaaataatagtgatattatataaatataagtaggtatagagtacctataaatgtttaagcgtgatagacaaaattacacttttggtagatcaattcttattataaagtatatcttattttttttagaattacacagtacaatatatatactcacaacgcacgcgcacttacccctatgaatgcacgctcgcaaatcctacccctatgagcatcttcgaagactgggccgacaaattcttaagattgacgaagtcaccacaggcgcttcgctgtcgacgggtacgtcgcctaccactgaaaacacagctgtgtgttccctaatttactaaacttagtatgaaatacccatataccatgtgttaatagaaaactagagaaaaaaatatgacatttattccctttattcttttacttaatatatatagggcattaatatagtatccaaaatagcttataaagggtgataaataggactgatagtttacgttattcatgtatgggcccaatagactgcaccctacatgttattaaatatgatgatatatcattgattttttttacgatttgtcataataattgaatgccatgctaaagcgccaacatataacctgttatatgttaactgataactgatatgtagtgatataatctatattttcatcattttcataattcgcatgtctatttgaattacatgcaaaatatgacctaaaatataatttcttttgcaatataaaatatagataatacttttttaatttaatggcaaataatacaatgggggtaaattttgtttt

SEQ ID NO: 27295 - DNA, 675 bp, Oryza sativa
  unsure (1)..(675): unsure at all n locations
tattcttttttttaagacaacatctgagaatttccctctagtcacaacctgaaagtactctcttgtcaaaagtaagtgatntgtttatcctttagtggtcagtcggctgaagagctggtctgtagcatttttgggtccgttgatgctaatcgaatcatacaaatagcacttactcctggtagcgaggaactcaggatgttgtagcatggcaacatactaaatctggtatgctcactgttcgatcggtttatcatgcacaatgcaatcataagttctgcaatcaggataggcaatctgagaaggtagagcaaacatgatttagataaggtttattttgttatgcggcttacaaaaacatatttaattttgaattgattcttttattggtacatgcagtgataatatgaacttattccttttgatgatagtacctgttcatctaattaattttataccacacagtatcctgagggaaggcttcatatttgctaagtgagttgcgtttttttatgtgtgctattgaattgaagtgagcaaatattgctgtcgcacatacaggtctgttgttcttccatccttcttagtgatttttacctccagatgtttatatatagatagaatagccaattctaannnnnnnnnnnnnnnnnnnnnnnnnnnnnnnnnnnnnnnnnn

SEQ ID NO: 27296 - DNA, 5400 bp, Oryza sativa
  unsure (1)..(5400): unsure at all n locations
nnnnnnnnnnnnnnnnnnnnnnnnnnnnnnnnnnnnnnnnnnnnnnnnnnnnnnnnnnnnnntggtatggtttgatggcatttgatcgccaaatgcttcatgaattgcacactagaatttgacagaatttatgtatactgccacttttcaaatgcagtttgccatctggacccataaacgcagttgatgtactctgcttgcatatagatgttttaggaaaccaatacaattttggaatatgctaagcaataatcgactgatttgtatagaacatctgagttctgaaagagtaatgtggattagatgataaaagttggcatagtgtggaaccatgataggctgaactaaattattttttctatggaatataaatttttgtcatgccaatggttgtattaaggaaataacaaatgcactacttgtaaagatctttatatatcaaagtgtttgtgtatatagaatttataaagattttggtgggtttttattttcgagtcttttggcaatgggccatgaatttgtatatgacaatatttccaaattttacaagtttatatattatctagtgtatatatgttgtggaaatgtgcactgcacatgcttaggagggcgagcgtattgttgtagaataatgtgcaagcacgacgcctctttgcctcgcactttctggccgagtcaattatcatgcataactggatcgtaccaaaatcgcaacaagttatcgtacatacagcaatttcacgaaaagaatcctaccatgaggtagcagatgacatggtgtgatttatacttatgataatttaagtgatgatttcaaatgggtacatgcaaattttctcattgcaacgcgcgggcatccaactagttttacttaaaattattggcttggatggaacatatataacccgttggctatgtgtttgttaaaattctatacaacccgtttccgcaaattcaacccgttggccatatgtttgtttggatggaatatgtgtttgtttggcttggatggaatggccatgtatttgttaaaattcagatatatttttaatttattttccattggatatctccccttttctgcaaatgtgagcatttcaagagattattaaaactaggcaaattttgctacaggacactgctacttcgtggaattagctccaggacaccgcacgaaatgagttttgggggaagacactcccaaaacatagctatttgccagaggacaccgcacccatttgtttagtgtattcgtgctgactaggcttgagcgggcccacattttgacgggaccggaccaaattaccctgcacatctaaagtctaatttctgtccctcgggctacatcttcaacctccagctctcgtgcccgtacgccacaccaccgcctcccgctctaaattcggccgatcccgttgctcgttcaaacattgattgaggggatttcttccccttatccttctctttctttcccctcaaaaatcggagcaaatcccgttgaatattgcgtggattcgaagcggatttcatctcttatttttctggcactctaaccaatccgtgcaaatcccgctgaatatagcgtgaagcgtgcttctgcttctgctgccgctgctgcttactgccgcgattgccgctgccgctgctgccgctgccgatgctactgctgtgctgcttgctgccgctgctgttgctgccgccgctgccactgctgcttgctgccgctgctgctactgccgatgctactgctgtgctgcttgctgccgctgctgttgctgccgccgctgccgactgctgctgccgctgccgccgctgctactgctgcatgctgccgctgctgcttgctgtcggtgagggaaggggagagggagagggagagggagagggaaagaagagagataaggagctgacatgtgggtccgaggatatttttgacatttcggctgcgttcttttcaggatagtcgttctcgttttccgttagcacgcttttcaaactactaaacggtgcatttttctgtaaaaagtttctatacgaaagttacttaaaaaaatcatattagtccatttttttaaaaaagaatagcagatacttaattaatcatatgctaatggatcgctccgttttccgtaatcactgttcctaagaagaaagaacgcagccttcatgtagtttctctctcctcttcaaccggaaattattattttaatgggtgcgttgtccgctggcaaataaccacgtttttgagagtgtttttccctaaaagtgactttgtgcggtgtcctggagttaaaaccacaaagtcacgatgtcctatagcaaaatatgccttaaaactatatacgcagaaatccctgattaaaataaacattattgtcattatatcttttttatgagcatttaatattatttttatcatttgtggttctgataaaataatttcagatgatggtgagccttctatcctaattggcgaaaattttaccatcatacacacatgtcatctcacaatatatcttcattactaaataatgccataacacatgcaacaatatgtatggtttcttctcgatcttaaggtggaacccactaattaagaaaaaaaaaactctattcacctatgatttcaaagatactatatatgttgcaaatgtataaaatacttttgtatttcttatggtataactttaagctcaaggttacccttaaaaatattatcttcatggctactctcccaatgatagaggtaaaacaaatatattactttattccttaagatcattttacatgcaacattgtggatgtggtaagtaataacaaatgattcagaataacacagcggctagcatagtaaataagtaaccttggattttgttccaacttcagccgttcagcttcattgttttgaagaactcctccaatgcctgatttgccgacgagccatgtccaccctcccgtgcagcttccatgatctccttgatcgctctcgcccgctgccgcatctcggccgccttcgctgttggagacatcaccgtctccaccacggcaaccagcgtcgctttgtccacaataatggcactcatgtccatgtccccccgtgccccctccacgcggaggcacaccccccactcctcgtcgagcatcttggcgttgtagtactgatcgccggcgagcggccacccgatgatcggcacgccgtgcgtcatgctctccagcaccgagttccacccgcagtggctcaggaacgctcctgtggagtgatgcgccaggatccccacctgcggcgcccatccatggaggaggaggcctttcttggtcgccgtcaccctctcctcgaatccgtcgggaagccacttcggctggatctcgccgtttatgttgtgcccgtccggcggcttcacgggccagacgaacggccggccggtggccttcagtgcggcgggcagctccgccatgtgctctgcttggatggagaactgtgacccgaacgatacgtagagcaccgacgacggagggtgggagtcgagaaaactggtgatggcgccggcggtggcgtccgtctccggcaaggttgttttggtggaggcgcgcacgagtgggccgattggaatccccggtagcctgaaggttcgccggagcatggcgagcccggtgggctcgaactcctccccggtgttgatgagcagcgcgtccgtcttgtaccccagctgtatctaccgcccgaagaacgcctcgacgcggtgcttcacggccgtgggcgggtggagcacgttgctggacacctgcgacctgtggatgaccacgtcggggtactccggtaggaggatccggccggcctcgtcggggcgaatggggaggtggctccagagcgagtgcacgacggcgctgccgaacgcgccgcacgacacgaagaaggcgtgggcgcacccgcggcgccgcgcgacggtcaccgtccacgccaagaacgggtcggagacgacgcagacagcgacgtcgccggcggcggtggcgccggcgacgaagtcgtcgaaggccggctggagcacctccaaggcctcgaggaagtccgggaagcgattgtgggggacgccgtcggaggactcccagcccgccgggaggccatggtcggccggcacgaacggcagctcgtgtaatagaaaggagtcatgtcctgccgacgtggctcgccgcaggctggccacgttgcgtggcgtcgagacgagggtgatggccacgtctgggagggcgcggtggaggacgccggcgaaggacaagaaggcggcgaggtgcccatggccagggaaggggaacagcacgacgacgttcttgctagttgctgccgtcattactgctactactcactccaacaagtctccatgtgacaacacgtacgtctcagggttgctggtggcagacatcactccgtgtttcttactccctcgtttaaaaaaaaaaaaaaaagcaaatcctagggttgcgtgtccaactttgactgtccgtcttatataaaaattttttataattcgtattttcattactgttagatgataaaacatgattaatattttatgcgtaacttgtctttttaatttttttcataattttttcaaataagacgaacggccaaacattgaacacgaaaattagggtttatctttttttttaggacgaatggagtatatttctattttgttaaataatagcgtcatttctcagcggtagttggcgacttaaatgttactaggcacaggacctaacgcgtgtggttcacccttctgaattatttctgatcgccatcggataattacacactagtacaaggtttgttgggagggtgtttgatttttcaacttaaaaatttgacatctattatcttctattatatcataaataatactaaagttcataaaacttcctacaaatactcataaacaaccatgtggaagtcctacaaatactcctaaaccaccgtgtgtcaccttaacaaatagttagacccaccattttaattaccattagaattgttttttttcacctccctctcctatcacccatcagcccacgtcagggcatccccaccagcccatatgcacgcacgtgcaaacttacgtaaggaaaaactacgcactatttgtgctaaagaaaaacaaaaaaagactatttgtttgaaaaaaataaaaaaagaacatatatgtatgcacgttttcacctacggtaaagaaagcaaccaatcctacacctttattttattttctctagttgttccatgttaaaattttataaagcatatgatgtattttatctataaaaatgtcacatccatatcaactatattttannnnnnnnnnnnnnnnnnnnnnnnnnnnnnnnnnnnnnnnnnnnnnnnnnnnnnnnnnnnnn

SEQ ID NO: 27297 - DNA, 4191 bp, Oryza sativa
  unsure (1)..(4191): unsure at all n locations
tatcataaataatactaaagttcataaaacttcctacaaatactcataaacaaccatgtggaagtcctacaaatactcctaaaccaccgtgtgtcaccttaacaaatagttagacccaccattttaattaccattagaattgttttttttcacctccctctcctatcacccatcagcccacgtcagggcatccccaccagcccatatgcacgcacgtgcaaacttacgtaaggaaaaactacgcactatttgtgctaaagaaaaacaaaaaaagactatttgtttgaaaaaaataaaaaaagaacatatatgtatgcacgttttcacctacggtaaagaaagcaaccaatcctacacctttattttattttctctagttgttccatgttaaaattttataaagcatatgatgtattttatctataaaaatgtcacatccatatcaactatattttaattaattaaaagaagttgtcacgtgaaactattgtcttaatgattacttcgtttgtgtttcaataaccgggaactaaatgagctccttagccgtcaattaacacactaataaattagagaaaataacagaaattacgaagaaaaaacaaaaaaaacattgatttcaacttaaatatggtagaccaattattttctaccattaatttatcttagcaatataaaaaaaagaaaatacccacctcccaccccttcacgtcatgtatgtatgaatgtgcacgtacgtacttatgtatctctctctctccccccttactttctctcctttattaacaacatcttaactaatataaatattcggatttttcctttagtcaccaattttttcgtccgtgcgtaatttttttcgcccgtacatgcttttttcacggatccgattttgttcggtttttcacttttctctagcgccagcccagtaggccaggccagaagtccaagccacaagcccataaagctacaagtccaggtgcgcccacaagtccaggtgttccacaaacccacaagtccaggtccaagccacaagcccatagagccacaagtccaggtgcacctccacaagtccaggtgttccacaaacccacaagtccaggtccaagccacaagcccatagagccacaagtccaggtgtttcacaaacccacaagtccaggtgcaagccacaagcccatagagccacaagtccaggtgcaccacaagcccacaagcccaggtgcacccccactcctactccggtttgccccaactgcgaccaggagtcctgctcttgctattccgttttccttttcttctttcttccactatttttagcgctcacccgatcacgattttacagatttctcaggcaagacatacatatagaaataatagaagcacacaaaaaaaatacaaatcacaaggtttttcctctagggtgccaagccacctccaatcaatgtcgattccaggttatcattgtactcaacctgaatgcaattacaatttcattagatttatataactcaaaaaattctactccatgcatgcttgcctacttttttaatgttatcactaagtcataacatgcattggctcataataacttgctgatgcactcactgttcatggtacgttatactgtctttaattatgcatgtgatgtatctaccaaaatagtacattcgctcatgcaaaagcaagccgagtttaaaccaacaaagaaaatatttctttaccaatgtaagaatgcaagatcaatttcatctgagaaggccaaaaaactagacaattaatgcactatggtgatgggaaaaaaaatcaagaaatttgtttgtaacagctctaatttcctaagtcatataaatcatttagataccccatttaaactatctgaatattcagaacatttattttgaaggcagacacaaacgatagtaaaataaggcaaaagagaatgttatctctaaagaggtaccttagaattgtctattctatctatatataaacatctggaggtaaaaatcactaagaaggatggaagaacaacagacctgtatgtgcgacagcaatatttgctcacttcaattcaatagcacacataaaaaaacgcaactcacttagcaaatatgaagccttccctcaggatactgtgtggtataaaattaattagatgaacaggtactatcatcaaaaggaataagttcatattatcactgcatgtaccaataaaagaatcaattcaaaattaaatatgtttttgtaagccgcataacaaaataaaccttatctaaatcatgtttgctctaccttctcagattgcctatcctgattgcagaacttatgattgcattgtgcatgataaaccgatcgaacagtgagcataccagatttagtatgttgccatgctacaacatcctgagttcctcgctaccaggagtaagtgctatttgtatgattcgattagcatcaacggaccaaaaaatgctacagaccagctcttcagccgactgaccaactaaaggattaaacaaatcacttacttttgacaagagagtactttcaggttgtgactagagggaattctcagatgttgtcttaaaaaaaaagaatacctgggcggcagtggctggggttgacggcgaatcaaggatgtccgtcgctggcagatggagcgatggaggtagcgtccacccatcgtcgtcgtcaccgtaggggaggctaccggatccacccctcccgtcgtcgccggcgcgacgggatccgtgcgagaggggaagaggtcgccggatcagcccctcctattgccgccgacggcggatctgcgcgagagaagggtggagagacggtggaatccaggcgccgacggcggatccgcgcgaggggggcggagagacgaagggatccgtgcggactcgagctccaaggggccagcggagcagcagaggggcggcgctgccccaatacgctcatcaccgaactgcagcagtaagggaaagagcctggagcagtggtggatatggccggcgatagagagagacggagaaagacgaggagagagcgagagaaatgatggaagcactccgaccggctacagatatttgctctcggtaatgaactacgagctttcgttttttttaaaaaaaaaaagaaaagaaaactacaacggtcaagttcctagatagtgctaatccacggaattgatttccactaaaaaatgtttagatatacgtacaaacttaaacttcagtatcacagacgagtggtattttcttttattattgatttttatcattgacataaaacacacaggaaacttccactttaatatttgtttgacgtaaaaaaatgtcgattgtaaaaaaataaaaaaaaattcgtgagacacgacatattaagattatgcgcgctatcgatcatccaaatgtcacacggtcgatctccacccgagtccacatatgattttgggaactggatcacacgcaagagcaagtttaatagtatagccaactactaactctaattcatctatagccaatctaatagcttattcatacaatagttacatactacactattaatacctgaatacctgatcctacctgttatactcacactgtttcccgtgctacagctgtctataaatctgtagcccgctgctattctttctctatttaacttcttaaaatatgtttgcaaccgacttatagcctactattgtacatgctctaataacataataattgacagtaagaaagcataattgacagagtaagaaagcacgcatgaccattataaaagtattattttatccgtcctgattattattggtctaaaacttacctatttaatcaaacaaacttccgtcctctttttgcgtgaaagtgatcggaacattcactgtttattcctcccgtggtacaatcattatgttaacgcattacattcttcgaaccatacacgtgtacagtgcaataattattcaaaataaaaatacctctgcgattannnnnnnnnnnnnnnnnnnnnnnnnnnnnnnnnnnnnnattggcacattggagtgcttcaaacaatagttgagttaaactttattcaacataccacgacccggtgcaacgcacggacatattactaggttataaaaaaaatcaataatttgataccttgagatcgaaatttcacttaactttcacaaacatttattat

SEQ ID NO: 27298 - DNA, 7928 bp, Oryza sativa
  unsure (1)..(7928): unsure at all n locations
ccctataaccactctcgagtcgtcaggtgacaccctataaccagaaaaatttggtcatcgattttcatttaaataagtaagccttttattttagatcattagatctatcttaaaaaaaatatcgctctgtccacacctctgtacggcgttctcacgcatgtacctaacataccctccctccgttcctttcttttcttatttccataataattaaaattatttttttagcctaaaaaatccatagatagacatcaacctactagatgtagcaagctctatctctatcctctatttttagtacgttaaacatcgtacaaatatttctaaataactgcatggccctcttaaattagagaaaataaaacattcgaccatcggtttctatttaaatcgattttatattgttagatctatcttttttaaaaagaaaaatcatccgaacctcactccacgcccctatgtgacgtcttgacaaagaatgatcaaatgtaccaagatcgcaccaacatatgacaaattattttgttaattacagaaaaaaattaaatgtgacaacgttatatctacagtatgtacattgtacattattattgtaaattcaatagaggggaggcaatatagttacacaaacacgcaactttatataaaagtccattaaactttctacaaacacttataatccatcacatggcatcctacatacactcataagccatcatatgatgctataataaattacaaaaatcatgtaaattatgataaagattttcacttaaattgatgatccgttatttgaggctattggatttatatttcatcaaaagagaacaacctgggcttcaaccgttagattagtttgatctaattaaccatagcctcatgcagtcaagcccacgtcacctcccccatgaatgcgatgcacggtggaaaaaaaattctacaacacctctcgcggttgtaggagattgtcatcaccatggcaagtttctctgatgagctacaactttatattgtaaataacacaactcaagtttatgaagatggatctgtccccatttatattgtactgtgctaaattgttcgtcgcttagaacaaagcaacaattgatatatactagagcatactcataaaacatgccacataagcaacaaaagtcatattaagcataccaagaggcaaaggtcaacgataaatcaacgaattcagtaaattcctaccctttaaagtagctgcatgggtttctccacaacctccatgggaatacaaaatcagtaaccttttttacagtaatatgattaaaagtcatatttttcctaataaattattattttaagatagggtctcacatattacaaagaaattctatataagatatgtatatttgatcaattaaaaagagagctagcatgatgtaaaaaaataaatttacgatcaattcaaatttttggagactttttaaataaaaagtaaacaatgaaaattcaattaaaacgaaagagaccttactttaatttaaccttattttgttagaactatttatgaaacaaaataatatacatacccgcgctaatgcgcgggctaccttcctagttttttaaataatgcgaacaagaaaattgaaattgatggaagctcttttcccaaaatttcttatatattggtccattattgtactatcgtcccatgtgggataaaagcaggcttaataatgtagctcgtcacggacggtaaaaataatcacgttagagcaaggtcaatggtatagctagtagtagctagtaatacccattgccatgtcattttgcagttaattgtaaggccagctagcccaatatgctagctatttgctcgctgcaccttattaataaaataattaattttgcatggacattttaacaactacaatcaaaagtgcactcagttgtggtttcatcaatcaataatgaaaaaaaaacttattatcgatttcccgatcatattggtttggaaaaaaaataaatatatacataggtggaccacattgcttaaggcccgccacaggcgaagatcattttcgctggcagcattcatcaaaggagcttctagtgaagagatatttcattggcgtttgccttatgaaatccgctagcggaaatggagtaaagctggtggttggcaaccacgtggaaaatacttcatcttcactagcctttggtctccagctgttagcccctgcgaaaacccattttggtcgtgatgagcacctggcagcaaagtaccctgaattttccctctcaatcacggtaccaacgataatcgataaattaattagctgatctcagaactgagtaactcaatagatatctaccagactgacttaattattgtattccaaaccctagataaatgatacttctaccggtgcttaagcaaacacgatcagaaaggagagaaacttatagaaccgagtagcaccaccaacagaaaacctcccacagcagttgctcttctaccaaccaaaccggtgacaagatctttcaatgaaagaaagatgggcgccatcttttgttcgctcggggagaaaccctcggcgaaaccaaacaaaccaatctaatccctctgctaattaatcgtgatcgaccaattaaaagatacgtaggctttcaggtcaggctctgaggctcgcagacctaccacagatggacaccgacgacgctagctagtccaaattggacccaagactcaggaactatcagaatacatgcataaaaaaaactgactcaacctgaccgctacatgcaagagaaataatataataatccggctgcagtgctaatgaccttggtaattaggctaatcaaacccgcaattgatatctcgggcagacgcgccacaagccaactgcacatgcatgcatgcaccttggtcttcatctgtgcagatgcattacacacacatgcatacactggtggagaaaccctctgtagtcccggttcgtaacccccctttaatcccggtttccaaaccgggagtactaatccgggactaaagatcgctatcattagtcccgggtgaaataaccgggagtaaagatcgatctttagtcccggttggtgttaccaaccgggactaaagatcgagctgaccttttttttttgcatggccctgttgctgcatggtttatatatatatatatataaaccatgcatatatatgtttcaatacatatatatgcatacatatatatatgtatatatatatatattatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatatcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaaatttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcaaaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgagacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatagtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagttcgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaatggctcgatctcctggtttggttgctctccaagctgagggactggtttggactttccagaagatgctcctcttgacagatgcagacatacccctaaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcaccttcttcgttgcccttgtgtgggcaggcagtggagctggggggggccttgactttgaaggtgccggaagaggagcttgcgggggagtaggtgtaggagcacgacgaggagtcggtgcaggatcctgaggaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccacctgcgccatagaataatggcatggcatgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgtggccatgcgttcatcaaccttccttgccacctcctcttgcatgttgagttcgtagctcgatacccggaactctaggtctgcaatcttcgcctcgatatctctcttgcttctcatccgactcctgtacgtgtggatgtcctccttgaaaccaatcttccaaggaatcacccctttccctcgtgttcatcctggatgctctggagtctgcagggcgagtgtcagctcgtccctatctctgtctggtcggaacgtgccctgagaggaggcttccactgcatctgttagtcgtcgcgcagcctctcgtatctgatcaccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagccttctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaactgctgtgacgtacatagttcttggcggcttcggccggggcactaggacgtccatcttcttccacttccgttatgatgtgccgaccctcaagcttcttcgctgcacctcgttgcccgcgtgccctcttccgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtctttnnnnnnnnnnnnnnnnnnnnnnnnnnnnnnnnnnnnnnnnnnnnnnnnnnnnnnnnnnnnnnnnn

SEQ ID NO: 27299 - DNA, 2457 bp, Oryza sativa
gcccattccaacaacacaataactcggttcatcgcccaagtaaacaacaccaaaatcaccagatttgtatgaagagaactactcccgctccgatgtcacgtgataggaactagctgagtccaacatccacgcttctccagacttctcgttagacactgtaagaatctcatgactactgctatctgaatcatcaccacgagctgctaaacttgcaatgccatctttcctcttcttcagtaacggacaattcctcgtagtaaatatcttttcatgtaatttcaaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttgtctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatataaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaccatatacatgatttaaacttgttgaaacctctaataatcgtgcgtaattgacatatgccatacatcgattcatgtatatggataatcaatacatccagaatagtttacatcgtgtacacaatatttacggcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggccctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgcaatccatgcatcggacttaccgatgttcctggcgcgaactagagccaagtgctcctcgatgtaaggagctaccaatgaagagtgttgcagaacagtgaaatgggctttacggaataaattgttgtctaccgtcgttattgctttccttccgagagttccctttccccgtagtctcccttcatggcgtgattcaggtaccccgattgggcgaaggtcttcgataaattctacgcaaaattcgatgacctcctctattccataacccttggcgatgcttgcctctagacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaacttaaaactgacgagacattgcaccacttcattctgaagggcttctaatctatccggatcgatgaccttctgcgaaattgcgttcatgaatgcacatagctttgttattgttgcccggacattgtctggaaggataccccttattaca

SEQ ID NO: 27300 - DNA, 694 bp, Oryza sativa
  unsure (1)..(694): unsure at all n locations
ttttgggcgtcccttccccccctttctgcctttccccttgttcctggcccccccctttccggtggttttttgggggncccccccttccctttgccggggttctcttctttgttggtggcccgtctccttctcctgggtcgggccgtcttttcttggttcgtggtcctttgcgcccggggcctgcttttgggttctctttctcctcccccgcgtttgtgttcccttcgttcggccctgcgtggttcttttgntcttcccgtcctcgcgggcggtctttcttcttagcctcgtccgttgtctcgggctttttgtttccccccggttgtttgttcttgccgggtttctttttttcgccttgtcccttgtcgctggcccctttttttgccttccgttgcttcgtctccggggtggtctccgcctttttgtgccccttctcgcgccctgggtcctccggtgttctgtggtcctccnccttcttgtcctgtttgtgggcctccttttccctttcgcggtcctccctggcgtcctgcgccgtctggcctgtttcgtccgcggcgtcgttcccttctcctgcttnttcctcctcgcccgtttgttttccttcccttccccctccttgggcgntgtccggngtgttgtcgtcttccgcttcttctttttccttttcnnccccttgctctccgtgggntgtccc

SEQ ID NO: 27301 - DNA, 1833 bp, Oryza sativa
  unsure (1)..(1833): unsure at all n locations
nnnnnnnnnnnnnnnnnnnnnnnnnnnnnnnnnnnnnnnnnnnnnnnnnnnnnnnnnattcagtatccaaagatggttgctgtatctatgggaataagggttccataacgaaatgatcttggatgcaatctaggagtttgctgatgataacgttagggatcttggataggaagggttttgattgcctgtgtgttctatctgcatccgcctcgtcaacagatatgtagcatccatactccttagagccggagcagacgggatctcgacctcgacatccatatcccactagaacttgctaccgttgccactatcttatgtcagtgacattgatagcaagttcgagtggtatactgatgtcgaggtcgagttcccggctgctccagccctattgagcatggatgctatggtttcgtcgacgaggcgaatgtaggtaggatatagaggtatatcaaaccataagagaatgtgtgtggatgcaattttgtgtttaaaaagtactttctccccgtacaacagtgacataggacatgtcgcagcaaggcgaaccgatgtcaacgaccacttctgggactacatcgtgccggaatcctaggacccagaataagattcctaaagaagtctacaccataacagaggtggacgatgttggatatccgacggctccgacgaaagctgtcaaaaagttccctacgatatgcggagtcctagggaggcggaacttcactattctgaaggaccacatcgatttggtccctcaagaagaaaaagaagaggcctagaggtagttcaaggaaagcttccgatatcctacagaggccgcggtaggactgaagcggcaggctatccgcaagatggggaattgttggaaaaatttcaagacaacgctggtcacggagtacgtcctcaaccctgcccagccagaaccatttgggaaatatccattcatcacccaacccgtgtgggatgagttccatgccgccaaatcatggaaagagtctcggaaaaaaagccagacctaccgtgatctgcaggcaaggaaccttcacccgcactggcttggcaccggtggctacgcggggaaacaggcagaatgggacaaggaggatgaagctgcagcggaatctaacaccccgcaagtgcttgctaatatcccggtccagcgggcaaggaactgggcaagggcaagggtgaagaagaatagtgacggaactctttcgttcccaaatcccgaagatcaagtggtgtaccagaaaatcgtaagttgaacacatagaataagtttcattatgttgtatcttgttcttcgtctaaagtgtcctaagtgtaccccaggtcgaactgaatgctgagagacaggcctcctaagaggtatgctcacaaaaacgcgaggatgacatcctcacgaaagcgttgggaaacgaagaacaccgtggacgaacaaggggcattggctccaatgttccatggaagtttgggtttccccaatacgtgtggcagtacaagaagcacaagctttccaaggcgcagaaagctgcacgcattaaggcccaacttcgggaggagcttaaagaagagcttagagaagagctcactgccgagctgttaggtatggaggctcggatggaggcacgcatcagggataggtcgaccgatgccactcctggtcccatagtacaagtgagccccacgcagaggcgtagcagctgcgcatcaattgaggctccggcagaacagcctgaaggccccgccacggtggaccacataacggtaaaaacaannnnnnnnnnnnnnnnnnnnnnnnnnnnnnnnnnnnnnnnnnnnnnnnnnnnnnnn

SEQ ID NO: 27302 - DNA, 4253 bp, Oryza sativa
  unsure (1)..(4253): unsure at all n locations
nnnnnnnnnnnnnnnnnnnnnnnnnnnnnnnnnnnnnnnnnnnnnnnnnnnnnnnnnnnnnatgctcacaaaaacgcgaggatgacatcctcacgaaagcgttgggaaacgaagaacaccgtggacgaacaaggggcattggctccaatgttccatggaagtttgggtttccccaatacgtgtggcagtacaagaagcacaagctttccaaggcgcagaaagctgcacgcattaaggcccaacttcgggaggagcttaaagaagagcttagagaagagctcactgccgagctgttaggtatggaggctcggatggaggcacgcatcagggataggtcgaccgatgccactcctggtcccatagtacaagtgagccccacgcagaggcgtagcagctgcgcatcaattgaggctccggcagaacagcctgaaggccccgccacggtggaccacataacggtaaaaacaacttaataacgcatatattatattagcaccacaatacattgcaacatatactaaggacactaatgaatctattgcaggaacccacatcgtgtaccctagttgttagggtgacaccaggatttgcaattcctgccgcagagggtcaagcattcaagcctaccccggagacccgagtgcacggggcgcagctgcaagccggcaatgccaaagttcaagtggacttactgaagcccgattgggttggctacactatcccacacctaccttgacggtgcgtgggggctcctcaccgggagaccgcgcaggcccccctttgccggttcggccgggggcgctaagtgaggttcttcgccctcgatctgaggaatgtcagcgagaagaaacgcacaagacacgggcgacgtagacaggttcgggccgctgagaagcgtaataccctactcctgtgttctggtggatctgtgtgtgaaggtaaacagagagctccagagccagagagctcgagagcgagagagagttcaggctctccgatcaagtcgccagcgtccgacctccccttccttccctcctctcttcttaggcctgggcctcctttttttatctggttaggggtcaccacatgggcctctctctgcctcagaaaagaacatgctttttacaatgagggctaatctacagccggaaatgacctctgacaagcagtacgcacgcctcctgctccgctcgtcagctctcccggtggacgcccgtttcaaccttcattcaatagccagcgactgtcttgccatgcttgcactgaagcctggaatggatctgaccgggactgacataccaactccaggagtcagcacgccagctccggctagagacgagaaccaggaagctctcatcattccgacgggacggggcgaggcgtgcgacaggccgcctgttgccacctaacccgcgatctgaccggtctgtgaccggtcacataccgcgactggtcacagnaccgataagcatgcgctgcgccgcatngaatgcggcgtgacgcgctcgtctaacccgctataaatgcggttaggtgagcgccgctgtactcacctaacccacacacgtggcgccaatcaccacagggggtcggggtgccccagccctcggggccgaaacgggagcggcccgacccctcggagagacagagggagaggtggccacgtcaccgtcgggcccgacccccccgagggggtcgggccacgtgagtgatcgcggctacccaagcctctagtcaagatacccccggccccatgtcaccgacacacctaatgacgagattctgacccttggggctgcacgtgggacctttattcaatggcccaagcacagcattgagatcaatataactccaaggccagcgccaagttctcgtccgccgccgacgcgtccccatcaaactgttgtatctctccctcctgccgttgaacaaagagatgaagatctccaattacagtatgatactgattttggggacgacggtatggaggttgacagcaggccgcacctcccccctcctgccaaaaggagcaagagggcgaaatcttctccacccaagcttgacacacgcagaaaagctgctggaacggggagaggaaaaataaaggtgccatttgccccaaagaagcttgatcttggcaaggcgccagtagctcctccaaagcttccagccgaattcacattgggcatgccattggtcggagacgatgccttattcaagatgggccctgcatgcaaggtgttgcacgggtactacatggagaagtccaacgcaaggaggaagaatagagagacctccatgttgggccagcacgatggtcagccgttcctcgggcctactgccttcatcgccgtagacttcaaagatctatgggacctctacagggtgcgagcgatcgacaccaacctccttaagtgctactccttgtaagtatttcttggtacgcgatatggtagtgactgtccataaattacacttaccctgactcttgtcttgctcgtaggttaacctggaagcatgtccatcgtaaagcaccccatgttgccttactcgatccagctgtcgtcaacgagacaatgctgaaaaacgatcgagcaaacatggtggcctatatcaaggactgcttatttgcccgtcaagacaaggacttcattatgtgcgcctacaatcaatagtaagcgtgtaccgtacttatactcaaatactcaacgcgtacaactgtagtatgtaactggcaatttaataatttcgcaggcgacattggattcttctggtaataacgccgaagtggagtttggtacactaccttaactccaatatcaagccagaaatatacgattggtcggccatcgaatctgccttgaacgaggcatgggaccaatacgtggcaagaggcgggaggcataaggatgggcatcccaaactcggtcacaagaaagacttcccaatacgtcaacaagttagcgaccagtgtgggttccatgtctgccataacatgaggagcttcgcagacaaggtgacattgctcgaccctgaggtgtgtaattcaattgtttatacacacataggacgacaaatttacaagtatgtagactaacttggcgccgaacatgcaggaatttatttcaaggattccggaaatcaacttcgaaatcattagagaggagatagcacaattcatactagatgatatcttgtcatcgaaagggatgtttagagtgaagtcctaggtagctcgtctcggaatggcagaacatttgcaatgcatatgagacaaacatttgatttttgtaaatattctttgtaatacaattatattcttcagagtaaagtcctaggtagctcgtctctgtatatacttgcatttctagttacatataaaattgttccaatttataacttatttttgcaggttttgatgcatgtcggcggtttggagagaaaaatggatgtgaatgacatatatgtgaatgggttgtggatgtgaatgtatatgtgtttgattttgtgaattggctgtgctgtgatagaatatgaatgtgaattggctgatatgatgctgggaatgggtctatatgaattggctgtgatggaatatgtgaattgatgctagaaatggggttgctgggaatgggactatgaatttacagaagcagcggggctcctcatccactaatggtgacgatatcagcggggccacagacgagtggttcccggaagggttcgaggaaaggatgcgagccaagaacacggggctcctcattcacgggttggctcccgcaggtggccattctcgcgcacgcgtccatcggcacgttcctgagccactacggctggaactcggtgctggagagcacggcacacggcgtgcccgtcgtcgcgtggccactcaacgcccaagtgctggaggagtggggctcgtgtgtcgagctgtgccgcgggaacgcgccggactcaccggcgctggagcgtgaaagggtggccgaggtcgtggagatggtgatagggagcatggagatggcggccaagacacgacagtgcgtgaagaagattcaggaaatgattgctccagcactggaggacggtggttcgtccatgaacacattgaaggaattcttcgccttgctgacgctgcgggatcgtactatgcccatgaaattatgaaaccaagaggaataatttactatttttagcattttgtccaactttggactacagtgtctattttatggttgtatatggatggacggtcg

SEQ ID NO: 27303 - DNA, 3895 bp, Oryza sativa
  unsure (1)..(3895): unsure at all n locations
nnnnnnnnnnnnnnnnnnnnnnnnnnnnnnnnnnnnnnncaaaatgggagtgaaattggctacattgctctcacaaaataaactagaaaaatagacctagtttttggctgctccacaactatattttagacccaattcataaagttaattttatgagttggagccctgccaaatagatcctaaatgtaattatacaccagatgacatacaattatacaaatgattgcatctaagattatctgtaagtaaataggcatttactaccttcattccaaatataagaagttctaggtttgaacatgagaactataaaaagtatgtgaaatcgaatagtggtggattatgattggttaacaagaagacgtaggtagaaaaattaaataggagagagttgtgatctcggttgagaaaataatgtaggtggtattatatttatgataaattttaaatacttagatgttacactagtacagaaaggctttttgcatacgggcaaaaggcatcatgcggttgaggcaacctcatgggagagaaggtctgcaaaaatcacccttttctcatgcggccggcccaaccgcatgcgaaaatcctatttttgcatgcggttgcttataccagccacatgcgaaaataaattcagcaaacaaaaaaaataaaatccaaaaatcccaaaccctagcatgccgccgcacggtgccagattcgtcgccaccgccgctcgccggcgtcgccggcaccagatccgtcgcccacgccgcccgctgtcgttgccggcaccggatccatcgctcacgccgcccgccgtcgtcgccggcaccggatccgtctcccccgccgcccgccgtcatcaccggctccggatccgtcgcccccgccgctcgccgtcgtcatcggcaccggatcggccgccaccgccgcccttggcgccggatccgcgcagggcggcgccactcgaggtcgtcgtcgccgcggcagtgaggaggggatggcggtggcgtcgctgcccgaggtcgtcgtcgccgcgggggtgggcgccgccgttggagggcgggggagtcgccggcgacgacggagggaggtagagtcggcagatccacgcaggcggccgctcccgccccctgccgccgcgtgccgccctcggccgctgccgccgtgtgccagtgcgtgccgccctcggccgccgcccctgcgtacctcctcggtgtcgccgacgcccgccgcgaccttgctgtgtgtgagggggagagagagatagagggagttgaggagaaataatggtggagagaagataaggttggagataaggttgctggaattctgaagcggtggagagggagaggagacaaattagacttctagataaaaatgaacattaaatctaattttgtggtattaaatgaactcatgtgaaaaagttgtcaaaaacaaagttgtagagatcattgagatctaccaattttcttttggtcatttctccatccaagtttgattgagatatataaaatttgaattttaaaatataagaaattcaaataatattttgaagcaataaatgatttcaaatggaaaagttgtgaataacaaagttgtataacttatcaagatctataatttttgttttggtcatttttctatatgactttgtttgaatagtttgaatttgaatttcaaattataacaacttcaaatagcattttcaaatactaattgatttcaactgaaaaagtcatcaataacaaagttgtataaatcatcaagatctataacttttattttgatcattttttcatccgacaaagtgatttataagattattcataaaatgtacatatctcttatattgtttataaaactataagagacatgtacattttgtaaacaatcttacaaatatttttgtcggatgaataaatgaccaaaatagaatttatatatcttgatgagttatacaactttgttgttgatgactttttcagctgaaatcaattaccgcttcaaaatattatttgaaattttgaaattcaaaattttaattgataaaataaagtcacaagaaaaaaaggccaaaataatagcagtaagaacacaataacatgatagagcatgattttagaaacatttagaaaaaagaatcatttaatttagaatttatatgagtgagatacactagtttcaaatttttcaaattttatttttacatacgcctccttaagtggcatacgggcgcttaattgagccgcaagcaaaaatgagctcatttttgcatgcggctgtcttaagaggtccgtatgggaaaatcgatttttccatacggcccacttaagggggccgcatgcaaaaatgaccctcaatttttgcagacgccactagttatggtccgtttgcaaaaataagggtcctcgtacaaaaaaattacttttgtagtagtgttactatatattttatatatatatatatatatatacatatatatatatatatatatatatatatgtatatatatatatatatatatatatatatacatatatatatatatatatattcattaacattcatatgaatgtggaaaatattagaatgacttacacagtaaaacggaggaaataaaacagaaaattgagggtccgggggtatcttgactagaggtttggggcagccgcggtcacccacgtggcctgaccccctcgggggggtcgggcccgagggtgatgtggccgcccctccctctgtctccccgaggtgtcgggccgctcccgtttcgaccccgagggctggggcgtcccgaccccctgtgggtttggcgccacgtgtgtgggttaggtgagcacagcggcgctcacctaaccgcgtttattgcgggttggacgagcgtcccacaccgcatttaatgcagcgcagcacactcgttcggtccgtgacaggtcacagtgtgtgaccggtcacagaccggtcagatcgcgggttaggtggcaacaggcggcctttcgcacgcctcgccccgtcccgtcggaatgatgagagcccctagacactcgtccctagccagagccggcgtgggaactcctggagttagcacgtcagtcccggctagattcataccaggcttcatcgcaaccattacaaggaagtcattttacgaagaagggctgacgggtggcatgctaaactgacgcgtggtagacaagaatgaccggtttgtgactggtctgacgccggtcacgtcattagcaaacaaccgtgctcccacgttgcacctgcttccggcggagtggaggttggtatgacccatcccatcggagggtcattcggagagcagccattgcaaatctccgcccattaatgaaggaaggacagggttatcccggtgtcaggcgaaggtacgagccaagttttggttaaagtaggatgagtccccacccaaaagaagggtaggtagaaatggtatatgtggtatccccttgagatataaaagaaggaccatgcctaccaagagaggggactgacggactaacggactggagggagctgaaaaagaagaaagaggagagcagagctcgtagagagaaagagtgagagggtctctagagtttgaactcttttgatctccagctccttgtaactccttcgtacatagatccaccagaacacaggagtagggtattacgcttctcagcggcccgaacctgtctacatcgcccgtgtcttgcgcatttgctctctcgcgaaacattccacagatcgagggcttaaaacctcacctagcgccctcggccgaaccggcaaaggggggcccgcgcggtctcccggtgaggagccccaacgctccgtcannnnnnnnnnnnnnnnnnnnnnnnnnnnnnnnnnnnnnnnnnnnnnnnnnnnnnnnnnnnnn

SEQ ID NO: 27304 - DNA, 736 bp, Oryza sativa
  unsure (1)..(736): unsure at all n locations
cgagcgtcccacgcggcatttaatccagcgcagcacactcgttgggtccgtgacaggtcacagtgtgtgaccgtcacagaccggtcagatcgcgggttaggtggcaacagcggcctttcgcacgcctcgccccgtccggtcggaatgatgagagcccctagacactcgtccctagccagagccggcgtgggaactcctggagttagcacgtcagtcccggctagattcataccaggcttcatcgcaaccattacaaggaagtcattttacgaagaagggctgacgggtggcatgctaaactgacgcgtggtagacaagaatgaccggtttgtgactggtctgacgccggtcacgtcatcagcaaacaaccgtgctcccacgttgcacctgcttccggcggagtggaggttggtatgacccatcccatcggagggtcattcggagagcagccattgcaaatctccgcccattaatgaaggaaggacagggttatcccggtgtcaggcgaaggtacgagccaagttttggtcaaagtaggatgggtccccacccaaaagaagggtaggtagaaatggtatatgtggtatccccttgagatataaaaggaggaccatgcctaccaagagaggggactgacggactaacagactggagggagctgaaaaagaagannnnnnnnnnnnnnnnnnnnnnnnnnnnnnnnnnnnnnnnnnnnnnnnnnnnnnnnnnnnnnnnn

SEQ ID NO: 27305 - DNA, 1013 bp, Oryza sativa
  unsure (1)..(1013): unsure at all n locations
caacgatgccggtgggagagaagcagggtgcggcgggtggctgacggcgggagaggagggggagtgcggcgggcggctgacagcgggagaggagcggggtgcggcgggcggtaggcggcgggagaggagcggggtgcgcccgccgacgggcttcggcgggagaggagcggggtgcggtgggcggtaggcggcgggagaggagcggggtgtgcccgccgaggccgccgtcgacatcttcccttccgcggccaccgttagcgagagcggcttcccgtcgaggccgccgccgatatctccccgcccgcggccgacaaggaggaggagagtggctcccggcccttggcgccgcctttcttgtcgccagcttgctccggtcgtcggcgtcgtccgctccggctcggccgcttgtccttcttcgctgacccgaaagattatggatatgaagctgacatgtgggtcccactgttttaattatttttcagggatcaaattaccacgtaagcgccacgttaatgccatgtatgacgaagacctagtcaaagaagccacgtcgacgccacgtcagcaaaaaccaggtacaataccgctgagggaccttatttaaacggtttcgtaagttgggggaccagttgtacccggttttgcgaccaagggacgaaaatcgacgtgggcgacaaatagagagacccaaagtgaacttatcccgcctagggcacctggcatcggtgcccacagaaaggagaggggcggctcagctggaagggttggctgggccgtcctgggccaagagggagatgggccgatagaagaagaaaagggaattttggcccaaaagcaaatagaagttatttttgaattttggaagatatttgaagaaggaagtttgaatccaaattaatatttggaaggaatttaggtggctaacttttgaaatgaatctatttttggagataactttcaaaagagatatttnnnnnnnnnnnnnnnnnnnnnnnnnnnnnnnnnnnnnnnnn

SEQ ID NO: 27306 - DNA, 3612 bp, Oryza sativa
  unsure (1)..(3612): unsure at all n locations
nnnnnnnnnnnnnnnnnnnnnnnnnnnnnnnnnnnnnnnnnnnnnnnnnnnnnnnnnnnnnnnnncagatcaaattaccacgtaagcgccacgttaatgccatgtatgacgaagacctagtcaaagaagccacgtcgacgccacgtcagcaaaaaccaggtacaataccgctgagggaccttatttaaacggtttcgtaagttgggggaccagttgtacccggttttgcgaccaagggacgaaaatcggactgggcgacaaatagagagacccaaagtgaacttatcccgcctagggcacctggcatcggtgcccacagaaaggagaggggcggctcagctggaagggttggctgggccgtcctgggccaagagggagatgggccgatagaagaagaaaagggaattttggcccaaaagcaaatagaagttatttttgaattttggaagatatttgaagaaggaagtttgaatccaaattaatatttggaaggaatttaggtggctaacttttgaaatgaatctatttttggagataactttcaaaagagatatttcctaaatatttgagtgcaataatgtggtctaaatattaaagcactcaaatgggagggaattaatataattcctcaaaatatttttgggaatgaggtaagaaaacaaaggaaataaataggatttttagccacaaactgcctgacatggatttagaaaattatttgaggctaaaaggagattaatttggaagagggaaataaaataaaaatatatccttcttagcacaagagcaattattcaaaaaaaatattattcttgtgccaaagagggtatcaagccacatgaactaaattagtggccagatcgaaaggaaagaatttggatttggaagaaagttaaggataggtttcgaatcaaaggatggatcgacaattaattccaataaaattggaatcacttggtttaggttctaggacaatagtagagaatttcttggaccataattcataaaagtgcaaagggtttttaaactaaatttgaataaaaggaattttgtcaatataaggttttaaattaaaaccaaatcaagaaatatcccaagataattttaaatgaaaatcacaaaagcttttaaatatcaaagagggattttatgcaagttagttttaggaggtctctctctaattatattttcctaggtttagaaggttaataagaacataagaaccggcatgatgcataattagaaaatagctaattttcagtatgttacacagacccacatccatgttgaggcctccactaaataaaaaaaacttaaattcatcactataaatcaaaatatctcatcttaagccggtacacccattacttatatcccattagacacttataaactttctatcaacttaattaatttctctcaacatgtatatgggggctatttacctatacaaattgattttggtgcgtttatcaataactgatctttttaggagataaaattatatatatgatctatgaagtcactaataatttagagaaaaatatttaaatgatatcaatttttctatcatattgtgtaccccatctagcgttattttttttaaagacgccattttaaaaattaaaatgtgctcggttgaacatcgtactgatcattccgaacaggtgagttgtaccaagaaatcttagcagtgaaacaactatgaggtggctttaccaatatagtgagtcaattccatatgggaattaaagaccatgttcatttatttctttttggtaaaacttgctacgctacatagtaaattcctaacatttagcggagaataatctagaaatgtgtatgtattatatgacctctattttaatatttgttactcaattgaagagagataatttagaacatatgactttaccccatgtgaggttgttggttcaacccacatatatttttagcccaaattgcagagatgaaatcatttcaaagatgcttgatagagtggaattctccaaaaaattttaaaaatggacatgaaatgaattcaaaaattatgtaaatgttttaaaaaaattgttgggtttaaacccattctaaatagaaatattcaaatattttagcaagacaaacagaatgaaaatatctaaaattttgaatagaatataacaaaaaaaaatgggactttttagggatgtctgggtgatatatccctgtggggattcaaaatacccaaacttttctcataggaactacatctattgtttcgacataatattatttcataaattgaaaactatacggtttcgattaattttagtttagaaattatgtgctgcatgggtaattagaagaaaatcataaccaacattcaaagcacattaaataagtttaattttaatttagatatagtaaaataaaattttaatacaatatcaccaacatacatggacattcgttataaaatttcacacatattaaattaggtgcacgcgcatgtacgcgggctatctttctagttgtaataaaaataacaaacaaaacttaaattactatatgcatatttacaattaaatttgttatttttttataacttgtagaagttgaatttaaacttgtatgtttgtggaattatatattacatattgatctatcttgtcaatttttttgaaaatttctcataattattcagttggcatgcaataaacaggttgacatctttgtttagaatccttcgcttgccggggcgtgtggcggcgactcggtctggaaaggggagcgcgggatggcgggcggtgacctcccgtgccgaacacgagccaagcgcagcgccttgctgctgtcgaaaatgttccgccatcgccatcccacacggtatcgccggcactctgctgtactcgaaaatgtcctcacgcaattgctgctggtgccgcgactagcgccgcgctgggagaaagtccatatgcgctggaagaacaagtccacgtcaaagtcacttttgttgctaatgacattactaattaatacgattttgaggggatgctttgagagccattgagattatgactgagacacgtgtcctgcacgagataacgaccgagacggcctcatctttctctcatgcttatatttagcagctaaaatttaaattttcaatcttaaatttagagcggattttcaatatatatatatatataacatatttaaacgtataatcaggtagtaagcagcacaagcaaaataaaaaaaaatctttagttctgggtattttaaccgagactaaggataaaaatcttcagtcatgtatttatagtcccaatttacaacctgagactaaagaaaattacaaactagtactacaaagggtttgcggaggtccagttaacatcaaaaaccaattccaatcagccatcgtggatagcaagaatatagctacgaggaacagagagagagatcaacaactctccgaattccaattgataatactgttcaacaagctcacgtgttgagttatgccgtgtttagattcaaagttttttttcaaacttctaacttttacatcacatcgaaacttcctacacataactttttcggctcatcgttccaatttcaactaaa

SEQ ID NO: 27307 - DNA, 1614 bp, Oryza sativa
  unsure (1)..(1614): unsure at all n locations
tgagaaaaatgcaaaaaaaaaaaatctagccattgattttcattaaatttgatgaacccattaaaaaacttttatctcttgaaacccgatcttacctgggccacgtacgtatgtatgttaccttttttcttttacgaaaatgcaatacgaaaatgcaagtacgggaaacgcgccccccctccacccccacccccccagccgccgccgccgccatcttccctcaatctctttcgcctcttttccacctattcattttcctattttcatgctttgttagttagaaaagaaaaatgcgttaaacaatttaagcaactataatgtctaaatcatacaactaacctttatccgctaattttcactatattttaactttgaaaagaaatttcatttggattatattttctaacttttgtatgccattcaagcaattgtaaacaatatgaactatgatgatgatgatgatgatgatgatgatgatgatgatgatgatgatgatgatgataataataaagattttagagctacaatcataaaataaaataaatataactgtcagtaatatttccaacatatattagtttgaaagcaaaagtaatgctaaaatataggtaactataacatgtaaatcattcaactaatatttgatccgcttatatctttagattattttgcatttaaggacccaaacctactataattcaactttgaaaagaaatatatcactttggggctatattttctaacttttgcatgtcattcaaacaattataaaattattaaaaaaatgatattgattttatcattgtatatatcttcacagtagttaaattagatgtacaatgataaagtgaaaataacctaaatccccccattctaatattataattagtcaaaatgatattattagacttatagtgttcatatttttaacacctactgtgaatataccgtagaaaaagacgtgtaaaaaagatagagtttaattctatttttagttaataaagtaaacaactaaaatagtataacaagtaattatatgcaagcatactctctcccctttcactctgttcgtctcctctctcattcaattcatccatcttctaatttttaactaattagtaaaaatgatcaataattacaaacaacagaatcaactatattagatttttaactaattattattcttaagattataattactccgtagcattatgagtttatttgtatataattgcatatataagccacactaagatagcagtatatagttgttgaaaagttttatttgttactattaaatttaagttttcagattcatgttaactaggtattatcttttaaaaaggataatatagatcatgcatatcacaaggaaatgaggcctatgatacatctttgttaatttatatgtaagtatataacattttgtgtaaatctgaaccatctagaaggaggactaatttggtgggacaaataaagcatatttattaacagtaatagttctttaggatttattttaaaaaatactaaacattcaattaaacaagacaaatnnnnnnnnnnnnnnnnnnnnnnnnnnnnnnnnnnnnnnnnnnnnnnnnnnnnnnnnnnnnn

SEQ ID NO: 27308 - DNA, 535 bp, Oryza sativa
  unsure (1)..(535): unsure at all n locations
nnnnnnnnnnnnnnnnnnnnnnnnnnnnnnnnnnnnnnnnnnnnnnnnnnnnnnnnnnnnccgctcgctcgtcgccggagaggaaatgtgatcaagagagagggatttgggagctagggttttgcccctctccccggtcggcgcttcatccggtgcggggacgattggagccgtccattaaatcggacgactcagattcgcccagcgtcaggccgttgctgccgttgattacgctgcgcccaatggaccgcggaagtgcatcggaccgtccccgcatacgtcggccgcgctcagctgctcagcttgcgggccgtcgaattgactctaactcgctgaagatgggccagctcaagtttaggccggcttgggaagacctaggccgaaagcaaaattgatcaaacaatgtggctcacatttttcaaattaaagtccgttggataaactcttaagtagtctagaaaaataaatctagaactaaatcctaaatcctatgctaattgatcaaattagactcggttctacctatttattaatg

SEQ ID NO: 27309 - DNA, 693 bp, Oryza sativa
  unsure (1)..(693): unsure at all n locations
nnnnnnnnnnnnnnnnnnnnnnnnnnnnnnnnnnnnnnnnnncaagaagatgtacgttgttagggatggcaagcgaagaattgtgggggtggacaatgttgccgatgaagaagaatacaacaagaatcttcatgtcagacctcagattgaccttgacgatgatcccgaagacgaagtggcttacgttcgttcagaccattcggaaggcatatcactgtgaatgatgtatttaatttgtattggagccttaatgaatgaattgcatatgtttcatgccattcgagttaaaactctttgaagaaatggatttgttaattatgtggttttaaaaaattatacttgttattttaaactatatgtgagatagccaattgttaattatatgaatttaaaaaaagtaatatgaattttaaactatatgtgaaaaaggcatttgtcaattagatgattttaaaaaaaaattaataggaattttaaactatatgtgagaaaggcaattgtcaattatatgaatttaaaaaattaataggaattttaaactatgtaaataagacatttgttaattatatgtgatagatcaaatgtaatagcaattttaaatcgggtagaagataattataaatgatttttataacttcaaaatattttaataagtcatctgtgacgggctttagtactatgcccgatagagat

SEQ ID NO: 27310 - DNA, 767 bp, Oryza sativa
  unsure (1)..(767): unsure at all n locations
nnnnnnnnnnnnnnnnnnnnnnnnnnnnnnnnnnnnnnnnnnnnnnnnnnnnnnnncccataataatcaacccccttgtgtcaataagaatgacatagtttcgcccatccacacgatcgatttgtcgaacctggccgtatattgctccaattgattgaacttctgcaggcctttcggtgcactggccattagctttcaagtatgtgaagcaaagtgacatggttcatgtttatatgatttatatatgtgggctcgatgggccccgagagttcagaattaccctatgggtccatgaagttctaggctgcccatcgagtaacgaacaatggtaagtggatgcggaggtaggttggcacacacctcggaccagatcactccgagcaacatcccgagcatcctttaacttataattactaggcagaagggagagatatatggagcaatattacaccttgttacttttcagcccggccagctgtgggtatcgtgtgggtaaagctgggcagacactgcagagtcgttgagtattcgaatacgccatgctcccggttaatggagatgtgtctatgggtgattcctgattatgggcacaagttaaactaaatggctatgaattaatatgggtaacttatttattatttaatggtctattcatgttatttataaagaacattcatacttttatgctccgtattattggttaaattaaatgttcaatagtggtgtgtataacaaatgcttaataagaaggctctatgaaataactg

SEQ ID NO: 27311 - DNA, 738 bp, Oryza sativa
  unsure (1)..(738): unsure at all n locations
nnnnnnnnnnnnnnnnnnnnnnnnnnnnnnnnnnnnnnnnnnnnnnnnnnnnnnnnngagtacaacgtactcagcaccctattatattaatcaacaatgaatgcatgaaatggtaatgtatgtgtagagctaggtttaattgcagaaagctgagaatgtagaagtagaaagtctataatgtttataatgcaacagtatttaataaaatctggaattatgtttctaaccaagatgccattgtgagtcccattgcccgataaccacgagcacggctattcgaatagttttaagaaacagtagatgtacgctttactcgcaatccatgacgtgccaaacacattagccttgtcatcgcaaagcttttcggttactaacatcattggtacctgttccatgaactctagtccccatgcgctctgaacgtaacgttatcagcagcgagaggagttctggcattcccgaggtctttagagagaactgattttatgacaccatgtcatcgcaatcagggttcacaaacaatttgtgcacaattcatctcatatatttacctgcgcctcggtaaatatcacagttgcccttcgcggcataaatttgcctcctgcgcgaggacttaaagagaaccactatacagaggtaccacctttgctagataacttaatcagctaggtctatgccatacaagaattgccgtcggactcgtatgttcttcacatgtacttaacaggtttatgtcgg

SEQ ID NO: 27312 - DNA, 591 bp, Oryza sativa
  unsure (1)..(591): unsure at all n locations
nnnnnnnnnnnnnnnnnnnnnnnnnnnnnnnnnnnnnnnnnnnnntttaatatttagaccacattattgcactcaaatatttaggaaatatctcttttgaaagttatctccaaaaatagattcatttcaaaagttagccacctaaattccttccaaatattaatttggattcaaacttccttcttcaaatatcttccaaaattcaaaaataacttctatttgcttttgggccaaaattcccttttcttcttctatcggcccatctccctcttggcccaggacggcccagccaacccttccagctgagccgcccctctcctttctgtgggcaccgatgccaggtgccctaggcgggataagttcactttgggtctctctatttgtcgcccaggccgattttcgtcccttggtcgcaaaaccgggtacaactggtcccccaacttacgaaaccgtttaaataaggtccctcagcggtattgtacctggtttttgctgacgtggcgttgacgtggcttctttgactaggtcttcgtcatacatggcattaacatggctcttacgtggtaatttgatccttgaaaaatattaaaa

SEQ ID NO: 27313 - DNA, 1598 bp, Oryza sativa
  unsure (1)..(1598): unsure at all n locations
nnnnnnnnnnnnnnnnnnnnnnnnnnnnnnnnnnnnnnnnnnnnnnnnnnnnnnnnnnnnnnnnnccaattccaatgaaacctggatctaaattcatctaaattcaaagctatattttgatacctaatttgctattttataattttatttgaatttattcaaatatcatttgaatttatatttgcctttttcaaatactttcttttaccccaaaatacctattagccactaaaatgccgccgattggaactttacgtcttccatggggacgtttgcggtctattggccctgacgtcgaaccgttggttgtaaagcctgacaaaacccaaaccaaaggtcgaagtgctgctcctggcatcttacgcctcgctgcgtacaacggtcggagcttcactattccctcgaccaccatagcacactgcacagttagctttcgggccctgtgtgatcctagccgctccgccgccactcacggttgtcggagtaacacttccgcctcgctaaacctgcacaaacctcccatccctctagccgttatattgtctattgacaccgactagagaagataccaaacctagtcgtcatgctttagcgatgactagcgaacacccaaaccctagccgatatttatcttaccttgatatcggcttagacaattgaagccagacccccaccagctataatctcaaccatttaccctccaactacccatagcatatacatgaaatacgagccgatatgctatcgtatttcagcatcgactcgagaacaactaaatcctagctattcttctaccaaagccaacctcgatcaatactagccacatatccacttaaccagttagattattcaatatatctcctactctccaagaaaccaaaacccacacatgaaatataagcgacattagttgcttaatcccctctagcctccaaccctttagaacctccacatataatattagctcaataatccctatgtcctataaaagagataggctatatcctaaaaccaagccctctttaccgtttatcgttttctcgttattttatgacttttattgaatttggttcttcgtctttcttagtagagtctattatcttttggatggcaacctgtggtatttcgaggatcggataatcaggttgcttatcttgaatttatttgcgttggagcaaggcaagttattatctctctcctttgagcataattatcctttattctatatctccattatctcatgcattagtcattcatgatttcgaatgcgtaacctgaacatagcaaaccagatatgctagctttgcttagccctgcctaattggactgcataaaatataatgaacttagattggaacagtatggtagaaatggttgatttccaggtggctagtactgttccaaccgacataaaactgccaagtacatgtgaagaacatacgagtacgaccgcaattctcgtatgggcatagacctagctgattaagttatctagcaaaggtggtacctgtgtatagtggttcttcttaagtcctcgcgcaggaggcaaatttatgccgcgaagggcaactgtgatatttaccgaggcgcaggtaaat

SEQ ID NO: 27314 - DNA, 1105 bp, Oryza sativa
  unsure (1)..(1105): unsure at all n locations
tnnnnnnnnnnnnnnnnnnnnnnnnnnnnnnnnntatatatatatatatatatatatatatatatatatatatatatatatatatattggactagggaaatatgtgcaagatgaaaaggggatgtcatattatatgttttgattttatgcgaagaaaggatagtcttgatccgttgatatctatcaagatctatcattgacatatatacaatcaagaagacatacaatatgaagccaagtgacagttcaagtacttgagaagcatccagatatttccaaacaaataagtgactcagaatgaaggattcccgagattatagaaatctagttgaagaacttccaaatatacaagactcagaataatttgaaagattccaagagcttcaatttcagggagtagaagatcaacagactggtgatgacaataaacatgcaaattaatggacgcggtctgaagaaagttaaccaaccaagaaaacatttgttctgaagactattgatgtaatttagaagggaatcatctcttccatccatatatacaaaaaaacccctatgttatcataaatcataggtagagcgaattatcaaagaatacactaatatgaggttatatgtatataatgagagcggttatacctatagacatcatactattatggagcaatgcatggagtaacaatttcatgaagacaagagctcctattggttaagtggcacaaccaatcaagaagaataaatgaagcttcagaaggaacaaaatattcatggaatatttgttgccgcgctgaatgaagatattttttccaagtatacaagtacttacattaatgaagatagctctttctgccaagctaaaactatgactggataaaaaaaagcaagacctacaaagggagtctgaacagataaatctaagcaacataacgacattgtgtagagaaaatggaataaaggtttatacaagaaaataggatagtaacttatgtgccatagtaattacgacacataagcatgactattcataatttgaagattacatgnnnnnnnnnnnnnnnnnnnnnnnnnnnnnnnnnnnnnnnnnnnnnnnnnnnnnnnnnnnnnnnnn

SEQ ID NO: 27315 - DNA, 851 bp, Oryza sativa
agccaagttttggtcaaagtagaatgggtccccacccaaaagaagggtaggtagaaatggtatatgtggtatccccttgagatataaaagaaggcccatgcctaccaagagaggggactgacggactaacagactggagggagctgaaaaagaagaaagaggagagcagaggtcgtagagagaaagagtgagagggtctctagagtttgaactcttttgatctccagctccttgtagctccttcgtacacagatccaccagaacacaggagtagggtattacgcttctcagcggcccgaacctgtctacatcgcccgtgtcttgcgcatttgctctctcgcgaaacattccacagatcgagggcttagaacctcacctagcgcccccggccgaaccggcaaaggggggcccgcgcggtctcccggtgaggagccccaacggtccgtcatctggcgcgccaggtagggggcgcgtgtgtttttctaagctctcgtcctctttcgtgtgcgccaagcttctcccgttcagcccaatggccgaacgggcagtggcgcacaacctctctccgagcgctagcggtgacgacggggagcagaacccgcgccgtcgagctcgtactccaccgcccccctctcgccgaagtcttaggcgggaggaggcgctcgagggggttgaaagatccgcgacttcgccgcccacgagcgatggagaaggacggcgagacggggagcatcgcctcctcgtctacggcgatggtagcacgccccagggcgcgctccaagctgcgggcgcgctcttgcgtcacccgcccgtcgtccccgatccagagactccagcccgacgttggctgg

SEQ ID NO: 27316 - DNA, 721 bp, Oryza sativa
  unsure (1)..(721): unsure at all n locations
nnnnnnnnnnnnnnnnnnnnnnnnnnnnnnnnnnnnnnnnnnnnnnnnnnnnnnnttccatcagcacgtagcgcttggagatgcgctggacgcgttcactcccttcgcggtcctcgggtagagtcttatctacgaggtatgcctggatctcagcgatccaagcaatcaatctaggagagccgggaacgctcccctcgggtcccgaggcctggactccgacgggcctcgggggccgttcaggcgcgtccgtctcccctagggggtcgggtcgcgccgacggctgagcaagcctttcttcaaaggcgcccggtggggtctgggctcgcgaggaagcgagccttgagagttcgtcggcgaccgcgttatcccgtctgggcacgtgccgaagctctatcccgtcgaaatggcgctccatacgccgcacctggcgcacataagcatccatctgcgggtcagagcactggtactccttggagacctggttgacgaccaactgggagtcgcctaacaccaggaggtggcggatccccagtccagctgccactctgagtcccgcaaggagtccctcgtactctgccatattgttggttgccccaaaatcgaggcggaccaggtatctgaggacgttacagctcgacgaggtcaacgtgacccccgcaccggcgcctttgagagacaaagagccggccaactgcattacccaataaggcggtgtgaggca

SEQ ID NO: 27317 - DNA, 1061 bp, Oryza sativa
ccgttaacgaacgagaacgagaacgatcgaacgaacgagagcgagaacgaacacgtcaatgtacgttgccgcgagaacgtgaacgagaacgagaacgatcgaacgaacgagagcgagaacgaacacgtcaacgtacgttgccgcgagaacgtgaacgagaacgagaacgagaacgatcgaacgaacgagagcgagaacgagaatgatcgaacgaagacaagcgagaacgagggaacgaacgtgaatgagaacaagcgaacgaacgtgaatgagaacgagcgaacgaacgaggacgaacgttaacgtgaaatgcaatatatatatatatatatatatatatatatatatatatatatatatatatatatatatatatattacttcgcatttatcctaatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattttagtcttaagcatgtaatattattttgaagttttaatataagattattttattttgtaattagacttagtatattattattttactagctaaggttggataatatacgttacctagacttaactaatataacgattt

SEQ ID NO: 27318 - DNA, 1024 bp, Oryza sativa
atagacctatctgattaagttatctagcaaaggtggtacctctgtatagtggtttttcttaagtcctcgcgcaggaggcaaatttatgccgtgaagggcaactgtgatatttatcgaggcgcaggtaaatatatgagatgaattgtgcacaaattgtttgtgaaccctgattgcgatgacatggtgtcatacaatcagttctctctaaagacctcgggaacgccagaactcctctcgctgctgataacgttacgttcagagtgcatggggactagagttcatggaacaggtaccactaatgttagtaaccgaaaagctttgccatgacaaggctaatgtgtttggcacgtcatggattgtgggtaaagcgtacatctactgtttcttaaaactattcgaatagccgtgctcgcggttatcgggcattgggactcacaatggcatcttggttagaaacataattctagattttattaaatactgttgcattataaacattatagactttctacttctacattctcaactttctgcaattaaacctagctctacacatatattaccatttcatgcattcattgttgattaatataatagcttgctgagtacgttgtactcacccttgctttaacccccttctttcagagttaatttggaattcttgccgaagccgggagttcaattatataagttagtcttatataagttagtctcatctcaacctaattcgcaaatatagattagatagatggtttaagtctatagccaaacattagggtcaagtcattctatagcttctgttgtaatagttagccacaaccttgtaaataccctattatatcacataaagaagtctcctttggagccttgatcaaatgtatgcaatgaagatccagattgttgaacctgtatcaatctactgatccagggcttgatacagttaaacatgtcggtttccgaatcattagttctgggacccgacagcgttgatatcagagcatatgttttactagagccttaaacc

SEQ ID NO: 27319 - DNA, 1463 bp, Oryza sativa
  unsure (1)..(1463): unsure at all n locations
cgaatccaaggaggcgtcggcgtcgctcgcggctcgggtgaaacgtggtgttttgcgtgcgacagcggcgcacggcaggctccggcttgaaggcggggcggtggtcaagagcgggaccgaaggcgacgtaatgggacggagtcgtttgcccggcgtggtgtggcgacgagtgcgcagaagcagcacactggagtatagcaggcgcggcgctgcatcatgctcgcggtcgtgggcgtgcgtcggcgcgagactttggagggcgaccacggtcgacacggctcacggcactggcgctacagtccacacgattgagcgcgagactggttcgtcacggtgtagcggcggcagctcgtgctgctacgagcagcggcgcaaggcaaaggcaggcatggcccgcatgggcgcacggcttggctggcttggctggctgcttgaccagcaggcgtcctagccggcctggcttggctgtgggctgctagctgtgctgggctcggccagaaggtggcgacctggcctttttgtggttgccccgactggtattttaagaataactagcaatagtgccattgcgttgcaacggcaaaaacaccgtttgatagtgttgcaccttgaaaaccttaaatctgtaaaaatcaagtctaatttgatacattaataaataggtagaaccgagtctaatttgatcaattagcataggatttaggatttagttctagatttatttttctagactacttaagagtttatccaacggactttaatttgaaaaatgtgagccacattgtttgatcaattttgctttcggcctaggtcttcccaagccggcctaaacttgagctggcccatcttcagcgagttagagtcaattcgacggcccgcaagctgagcagctgagcgcggccgacgtatgcggggacggtccgatgcacttccgcggtccattgggcgcagcgtaatcaacggcagcaacggcctgacgctgggcgaatctgagtcgtccgatttaatggacggctccaatcgtccccgcaccggatgaagcgccgaccggggagaggggcaaaaccctagctcccaaatccctctctcttgatcacatttcctctccggcgacgagcgagcggaacgacggagcgagcggaggatgtttttttttctttttcatagtacaagttttttttctctttttttgttttttctcacctttatttttctccaccgaggagtcggatttttttagagtcggacattttttttgtcgatggaagttttttttctcttcgttttttgttttttctctctctttttttccaccggaggagttggacttttttttttctgatcttttgcttttatcgctttttttccggtctttttttcacctgtttttttttgcgcttgttttnnnnnnnnnnnnnnnnnnnnnnnnnnnnnnnnnnnnnnnnnnnnnnnnnnnnnnnnnn

SEQ ID NO: 27320 - DNA, 930 bp, Oryza sativa
acacacctgaacgtctggtatagatccaagctagaacatcactcatgtcaatggagaatatgtatggatctaaattctgccattttatgaagggttctacaaccatgcaatatttggataccaaacctaatatcaaatttactggacacagtattatctgatcatgaaagactgaagatatggaaagtagttagagctgactaattaaactaatcatggacatgattttacggattaacagtctgaaactactctaacaaccaaaccatgatgaattatgaactgtgatatcttaacagataaacatatgtgatgaacgagagcaattgtttttattctaaattccagcacatgcaaaaaaaaggaaaaataatatcttctaatatcaatcaatcaaggaaaataggaaaaaaaagagagaagaaactgcttttaccttcaattgaggcatgaaccaaggatgtcgactggaaacaacaggatatgggcacaggagagctctgattggcagggttacgcatggcaatctgctaaacttgttcaaattagcgaaatttctgagaattgaaaagaagctaagacatctattttcagttatttacttgagggtagagaagagcaatgcaaatagaaaactatatgagcctaaaacatttcatcccaaaatacaccactgaatcttgtctagtaatttgttttctcatccttctccaattcatggcattactaaatgaagtttatcttccaaaaaaaaaatactcccttcatactcgtaaaggaagtcgtttaggacagcgacacggtcaccaaaacacaactttgacttcttaaatctataaaaatatttattgaaaagtgatatatgtatacttttatgaaagtatttttcaagacaaatctatacatataatttttacattttcaaactca

SEQ ID NO: 27321 - DNA, 808 bp, Oryza sativa
  unsure (1)..(808): unsure at all n locations
ggggcgaagcgagnaagagtggaggtgcggcctggcggtgatctgacgacgggaggagcgagaatgggcggcgcggcttcggcggcggtggcgacctggcgacgggaggagcgagaatggcgagttttttttttccgggataatcgcgagatttggggcgaccgtgggggacgggagttgcggggagaggaggcgcgggtgggtgcgggagggaggagagggatctggttcattggatttgagagggtgattttggaccattggatatgtgattcgacgaatgatgaatgattaaaagaatttgttgaagtatatgggtagaattaaatgattcctcctacaccataaactctataattgagctattgccattaaattattacaataaaaaataattcgtagcaatatattgtaatgttacaatgataatttttctgtggcaaataattatattttattgcaacgatctacgatcgttgttttatttagtacttttgttgcaatagaaaatgagatatcgccacaaaaaatcttattgctaaaaaaaacatgttctatcgccacaattttaattttttggtaatttacatagtacatggtacttttcactatttttcattgccacgatcagcaaattcattgcaataaaaaaattgtcgtctcataatttaacttaaatttttcatatggacacggattgagacaaattttatatggaaattatagctctcgacgagatctatnnnnnnnnnnnnnnnnnnnnnnnnnnnnnnnnnnnnnnnnnnnnnnnnnnnnnnnnnnnnnnnnn

SEQ ID NO: 27322 - DNA, 581 bp, Oryza sativa
  unsure (1)..(581): unsure at all n locations
nnnnnnnnnnnnnnnnnnnnnnnnnnnnnnnnnnnnnnnnnnnnnnnnnnnnnnncaacatccacgcttctccagacttctcgttagacactgtaagaatctcatgactactgctatctgaatcatcaccacgagctgctaaacttgcaatgccatctttcctcttcttcagtaacggacaattcctccttatatgtccaaactcatgacacttatagcaccgggcccccttctacttgctcttcaacacccccgcttcatgatcatgctttgccttgaccagcaaactcttagcctgagaagcctccattgcctcgtttttctttgatcttctcaagtctcgtgcaagcaacgacgaaattatcttctcagttttgatagtattcttgccgtgcattagggtagtcaccacatgttcatacgacggtggaagcgagcacagaagaattatggccttgtcttcatcatccaggttcacatctaacttacttagatccacaaccaactgattgaagacgtccacgtgctttctaagatctgactcctcttgcatcttgcaaccatacagctattgttgagat

SEQ ID NO: 27323 - DNA, 532 bp, Oryza sativa
  unsure (1)..(532): unsure at all n locations
nnnnnnnnnnnnnnnnnnnnnnnnnnnnnnnnnnnnnnnnnnnnnnnnnnnnnnnttcccttgcctttcttcttaaaattggttgtagccttgggtttaacgtcaagtttgactttcttgttgttgttgtgggatgtgtgagggttcttcttctgcaccaaattggcgctagaacctccctcgatctttttgccccggttgtcatttgcccttgccttctcctcaacacccaaagagccaataagatcagtaatactgaactcttgcctcttgtgttttagagaagtagcaaagtctgaccaagaaagtggcaattttgcaataatgccatccgccacaaacttgtccggcaactcgcagttgttgttcccaagttcctttgccagcatctgaatttcatgagcctgttccactacagaacggtcatcgaccatgttgtagtcatagaactgctccatgacataccgctcactgccggcgtcggaaaccccgaacttggcctcaagagcatcccacatgtccttccctgaag

SEQ ID NO: 27324 - DNA, 1198 bp, Oryza sativa
  unsure (1)..(1198): unsure at all n locations
nnnnnnnnnnnnnnnnnnnnnnnnnnnnnnnnnnnnnnnnnnnnnnnnnnnnnnnncattatttgttgcggacacaaaatagagcatttaatacatatatataatatactaccctgtaggtaaataaccatcctagtgtttagcacttgtgacacacttcagaaatttttcttccccgtactacaaattgttaagagatcgtgcaaatttagttaacaaaagtcacccgtttctgtctccataacctgcaataaaagaaaccatgattgtaaaaaatgacacagcaattttcaattcattcatttcttccaaggttcatatctttagtctatttcccatgaaaatcaggaaccacatgaacaaactatttaattatatcattggttgtaaaaaggtcagattcgacatatggaaagcaagaagagcttaaatgtaatatggcgtgctaacactacatacaccacaatttagtaaagcattaagtttttctaatttgatagcatctgacgatgtcacaatcagagcaaaattgacacaactgaacgtctggtatagatccaagctgaaacatcactcatgtcaatggagaatatgtatggatctaaattctgccaatttatgaagggttctacaaccatgcaatatttggataccaaacctaatatcaaatttactggacacagtattatctgatcatgaaagactgaagatatggaaagtagttagagctgactaattaaactaatcatggacatgattttacggattaacagtctgaaactactctaacaaccaaaccatgatgaattatgaactgtgatatcttaacagataaacatatgtgatgaacgagagcaattgtttttattctaaattccagcacatgcaaaaaaaaggaaaaataatatcttctaatatcaatcaatcaaggaaaataggaaaaaaaagagagaagaaactgcttttaccttcaattgaggcatgaaccaaggatgtcgactggaaacaacaggatatgggcacaggagagctctgattggcagggttacgcatggcaatctgctaaacttgttcaaattagcgaaatttctgagaattgaaaagaagctaagacatctattttcagttatttacttgagggtannnnnnnnnnnnnnnnnnnnnnnnnnnnnnnnnnnnnnnnnnnnnnnnnnnnnnn

SEQ ID NO: 27325 - DNA, 715 bp, Oryza sativa
  unsure (1)..(715): unsure at all n locations
nnnnnnnnnnnnnnnnnnnnnnnnnnnnnnnnnnnnnnnnnnnnnnnnnnnnnnnaggggaatatacttttattgttaaaatagttattcttttgaaagagagatatgatgcataagtaaaagcaaaaaaataaaaccaacggtgaaggggagttcattctaataaaggccttagcaaaattattaggcaaatttttagtttttaaccaaattattctatataggtgggaaagttactcatgaagggggttagaaaacctatgggtttaaggctctagtaaaacatatgctctgatatcaacgctgtcgggtcccagaactaatgattcggaaaccgacatgtttaactgtatcaagccctggatcagtagattgatacaggttcaacaatctggatcttcattgcatacatttgatcaaggctccaaaggagacttctttatgtgatataatagggtatttacaaggttgtggctaactattacaacagaagctatagaatgacttgaccctaatgtttggctatagacttaaaccatctatctaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 27326 - DNA, 737 bp, Oryza sativa
  unsure (1)..(737): unsure at all n locations
aaggtcccacgtgcagcccccaaggtcagaatctcgtcattaggtgtgtcggtgacatggggcggggggtatcttgactagaggcttgggtagccgcgatcactcacgtggcccgaccccttcgggggggtcgggccgaccggtgacgtggccacctctccctctgtctctccgaaggggtcggcccgctcccgtttcggccccgagggctggggcaccccgaccccctgtggtgattggcgccacgtgtgtgggttaggtgagtacagcggcgctcacctaaccgcatttatagcgggttagacgagcgcgtcaccccgcattcaatgcggcgcagcgcatgcttatccggtctgtgaccagtcgcggtatgtgaccggtcacagaccggtcagatcgcgggttaggtggcaacaggcggcctgtcgcacgcctcgccccgtcccgtcggaatgatgagagcttcctggttctcgtctctagccggagctggcgtgctgactcctggagttggtatgtcagtcccggtcagatccattccaggcttcagtgcaagcatggcaagacagtcgctggctattgaatgaaggttgaaacgggcgtccaccgggagagctgacgaccggagcaggaggcgtgcgtactgcttgtcagaggtcatttccggctgtagattagccctcnnnnnnnnnnnnnnnnnnnnnnnnnnnnnnnnnnnnnnnnnnnnnnnnnnnnnn

SEQ ID NO: 27327 - DNA, 1799 bp, Oryza sativa
cgaatttgagctcggtaccctgatttcttcagccacctactgcatgtaggttccatacagtcaaagcatgccttctttttttttacggtttgtccagaaagataacccagcgcgggataatcattaatggtgcagaacaatagaactcgtagtgtgaagttctcctgaccatatgcatcccaagtttccacaccctctttccacagaatctcaaggtcatcgataacaggctccaagaacacatcgatgtcattgccgggttctctcggaccttggattaacaagcacaatataatatatttccttttgaagcacaaccatggcgggaggttaaagtttgcaatgagaactggccaagtgctgtgagaactgctcatgtctccgaaaggattcatgccatccgtacacaaatatatcctcatgtttttggggtcgacagcaaagtctttgtgctttcgatcgatattcctccattgaatcgaatccgcagggtgtcttagcaaaccgtcattccttctctctgtggcatgccaacgtactaactttgcttcattggggttggcaaatattctcttgaaacgatcaatgattggtagataccacacaaccttcgccggaccaccccgctttgacttctttccctcgcccgcgctcttctttcgcttgtatcgagaagccttgcagacaggacaagcatctaagtccgcgtattgcttgtggtacaatatgcaatcgtttggacacgcgtgaattctccggacctctaaccctaggggacacagaacctattttgcttcatatgtcgtctcgggcaatgtgttctcctgaggaagcatgtccttcagtattcccaaaagttttgtaaaactcttgtctgaccatccactactagccttcaacttcattaggtctaatgttgctgataatttggtgtgctttggcttgcatcctgcgtatagaggagtctccgagtcactgactaacctgctaaacttcatgaaatctctctcgttcatagctgggtcatcaatgtcacgtaacatgtcttgcagcatatcaaggtccacatcaaccatttcatcgcccaatggagatgggacaaacatgtcatgctcttcttcatctccttcttcatgattgtctgcaccacttccgtctgcagctgcaccatcagtacccagatcttgctctccatgcatcacccaacatgtgtatctctccatgaatccccagcgtatcaagtgagcgtgtacttccttttcatcttcccacaaaatctcattcctgcaatcgctagatggacaacacatgtacttgtcgtttcttcttatcctatcctcctctgcggctttcataaaacttaatacgccatctccatactccttgtactgatgcctcaagccaatcgtgtacatccaactccgatccatcgctgaacaatgaacaaaatattagttaacatctcataacataagtactactaaattaataggaaatgtttagtacccttttacttacttttatgattttcctgtttttgtttgcaaaaaaattacaaaaactcgcccccttcaacctcccaccaaaatagtgaacagtgggataaactacagacaacggattgctggagtatatatagtgtgcaaagtatatctcaatcgggccaaaaaaaatgtcatctctaacgggcgcacactagtctctaacgggcacaaatagaaacccgacacctataaaagtcatcggtaacgggcattaaggccatctcaatcgggccttctttggagcccgtcaccgat

SEQ ID NO: 27328 - DNA, 2202 bp, Oryza sativa
caacgtccttcaataagcaaagagacttcctactaccaaaatttcttcccttgcgaagcgtggctgatacgcgtacgagtctataccatttttcaatggtatagctcttgcgtattaaccttcttgaaaaattagctttttcaatacaaaacccaaatgcgtgtgtactcaagaacacataataggttatttcaggcaccacgtttcaaggttgggcaaattgctacttcctccgtttcacaatgtaagtcattgtagcatttctcacattcataatgatgtaaatgaatctacatatatatatatatatatatatatatatatatatatatatatatatatatatatatatatatatatattcattaacattcatatgaatgtggaaaatattagaatgacttacacagtaaaacggaggaaataaaacagaaaattatttctctcggcgtcagcctttcttgagcataatgcgaccatgcagcttcaagaattcctccaatgctgtcttgaacgaaacacccgcctccagagttcgactaatcatcccctgaatcttcttcacactctgccgtatcttgtccgcctacgccgtaatccccatcgccatatccacgacctcgaccaccctctcacgctccagcgccggggagttcggccagctcccgcgggacacctccacgcacgcgccccactcctccagcatctgggcgttgaagaactggtccgccgtgacggcccacgcgatgattggcacgccgtgcgccatgctctccagcacagagttccagccgcagtggctcaggaacgccggtggacgcgtgcgcgagaatgctcacctgcggagccaacccgtggatgagaagcccaatgttcttggcatgcatcctctcctcgaacccttccggcaaccactcggcgctgaactggccaccgttggtgggctcgatgtcaaacccgaacggcggacagatagcccaaatgaacggccggccggtgagctccagtgccacggcggggtcaaccatctggtcaagccttagcgagttataagacccgaatgagatgtacagcactgacctctcttcttgggtatcgagccacctcttgacgtaatcgtcgttatggtcaccggtgtgatcggagtgctccgtccggcgacgcactagagggccgatgggatagaccgggacgcccatcgttctccggagcatgcgcagcccggtcgtctccaactcctccatcatgctgatgagaatcgcgtcggtgtcgtacccggctgatgtctgccggcggtggtgggccgaccaccggtccgtgccgtcggcgtggagtaggtacggcggaagcttcgaccggtggacagtaacctccgggtggtccgggaggcagaacgcatcgtcaccgggcgcacgcaggtgcggcaggtggttccacagcgagtggtacaccacgctgccgaacgcgccgcaggacacgaagatggcgtgcgcgacgccacgccggcgggcgatgtcggtcgtccacgcgaggaaggggtcggcgatgacgcagaccctggcagcgtctgctccggcgtcggcgatcaagtcacggacgaagccgtcgaagctgtcctgtagcgagcgcgactcggtggcctcgaacagcgtgatgaagtggaggggcggcacggcatcggtcgactcggcgtctccgggcaggccgtgctcagcaggcacgaacggcagggcgtggaaccggaggtaccgcgtctgggagctggaccggcggcggaggccttccacgttgcgcggggtggagacgatggagatgtcggccgtgggctgggcgtcgtggaggtgggcagcgagggagaggaaggcggagaagtggccctgcgccgggaacgggaagaggacgatgcggaggttgccatcgctgggcatggtgaacacgttgttctttgacttcgaggttctccactggaaggaaattaattttttgctttgtctgaaaggagaggaagcacgagggcacctgtcggtgtgtgtgtgtggcaatggctctgggtggacaggatgaacgagagggtggggagtagagatggcaatggcccccgttcacgcttccccgcggtgaattcacctattaggtgatggggatggttaatatatattcaccatggagaataaaatggttgtaaacctctcaccatcaggg

SEQ ID NO: 27329 - DNA, 11576 bp, Oryza sativa
tgtctttctctcgcgtcgtcgtgctgccgggagcccccatcaactgaagccgccgtcgccgggagcctgcttcgatgcgccgtcggaagacgccatcgccgggagccgccgtcaacgtgccatcgggcgtggtgactgcagccgtcgtcactgggagccgccgggagtcaccgtcgccgcaccgctgggagccgccatcgacgtccgccagcgccctccgacgtcactcgttgtgagaatgattcttcctgtgattttcatctataatttgttgatttgttgagtggagcattttggatatatattgatataatgtgattgtgaatatgttgtttacccggggacgggctaaccacggggataaattcaccacatggtgatcggggctggagaaattatagccccgtcgtggttgacggggacggggacggtgaaaatttttcaccgcagtgacggggacgcggtggtgattcccgacggtgaattcatcattgccatatctagtggggagtgaggctgggaaggatgcgcttggcagactagctttgggatgaacgacgagctcgaggcgtggggcagttggtaaggcttccgagcagggaagcaagggcgtggacgaaagtcggtaaggcttccggtcctgcgattaatggtgtcgtgggctttgtccatgccgtgaggtgggacggtggggccgttggatttgatggccggggtacgacgcagcgagattccgagcagaaaaagggcccttgccctgtttgcgccacagggctgatgcgaatgcgagtgatgaggtgcgacgtggtgctttgcgtgcggctgcggcgcacggcaggctccggcttggagggcggtcggtggtcaagagcgggaccggaagcgacgtgacgggacggagtcgtttgcccggcgtgctgtggcggcgagtgcgcatgagcggcacactggactagagctggtgcggcgctgcatcatatgctcgcggtcgcgggcgtgcgtcggcgcgagacattggaggcgacttcgctggactagagcaggcacggcttggacgccaaagttgtcgccacggggctcgcgtgacaagcggcgcggctttgctgaacatgtgagcgtacagcgcagcgtgatggctagctgcttcgggcgaccacggtcgacacggcgcacggcactggcgcgacagtcgacacgattgagagcgaggctggttcgtcactcggtgttgccgcggcagctcgtgcggctacgagcagaggcggatggcgaaggcaggcatgggtgcacggcttggctggctggctgcttgccctagccggcctggcttggcactgggctgctagctgtgctgggcttggccagaaggtggcgacctggcctgtttggtggttgccccgactggtttgctttagaaggaataagttcactttaggtctcttcatttgtcaccgagctcgaaattcacccctataccaaaaaaaccagatacaatgtatcctctaacttacaaaaccgagcaaacgagtttgtaaaatctaaatcgagaagcctctcgttttaggtcttgtttctttcagcttgggattattataatctagattattgagtcagattactgtaagctagattgttataatttatagtaaaataagcggttagttgtttctttcctaaattattaaagcctaaattattgggtttgcaagtctaaagagggagtgggtggcatggtgggtaatttttcacccaataatctagaaaaagctcaccaaaatgagcttattagattataataagctgggctccagattataataagctactttaataagttatctgtttctttcagcttactcctaataatctgaattataataatcctaagctgaaaaaaagggcttagtcatatcgcgcgatgcgtctcagagccatccgaccataggcttggcacatgcacgtagccggagccacaatgagcaagaaaagagagtactgctacatatctacacatgcatgtcttgtttattattatgtcataaatgtatttcttccttcttataaaattttctcttaaactagaaagtaagcccgcgtaaatgcacgggcaatttattttttttgtttatagaaagaatactaaaataaaccatatgttaccgtattcattttaagaaccatagattaccttataatctaaaagaagaaatatttattatgcgaaataaattataaagtttgatatactaattgataatatctattatattcaaacaaatttcactttgttatggctatacgtaaagtcgcatatcaccatctttcgtaaacatacaggttaatatgggtttagatttttttcttttactatacatctaagtcacctacgtatattcatgggtaatattcgaaggaataattcatattgtcaaaattatttgtgctaattttgtcaacactatttagatgagaatgacatacttatataaggatataataggtttccatgcgacattttttattgtacgtatgtttttttttgtgaatagtactgcacatattcgtaggatggttgtgcacatatttatatgagtgtctacgatttcgttttagatcattagttaaaaacatattttaaaaaagtttggtgggatggcatgaagagatgccacggtggcatgactttttcgataacatcttaaagagtttcattatatatatatatatatatgcataatttgaggaaaagtttagtgttgcaaagaaagaaacaaaaaacaaccaaactaagcagatcatatatacattctttttttttccgttttgacatctcttgtgtaggtacgtacgtatgtagggagagattagttggtttttagctggaatatatccaatataatggttgaaaataatggatctaccagttgaagtgtaaattgatgaccatatattttcttttttatattttttcttataatttttttctaatttatgagatctattacgtgatatattaagagttcttgtagaagtgtagaaattctattgcctatactgataatatacttgtagtcgattattatttattgtggcttggtggcatgctttactttacctatcatttgttgatagttctccacttagtatagtccgttatatatggtgcttcatgacataagtgctcgttggatggtagctaattattagatgcactatgcatgaatacctcgtaagcaatatgacttgacgattagtggatagaacttatatacttatggatcagtggtggcatatgattgatatattaggatatttttttattcataaagtatattatatactacacattaaacgttttagtaaataagcaataagttctagagtaattatcggattggttgctccttttcccagttatctacccattgatataggaattattacaaaagacatatcttttgataataatatctaaatccatctgaaccattttatgcactataattaaattgacaaccataacctacatcgtatatatttaaaagcaacttgtgtataattaaaatatattttatataaaagtttaaaaattaaataaatatattttggctttattatattcaatatttaattaatcttgcactaatgatacgtgtcgtttcatgtatcctgaataagctcagccatccagctagatcaaatgaagcataagtagaagataaaggagatcagtacggtgtgaaaagaatatatacaatctttgatatttaaatattatacgaatagagaaaacacattcatgataaatttagtgatatcattttgacatatcattatttttataaggagtaggtaacttttgagaattgctagtcacaattagaattgtttttattttaaaatatgcaagtctaatttaactattacataatatatactttaattaatttatgcttctcattggtgtttcgatgacatctgcctacatttttacaacgtaagtagagcatagttaatatgggcagtttggttttttatccgagtgaaaaaaaaaagaaaataaaaagatgtcgttagcccggcctgcttatgtacatatgtacgtacttttttaccttggaatatatgtacgtacctttttttttttgggaatacctactaaacgtccgtacttatgtgcacatatagatcggcaatattgagttttggagataactttaattggtatttttacaatagatctaatggttgaaaataatgggcccaccatatattaaatgaaaatcgatggctaatatttttttagaatttctataatttattagatcgccacatggcggcgtaggagcattttcaggggtcctatgtggcggcttagaagggtttctaggaaagttaatggacttttagtatataatagatagatagatagaagatagatagattcttattcgatctatatttcgattacaccattgtgttcgttgtaattaaatcattataacaatatcttacatgattatattatgataaaaaatatttatactggtaaattacttttattatatatgtaagttacttttatcatatataaaaattacttttagatttgattaagttacttcattcatagtgctctgagtagattacatttattattgtttttagtcaattccacaatttggtgccgattaaatttaattttttgataaactcatgtttttcatccctataacggatttacttctaatgttgtaacaacttacttccatttcgtactaagttattttttttatgatttatgtaaattgctttcagactttattaaacttactttcataaatgtatttacttgaaaatcttctctacactttggttgtgaatttactccacatagtttcttactacaatccagttatagtgtaattacttctaatcttatagtagagaattacttctattgcatatctaagttatttctacaatttaaataaattgcttttaaattgataaaatgtttgaatatattccacatggatctcattttagcacatattttgagtagagtacaatgatgtaaatagatcttaaaaataatatatgatttataagatataaatctttaaagggggatttatatatggaatggagtgatctctggttaggattaacccactaccgtgcactacctagtcacccctcggcggtattctcccgggttttggctaacgtggcaccttcgtggctcctttggctaggtctttatcccaagtggcattgacgtggctcttatgtggcaattcgatccgaaaaaattaataaaccacgtgggactcacatgttagtttcacgcacaaaataataaaaatggtgggggcctatcgatgtttgagatcacgactacggtatttggatggtatggggatcgttggtaccagggtatatgcgagattgaggtaaaagagatggagacggagatttttatacaggttcgggccccttatctggggggtaatagccctacatcctattggccgaagccggtgtagctctttattcatctggatcacacaaatacaatatttgggataacctatctggtcatcgttgacttggcggcatgaacaccaactcgtagttgacgacgggtagtcttcctcctcgagtatgaactcgtcgagatgagagatgccgctagatccctcttgtcggcccccgtgggcactgatggggtttgccaaggctaatctgatctctaatgttgatatctggtgacgtgtgttggcttgtgtgtatgttgtgttggtcttgtggcttccgtgtatgttggctgtgccccctctcctcctagggggcttgtatttatacccatggataacccattgtccaagtaaaactagggagaccaatatggatacaatctgggtagtctttgtcatttccatatagaactctatttgtccttccttatccggatttccttctatatacgaagtttgattccgtataagacatggtatatggtgggccccgccgagctgaatcgattactattgggtatgtggtatccataaccctgacagggcctatgtggccccacattttatcctcattactcccgtcttgtatctatcttctctatcctcttctctctatcatctatagagtcccactctgaagcggcggcaagcctcaggcggagcggagcaaagggatgaagtggggtgggcggagcggcagggcgagcgaagcacggtagctggatcaggccgatggaatggagcggaccgtcgtcatcaactgctatagcacctgccatagttgccgcgctcgccgacgactgctcgagctcctcctccggccatctccaccgttgttgcccccttcaccgcccgtggcctgccttcgccgctgctccgtccacggtctaccgccgccaccgctccgctggcatgcaccggtcaccgcgttgcacccgtcccactccgctagcatgctccaaccgctgccgctccgtagtgagactctacagaaggatagaaagaagaggagagaggatagagaggagagggggtagtgaggatggcacatagggtcacatgggccctacccttttttatcgttttatgtgtgatacttacatgtgggtcccacgggttttattatttttctagatcgattgccacatatttgtcacgtcaatgccatgcagaacaaagatctaatcacaagagccacgtaggcatcacattagccaaaaccagggacaatattgacaagggacctcgtttacacggttttttaagttggggatgcgttgtagccggttttatcatccagggatgaatttcgaactttgtgacaaattgagggacctaacgtgaacttattccgctttggaactaagggtgttgggccagctgaggttctggcccaaaaggagttagactttttgaaattaggcttttaattagttttattaattgtaagtcctagatttattgcttgttatttactggaaaggtcacatattaatattccccataatatatgtgggttccatctgtagtagttttatagaattaagtgataattgacattcttttttaaaaaaaattacatagtataacgcagacactcacaacgcacgcacactcacccctatgaatgcacgcacacaaaccctacccctatgagcatcttcgaagactgggccgataaatcatccttaaaattgacgaagtcaccataggcgtctcgctgtcgacgagtacgtcgcctaccattgaaagcacagtgtcattaaatcctgaaaaattcgctcccatggggagtcgaacccagaaactaaggtggccctactttagttttatacttcaattaggagaattcggaattgggggttgtacttaattcttattttacttgtataatctttactttagttttatacttcaattaggagaattcggaattgggggttgtacttaattcttattttacttgtataatctttaattcggagaatgtatgattgattcattgtttgtatttataagtatcggaaattaaaaatttcccttttttgtgttgtcttttatttatttgagattatcgaattatcttgtaattcaatttgtgattgtaagttgcttccttacttgggtcgattcaagcaaagcactcaaaaaagcaccatgttttaaaaaagttaacaagtttacacgtttttattaatatacgatttttagggtgttacagtttccctctccgactcggatccgaacttgctggggaggcccaagataaggactacacgccgatccaagaaatttttatggcctcaagagctgaggatgaggaagctcgccgattaagggagcagtgggaacgtgaggacaaacgcctttgcaagggggcagaagatgaagaacggcagggcctgcaatcaggatccgtgcacgagttcatgccgtgttcaccaaaactataatcacaactgtatgcttaattaagtgctatataaaaaataattacgcaagtatgagatgaggtggtgagagcctcagaataaggagtctagattaattaatttatgaattaggtcattggtatgtctagattgataattcagacagagtggtacatcagggttgataatttcagattatccgtgtaaacggtctatcagaaaatccaatagaaatattaaataatccgcatatgccggattttagagataccacatccacatccgaaagcgcaccatactatttggaaacatataccatatcctcgtttcggatggattcggagcgattttatctgatccgttttcaccccttcataaatgtatgattttaaatccatctataatctacgagactatgaaggtgacatcttcagcttatacacttcggttgtttgggcattcagctcagtgagtgacatctccaaatttgtgcacaaatagctatatcacggtagtgggtcttactatgacccttcccctccttcacaatttcgaacaagattctttaacatattatcttctaaatttgagtgactataccatatatatatataggccacacatacattactagaaaaactattttcgcaaacatccgctttattttttaggtggggtcaaaagaagacccatctgtgaaaattaggagagtcccttgtcaaggctcgtaaataaaaatcgattttacacgcacacgcttaaattgctcacctacaaattttttataggcgagcgtcttaagcatgcacctttaaaaatttattttcacgtatggaaacttaagccacttgcaacctcatttccgcaaacgggcggtttgagtgtgcacatgtgaaaatcgattttcgcagacatgcggcttaagccactcacttttgaaaaatcatttttttaagaaaaaacatgtatctacacctaactttttcatacaaagttggatgaagataaagtttatatcaaaattttttatcttgatgatatctacagttttgtagttgacaattttttatttgagattattttagaggctgaaacatttgttacaaaaatctcacatgtatttttacaaaatttaatatctatgcttcgaacgatctctgatgaaaacatgcgctacatcaaagttatagggttgaccagatttacaactttgtaatggaagactttttcatttaagattatttagagtactaaataaacgttttaagtttcactgatgtgaagttcaaaagaatagcatcaactccaaacggtaagaactagatagtgtggtggttaggagggatgcgtgtggactatgacggcctgtttggcgagagaagggaagaggaatgggagtttgaaggagggagttgagggtgggattggtcatgggagttacatttttagtcctcatcgcttgtttggtttcacgttgaattcccttcaagtctcacgaattaacaggcctcccccaggtaagagattggtgggagttggaccccttaattccccatcccgaaccctcttgaattcccaagtcttccaatcaaactatagacttaaactcccaaatatcataaactcccattccctatcactaactccctccaaccaaacatgccgtgaggtcttgagtttgagtcctatatacttgtatttagtaaaagaaaatgatgtgtattgtgattcgggtgtgcaaatgtttatggatggttactaaaattaaaaaaatatttttttattttgttttggtgcctaaaaaaattcaaaaatgtgaaaattcactttcaaaaacaatcctcttatgtcgtccacttgtgaaaatcgtttttctcatacggccgccttaagccacctacttgtgaaaaaacgatttttccactcgactggacatcccacctatgataatctctattttcacaaacacctaggaggaggcggggtcgctcagcctcttgcgaaaaatagattttggctgtctgtagagaccatttctatagtagtgagataaatacttggcccacatgtcagccatccaatcaaaaatacttaggagtatcacactatcaattctgggttggttcgggctgattgctattgtatttgttttatactacctctgttttttaatagatgacgccgttgatttttatcacacgtttgactatttatcttatttaaaaaattacataattataatttatttttttgtgagttgttttatcacacgaggtactttaagcataatttattttttatatattgtgtaaaatttttgaataaaatgaatggtcaaacatgtgttcgataattaacaatgtcatttattaaaaaactgagggaatatatctttcggcttttggagccggccccatcttcccattcgctccacaaggaaaaaaaatgtcttaaatggcattgctgcagtgtagacagttatactatgcgtgacactggctagaatcggagcaattatttccactccatagttgttggaagtatcctagtatatatactcgatttggagaaatctatctatatattcattttgaggtatattcattttgaggcaaatttgggagaattaaggatagtcgggatgacagacagaaatttacatggaaggaatcatccatcgatcagctaacaaactactagtagtaccggagaagtacaaaaaaaaaatgtcagaattcgaggagcgtggtggacatgttgagcagcggcccgagcgcgctgggcgcgaacttgcgggcgaacaggtagcacacggtggtgggcttgccgttgtacgcgcagcgcgtcccgttgttgcggatggcctgcacgaacgccggcgtgacggtggccttgccgaaccgcgcggggtgcggcccgccgcgcgaccagtccacccaggtgactgtgcggttggcgttgcgcgcgccgtggcggaggtgcaggtacgtcgggatgtagtgctcgtccgggtagcacgacggcgtgcagtgcttgcggaagatggcatggtacttccggtcggcgacgatgtcggcggcgaggtctcggctcatctcgaaccactcggaccccttccgccactgctcctccagcacgtcgggcgccatgcgcgggttgtaccgccccgcgcactgcggcacgtcgatgttgtacgactccacgtagctctgcgccgagttcaccaggtactcgtacaccgtcgggaagttgaacaccggcacgcagctctcggaggcgagcacgaaccgctcgttggagaagtccagcagcgcgttcgccagcagccgcttctcggcgtccaccagcgtgatggagccccacgacacgtcgccgctcgggatctgccggccgtggaacggcgacgacgacgacacgttcagcctgtactctggcagggcgtgcacgtacacggagtagagcccctcgtgcccgtggaaaaaccgctcccacagcggcgcgaacggcagcggcccgcgcgtcaggaacaggaacgccaccttgggcacgcgctggtacgggtactcctccacgcgcggcgccatggacgcgcgccagaacagct

SEQ ID NO: 27330 - DNA, 3034 bp, Oryza sativa
  unsure (1)..(3034): unsure at all n locations
ccatcaggatcagcagcgccgccacggccttgaggagaatccccaacgaccagcaccactccttccgtgtcgccgtggggaggccgccgctgccgccagatccctcctcctcgtccccggcgctgctccgccgagacttcagcaatcccggcttcatggcggaccacgaaccgcggcggccggcgacacccgcgtggagtaggggcgattcgatcggatggacgacgatgactgctcaccgtaggcgatggccagatgatagctggcgatgtctgcccgtgcccggccggccggagatggtgcccggtcgtcgttgctccgtccggtggtggcaatgcaacgacatgcacgcgcggacgaacactctgggcgggcagctgctagcgattgcgaatgcgaatgcgatgggagggaacggccctgcgtgcgtgcatgtgtctgcgcgcgttcctcggctcattggccctctctctgccttgccttcccttccctctaatttaatttgcacctctatttatttttatcttgggaaaggccatttaatttacctctatgtcatctcttacatactagcatccaaatggtcataacaaagttataagatacaccatttatgaataagtgacaaatcgtctttttcaaataatttcaaaacatttcagaaacgttaaaatattaaattgtattttcaaaatatttataatttcttaaaaaagtatggcggcactaatacgcgcgcaatgctcgaaacagtagttcgagcgccgcacaacgttccctccatccggtttttttcgttttttaccagcccacttttcctccgtacaccatctttccctgtctgtttttttcaattttcaccaccttaccttgtgtattttttttcttctttccatctcatccgtgcttcatcaaagggtccgataaaatattaaccatccagatttttatattttctcgttccatctcttcagatttttgtgttttctcgtaaaatatttaccatctagtttttcttttcgagttttctatttttctactgtctccccacatttcaaaagtaaaaaaaaaaatactatacggagttttccatttgctcccaacctcctagctctgcaccttcaaaagtaacaatttactcctatgaatgcatcatttaaaagtaacaaatttacttgcatgaatgcccccacatcgtttggcactgttcctagatcgctataaaaaaatattaccagtgttataaatattgtttaggcgtcgtagtctacaagtaaaacaattactaccttcctctctatatagcccatgttggcaaggagttaactctgttccttctccactaactctgaaccctataaatcaaagccaattctagccaatgttggttatcactgctcgggctagcaccccccttgaataatcaccaacattcacacgaagcctagaacagatggggagcatttaggatttggactagagggaataaagtgggcgtaatggggaatgagagcgagaagaagaacctggagtgcgccgtgggaagatgaccatcgccgtcgatgccggcgcagcgctggatatgccagttccttcccccacgccagtcttgagttttgtttgaaccaaaaagaaaaatcccgacaacttgtcccagcgtaaatgagatagacgcgagtgattgcgcaactagaaccataaaaatagctagtcccgtctggacgggacaccggtaatagcatttccgtaaaaaatacatatgatgtattttaaaacggatgattgattacttcattattagtctcccgcaacaaacttcatgtttgtttgtgatatgtctaaggagcctgatgctctagctaatgcatcagccgttgttgaacagtctggctcaaataatgatgcgaaatttgttgcttttaatttgggtgcaaaacacggggaaatgataaggccaaatcaaattatttaggtgggctcattatgtgtggagattgttccatgccaagagtttggccatgcttaataacttaattaagcatctaccattagtaacttagccgctacgtgatatgtttatgttaaaattttgtacttgagaggtgttctggttgtttctttctttcattttttttttttgctatatgcattttatgcaaaggccagggtacacagtgattcaatttgattgcatcatctttatgtaattaactgagtctaaataaagtttctattatctaaaaaggtaacttagctgcaattttttaatatttctgcatatagcttatatagatgagtttagtcagagttctcgttgtgtacgttagacgcatatacatgggctggcctacgtgccacatacatatatattggccttttcttttgtatcaggttagttttttttttttgggcggtgtttaccgtcgaaagaggtatctaccgaggtccatggcggcgaccccgtcgttgctttcttgaagttgtgcctccacattggtttggtgtggagaataactttgtaaaagtcatattttaaagctgaaaaggctattatattttttaaatatatatttttgatataagttcttatactttattcttatggcaacgcgtggggttgtcgactattactataactaggacgaaagcccacacacatgcatggacatattactaaatgctatataacagtagttactctaaagatgtgaatatttatttatttatttattgacaaaaaccgcaggagagactatgcacatgttgagcaaattcctccttaaaatgaaacttccaagaaatgaaagttggattaacttttctaaaactagtaatatgcccgtgctaaacgctacggtgcaattcaaattgtctttaataatttttaatatttcatgttagcaaaacaaatatttttatgatcatattacgtggacagaataaatctttacaataattagttatatataataannnnnnnnnnnnnnnnnnnnnnnnnnnnnnnnnnnnnnnnnnnnnnnnnnnnnnnnnnnnn

SEQ ID NO: 27331 - DNA, 3467 bp, Oryza sativa
  unsure (1)..(3467): unsure at all n locations
nnnnnnnnnnnnnnnnnnnnnnnnnnnnnnnnnnnnnnactctaacaaccaaaccatgatgaattatgaactgtgatatcttaacagataaacatatgtgatgaacgagagcaattgtttttattctaaattccagcacatgcaaaaaaaaggaaaaataatatcttctaatatcaatcaatcaaggaaaataggaaaaaaaagagagaagaaactgcttttaccttcaattgaggcatgaaccaaggatgtcgactggaaacaacaggatatgggcacaggagagctctgattggcagggttacgcatggcaatctgctaaacttgttcaaattagcgaaatttctgagaattgaaaagaagctaagacatctattttcagttatttacttgagggtagagaagagcaatgcaaatagaaaactatatgagcctaaaacatttcatcccaaaatacaccactgaatcttgtctagtaatttgttttctcatccttctccaattcatggcattactaaatgaagtttatcttccaaaaaaaaaatactccctccatactcgtaaaggaagtcgtttaggacagcgacacggtcaccaaaacacaactttgacttcttaaatctataaaaatatttattgaaaagtgatatatgtatacttttatgaaagtatttttcaagacaaatctatacatataatttttacattttcaaactcaacaacttgagagttattcatgatttatattcccaaggtttgacttaaacattgtcctaaatgacttcctttatgagtatggagggagtattgatcagtggttaattgggttagcttgttaacatgaaatcaacaataaaatgatatgattgggccagccttactattgaaaccaagaataaaatgatatgatgggtgaaatggtctatttcctatgacatttctcaataatactaatctacaatttggctgtcattctatgaaagattggaagtgagaaagcacctggaaagagaaaaaccaaatcatgcgaactcttagttccaaaaatgcatggttgtaccttcctgatagtgtttttattttctggcagggctcttaataggatttgaacaattgaaaatggccatgcgtgtgcaacaggaaatgtaaattcagtatgaaccccacaatagatacaaaggaagaatctgtatagcaacacttctgaacatttttgaagatacaaacgaaaatataaattcagtatgaacccagtaatagatcataggttagctcttgcaaagtacaagtacaaagaaaatcagaggaacaaagatccctcttggaattcagaagatctactccaatattcagaatgaccaataataattcaaacagtagatctcagaatcaactttttgtacaatacataatatcattaggtttcaataataaattatgagaataacattttttttcaaactaaacagtagaccaccatatttttatcctaactgaacagtagaccacaatatttccatttcatctttccccgggacagcatatgctttctctgatacggcatgaaaagaagaggactaatggttgaaaaatctaaaatttgcactggaaaatagaagtgaatttgacaattggcatcacacggaaacactttattcaatcatccagatccatttcaccccaaatccaatcattttacttttctatcaaccaacaaaacggtcacagtgcacggcttcatatggcacaactacattatctagaaacgtcataactcaaggaaacatctatcaccttgagaagaggttgacggtgctgcataaatgaaaatatacatgtcacatttcagttaaaaaaaagtgttctttcagtccaagttgcataaacacaaagtcaggaattgtaggattttgtaggtacagtttaatgtttcttaaagatgaactgacattcatttactcaaatcgtaggtaaaatctgaccccgacgcaagcacaattcacatgctatcttgcgtgcaaaatggaaaccttgacatggtagtgctcacatgctgttgacatcaataggaggaatagagagcaggagatagagtaggcagtgttttacctgtttagtaaatagtcttagggaggtgagtgcgccatggacgaggttgccggtggtgtagtctgtgccacgtgaaggattatcccgtgccagggcaaggcacagagtatcttggcaacagatgcagtttcagagtcttgacggcaaatgcagttacagatcgcggatcaacagatgcagtttatatagtcaccttgatatgccttaggagatctttcttcaaagcctaaatcccagtgacgctgacctatttttaacatttacctcatgaggaaaacaggaatccacaaagcaatgcatacataaagcaaaagtcaagaccaaggacaacactttaggttttacatcaacttataactcacaaataactacaaaaggtgcatgcatgcatgtagattttactctaatctagacaccaaagtgttgcatctgcattttctgtcttaaaatgctttctttttcgctgaatagtagccactgatgcaatacaaggatcataatggctccgtggttctcacttcctagtggggccctgcatttcaacaacgtcatgtcctaactcctgatcttaacaattgtctaaaccatcttaccttgactgctgggatctcacattgtgacacaaaagagagagatcattatattttctttaaatagcaaatatgggataaataaatgaataaagttgacctgacactggcatgccacaacccacagcagacggtcgcccgctcgagggccgcctcgcactccatgacaaggaaccactactacggaaatcagtataggcgccggttaggaaccggctatagatgacggtttccccgccggcaccaattggtgggcacctatgctggttttagaatcggcagctacagagattatagatgccggttattacccccaaccggcatctatgggttagggatttttttttaaaaaaaaaaacgtcttcaaggaatataggaactgaagcatcccggtgatctcaccacaatcagaagcaaaaacttactccaaggaagcagaaacttgtaccatctcacaacaatctcgaacccaccatacatacgaagtagaaacttaccactaatcatcaatctgatgagctgctgctcctcatgaacatcccgcgcttacgagacgaagccctcctcgcctaccagggaaccccacctccagatcgatcggcagggcgtccagacgtctgtcgctagcggcacgcaccctgaatgaacagaaaccaaatcagagaaaaatgaatccgcacctccgccgctagcggcacaaaccatgaacaaacaaaaaccaaattagaaaaaaaaagaagaaatcccttgatcataagggcgcacgca

SEQ ID NO: 27332 - DNA, 5204 bp, Oryza sativa
ataatcgcgagatttggggcgacgtgggggacggaagttcgggaaaagaaggcgcgggtgggtgcggaaggtagaaagggatctggttcattggatttgagagggtgattttggaccattggatatgtgattcgacgaatgatgaatgattaaaagaatttgttgaagtatatgggtagaattaaatgattcctcctacaccataaactctataattgagctattgccattaaattattacaataaaaaataattcgtagcaatatattgtaatgttacaatgataatttttctgtggcaaataattatattttattgcaacgatctacgatcgttgttttatttagtacttttgttgcaatagaaaatgagatatcgccacaaaaaatcttattgctaaaaaaaacatgttctatcgccacaattttaattttttggtaatttacatagtacatggtacttttcactatttttcattgccacgatcagcaaattcattgcaataaaaaaattgtcgtctcataatttaacttaaatttttcatatggacacggattgagacaaattttatatggaaattatagctctcgacgagatctataattttataggtgataacattttcatttgaaatcttttagatattcaaaactatgattcaaatctcagttaggcacgctcaaatggaacgatatgtatttttccaatagaattgatgtgtaggtgagttggtaaatgagagtatgtgtgaagaataggtcttgggctcgaatccttgccaagacacaatatcaaaaaaaaaatagataggatgatagactaatatttgaacttttaatttggtatatagaactaatgccacattatagagtggtggcaatcatttttattacaacgatgtgaagtgttgcaatatgatttttttgccacatccattccgtgacaacatcgaaatttattaccactaaataaaaatcgttgcaataacctattactacgctatttattaccacggttagcaacgattttaaaattatgacaacatgtatctattgtcacaattttagtattgatgccacgatttttttcgtggtaatgatttttctagtacagcaaactatggcgacaaattccacgattgctgaatatttgattttggataattttaacataaaatattctttaagtttattttatacttataattctaagtagataatgcgtaccaaggatccactaataatgcaagtctaaaaatcatagcctgattttctctgatttaagatggtgcgctgtggcgtaacatgtcataatttatttagtattgaaacaaaacaaacattattttgacttaattaaaatgctacaacatttaaaccgcttgtaaagccaatgtaacatacactatgatcaactaaagttcgcttatttataaaaataccaaaaccaatggaccctacatgtacgcatggtgcatgtggcattgggccattgaagttatagatggccatcataagacctgcccggcacggcctggcccaggcacgggcgaggcacggcccaaggcgatctggccggcacgacacggtcggcacttcgggccatgccgtgccggcccacgggctgcaccttaggcccagacacatcccaccagtagtcgggtcgtgccgtgccggcccgaaggcataggcagcccatcgtgacttttttaaaataagtctattttccttccatcctctttgggatgtgacatatatatagctaaataagtctattttacgtcccgactctttgggccgtgccatataatatatctattttgcctccctattctttgttatgtgccttacatatggttgagaataagtatgtttcgtatccctaaacttcgggccgggacgtgccggcccagcgtgccgaggtagcagcccaggcacggcacggctattgggccccggccgacacgggcatgaccgaagtcgggctgtgctgggccaaaattaccgggtttgggtgggccatcgggcctcgacccatatgaccatctataattgaagtccatagtcggtgtatttctaaaccatctacaataatgaatctactaatttaagtgaaaaccaataaccagatattttaattcttttcaaaatttataggattttataatttattagaataatcaagagaagagaagtcatagaggactttaaagaatgttttttattgaaattactattgggcctcgtccaatatataaaggtaaattttgctatagtacactttggtttcgtggttttggccgtaggacaccgcccaaacatacttttgggggaaaacactccgtaaacgtggtaatttgtcaatggacaccgtatcgattagaataataattttcggtcgaaggggggagagaaatcgcgtgaaatgtcaaaaatgtccttggacccacatgtcagttatatctcttctctcacaatcctctccttccagcgccgcaacgcatgccaccgtgttggagccccacgtcggagctcgccgtggcctcggaactcctccttctcctccacgccccaatccccaggcaacgcggacgacgacgacagggaacggcggtggcagcaccgatccaaatctaatcggcacagcttcggcaatgccgcccttgtcgttctcttcccacgcccgaccttctcagacctgctccgccgtgggcgacgtgcgcccttccttactctgcttccccgcgttgcggcgcatgccaacctcactgtctcgctcatcgtggcggaggagatggcgaggatagcgggagcgactgcggcggcactcgcggtgggagcggcggaggacggcgaggacgtggcgaagtggcacggggcgacgtcggtcaccggggctcgagcttgtcgcggcagaggagatggcgaggatggcgggagcggcaaagaaggcgagaaggagagtcgcgtcgtcgtcgccaactgcggccactcccgcggcggaatgtatccatggtgctcgtcgccggcttcacctccgccttcatccgcgacgtcgacttgtaccgcgctgagccctgggacctcctgctgccgtcgctgccgccgcgttagtccattatcttgcatgctctggcctgagatcgattgcgacgacattgcttgcgtgcgtgcgttggctttgatcgatgtgccgtcgttgttgatgtgtgcaggtgtggcggcggacggagctgaggagtaggaggaggagcggtgcggttacttcttctgcacgaggagcttcaggtggccatcgggaacgaggacgaacagggccacggcggcatgaacaggggcaccctctccttcatctcccaaggcgtgacatgtgagagaggagagatagcagtgctgccatgtgggcccaaggatatttttgacatttcccgcgatttctctctcttcttcaaccgaaaattattattttaatcggtgtggtgtctattagcaaattaccacgtttatggagcgttttcctctaaaagtgagttccgacaggcgaagtgtcctgtagcaaaatttgtcatatataaaatactataggatgtttgatggacttttaatgtgtttcctctaatttcttgggaggcggcatgcctctcaagatagatcagataatatcattttgaggcttcactatttaaaagcattgggagtaaatgttgtaaataatagatgagtatccagccgcgttgatgcgggaaatcaagttacataatatgtataaataagatgtaatataattattaaaactaaaacaaattgatacttatgaattttgagcctaaaaataattgaaattgcatggtgttatgagagaataaagaagagacaatttaaactatagatctatcgtataaaggctagaaataattagggtgacgtggcttaatgagaaaagagaaatagcgttaacttagtggggatgaactatataagtatataggattactcacaatcagatttagcccctagcaacgtatgtccaaaagttatatctacatatatttacatacttcccctattccaaagtataagtatttctagctatgaatctggacagactattttctagtttcatagctaaaaattgttatattttgggacggaggtaataataaatattgtaaatgttattatttctttcaagaaattttatattttatttagctacaaatatataaaatgataatataatctatatggtcaaatgacttttttccttacctacttgaaggtatatgtgcacaccagatctcaaatatagttgagttgatgtacaaacacctcattacactactaaaaaataattttctcaggcgagctgatgtgaccaaggcacctatctcttttgccggtgattctttgcaaatttgtgtcaaccaaattgaagagagaaaatcaattaaccctgctactggtttgatgcagaaaaaaactaaaggagtacatatatgttgggttaatacgtgtggtggtttgatttgggattcctaacccgcgcgtacgctgtccagtcactaaccatgtgattagcactaatgataacgtgattagtgattagtgctaatcataattaagtacctacaataactttttttttctaataaattgaaaactttcaagttagatttaaaaactttcaacttatgatttaaactttgaagtcaaattttgaaatctttcaactcaataattttaaaaatttttaactcgaaatttaaatttgcaagataaaatttgaaaactttcaatttcaactcggatttgaaaactttcaactcgagtttttaaatttgaattataaaaaatatttttttattaaaaatatcttataataaaaaaattgataactttcactgcatcctaaattaatcaagataaaaacataaaaaaagaaagatcgtatagatacatgcatgcatgtgtgggaccaaggtgcgcactggtgaagaaaccatctttcgccggtcggccgatttccacaatagtcccggatgcaataaaaaccggggctaaagatgatctttagtcccggttcaaaagggtaacgggcatatttgatctttagtcccggtttgtgttaccaaccgggatctttagtcccggttcgaatgctgtcagggcctgtcaggcccccccgggatctttaatcccggttgg

SEQ ID NO: 27333 - DNA, 3013 bp, Oryza sativa
  unsure (1)..(3013): unsure at all n locations
aaccgggactaaagtcccacccctatatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgtttttttttgtcatactacattttcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctaacaggcaaaggggttttatttattgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcaatatgttggatttgaaggaaatcaaacgggcgaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagtaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgatagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcggggatgctctagagtcgaccgataggcatgcaagtagcagtctatccggacagtccaacaagggatacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcgaaaaggggcctagaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagaagcccttcagaatgaagtggtgcaatgtctcgtcagttttaagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtctagaggcaagcatcgccaagggttatggaatagaggaggtcatcgnnnnnnnnnnnnnnnnnnnnnnnnnnnnnnnnnnnnnnnnnnnnnnnnnnnnnnnnnnnnnnnnn

SEQ ID NO: 27334 - DNA, 1361 bp, Oryza sativa
cggtggttcgtccaagacagcattggaggaattcttgaagctgcatggtcgcattatgctcaagaaaggctgacgccgagagaaataattttctgttttatttcctccgttttactgtgtaagtcattctaatattttccacattcatatgaatgttaatgaatatatatatatatatatatgtagattcatttacatcattatgaatgtgagaaatgctacaatgacttacattgtgaaacggaggaagtagcaatttgcccaaccttgaaacgtggtgcctgaaataacctattatgtgttcttgagtacacacgcatttgggttttgtattgaaaaagctaatttttcaagaaggttaatacacaagagctataccattgaaaaatggtatagactcgtacgcgtatcagccacgcttcgcaagggaagaaattttggtagtaggaagtctctttgcttattgaaggacgttgccacgtatatagtgatacatgtctatttagaatccttcgcttgccgtggcgtgtggcggcgacacggcctggaaagggaagcgcggcatggcgggcggtgacctcccgcgccgaacacgagccaagcgcggcgctttgttgctgtcgaaaatgttccgccaccgccgtcccacacggtatcgccggcactctgctgtactcgaacaacaatgtcctcacgtaattgccgctggtgccgcgactagcgccccgctgggagaaagtccatatgcgctggaagaacaagtccacgtcgaagtcacttttgttgctaatgacattagtaattaatacgatttttgaggggatgcttcgagcctttgagattatgactgaggcacgtgtcctgcacgagattatgactgagacggactcatctcttatgtttatgattattaactaaaatttgaattttcaattttaaatttagagctgattttaagatttttttcatcgaagtttatttttcaatctttgcttttagattgcaaagaacacgtatatacaaattttgtttataacttatttttcgtttgtaaatatgccgtttcgcttattaagggtgtgtttagttcacgccaaaattgaaaatttgattgaaattggaacgttgtgacgaaaaagttcgaagtttatgtgtgtagaaaagttttgatgtgatgaaaaagttaaaagtttaaagaaaaagtttagaactaacctcggcctaagcgaaaccatggctccaatcctaccggatggactttcgccctaccagattttcttcccttcgatagaataaattgctgacagaaagacacatggcaagtagtactcctgcctggtagctgtagctttattgtgatg

SEQ ID NO: 27335 - DNA, 823 bp, Oryza sativa
taaaagctggcccacatatttttgtttgcttcactaggtgaacagtgagatgaaccatgatatcgaagaaagctagtggaaaatacatctccaagtgacacagggtactgacaatatcggtctgcaacccatctaggtcttctggatctataatcttctgaccgattgcattgaagaaggcacaaagccgttggatcgtgtgacggacttgtggtagtagaatgcctcttatagcaactggcaagatctgtgtgattagcacgtggcaatcgtgagacttcattccaaccagcttaagatcctccaatttaacgtacttacttattctcgagcaatagcccgaaggaactttaatatctgccagacatgatagcattgcgatcttctcatccttcgacaatgtgtggcaagctggtgggaggtacactcttcccatcttctcatctgtaacaggctgaagttcactgcgaatgttcatctcctgtagatcgagacgcgcattcaacccgtcctttgtcttgccaggcatattcaacaatagccccagcaagctatcgcacacattcttctctacgtgcatcagatcaatgcaatgacggacctcaagatcttcccaataaggtagccgccaaaatatggattttttttcttccacatcctcttcttgtcctccttgctacgttttcttttcttcccaaactcattattaatgtccttcaccatgttgtgtacttgatctccggacaaatccgcaggggcagacccaagttctttcttaccattgaaaattttcttctttcttctaaaggcgtgccgtaggggg

SEQ ID NO: 27336 - DNA, 508 bp, Oryza sativa
  unsure (1)..(508): unsure at all n locations
nnnnnnnnnnnnnnnnnnnnnnnnnnnnnnnnnnnnnnnnnnnnnnnnnnnnnnnnnnnnnnnnnnncagaggaggaggaactcgaagtgcaagagtcgtgaagaacttcgtcgtcgttctggtcgctgcggagtatatatatgcgagcgcgagagtaacgttcggagtcatcaaccgcggtgtttaatttcgtaaccgacgcgctcgttaatacggaaacaattcacggcgtttaattccgtaaccaacggaatcaaatcaattcacggcatttaattccgtaaccaacagaatcaaattaattcacggcgtttaattccgtaaccgacgcgttcattgatacgaaatcaattctccgtgtttattaccgtccgttacaaaatgagagagcgcagcagcagcaattgtctgcctcgcctcgcctcgcctcgcccctcctggttgtccgcgcaccatctcaaccggtcaacagagacttgggtaccgagctcgaattcgccctatagt

SEQ ID NO: 27337 - DNA, 714 bp, Oryza sativa
  unsure (1)..(714): unsure at all n locations
nnnnnnnnnnnnnnnnnnnnnnnnnnnnnnnnnnnnnnnnnaattgagatgcatgcatcctctcgtttgccgcttccttcgatctactccctctgtcctataatgtaagggattttaggtggatgtaacatattatagtatagtgaatctgggcatacactttaggatgtgtcacatcaaaccaaaatctattgtattatgaaacggagggagtatatatattaaccatccagctttgcctccacggcggttaaacaatgcaatgcgtgcgtcgagtgtggggagtcgaggtagaaatgggcggcatgcgcacgcggagcaggcggtggccatcgtccatctgccattgtccatgagctcaagtattcctgatgaccacggagactccacaaggggtgtgctaacggctgtcggatttcttcatcgatttgaggcctcacccgtccatcgactgtgctgctataacgaaacaaaacggccgtggagtgtggactagagatcggtttgcccatggtagtaacctgaatgtttcttttagaaagttaattttccaatctggaaaattactattaattaccaacatgaatcaggactcctctgcgtgttagaattttttttccaaggctatgtatttattttannnnnnnnnnnnnnnnnnnnnnnnnnnnnnnnnnnnnnnnnnnnnnnnnnnnnnnnnnnnnnnnnnnnnnnnnn

SEQ ID NO: 27338 - DNA, 716 bp, Oryza sativa
tgcgatcccaggggctcacgagggccatggtgtacggcgattactttcgtcgcgggatcgcgccgctccagcggcgcgcccggggcgcctgggaagtacaccgggtccgaggactacatgaggacccaccagggggtcaaatgggactgggtccctgaagacttcaaggtggtgatccaacgggtgctgaatctcagctccgtggaggcatccttcatcccccaaggtgtcctccccctctgcagcgatccagagcgcgccaacatcctgaccatcatgcaggcggtcggggcgtcaggggagcgggctcctcgaggccacgatggcgcgggcgggagccgaaggggggagcaatctaccccgggagggggtcgtgcttctgggccccgtgacgggggcccggggggcagccgccctgccgacgcccgggggaagaggaaacaggaggataccccctccccatctcctccccgagggggcggggcggtgcgtgccagcagcaggcgcccggagggtgctgtgccgacgtcgcagcccgagggggagcgaaaaaagaagcggctccgcaagataggggggaccgaaccatgccggggaaacctcatctcccccccaaggtggtcgtttagccgacctcctcgcaggttcgtccccgcgccaactgcggctgtattcattctcccatctcccaaggcaagtttttactcacccgtttt

SEQ ID NO: 27339 - DNA, 519 bp, Oryza sativa
  unsure (1)..(519): unsure at all n locations
nnnnnnnnnnnnnnnnnnnnnnnnnnnnnnnnnnnnnnnnnnnnnnnnnnnnnnnnnnnnnnnnnnnnnnnnnnatatcttatataatataaatcaacgtcattgtctaacctaatcaactgccctcttccaacagatgttagccgattgtaggttaaataacgatattgccaaagattatgtaagatatatgataactcgacagattacataaacaagattagagtatcataaagatggaagcactaatcccgagaacacaagccgttataacaagttttacctcttgttgaagatcgaaaccgatgcagctcaacccgaaagcaagaactcgtcgaaataaaactaaagcaaggcgatgcgctaaaattgtattgaacgtgtgtgttaattgattacatggggttcggggtctatttatacctgaaaattacaaacaatgtccatatcggacacgactcttatctctaacaaactctaagatnnnnnnnnnnnnnnnnnnnnnnnnnnnnnnnnnnn

SEQ ID NO: 27340 - DNA, 572 bp, Oryza sativa
  unsure (1)..(572): unsure at all n locations
tagagttccgggtatcgagctacgaactcaacatgcaagagaaggtggcaaggaaggttgatgaacgcatgcccacacatcggtcccatgatccccagccgaccattcttcttgaaatggtgagcccgtcagaaaacagtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctannnnnnnnnnnnnnnnnnnnnnnnnnnnnnnnnnnnnnnnnnnnnnnnnnnnnnnnnn

SEQ ID NO: 27341 - DNA, 1021 bp, Oryza sativa
  unsure (1)..(1021): unsure at all n locations
cttgggcgtgaagaaggcgctgccggtcggggaggccggatcttgaacctgaagtcggcggcgacggtcagtaaggccggatccacgactatggaggaggcagcgatggatattgaaccgggaggcggtggcggcgtcgagaaggaggcgacggcggtcgggaggcgacggcttggaggaggaggaggcggcgtcagcggtggcggaggaggaggaggcgacgacggcggtggatctgagagagtgagagtgtgagagagtgagaggcggcgtcggcggtggataaggacccgtggatgaggattgactaagtaaaccctagtcaatcctcatctctatcgggcagactattatacccgatgcagatgacactcatccgtgacgggcgttagtactctgcccgatacggatgatacctatccgtgacgggcattagaactaagcccgatagagatggaataatctctatcgggcatagtactaaagcccgtcacagatgacttattaaaatattttgaagttataaaaatcatttataattatcttctacccgatttaaaattgctattacatttgatctatcacatataattaacaaatgtcttatttacatagtttaaaattcctattaattttttaaattcatataattgacaattgcctttctcacatatagtttaaaattcctattaatttttttttaaaatcatctaattgacaaatgcctttttcacatatagtttaaaattcatattactttttttaaattcatataattaacaattggctatctcacatatagtttaaaataacaagtataattttttaaaaccacataattaacaaatccatttcttcaaagagttttaactcgaatggcatgaaacatatgcaattcattcattaaggctccaatacaaattaaatacatcattcacagtgatatgccttccgaatggtctgaacgaacgtaagccannnnnnnnnnnnnnnnnnnnnnnnnnnnnnnnnnnnnnnnnnn

SEQ ID NO: 27342 - DNA, 466 bp, Oryza sativa
  unsure (1)..(466): unsure at all n locations
cttgggagcctacatgagataggttggttgtatcaggtggattctgataggaagaccatgaatatcatgaaggacggcaagactgttatgattggtgagaggacaagctcatgtttgtacaagttacaagggagtgctgttgcaggtggagtcatggaagatgggtatgctggtgttgctgtgcacgatcctgaaggcggcgagcctggcgtaggctcgtcgggcggctcggcgtgagctgcggcagaaccaactcaagtcctggtacacgaaggttcgagctagtaacagattcggattggcgtggcatattcgccaaggtggagtttgttagagtttgtgtcgaatatgtgtacgtagtcggttacagtttaggacttggagttgtaataggtattaggactagagtatgagttggactctatcctagnnnnnnnnnnnnnnnnnnnnnnnnnnnnnnnnnnnn

SEQ ID NO: 27343 - DNA, 1118 bp, Oryza sativa
agggtccgtatcgagtgatcggcgtcccccggccaggctccgttcggctggccacgggcgacggcacagagctgcctaacccgtggaacatcgaacaccttcgtcgcttctacccctagtgggggtcgggtgtcaggtctcgggctcgggccaaccccgcgcccccccaaggcgtgcagggttggccgggggctaccacatgcatatccttatcttttttctcttccgtatttcaataaaagcattttcgatttcctgaggactgtgtctgtgccatcgtttccttttgaagaatcttggcttgaattagcacgctcgtgctcgaccctaccctcggtggcccgggccggctaaaatcgccaaacggggcccagaaccgagccgtgccctggggcgtggtgaactccgggggggaatcggcaaaggcccacaatcgggtcatccataaccctcggtcaccatgttcccggcctggccagtctcgacacgtggatctccccaggcactagccccgacccgcgccatttgaggttgggacctgggcacgagccctcgttcaagccaagacacagaaggaccgcggcacagaccaccctcgtctcatacacacaacaaacagagttgacacaaaaatttcctctttatttgattgcagattgaattagtttatacaagaagggggcccgaaggcctcagaagaagaaagaaaaagctatttaagattggcgggggcctgggggctcacgccgacgcgcccgggtcgccggcctcgtcgtcgctgtcgtccgcaccaccgtcaccgccctcctcgtcagagtcgagggcgaacgcgagccgaggggccgtaccctcgaagctgtggacgatgtggtcggcggcgtcccggacctgcgcgcgcgcgccatcctcggttccaggagggaactcgtccagcgctgcccatggggagaagtcagggtccctggcctggtagcttgccagtacgagctccatcgccccccgggcgaggtccctcgaggatgacttgatcgtctcctcgagctcctcggggagccgctggagggtcccggccatctctgagaggcgctgggcgaggcccccctggttggcagcgtatt

SEQ ID NO: 27344 - DNA, 814 bp, Oryza sativa
  unsure (1)..(814): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacccgcagatggatgcttatgtgcgccaggtgcggcgtatggagcgccatttcgacgggatagagcttcggcacgtgcccagacgggataacgcggtcgccgacgaactctcaaggctcgcttcctcgcgagcccagaccccaccgggcgcctttgaagaaaggcttgctcagccgtcggcgcgacccgaccccctaggggagacggacgcgcctgaacggcccccgaggcccgtcggagtccaggcctcgggacccgaggggagcgttcccggctctcctagattgattgcttggatcgctgagatccaggcatacctcgtagataagactctacccgaggaccgcgaagggagtgaacgcgtccagcgcatctccaagcgctacgtgctgatggaagagaccctctatcggcgcgcggctaacggagtcctcctgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 27345 - DNA, 625 bp, Oryza sativa
  unsure (1)..(625): unsure at all n locations
nnnnnnnnnnnnnnnnnnnnnnnnnnnnnnnnnnnaaagtgctatgggtaataataccaccttcgaaatctaagtgaagaggtctcaacttaaatacggagctagtcgagagtctctgttgaccggttgagatggtgcgcggacaaccaggcggggcgaggcgaggcgaggcagacagttgctgctgcgctctctcattttgtaacagacggtaataaacacggagaattgatttcgtatcaatgaacgcgtcggttacggaattaaacgccgtgaattgatttgattccgtcggttacggaattaaacgccgtgaattgatttgattccgtcggttacggaattaaaggccgtgaattgattccgtcggttacggaattaaatgccgtgaattgatttgattccgttggttacggaattaaacgccgtgaattgattctgtattaacgagcgcgtcggttacgaaattaaacaccgcggttgatgactccgaacgttactctcgcgctcgcatatatatactccgcagcgaccagaacgacgacaaagttcttcacgactcttgtacttcgagttcctcctcctnnnnnnnnnnnnnnnnnnnnnnnnnnnnnnnnnnnnnnnn

SEQ ID NO: 27346 - DNA, 839 bp, Oryza sativa
  unsure (1)..(839): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgctttttacaatgagggctaatctacagccggaaatgacctctgacaagcagtacgcacgcctcctgctccgctcgtcagctctcccggtggacgcccgtttcaaccttcattcaatagccagcgactgtcttgccatgcttgcactgaagcctggaatggatctgaccgggactgacataccaactccaggagtcagcacgccagctccggctagagacgagaaccaggaagctctcatcattccgacgggacggggcgaggcgtgcgacaggccgcctgttgccacctaacccgcgatctgaccggtctgtgaccggtcacataccgcgactggtcacagaccggataagcatgcgctgcgccgcattgaatgcggcgtgacgcgctcgtctaacccgctataaatgcggttaggtgagcgccgctgtactcacctaacccacacacgtggcgccaatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 27347 - DNA, 438 bp, Oryza sativa
  unsure (1)..(438): unsure at all n locations
cgaattcgagctcggtacccgatcttctcatccttcgacaatgtgtggcaagctggtgggaggtacactcttcccatcttctcatctgttacaggctgaagttcactgcgaatgttcatctcctgtagatcgagacgcgcattcaacccgtgctttgtcttgccaggcatattcaacaatagccccagcaagctatcgcacacattcttctctacgtgcatcagatcaatgcaatgacggacctcaagatcttcccaataaggtagccgccaaaatatggattttttttcttccacatcctcttcttgtcctccttgctacgttttcttttcttcccaaactcattattaatgtccttcaccatgttgtgtacttgatnnnnnnnnnnnnnnnnnnnnnnnnnnnnnnnnnnnnnnnnnnnnnnnnnnnnnnnnnnnn

SEQ ID NO: 27348 - DNA, 616 bp, Oryza sativa
actatagggcgaattcgagctcggtaccctggtgtagacttctttaggaatcttattctgggtcctaggattccggcacgatgtagtcccagaagtggtcgttgacatcggttcgccttgctgcgacatgtcctatgtcactgttgtacggggagaaagaacttgggtctgcccctgcggatttgtccggagatcaagtacacaacatggtgaaggacattaataatgagtttgggaagaaaagaaaacgtagcaaggaggacaagaagaggatgtggaataaaaaaaatccatattttggcggctaccttattgggaagatcttgaggtccgtcattgcattgatctgatgcacgtagagaagaatgtgtgcgatagcttgctggggctattgttgaatatgcctggcaagacaaaggacgggttgaatgcgcgtctcgatctacaggagatgaacattcgcagtgaacttcagcctgttacagatgagaagatgggaagagtgtaccttccaccagcttgccacacattgtcgaaggatgagaagatcgcatgctatcatgtctggcagatataaaagtcccttcgggctattgctcgagaattaagtacgtac

SEQ ID NO: 27349 - DNA, 14000 bp, Oryza sativa
  unsure (1)..(14000): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactactgtgagctctccaacgctagttgctgcagggatatgaaacaatccaaagaccataaactccactgatccaacagcaaacaagcattcccagtacacacgaacaccgtcatggcggctagttgctagtgcgcaccatcctctgccacgacccacgccgagtgagcatacaggatgcgccccttccacccctgcagcaaccaccctgcatcctcctcgatcacgaattcctcgtgatgccgcctcctcaccctgcgcctcaccgcctccaccacgtcggcctccaccgccacctgtctcagccccgcgcgccgattcctcgcctgccaccgcctgtacgtctccggccgctccacccgctccgccccttccccggcgatcacccccaccgccgcccgcctcagcacgtccctctccagcaccgcccgcaggtggctcccctcctccggcgtcgtcgcgtccagcatgtcgaacagcgccgagaagaagaagagcgcctcccggaacctcgtcgggaagaagggcgcgccgtgggcgccgttcaccacggcctggacgaacaccgccgggcgcatgtcgcggatgctgccgaggaccgtgtcccgagggctcgggtcgtcgaacacgccgctctcgtccatcagggtgcccaggctgagcacgtcgttcacgacgaccgccgcctcgtcgtggtcgacgccgacgacgtcctcggcggtgaccgtctcccacctcgccgccgccacggcgcggaacttgaatgggagcccgaacgcgcgcgcgcagttgctgagccggcgccccgtcctctcgagccgtcgggctggccggaaacctggctgcgggtggccgacgagcgtcatcctcacctccggtggcccgccttccctctccgccagccgctgcagcaaggatggccactggaggccgtggtactgaccgccgtagtccacgatgtgcaccttgctcctcccttccgccgcgcggaggatggccatgttggcgaacgtgaacgccacccacttgaagcagcacgccgccatgaacacctggtacgcttccagcaactccatggccgacgcgcgctcctccgcggacgcgagcagccggtgctccaggctcgccgcgccggccagccgcgcctccaggccgtcggcgaagtaatgcgccagccgctcggtggcgtcccctgtcggcgacgagtgccgcttgatctgctccaggagttcgccggcgctccggcggttgcccgatgccaccgcctgcgcgcacgacatgagcagctcgcgcaggtccaccacctcccccttgccctgcctcctcttccgccgcgccgccttcccgccgtttttctccgcggggacgcgtggcgcgttcatctcctcgtccccgttgagcatcatcttctccaacatctcgccgacgccatcgtcgtcgtcgtcctcctcctccggcgtggccatcagtttgctcgccctgcccacctcggcctccagctcgtccccgccatgcttactacccttccgtcccctaccattgccgctcccctgcatcatcaaggcagcagaatcctccatgggtgcactgttcacctcaccggcgatgccggaggaggaggagaggatctgggcgaacggctgctgcgcctcgaggagagcggggtggtcggggtacaggcagaagaacatgtcgtcgtcgatgtcctcctccatgagaatacgcgagatgtacgggagcaccacatcgtcggccgccgcggcggcttcggacggcggcgcggctggccccatgaactccagcaacgcagcgccccaagaaaacacgaactcctctcatcaccggagtgccatatgatgtactaggtggtttccatgcttacattggagtcatcgatcagctaatcagccagcgtatcgacatggctgtggctgatggcatcaggcatcagctgaacataggcatcatctaagctcattgataaatgcgatgcgaccaacacacataagaactgacgttgtcaatcagatcatcagttttgttctctgaaaaggaaattttgttacgtttgttgtatggatagtgaaagttacaacttacaagtgacaaaaaggaaggaactctagcatcagaaacaaagccagcacctcatctgcttgttgaatttttcagacgaatatgcagcaacaaaccagccgtccagatcaaacccaactcatcctggcgagcagaacacgatgtagagaaatggacaaacttgtattgtgcatctgtgtactatgtttaccatgtcaacttgaggcaattctatataaatcctgtcaatttgagcgaaatgctcaagtgtatcgtctcagctctgagatctgaactctgaacaggcaagcaaaagcagaacaagatggagcgttcttctcccaagccggtcattgcgctcgtgctgttcgtcgtatgcatcgtcagctgttttgaggatgccaccgcccagtacagcggatcgtccaacaacggcgcggcggcgacgggccccatggccgccggtgggagctgctcacttgctgttgctgccgctgtgctcgccgtcgcagcgtttgtctggaactgaaacattgtggttgagctctctgttgcttctttcttttcgtataactatgagtgaatcatcttagtgatctcctttgctctggttattttagtatcttatattttatatttatttttatgatgttcttgtttgcgtgagatttatgagtttttatgtgtatgcgatgtgaatggagtacttggtcttgcacgcctatgagtaaaggtgttcgtgtacggtgtacctgttttctgtgtacgtctgaaatgaagttggagttgcttgtgtacctctgttgtcaaaaaaaaaaaaatttagcatggtggcccgcgcagattgcacggctagtatcgttaaatttttttctcatatattagcttaaatattttcatattttattattaaaatatattaaaatgacaacataattttaaattcttggttgaactaacaaatgtgtgatatttttattgtattgtatatcattattttttttcacatagtagcatatattttcacataatataattaaaatatattaaaatagcaacataattttaaattttgtactaacttaacagcaccaaccaatatgtaatattcatattgtattgtatatcacatataatattcatattgtattgtatatacgtgatagttactaactatttttaaattttgaatttttgtaatttctaaattggatttctatatggattccagactcctcttccaatatttcttattttctaatttaaaaatatttcttattttctaatttaaatgttctattatttataaattttatttccatatggactctaaacctttctttcaataagtatttcttatttttaattttgaattccaattatttttaaattgtattactatatgaactctagactcctcttcccatatttcttttaattctgaatttctgttatttgtaaattgtatttccataatgaatctaaaatattctttcaatattttttattttttaattccaaatattagttatttctaaattttgtttctttatggactctaactttagttccaaattttaattagttctacattgtatatacatggagtctagtcttctctttgaatatttctttttttttaattaggaatttcagatatttttaaattatatttttatatggactcttttttaagtaaattctatataactctggtctcaatgtttagatttcctaaaaaaaataattgtaatttcatattagtataaattgtatttatacatagattcttcttgcaatagttagttatattttgaatttcaggtattttaaatagttttgtttttttttacttttggactctaaacgatactaatgcactgtgaccggagtctatttttacttgtatcgttgtatttccgtttccacacactaagtctgtttcttattgatgtttgacacttttacagtttccatgaatccttgtccgattgattgctttactatttcttttcatattttcatgctattaacatatccttctccgcttgccttttttatttttcttattttcttcgattaacgtggtaatttctaggccgtgagaacaaatgtggtggcttctttttctattactttaataagataatagatttgttcttgttgtatttgaacagtttcaggaccggtttgtgctgctcatcagggatctccagctgactgttgcagatttgtgtcctaatccagttaatgagttggaaaaatcatgagatttggcacgcagaaaatattatacagccatcggattcatgagtcatgcagctcctaaatatctttccaaaaacagaacatcatctctacaaaagaagtaaaagtgcatagttaacaactacagaatatcacacccaaccactcacagaattggacagagtatctgcaaaagaaggaaatgctcagaattaacagctcctaaaacacaaattcctaaaactgaacattatctctggaaaagagggggaaatgtgtattttacactgcatagaaaccaaagacattttacactacgtagaaaccaaaaatttgtatttgataatgaacctgaaaactaattactaacttgcaccagatttcaggggtaaaatgccacctaggaaacgaggcatcaaccctccaggctccacggcactgtaatactactgtcttatcttctgataaaaaggctagaaacaaaatagagtaaattacatgttggactatatttttttaccatggtttcactttgggctacccttaatataatgttttcaccttaggccagattttataccaaaacctttcactttgggcgtatggcccatagtcagtctctcagagccaatctctcatccctatctgatcatctccaactgttttcatcgatggctgtagaccacaaagaccacgacgcctaagagagctcgagcatatataacagagctgacgcccgcgcatctcaagctcgtagtccagccagcacggggtcaacctccgccaacacggcgtcacactagctcgacttttgttcccgtcgtgccggccggtctcaggctcaagctcgatgtctggtggcttgatctcgacttccgcccgcactcgcacgccattccctggcttgatttcaatctccgccgatgtcgtccggtggctcgacctcgacttccgcctgttcccgcacacacgcatttcccagtctcgatttcaatctccgctgtcgtcatgccccgtcttgacctcgagctctcccatagtcccatgtcggcgcgccacccccggccttgacctctgccgtgtctctccccgctcgacgttgatgccccgtcttgacctcgaactctcccatagtcccatgccgacgcgccacccccggccttgacctctgccgtgtctccccccgctcgacgtcgacctccaggcaccagcaggcatcagcacccacaagctgtccttgagctcgagctcctatccaccaccccagcttgacctacgtggctccgtcgccccagcgtgccgtcctcaagctcgagctcttctccgccgccgtcggccctcgctagcttgacttcgttcttcacctacgcccgcacgtcgtccccgagctagagctcctctccgccgtcgtcgcacctcgcttgacctcgatattcagtagcactagcacatcgtacttgggctcaagctcctctctgccgtcccggttcaacctcgatctccacggctactccgatgcccgcgcgccatcccggagctcaagctcctctccaccgccgtcgcctccgtgactcgacttctgctgtacctggacgtacacgagctcctctttgctcacgtcgcctaacatcgacctccacacgagtctttccagtcacaagctccccatgttgcccccaaggctttagcgtgatctctgcccacaccgccatgagatggttgggtgaagttggaaagagatcaacggtgtggtaggagatgagtcagcggactcgctggttccttcccaaccgagaagtttccttttttttttcccctcagccacactggcaagtggaccactggtccaaagtgatacattttggtaataaaatctggtgtaaagtgaaagcattcagttaatggtggtccaatgtgaaaccatggttaaaaaacatggaccaatatgcaatttactcaacaaaataatacctacaatatctactcatcctttgaggtagatgagaccatgaagcttccaataacatcgctagggcttaaagcatggggcaccaccaggttctgccctgaatccgagctgatatggcaattcactgtagaaggtgcacaactctgtctcacacccaactccggctttccagcaaagcactgagccattccatcacaacccaaaacattatcaactccacattgtgcttggatcgggcaactacccaatgcaccattgatcctcgatcgcacatccaccagtaacgacctcaaccgtaccacctccacctcaagtgcagcctgcccttgcagcctcttcaccagctgctggttaatgacacggagcctcttcacttcctcttccaagtgtgctgtatgagccttcttcttctgccggtatttgcggacagcctcgcggttgcccaatggcttgcggctcttctttggcttggctttgtcacctccacaactatcatcatctgagctgaagacacgggtgtgagtgtggtagcatgtatgggtgtgctctgttgccgatggaccaggcgggttgcaagtatgagtgtgtgtgcatgttgtcctgatgcttggcaggaagtcatcaaggctggttggaatctctggatttggaaacatcatttggctggaaagctctatctccccgtcatccatattttttcacccaacttagaagatgcagatgactaaatgagtgggcggatatataaattcttacaccaaataggccctgtataaagttcagaaaattcacagaatcagataacagtaccaggttggattgttcagagagtagagaaactaaattcaaaaaaaatgtttcctcaagtaaatgaaataatctaggttaaacattggcataactactggacagagacatggcagtttatgctgcaaatgtatatttgaagctaacctaacaattgcaacctttgacattgccctgttgttcaaaaacctaaatttgtactagaattcttcagaacaaaaggatgtatcaactatcaagcatgacttgaccagatagagcatacataacagttcgtatataaataaagatcagcatcatgaacctaacatgtttcagggaaatcagacacctagcatcattgatgatcatgttaactgtagcacttcgcgtacaatattgggcaggcaaaatatcaatgaatatagaacggtacagcatagccggatagcccaaccctgagtaactatgactctatgagcaacctaaagataattaactaggagttatttcattagaatgaagtaaatggataaatatgatctgtcatttttgtcatgcgcaaaagcatcataaatttagaagttggccaatccggcgcctagaagtccaatacaacatgtacaatcaccatatggccggaaattttgatgcacaaattagaaaaagaatttgcaagttaattgcaaagggaattaaccaatcattctcaggcggagaaagcacgcacctttcacctgctgccaggaccgccggattgcagtgtcgtcgccggcgtccgatgcttcgtggactcgccgtcgaccggaatatggagctgtggcccgcgccgccctgtacgaggttccccggaggaggcgtctagtcgagaagcagcgcaccagagagcccgtggatgcttttagattagaaggctagaatggatggaggggcggcacgtacccgtccgcctctcgagagagtcaacacgacgtgttcagctcgggcagcatcaaccgtgtctccagtcttgagcacacacgtcgctgcgccacccagccaagccacacctcactgtctacctcagattctggcccagaaatctcatagtccatgtggcttacaggggtgaattgacggtactgcaaaagcgaaagataatgtaaaacaggcttacaaagagacctgaaactggcttatactgtaccagtgcaccatcagattcagcactctgcgatacaggtaaaatacgcatgtacagtcttgtttcagaaacgcattcctctaataaatcgacgagtacaaacagtataaattatttctaccagattttctggtaattttctgcaacgacactacatcttctaagtggtagctacagctatgctgatcagatcagtacgggcggcgccggcctttgtggcggctactgctgttgtcgtctcctctctgccgctttgcacctggcctgctactgccggagctgccaccaccaccgccatagcggccgccactgccgccatgacgtcctccactgccgctacgatgtccagcttgctgcggcggcggcgaagccagcggcaactgtccaccaggctgttgtctgcaaagaagcaatgaagatatcatcagcaatggaaatgccaaaatgacatgtaactgaacagaagtcatttcatctcatctcatgctgataggtgataacatgttattagcttttctgaagaaaagatggttggtagcgcttacacaacatatacgagacgaccatccggtaacatcattggaaccattgctgcacctggaggagctcttggagcatacagcataggctgcaaaatgcagagcatacaatggttagaagggcatcaatcatcctttactacatgtatttactcattgattgggcaaaggggtctatgatgatgatgtactcgtgtacctgtgcagtactagcaggagcagcaccataggcacctggtactgacatgataccatatccaagtggaggataactcgggagcaatggagctccatttgaactaggtagtggtactctatcatccttcttatcagcagcaggaggtttcgcaagtgagcaatccaggacctgacctgttaagagaaatatgtgagaccttgaatgcaccagacaaaccagactaagcatagtgggacattttttgggggaatacgcaagcatagtgggacattacagcgcaagaggaaagctcaccatcaagctcatatctctctgtgttctgcagagccctcatggccatggatctgtccttaaagtgaacaaaaccatacctattatcatgacctcctcttgaaggaggaagaacaaccttttcaatttcaccatggtgctcaaacagccttttcagctgtgcttgagtaacattcttgggcagatttttcacatatacagatttaacctgaaaacacacgcaaaataatcaagttcaaataaaacatcatggtataagaattatacacaaacaaagtaaaattgttcatgttatgcttgaacgaacctgagaagtagaggccgagtcgttattcttaggatctgcccagctgactgtaggagcatttgaatctagtttgaatgttggggaagacatctcctgccttgcatactctgcacatgcatggttgtagtattcaacaaaaccataaccccgattgcgatttgcacttgagacctacaagtacaaagaaatttttaggagaaacaagatcgagggtgcataacaaagttgttgaactacccagatccataccttcatgagatcagcttttaatactcctggaccaacttcctccacaacctttctgaaatcatcatctgtccaactatggggtacatttccaataaaaagcttgttcttagcctgcgaggaagaaacccttatccgctttccctgtaacgagaagcataatgaaaaaattcagtaggtataaaagatcaagatagataagttgtcagctataacagggaaccaggagatattctgcacatgtgtgtgatcaaggcagcaaagctatgttttccaaaattattggtaagagaacataagctaccactactcccaatcatgaacaagtgtttcctgttaatggcataatcagtagttttaaccaaatattacacgttacaaaaccatgatattactagagatcatgtatagtagatatgtgtgtgcccctccctctttcttcctacatatccagggaaacagggagcacagctgatgtgtgaaattactgtgctatgtcaaaatcaacagaagtcaactgcagatataagtgcaataagactgaaaaaaaattaaaaaaaaggaaagcttattgcatgataatattcgagtgaaatcactattttgttctctaccagttcacatttggaaactgcaaaaggtgtagtaaaaatgtccagaacttgcttgatcaattaccaatcttaggttaaaaatcaatggcactgatggagtgacagtatagacatttctcaagttcaacagaaaacaaaccttcagttttgcattgttcaattctttgacagcctttaatgccaaaccttttgttctaaaattaacaaaagcatatcccctgctatcgtcctttcctctcatcattctcacctgcataaaacgggagaatatgtaattcagaacaaaacaggccacatggaaacataaaatgaacaatgtaagcagtacttacttccacaacttctccaactggttcacatagtctcttcagatcttcagaagatacatcactggagatgcctccaacatatacttcagaaccatggggaggaagagcaagaagctcagcatgctttcccttttcagtaacatccttctggtgaacacctttagttttacttacaccttcagtttcatcagattcctcttcttcctcctcatcttcctcctcatctacctcctcaacttcctccacgacatcttcatcctcctctacctcctcctcttctatctcctcctcaatttcttcatattcaatttcctcctcttctacctcctcctcctcatcatcatcaaactccaaacattcttctgatttttctggttcaactgaattggcagaagcagcattatctgtcctccttggcatcttgaaaagctcaaagttccaaggcaactttggaaagagcaaaggagccaacaatattgggagagcaaagtgatgatacaaggataggaagaaaaacaaccaaataaacaagagtacttgttatgcaataatgtcaaacaggatgcagccatgggtatccaactggatagaaagaaaatgtatatggaacaaatgaggaaacagtggtatggttacaaaggattacacggggaggttctcaagatacaatccccaatcagcatggacagcaagagcatgcaaaagaggggaagcaaagatgatgcaatgcgaagaataatcaacaagctgatgatgccaatatattccgtgaaatggaagggaaaggaaaagaaaagaaaaaggcacagagataaaagcacgatgagaaatagaatacaatttgcataatatgatatctgaagtaaaaatctaattcctgagtaaataacatgacagcagttgagagtctgactaataacaaagaatggagcaaaatgctaactggaacaattttcaaacagcaagcaatcaacctagcccttgcttaatttttaggatcttaagtaccatatagataattacatgctgactctatttttcgttaagaaagagatatcacctgcactgttcagcacattgcaattttcgcataagttaaaaaacaactattaggacctaaaattaatggactgaatatatgagtaaagtttgttcgtttatatacaagggcctgtacaaacatattagatcgaagaagtagattagtgctctcgtttccaaatagcacaagataggtattgggaaggagaaatattaacgaaatgacgcaatccagcaatcggaaaggataaatttcgacgaactagcgcgaccccaacaattgaaaagaagagatcttgacgagcgccttactgctgctgccgctcccaaatcgcaaggcaaagaacaaccaagaacgtaacaagattggaatcagagatttggttctcaccttggggaggtgtggtctggtcccgagcaaattagggggaataagccacctgcgagccctagtctcgagctggaaggagaggaatacgatgggaatggagatttgcatccagcccctcgattttttcactgattacaaattcatccttgacgaagagtccggctcagcccaatacaggaaatgtccctgaggccttggaccatggcggccatataaaatcttgatgggcctccaatgtgcggcgaaatgcacggcagtgttttgtttctttcaaacttccaaaaattcccgtcacaacaaatatttagacacatgtatgaatcattaaatatagataaaaaaccaattgcacagtttgtatgtaaattacgacacgaatcttttgagcctaattatacaataatttgacaatgtgatgctacagtaaacatttgctaatgacggattaattaggcttaataaattcgtctcgcagtttacaggcggaatctgtaatttgttttgttattattctacgtttaatactttaaatgtgtgtccgtatacttaaaaaaaattggcacacgaacaaaacgcggcctaggttaatcagactcagcgaaatattactcgattaatacaattgaaaggagagagagagtcaatgatgcatatatgattggacaggacttcatgtagggcctcatcttttctcttatacttatacttatcagtcaaaaattaaattttcaaccttaaatttggagctgcttttcgtttatacttatacttatcagccaaattttgaattttcaaccgtaaatttggagctaattttgaggtttttttcatcgaagtttattttttagcctttgcttttagatctttaagaacatatatataaaaagttttattcacaaattactttttatttgcaaatatgtcgtttctcttagttcgcaaataagcgaaatgatggcttcggtattcttgttgctagcttttaatgaacctaaagatagtactacttaccccccccccccctttgatttcaaatttgaaagattttaatcatatcgaaaaaattcctataaaaattcctataaaagcatttgaaacaaggattgaatcatatcattttgtgtaaatttcacaaactacatgtatgttgaccaaactatcacaaaacaacaaatttggcaccaaatttctcacagaactacagatttaatgtgtttaaaaaataaaacaacatatttaatattgaattcatcacaaaagtacatattttagaatttaaatccctaacaccattgttatgttggagcaataagtgttgtaattttgtgactaaaatggttctaaacccatagttttgtgataattttgttactaaatatgtagttttgtgacacttcatcttaaacgtatagttttgtgataaatttagtgttaaatctgctgttttgtgatacactaattaaatttttagtgctttagtcataatatttgtagttttgagaatttttctctcattttctttaaaattttta

SEQ ID NO: 27350 - DNA, 2263 bp, Oryza sativa
gtgatggggttcagcgacatgcccttggaggtgagcagtatctggatgagcacgagccgcgtggcctcggcggcgacggcggcgagctgcagcatgacgccgaacgcgtcgaaccgcgcctcgccgtaggcagccacggcgacgcccgcggagatgccgagcatgttgagcatggaggcacggcggaaggagtcggtgcggaaggcgacggcgagggagtagacggcgacgggcatgagcgccttgagcatctggatgaaggagacggagaggtagatgtacgcggagttggagaaccagagcgacagcgcgtagagcgcgccgatcggcacgacggaggcggcgtagaggctgggcgtcatgggcggtgacgccggcacggcgacgacgcggaggacgcggacgagcaccacggcgagggaggcgcagaacgccatgtggatcatggtgagggagatggggaatggccagttgtacatcttgggatcaaggatgtacttgttgtacacgatcaccgagaagctgagtgtgatccacacgctcacgtacgcataggacagtagcaccgacttgagcaccgacggcgctggcgccggagaagaagacgacgacgacacgacgtccatgccgcggcggccgcaggggccttggcgccatcgtcgccggtgccgcccatttgggcgaggtaggagcggaagctttgatgcggctggcgaggtgtgacgccggcggtggtgggcgcgcgcgcgtagaggaaatgcgtcgagcagttggtgggtaataaagttggcggttgttgcggtgacgtgcgtttctccatcgtcatggacgctttacgtgttatgtgcttcagctaatcagctcacgattagttgctgaactgtactggtaatggtattgctggttgctgcgaagagaagggtcgttgatacacactactcagttgctactttgctcaactggtcaactgcttgtgcgttggatccgaggattaacaatttaagattaatcagaaacagaatcaactgcataacacctcttgtcactcgagtatttgacaagaacgtgtgctaagctggctaacagcatgccagcatcaacctgcacagttgacaaacaaaaggcaattgaatgggaactccgatgatttgagctcactcaacacgcctcttcgatttcattactcatatctcgttcgagaatgcctaccagaaactgtttttttctttttccaaatcgagagaggagagatagatgactatatataggccggagaggatttcacaaaacccaccataagcccataggtttttggtgcgaaacgaaacaaatccgaaaggaataagtttacgttgactcctttaaccagtggccgaatctaattctaaccacaatacggatatcttgaccccaaactattaaaactggtgtaatttaactcccttagtagttttggagggtggttttgctgatgtgacatcaatgtggcaatattgaccgggtcttcgttcacgtggcgttgatgtagcgcttaagtagaattagaattaaaaagggtatgtgtaggaccaatttacacaaaggatgacatgtggggccctctcctccccttcttcctctctctctcccttctctctttatctgactatatatgacagtggggacggcggcggcgtccggtggttggcagcggcggcggaggtggggagaggcgggtggttgccgcttgctaggtgggagcagcgtgttggggccagaggaagggcggcgacagtggcaagcggagacattggcgtggtgggtagcgaagacggaggcatccggtggtgcgcacagatgtcttccttggtgtcaccacccgcctacattgccatgtctaccgcgtccacatcatggtggagccacacccccaccgctcttattctacagctggatcgacgcccgtccttgccgccgccatggcgtgcaggccggccatgtgctcccgatccgccctcgcgccgctgcgccaccgccttttcctcctcggctacgtgtgcaacgcagctccctcagggcgccgttgctccccaccccgccgccgccgctcccaccgccgctccacccaggtgaagagaaaggccccatgggaggggggagggagaaagagagataagagagagaggggggaggagggagaagggaaggagagagaggggatgacatgtgggcccgtataataagtgggtcccacaattatttttgtgtgagtgacaaatgggta

SEQ ID NO: 27351 - DNA, 5061 bp, Oryza sativa
aatgtggaaaatgctagaatgacttatattgtgaaacggaggaagtaacaactaacgacagacaacagtttcttgttcttatgtatgtgagtgttttctcttgtacataagagtttggataataataattgtgccttaatatcatttcaggttaagaaacatattaagcaaggagaaggacatacaggtgggattttctcaattgaagctccacttcatgtttcaaatgttcaagtacttgatccagtcactgggtatgatacttaaccatccatcttgtcatctagatagaatatttttttcttccatttctactgcagtttactggtaaaaggtaaatttatccacacaacgctggcaacaggaaaccatgtaagattggatacaagtatttggaagatggaactaaagtcaggtttgctagaggaatgaatgcatctggtgctgtgatacccaggccagaaattttgaaggagcgaagaaagccaagacctacatcacgtatgtctctgttcattgcatggttcccttgtcaagtgcatatatacttttgtggtgtctatgctgttcttttcctggatcagaaattaagctgtaccagtttgatgttcaactgagatcacaataataataaatactaataaaggaaagcatcaagtgcttataataatctttggtactgtaacatcatgcataattactagtttactacagtagatgtttcttatggtgtttgctgtttggcttgtggtactattgtttgttttgtaattgttctgcattggaacgataatagcagttaactaataatacaaactgaaaaagaaaaatcatgactctgatctatccatgacctttacatacctggagtcaaaatactaaatatgtttgttacatgcctttgtattttggctatctattatcgaatgactaatatgtaattgacatgcaagcaaatgcgttctatttcctgtcaaagtgtcaatatattactcggcatatgatgtatatattttcttttttttttgtgaggaaactaaatttggccattttgtttcattcatgcagctggcccaaaggatacacgaattgaacatgtgctggagaaaacctatgatgccaaggctggaattgggatgcctgatctataggttagtgctgtctgggttgcagagttcattgtatgtgtggcaacaccccagttcagatagcaggaagtctttcttcaactttgcacctgtattgctctcgaaataattttgttatggtcattgaaaaaacattaccccacatgtttttagtctctgctttggttagaatctttatcccactggaaatgcacatacagttggtaaaaaaagttcaaatcatatattctgttctgatgacgcctaagccgcggcaggggcttcttctgccacatcatctctcttcttcttgtcgcacggcggctcggaaacctgcggcgccggctgctgctgcacgaaagcagcggattcctggcgcgccgcggaatccggaggcgcccgcggggacacgtacatccggcagatgacgggctcctcgtcgccggcgacggcttgctgccggcagcagtggtgctcctccatcagccagtcggtgtagctcccgtccttcttgaaacggaagttctgcgtctcgccgaccttgacccccgccttgttcttcacctccttgctgttctgcctcacccaggtgccagcccccgccgttcgctctttcttggtgctactccccttgtgccgcttgcagctagtgaagaagaacctgccgcctttctcgcacctgggcaccggcgcgaactttccggcgaggtcactgggctcgctgccgtaaacatcagcgcggcagatgaatttctcggtgtctttcattggcttgccggcgatcagccgtggcaggtagaaggtgatgagatcctctgcagacgggttgaaacgaaagcctaaactgagcatcttctcgacgtgtttctccatcaaatcgaaatttcgtaagcggatcggagaaacgaaaacacgtatgcattgcgcgggaaacttgtttaactacagagacattgcgatgtagacatgtactacgtgacggtgagatggatacaggatttcgacacaaattcagacatagaagcagacaccgattcaaacttggaatcgattcagtggctatcgacgaagctcttgacggcgtcgacgagctcccgcgcccgcgccgccgcgacggggtgggactccacggcgaaccagttgaggtagaacacgtggccgatcccgcggccgtggctgaccaccgtttccactgccttgcccgcgcgcgccatggcctcgccgtactccacctgcgcgtcgcggagcatgtcctcctccgcgaccatcaccagcatcggcggcagctgggctccctccgccgccgtcaccgccgccgccggagacgtgtacgggtggtccctgctggtggttcccaccggcaacgcgagcatgacgaacttgtccaccgtctcctgcgtcatgaacggcgtgggagggttctccagctccgacgggctcttctccggcaagatgaagcccgggtggaggaggacaccgccggcgaggcgtatcgggtcgagagcctcggccccagcctcgccggcgcgtgccgccacgttgtgcacgaggacgccgcccgcgctgtcgccgatgaggaacacgcgggacaagtcgtcggcgtcgccaaggcgttcgtccgcatggtgcgcgatggtgtcgctggtaccgcacgcgacgtcacggagccagagcagcgcggcgtgtcaggtgtcgatggcggcggggaggcggtgctccggcgcgagcgggaggacgacggagacgatgcccgcgacgtcgagctccacggcgaggcgggcgtagaagcggtggtagagcgaccacgcggcgtgggacaagcagaagccgccgccgtggaaatggacgagaacagggcggcgcccggccggcgtcgtcgtcgtcaggtacaggcggacgtcgacgccatggtccgtggcgacgtcgtggacggtgaccccgtcccgtgggtcgtcgtacggcgggacgaggaccatgaacgcggcggcttccggcgggccgaggcggtcgacggagccgtcggagtagacgcggatccagttggtgacggactcgaccagcgtcctggtcgtcgtggtcgggttagccgcctcttgacgctccttggtcgcggccatttgtggcaatgttgccatggcagcagctggccagatgatcgagtacgtagcagtgaaaatgtgaaatgaactggctatgctgcgtttgtgttttatagacgcagcacggattcacggcgagcatggatgacctggccttgcaaactctgcgcgcatacgtacgtcgtgtggacgcgctggcttgacgccatcgttgattggctcaagtcgtctttaatttgttgtagtatgttaatttgagtctttcacttagtcttggtgagtcgtttcgtctcggtctagctttaataaagctcgatcgacagaaaatggtggccttcttcgcacctaacacttccgataaaatggtgtgtcctatcaaatctctctggaatggaggattactattttgctccaataacttataggttgatatatagtaatgtggttggaatgtccatgtccaaaaccaactacaggcctacaggctgctcaacttattaattaagttaatttgcttcttcgttggagtttcagttcgtatttgctaaagtcagtcaactgcaattccctaaatcccatgcagttgactaacaatagccgttggatagatcaaattgcccttcaaatatcactaacacggagtcctttcccggcaagccgacgacggagcagtgatgaccaagcagcgaaaccacatcgccaatgccgcagtttttcagtgagttagctgtcattcgatcgagggatgttcgggatatggcacggcactagaacggatatcctcatctcaatcgggcggtaagccccatctcaatcgggcatggcgtccgtcacaggctagaagtcactgatgttaagagctatctcaatcgaacaaacggccgttacagatgattctatctcaatcgggccctaagtaaagcccgtcaccgatagctttgacccagacgaccagtcaaactatagcccgtcacagatgacctatctcaatcgggccacaactagtgcccgtcacagatgacccttatctgtgacgggcattaactatggcccgtcacagatgactagcccatcacagatgactagcccatcacagatgagtcatctgtgacgggcattaacttatgctagagttaatgcccgtcacagatgagtatattccaaaaataaataaactttattttttggctagccctcactcgtgtgcacccacgcgggaagttcaaacttcccggtcggtcacccatcccgaaattgctccagactaagcacacttaacgtcaaagttctatggagattggctttcggaaaaatagttgtaacatgttgtatgagtattctattaatcctattatgccctaggccaggatatcaaattagggttattaaatgatttcaaatggaaaagtcaccaaaatcaaagttgtagaactcatcgaggtgcaaaatttttattttggtcatttctccatctgactctatttaaacaattcaaaatttgaaattcaaagtttgaaaagttcaaatagaattttagatcagtgaacgacttcaactgaaaaagtcatcaacaacaaagttgtataactcatcaaaatctataacttttattttggtcatttttttatataacattttttgaaccgtttgaatttgaatttgaaaatatgacaacttcaaacatcatttttaaatactaaatgatatcaactgaaaaagtcatcaacaacaaagttgaataactcatcaagatctaaaacttttattttgttcatttcttcatacgacaaagtgataataacattgttcacaaaattgacatatctcttatctgg

SEQ ID NO: 27352 - DNA, 4664 bp, Oryza sativa
aaattcaaactgttcaaaaaaatgttatattgaaaaatgaccaaactaaaagttgtaaatattcataagttatacaactttgttattgacatttttctatttgaaatcatttactacccgtaaaattattttgactcataaaatgaattattatactgcactaaattattttgctatagtcaacttacaaatataaacatttcatatgaaaaatggaaaaatagtcatcggtaacgggctttagttaatgcccgatagagattaagtatatagcccgtcactgatgagtcatctgtgacgggcctagttgttatctcaaacgggcctcaagttggtgcacgtcacagatgatggtcatttgtgacgggccataacttgagacccgtttgagatatggaatgttatctcaaacggacctaaagttgtggcccatcatagatgatggtcatctgtgacgggccacaactttaagcccgtttgagatatagaatgttatctcaattgggcctaaagttgtggctcgtcactgataggtgtcatccgtgacgggcttaagttttatgcccatctaatatgtctgtgcgaccatatctcaatcggacacttttcggcccgattgagatgacttccttgtgacggcccgctatttctaaacatattagagcccgtcacagatagaaggatctgtactagtgcggtgtgagaggaggagatagtttttcatagagagaactgctcgagcggtttctaaaacttatgcggccatacgggtgtgtcatctaggtctcttaagatgcatttttgatcctaaacttatcttaggtgttatatatatagttccaaataagctttaacttgttccatgcgctgatatggcaatgccacggcagtgcctacgtgttagtcggacctatgtgtcagtcatatagggaaaaaaacatattctatcctctctaccttagatttttttaaatcttttttctatctacttaagaggagaaaatatggtttttaattttattttttatatatgcttgatatgtggattccattaattgacacgtaggtgccaccatagcaatgccatgtcagcgcatggagcgggttagaacttgtttggacctatattacacctatgacaagttcagggacctaataacctaaatgacccacccacacaagtttatgcacttcattctttttttcatactttgatgtgcgatttcccctcgttgattcatgtcatatttgttctttctttttcagattttataggtcaaatgaataatcatgcatgtttatgaaatgatatatatcgcatatgaataatttaattatcttattatatttttttgtaactgtttagatgtcatgtaaaaatgaaaggatatttccttaagagataaaagtatttctctataggagagtcatctagtgtcatattttttgagaggccattagagggcgatgaggtggtggatgcttgtgaggtaggcctgagagacaatacttgtatttatttttagaactagagagacttgttgggttatgattacttcctggctatatattcgaaccttagagtagtatatggatcattcaaaagtgatatatagcgtttgaaaatatcaagcaaccaacaaatactataagatatcttagggtttctttatttccaccccgacgaagtttttttcatgtaaacacacaactagtacgtgtagttcggtgcacactaacatgtaactatacaaagggttatcatataagggtttaaaaaccatcatagtatatgaaaaaaaatgtttttgtgtgtcagtaatatcaatatgttactattggaaccacatacttaatggcttccaaaagaatgataagatatcttttgaaccattaagaacgataagaatggtttctttattagtagaaaaaaaactatattgttaagcaatcatattcttgcggtgaaatatgtgatttaccagtcgaataaaatgtgcatctaatcctagtgtccacgaatattacacacccgactaccccagtgtgttgtcgataggaatttatggggccaaggatatggcattggtctcattctctaatttgaatgtaagttgagggccacacttgtgaatatggtggtatatgtgcagtcttcggtgtaatcgggaaaaacgctgcatgtaattggatgccaatatgctcatgcatactgagtatgctctattttattcacgcaggaaatttaacagggaagtttgaacccaactagaaaacattcaccaaaccgatcaaactaggtgtaacaaacatgcagaaactgaacacaacatacatccatgcacggatggagatggaccagtgcatggctaaaagatagatgcacctgcacatacgaattatctcacaggacatgcatgcatgcaatacatgcatgatcttcattgcaaattgctattagggagaatcagtatctgtcgataaatgtcttgatggtgtcgatgagctcccttgtccgctccgccgtgagggggtcggactccaccgcgaagaagttgaggtagaaaacgtgcgccaccgcgccccggctcaccaccgtctccaccgtcttcccaacgcgcgccatggcctcgccgtactccacctgcggatcatggagcaagtccttctccgccaccatcagcagcatcggcggcatatgcaagcgcgccacggcctccgccgccagcgacggcgaggtgtacgggctgtctttgttcatccccaatggcaccccgagcgccaggagcttgtccaccatctcctccgtcaggaacaagctcggcgggttctccagctccgaccggctcttatcctcccgtgcgaaccccggattgagaagtaccccgccggcgagcctcactgggtggagatcagcccccgcgccgtcatccttcgccgccgcgtgtgccgcgacgaggtgcacgaggttgccgccggagctgtcgccgatgaagaacacgcgcgcgaagtcggcctcgtcacgtaggcgttccaccgccggatcaaggtggtgggcggcgccgttgttgttctcgtcctcgccgcaagcgacgtcccgcagccagagaagcgcggcatggccagcgtcaatggcggcagggaggcggtgctcgggcgcaagggggaggaagacggagacgatgccggcgacgtcgagcttcgtcgtaagagaggcgcgtagaagttgtggtaaagagcccacgatggactggagagacagaaaccaccaccatggaagtgaaggaggagaggacgccgccgtggccggtgcgcggttgccggctcggccgggaggtagaggcgggcgtctacacccctggccgtggtgacgtcgtgcacggtgacgccattgcgcggctcggtgtagggcgggacgatgacggtgaagggctccgcgcccggtggtgtcagccgctcgactgtgccgtcggagtagaggcggagccagccggtgatctcctcgacgacggtcttgctaggatcggtctccggcgccgtggttgtggagggcatttcgctatttcagccgtggactctcttgctatcttggctttctctcgaaagccggatcatatatattgggcttgtttggggaggttatagctgatgcagctccttctagaattagaaactctctcaaacggtctagttttttatttagattttaagaagatatagttgtaaaatttaaaaaataaactagaaaacaaaagttgggaaacacagatttttcatatttttagaagctagctaccaaccagttgcttttcagaactctaaatagaccccatgatctgtttcattgtttttttttttaaaaaaaaagaagacctcaaccgcctatttaaaggtcagcgagctacatcgttggttgttggaacaaggatatgattaatatcggctaacgtgctggagtagtactagtaatacacaaagtccaggaactaattaaataatgggatagaatcaaagaatgaattttctaacggaactaattaaataatgggatataatcaaagaatgatttttctaacatactttactagaaggaaaataagtacgaattacccccgaactattgcagctgtccgaattaccctcgaactatcgcggctgtccgaattacccccctaaccacaaaaccggacattcttcacccccaactatgaataccggacgaattacccccctcgacccaatccgcggtggttttggtctacacgtgacagttcagtcagcattctatttaaaaaaaattgtgagacccacctgtcatacacaactctctcttctctctcacacacactctctctcacttctctctcactctcactcttcctctctctctcacggggtcagcggcggcgggggacacggagcggcagtggccgcggcgcgtgacgtggaggcggcggtggtgggggatgaggagctcggcgccgcttccccctccctctcgtcgtcgtcggcgggggacatggagcggcggcgcgtgacgcagaggcggcggcggcgggggatgaggagctcggcgcggcttcccccctccctctcggtggcgtgcgcgtggggaggatgaagggcgcgagacaagaaggcggcggaggaggcaaggtgaggcg

SEQ ID NO: 27353 - DNA, 5386 bp, Oryza sativa
cctccgcgtcccccgccaccgccgtctcctcgtccggttgtcccacggcgccgcccaccgccgctgaccccgtgagagagagagggagagagaggaagagtgagagagtgtgtgtgtgagagagaagagagagttgtgtatgacaggtgggtcctataatttttttaaaatagaatgttgactggactgccacgtgtactccacgtagaccaaaatcaccgcggattgggtccaggagggtaattcatcatgtattcatagttgagggtgaagaatgttccgttttgcggttcgggggtaattcggacgaccgtgatagttcgagggggtaattcgtactttttcctatatatattattctctttaactacaaaagtacaagtgcacgtgcgttgcatgtttctagctcagctctacagatttaattagagatctcttctaccggtttgaccgataacacaaaagacatgtctatatataacttcttattttctccgtccaaaatagatataatatatagttacatttatcttagaaattttgtatttttcaaagccacttctcttaaattttggagtttacttccgcacgccagctcgccattggcagagataataacgtggtctggtcctatttcgaacaaatcttaaactaacgacactgcactacacgcttgatccgaaagttgaccttaagcacctaattaattcattaattagtcggataaggcctaagaacagtttaataatatagccaacggctggctctaaatcatttatagtcaacttaatagccaatttatatattaggtatttgtaaacatatactacataattaatatctagtctcacctgtcatacacgcatgcatcttggagtccgtactataactgtctataaatctgtatgttttatcttctcgaaatctgtttatagttgatttatagtctgctagtgtatatgctgtaagcatttctagtaaggaaaaagtacaccggaggtccctcaacttatcatcgagttacaaaaatcatcccccaaccacaaaaccagatatatgacatccctcaaattttaaatccattcattttaggtccttcagtggttttgaccctgtttttatacgacgtggtggctgaatcaccatggaacccacgtgggccccacctatcaggatgccacatatcatcctctctctccttcccctcctttcccttcctcctctctctctgtatctcacttttctcctctagcaggctggccggcgggtcgtgaggaggtcgccgggacgaggagggagaggagaaggaccgacggctagcaacaggcgacgcgggaggaggccggttagggaggaggtcggttagggcgacgacggaggagcgggggcggtaggatcatagggccgacgggcggtggccgcgtggagaaagaggcctccccacctcctccctccccgtgcgcgctcgccgctggactccccactcccctcagcggccgtcccgctcgtggctgggagggcaaggtggaggaggtcaccgtcggtccaaagggaggagacggaatcggcatacctcaacctgggcgtcgccgccacctccaactctacctcctggatcgtcgagacgaagatgtggccgtgcaaatttggtagcttagcgacgtctgccggtctccaccgtgggaggaggcaggaggaggacccaacgccaacgagcgcagtggtgggagatggcggggcggtggccgtcatcgggcgacgacgcctgggcgatcatggttcttgatgacgaggtcagcaagggaggtcgggaagccagtctgcacgggggagggccggcgtgggaaggtggatggagggaggaaggtgaggaggcgaacgagaggatgcggcggaggagggagcggaggaaatcggaggcgaaggcctcggcgaggagggaggaatggacggcgtcattgtggcggtaggaggagccgtcgtctccccttcttgcgcatcggccatcgccggccgcagccgccctagcatcggccgccaccggccaccctccctctcgtcttctccggcggtaggaggagccatcgtcttgccttttcccgcgtcggccatcgccggccaccgctggccgccctccctctctcccaccttgtgcccgtgggccggcctacccaaagaagaatgagagagagagagagagagagtaaccgagtaagggagaagagaggatcaggagagatgggaaaaagagtgagtgatgacatggacacactgacatgtggggcccacgccgacttagccatcacgtagaacaaaactagagccaaaaccaccgaagaacctattgggactagttttgattagttaagggacgccggatatctggttttgcatttgggggacgattttgtaactcgatgacaagttgaggaccttcggtgtactttttccaaaatatcatgtcttggccaggcccatgcacaggcccatgaatcggtcgagccaaccttgtgataatgtgcagggttgcgtgatgataactccacatgaccacatgcgttgcagctaggacgagcgagacttaacgggaaactattttgatttgtcgagagaatatttcctcattttcttaaaaatcatgttatgaaaaattctaaaaaaatttgatgctactcatacaacatatctatacaactccacaaaatctcaggtttgaattcatctcacacgtcgagatataaaaaaacaaattcagcttatgaatagtagcatactattcacatatgcatttttttccttgagatgtacattgaatttgaatttgatttttgatgtatcgatagatatcatcgtacaactatttgtatcaaatttagaagaaaaatatacataagggatatcctcaagtgattagaatccactctcgagttaacgggcacacataataagatgcacgtattgtattgtccgttgcctgatgaaaacgaccccacgctagctttgcttgttccgcagacatcgtcctgatgatctgtgctatgaaaaatataatactccatctatcactaatcacttaccctaatccatttcccaaagcttccagtgtcagaaaagctatatcctagtatatggactctggagtagtactatgcgagtattgaaatgtatggagtacatcaatcacgcattcacgcttcgaatgaagcaaagaaaattcgagagagcaaaaattgtctacagagcacagtaacatatgtgacatgtgaacctgtgtggctgtgtcatcgagcgtgcgcagcgaggggcacggcctccgcgagcggcgtggccatcggcgacggcagcggcgagtcgcggcacaccgggcaggtggcgctcacccgcagccaccgctccacgcactccgcgtggaaccggtgcccgcacccgggccctcgccggagcgcgtcgccggccacgaactccccgaggcagatggcgcactgcgcccccgcgcacgcgttgtcgtcgtcaccgacgccgacgtgtaggaacttggggtagagcgcgtcgatggcagggccgtcgaggcctagcaccacgacggcggacgctgccggggcgccgccgtcgtcgtcgtcgtcggcgaggagcacggcagctgcgccggccttggcgcggacgcagatgtaggaggcgagcatgacggtggagatgaagacgaggacgccgacggcgatggcgatgccgtagccgaggcacacggcgccgccgacgtccgctgcggcgggcgcgaaggaggcggcgtcgggcgaagatgcgggcgcgaaggagatgggcgcgtgcattcgtagcagcagtcgcgcgtgcatttcagtgtgagcaaataaaatggaagagatggagacagcagctgcagggaagtggggcttgcggctggacagtggcacgaacgagctgcgatgcgagcggcgtatgagtcggaatggcgtgacaaaatttaaggcggagttggtagaagctgatccgaatcgattctgaatttggatggcgagagtgcgtacgtgcagtggcagtgagagtgaagtactgaaggtgaaccaggaattactcggatcacacagccacatagattactaaattacagggcttatagggttacagcaacagttgatatattcttgcgcaaatgctcaccgtgcaatcacgtggctcgcgttcatcgtgatttatgaagcaggaagaggaccacattgcaaattgcaagcttgaacaatgtaaatggagtacaatcgtaaatgaatgtaagcacaagtaatcactcgaggcgggacgacagtcgagacagtaggttgttggcatcacaggaagccacagagaagtagacaaccaactcgaatcagttcttctatgggaccatgaatctgaccacaagccccacggccctccgcgtgctgttttctgcctaaaaaatgctccaggaaacggatcataaatcgctatcagtcgaataatcactcgtataatatttgcgtcccataatttgcagaaaatgaataagaactgtactccagtttgaatccaagttatgtgccaatgctaaataacaactggagaaaaaaattgtaatagcatccgatcaagttgctgttcaacaaacaatcccacgatggcgccatgttacttgacattagcatcaatctatcctatccacccaccaaatagcgcgaatctcactgaactgcggggaccacatctaccaacattctcagcactcgacgccggcgcacgcggcgcggcggaaccctggcggcaggtccggcgcgcggctccacttgccgccggcgatgtcgtacaccagcaccatcccttccaacgcgccgccgccggcattgtgacccctcacggccgcagcgctcaccacggccgccaccctgttggttcctaggccggccatcgccacgcgcaccgccatgccgagccccaccgaccccctcggcatcggcggcgcctcaagcgccacccacccgccccagcctctgccgtcaccggcacggccggtggcgccgcaccacctccagaaggagagctccaccgcgtggctcgccaccatgtacaggtggtcaccgacgccgcacgcccccacgacgcagccgccgccggggagcgcacgggggcgcgcccaggcgccggacgcgacgtgcagcgcgtccaccgacccggcgcacacgtgcgccttgagcgcccgcgcgccctcgccggacaccgcgacgcccccggcgacgtagaacacgcctcccgcgctcgcgccggcgcacccgtacctccgccgcggcgcctcgccgaccacgcgccacgcgtcagcctccgggtcgtactcctcgaccaccgcggtgcgcgcggaccc

SEQ ID NO: 27354 - DNA, 6599 bp, Oryza sativa
cgcgggcgaggcactcgaggaggaggtcgtcggggagggcggagattgggggtgccggcggcgacgagggaggcggcggttgcggggtggggcaaagaacggggacagcgatgtggcgggcggggtcggcggggatgcaggacttgacgagccacgagaggctgcgggagtggcagctctcggcggcgggcatggcggattgccggattgggagctcagctgctgctcggggagcgaggtgggttgtgattggacgtggggaatcgtgggaggtggagtggagtggaggggaagtcgttgggcggctgggctcgtgcccccaccttgtgcggggcgcagcaacggcgacggtggtggagccgttgcttttctttgaaattcgaaggtttgggtttaaaatttgagcgttttgaattggttaggtcagctttggcctgtaggaataacagtgtacttcactttacatcatctgatctattatatactaaaagtctattaaactttctacaaacgtcctcaaacggccacgtggactcctacaaacattcctagaccaccacgtggcactttctaataatttatagaaaaacaaagcatctcaccattaattttcatttaaattggtggatccattagtatacaccattagattagatctattggataaaattaatcccttccaccaaatctcgcgtgtatacaaacaaaatacgtaactatttcactgggaaattttaactacgtatttacgtacgataaaaaataattaaagctggcgaactgttcaccagccaaaaaacccaagaaaccatacgtagtacgtacgagtagaaaaagttaaagcccaaataaaacatgtatacgtgcgttagtgccatcgggaaaaaaggacggtctatataattttctataatataaaaataaaacatattacttctaaacatacacccatgtttaaaattattttttaaatcagatattcaatttgtgatcatattgtattcctctaattaaatgaactaccgtggacttatagtaatgatattataatgttaaatacatcacgacacataagaccgacataaaataattaatttcatgatatttttttagataatatcacaacatattttagagaaaattttctatgtgtccctaaagttttacccaattccttctttgctcccaagttttctatcgcatggaaaaattctttctttactacaaggtaatgtgaaaaatactataaaaaatattttgagtcaatgatctttccataacacaagcaccttaatccataacaaggattatgatggtatatgtatgattttttttatgcataatagttttagctataaatgaacagtccaataacatgcacattaaactactcatgatatattttattattgttgatgaattctaatatgtcgggcataatttctagatgtatgccatatcccccgctaacttgactataagtgcacttgaacaaattaattatgtaaataagtttgagaaaataaatatattcttggaattagtaaaagtttttcatataattacgaacaacatgtgttaaaagcaaattttgccaaaaaaaagatctaggtcaaaatataaataataatgataggatgctctatagattatcatcgtgatatgtctctttatatataattttttaagcacagtcgaatgatcaatcatgcttatcttcaaaacataatattgtatctataaaaaatattaaatagtactgattaacactataaacaaatcatgtctactttataccacaaatctactcaaaacgtaaataaaactatttctgtgagaaaaactatttttatcatctccatcatctctcttgtccttagttgaaggacatcaaacatggatgagaaaactttctacgttgttgtaagcgttagcaaaggcttacatttggttgagttgaggtggccctattggaggctactgttggtaatagtgctcaactttctacttaccattgtaatcctctatgagcatgccgatagtgatttaggcgttaaattgccctcaacgccaggtttaagtgacatggctacatggatgtgtgagaaagaaagcttggcggctacggcaagcttcatccgttagaggggttttacgtcaaattttaacggtgttattccattaaccagtagaagtggtattcttacaataaatatacatggatttggaaataagtgagacctgaacactcagattaatggtaaaccttttagtatattaataatgtattaggcttaattttggtgataggacatatgcaatttcatccattaaataggcccaggttttaaaacaatgataataaatagtcgtgataatatgggaatttatacataaccgggtgaacgtcatttttattagaatctgggagaaattattatcatctaacatatctagggtctatttgacaacgtagatacttttttattataaggtaataacgaaatcttataataaatatgtttttttagcgttgtgttcatgaaatagtaaataagacacccgcgcatttgtgcgggcttcctttctagtttcatttaaaaatagttttgaattggttagactagattatctgatcataatttagttgcccattctgaaatgtttggcttgaccaacacgtgaagaggaatacacaagactttacaggcagatcaacctgaccacgtacagtacaaacgattcaccgtctagcgcacatagtagcttccaaagttccaatgtgtgccattcagcgatcagcactccatcgttttttcatgccctaaagttgaacatgcaaatacacaagacaagttagtgctttatggtttatggaaagggaagggacatagagcgcaccagtaaacggtaaagtgcattgtcctgagctggtggttaatggccatcatcaaagttgatggatgcaaatcaccaaagtcagaccagattggcagtcaattgtgccaaggaaaaaaggacaacgattatggttaacacgagtgcaaagaatagaagaatgtaagaccaagtggcatcagaaagcatcacatgattcgttcaaaaaaagaaagcatcacgtgtgtggtttccgggaagctgcaaatcacctgcaaactcaactagctgcagcctccttcagatacatatattctcctctctgtagtccgtagcagcctggcagattgcagatgccagtaccaaccacaatgactcaatgagcgagcggacgattcctcctcctgtgtcgtcgcatggcgaggacttcgccgaggttgtggtggtgcgccatggggagacatcggcgaacgccttgtgcatcattcaggtcggcggtcttgtcttccctttgttcctgtcaccaataacttgtccttttcaatttttcttgagaattatacttggttgatggccttcttcagtcaatagctcttcagtcccctcgtcgtcattccatcaattttctcgagttgacagatcatcagaacaattttaacagggacaaatggatatagagttgaatgaggctggcagacagcaagctgttatggtgagctttaccaatacatttcaaataatgaaacaggattgtaatttggggttttgtctgaacttggaattctattatcgaaaaacctgaacttggaattggtgctaacgtctaaggttgctcgtcggttggctaaagaagctaagccagttgccgtgtactcctctgatctgaagcgtgctgccgaaacggctcaaactatagctacagcttgcaatgtgtccaacgtaagtacatgcattatatgctgaagcttccattttccagtggtaaacttgctatgtttctcatttgatttgctttcagctggtgttgagtcctgcactgagagaaaggcacatgggagatctccatggtttgaagtttgatgatgccgtcagaagcaagcctgacgcttacaaggctttctcatctgaagacagaagccaagaaatccctgtaactttcatccttaattttctcaccaacttcttaggcttgataatgattggcctaacattagtagatgtgtttcgaacaattttctgttttgacagggtggcggggagagccttgaccaactatctgagcggtgtgtttcgtacttgaacacaatagctgggaagcacaagggtaggcagtattgtaatattctcactctgaagtttttgtatggttgacagaatagtgaaatttgcttgttgagttagctatttcaaatctggtaagcatgctattagtaaagtgaaagctagcggtgcaaagaaaattcagaatgcacctgcacattcttatgccgagtcattcaagcagttgctcataatacacagaaaatgaagttattatgtatgctgcattggcaggggagcgagtgattgtggtctcccatggagcgagcatcgaggaactctgcagacacgccgatccaaccagctcagttcgcaggagaatcccaaacacttcgatctgcgtcttcaacatttctggctccaccggccattggattctcgagaggtttggagatgtcgcccatctcaacgaagacgacttcccgtagaatgcatttggtggcgatgaggcctctacgtagtgcctccaaccaaccaaccaaccggcttcttgggccatttcatgaatccgggcatgaactgttatctgtttgtctctcttttctctcaatttgacaattgtagaactttcgtgctaactgagtcacatcgcataactcacgaattcacaaattgtaattgcttgattgaaactagctactggacttttcatatttagtactagttaaatagtcacacattcgtgtgactataacctcctgctctgctagatgataatcaaccaaacttttggtttccaaagtatgacaatagaaacacggtcccttgtatatgattattcgatttgctggtggctttgatctggggattagtcaagcacctcagttagtggaaaaaaaataatcacgttcagaatccaacccaggcaaggaccgaagcattaactccgattgtggaatcattcataaaactaaaagtccttgaaaaaatttcaagcttaattagaacagaacatgggatatttatttaccagagaagtaagaaaaagaaaattgataggggctgaagtaaaaaacagcaggaatgcagacatgagaaagaatactgataagggccgaagtaccaaatgcttttattgctaatttggatgtcttaataccctgaatatgtgatgtcacatccgcatatcggcatgagtttcaaaaaacattctcctgcatgtgtgcgcctaaacagaattagctgcttaatgagctggggttcaccacccaggataaccttcactaagctccgccactagacggagttagtacgaaatgaaggggcagagttagtacaaaataaaagggtatcactcctttattttactttaatttggatcgagttaaggctgatgtaagtatttaagtttggacagagggtgcaaataggatggaaatatatgaagtatagattaaaaatattttgaaccgggttgttaggcaccccctcagctccactctacgaccaagcaaccgtctggtctactattcttgatccatttcgtgatttcagacatgatcaaaccatccgattatctttctcttttgcagtacaaatacaaatttgtcggtacggcagcacagtactactgtgtactagcagaaaatgaaatcaatagagttgctataaaacattgaccaaggtctctcccgctccccgctctatagatacatgtccatatcgtccgaagcttcctactcaaacatttctcaattaacctccattggattaaataattgatcttcgagttggtcttctgaagtctgcaacgcaagtccctatcttgggcaacaagaacaaacaatttggcatacatgtgccaatccatggccttacacactctttagtacagttcacaatattttagcattcatctcagagtaggactttcaattaaacagctcaacatctctgaactctgaagcgtagataggcagatagctcaacatataaaagcagtagcaaatgcatgtccatatatgtcaaccaacagcgaaagtagcaattaattcagtcagttgaaatggagttctacgcctattccatgctcctcatcctgcctctgatactgtacatgtcctaccacctcacaagaaccctagccgagaagaagcccaccacccatggcctcaaggcacacccgctgctcggccacctaccggccttcgtcaagaacagccaccgcttccttgattggtcgacggagctcatcgccggcagcccggagatgaggattggattgtggatccccgggatgcggagcggcatcgtcaccggcaacccggccgacgtcgagcacattctgcgcaccaacttcgcaaactattccaagggccagcacgccattggcacgctcgaggatttcctccgccatggcctcttcaactccgacggcgagcaatggctcttgcagcgcaaga

SEQ ID NO: 27355 - DNA, 11316 bp, Oryza sativa
gctgttgtcatcccggccggatgtcgtggagcggatcacagacaaggtccgcgatttgagaaaggcgaccggcacgcgccccggcgagccattcgggttcgacgcgctccgggagatgcactacctccacgccgcgctcacggagtcgatgcggctgtacccgccggtgccgaccgacccgcagtcgtgcgcggcggacgacacactccccgacggcacgttcgtccgcgccggatggttcgtgaactacagcgcgtacgccatggggaggctcgccgccatatggggcgaggactgcatggagtacaggccggagcgatggctcggtgacgacggcgcgttccagccggcgagcccgttccggttcacggtgttccacgcggggccgaggatgtgcctcgggaaggagatggcgtacgtgcagatgaagtccatagttgctaacgtgatcgaggagttggtggtcgacgtcgtcaaggaggtcgccggcgggggcgttccggagcatgtgttctctatatcgctgaggatgaagggtggcttacctgtgaagataaggagaaagggtgaatctttttaggggatggtttggtgattcttgcaactgaattaacaggagaactatatatcttagcgctgtgtttcttacttgaacacctgttgttgaaagatgaacgcttgtgccggtggtttcgaaaaaacttctatcggtagcgtgttaccacttactccctctctcattttaaatgtagttctgattttttttttcaatctttgaccgcacgtcttatttaaaaatttatatatttttttaaaataagtcacacataaaatattatttatattttatcatctaataagaaaaatttaaatgattgacggtcaatattagacataaaaactcacaactgtatttaaaatggaacggaacgagtaccactttccttatacggttgtgttcagcagtggattttaccgggtttgtgcacgaggaaaacgtggtctcttgcttttcactcatcagattttgtttattcgtactgcgtcgccatccttggatagtggttacaaatactgaaatgacccaatagctgatgttacgtgtggtccggcaggacatatgcgaggcactgttcgtccaagcattcaggccgcagcacctggtccccggtggctgaggctagcagccaccctccgccccatctcgccggcgacggcggctgtcaggtatcctctgttccctctcgcctgcggccatcaggtgtcagctgtcaccatggcgaaggaggtcgatcggttcgtggagctggtggttgtccggcacggcgagacgtcgtggaactcctcccgcatcgttcaggtcggtagccaacaccaagcatctgttgctttatccttctgacgattcgttgtgttggaaaaatgaaaatacatactcctgatagaacactgaacttctgcaataggggcaaatggatccagagctgaacgagattggaaaacagcaggctgttgtggtacgatacacactagctcaaaatttcgaagcagaaccaccaatatgtggatttatggtattaccagcattggtagtttaatttgatattttctgtctgaatgaatcgatctgatgcgaacttacaaggtggctcgtcgtcttgcaagaaaagctaggccagctgctatatactcgtctgatttgaagcgtgctgctgagactgtaaaaatcatagcaaaagtctgtgatgtatcaaacgtgagttcttctagcctaccttttcctgctttctcctccatgagtaacaccaataatttgttccagttagtgttgattgaagcactaagagaaaggcacatgggatatctgcaaggtttgacgtgggatgatgctatgaataaaagcccaggcgttttcaaaggctttgctaattttgaagtcaaaaatggtttggactttgatggcagaaaccacgaatttccggtaagttccaaaccgtattttttctttggaacacttataacccgagaaatgtaactttgtctaggtctgttaaatcagaagtggagtgagtgtataccattttgtagcactagtactatataacttttgaaaagtttatcattgtttcaaatgatgtttaggatggtggagaaagtcttaatcagttaagtgagcagggcatctcctacctgaacaaagttgctcagaatcatatcggtaagtatcaaactatcataaaaaaaaatcgaacttttactgcatttcatttgtgtatgccattgtacaccttatcctgacaagctgctatcctggaaccttaaagatgttttgctaatgttgcattgacaggggagcgggtgattgttgtcggccatggtgctgccatactagaactctgccggcacactgatccacccaacagctcgattcgtaggaaaattcccaatacttcactgaacattttccgcatttccggcgtcaccggccggtggatccttgagaggtgtggagacgtcggccatctcagtgaaaatggctttctggagaacgcatttggcggtgatggagcctctgcctaacacattcagcgactcatcttgtcagtgtattcagtgattcaatcacccatgacttgaagtctgaaacatttttcgtttttctgattgctattttcttcggtgtgataatcatgatgaattgatcataaactactcgttgtttcgtcgtgttagctgtatatcaatctgcaaaacaatcgcaaaaaggggggaaagatgcaaatctgaagggaaaaaaaaggctaattcggatgtcctcccttagactgaggaccggctctctgccgttggatgatcttctcggtactgtagcattgcaattgaacggttaagattgcgtttagatcgtcaggtcaggagcgtctctgctgttttaaggccggcccatcggttgctgcttctcgcctccgcgtttcctcaccccgccgccgcagccgcagccgccgccgccgccgtcgccgtcgccgtcgccgtcgccgtcgccgtcgccgccgccgcagccgcagccgccgtcgccgtcgccgtcgccatcgccgccgccgcgtcgtctgcgtttcatgttcaggctcctgccccgcatcaccccgctcccgcgccgccgcctccgtcgcagccacaacccaaacccactaatctcccccgccgtcgctgcttccctcgccggcgtcctcgccacccgctccacgaaccccacctgggcacggtccctcgcggcgctgctcccctccccgctctccgacgcccacctcgccgccgccgtctcctccctgcccgaccccgacctcgccgtcgctctcctctcctggtcacagtcccccgaccaccatgtcgccctccaggaccctactcctctcgcccattccaggatgttccgcctcgtcgcctgctcccgccgtttagacgccgtggacgacacgctccagtatatgtctttggagggcgccgtgcccacgcgcgcttgcctaggcgcgctagtagccgcatacgctgacgcaggcatgcttggaaaggccaccaagatgtgcgagcgcgtaagggagcagtacggctcgctccgggaggtgacccattgcatccgcctgatcaagttcgtagtgagagcagcggcgctggcgttcacgcccgtaagcttgtatgatgaaatgcttggcaaggatagtggtgcggataactacagtacttgtgtgcttgtccggggactgtgccggaaaggcgagtgcaagaggggttgacattgattaaagcaaggtggggagttgggtgcattccacatgtagtgttctataacgtcttgatcgatgggtattgccggcgtggagatatgggtacaggattgttgctgttggaggaaatggagacaaatgtattcttgccaacccttgtgacatatggttctcttataaattggcttggaaagaagggtgatctagagaagattgggagtttatttttggagatgaggaaaaggggattttcccccatgtccagatttataacagtgtcatagatgctttgtgcaattgccggtctgcaacacaggctatggtgatcttgaagcagatgtttgcaagtggatgtgacccagatatcatcacatttaatactttgataactgggctgtgccacgaagggcatgttcgaaaggctgagcattttttgagggaggccatcaggagggagttgaacccaaatcagcttagctacactccattgattcatgggttctgcatgagaggggagttgatggttgcatcagatttgcttgtggaaatgatgggcagagggcatactcctgatgttgtcacatttggagcactaattcatggtcttgtagttgctggcaaagtcagtgaggctttgattgttcgtgagaagatgacagaaagacaggtattcccggatgttaacatatacaatgtattgattagtggtttgtgcaagaaacgcatgcttcctgcagctaagaacattcttgaagagatgcttgagaaaaatgtccaacctgatgagtttgtttacgccacattaattgatggattcattaggagtgagaatcttggtgatgcaaggaaaatattcgaattcatggaacacaagggtgtctgccctgacattgttagctgcaatgccatgataaaaggttattgtcagtttggaatgatgagcgaggcaattctatgcatgagcaacatgagaaaggttgggtgcatcccggacgagtttacatatactacagttattagtggctatgctaaacaaggtaaccttaatggagctctaaggtggttatgtgatatgatcaagcggaaatgcaagccaaatgttgttacatactcttcattaataaatggatactgtaagacaggtgatacagactctgcagaaggcttgtttgcaaatatgcaggctgaagctctatctcctaatgtggtaacttataccatcctaattggtagtctgtttaaaaaagacaaagtactcagagctggtttgtactttgaaaccatgttgcttaaccattgttctcctaatgatgttaccttacattatctagtcaatgggctcactagttgtactccttgtgtcatcaactctatctgctgtaacactagtgaggtgcatggcaaggatgcccttttagtcgtattcaagaaattggtttttgacataggggatccaaggaattcagcatacaatgccatcatcttcagcctgtgtagacataatatgctcagggaagcattggattttaaaaataggatggctaaaaagggctatgtgccgaatcctatcaccttcctttcacttctttatggcttttgttctgttggaaaatcagtgaattggaggaccatccttcctaatgaatttcagcaagaggagttcgagataatatttagatacaagtttttgtttgaccaatatgcaactgagtcagtttgctgtgaagtctccagggttttacagcatcttgcagggtgtaaatccttgcagcgtgtggagcagaaatttgctaattcttgatgcccgtctacctggctcttgtaaatgagggagatcatttattcttttgtttggccagaaaaatcaccagccaaattcattatgaaagaaaggagagtgtagggtacaaagttactgcaacaaggttgttgttacggcttatttgatttttttacttcagcaactggaggttgaaagatcaggaacgttcatagtaccatctaactggaggagtggtattaatatgaccaaatctcccgcagagatctccacccaaaggtattaatcttgctatgactggtcatatgtgattttagattatgcttgaatctttgatggttgaagactcaaaagtttttctgacaactcaactacaggaaaattgaacattagaacttctaaaattccatgtgctagttccccttctttaaattgtttactcaactagacttgctagaggaaacaaaaaaaacatactactggtgtcctgtttctgtaaacatagttatcttctcattcacaattcattggcatcattcgtttggaattacatgtgaaaggaaaatgttgcattagtttcttgtccatgttgatgctgtgtctgaattaatatttgctgttgttctcaaggtcgttagtaactaaattatagtatgtttttatgttgcagtaatcattaacctgtaactgaagtcatcagtcgacattgattttttttttcattttactctgttcaattcttcagtaacatatcaataaatgtaagacttatgaaacttcgaattcgtactggtatagagctttcgtgcttgcactttagttgcctgtcaagcagaagcaatgcttatgagattcttactgaaaaataaataacttcttgctgcttttcaggtgaatttatttaaccctatgacttttccatggttagtgtctccaatggccactcaactacagttgatgctattgtgacactgcaagcaagattatttggcaggatgcgcaggtgtaaatcagactgcaatgtcgcttaagcgcaggaccgtcgtagcaactgcagctagatcatactccctccatcccataaaaaaccaacctaatacttgatgttgacacatcatagtattacgaatctagacatatcgctatccagatacgtagtattaggatgtgtcaacgtccagtactagattggttttttatgggtacgcgatttagaattttgttgtccttctatcattcggtataggcgacggttgcagacttgcagatcacaacaccctccgtcagaccatcactcagtaagtatgcaggtagtttcttttagctttaggtgtaggagtgcaggacattgtatagcttacacgtaattttacatgtacaaacactcgttggtatcatgacaaatctggaaatcttgccgtcttgctcatctagaacaatgccattacaaagttttttttatggccatgaccgacattttgggtgctgcatcatcactatccactataggagtcccatgtctcagtattttgtgtattttctgcacaaatctgctcaaatgtgtcattagttttctgcacaaatctgctcaaatgtatcattagttttccgcagaaatctgctcaaatttatcattagttcatcagtaatgtacttacagtattcatttggcagtaagaacaacacctgaaagttggtcaaatagttgcttaaacaggtctatttgtgtcttacatggctgatttcaacttgttaaatttgtacaatacagtgatacgccatccttttattgattaattggcatcaattcaacccagggcaaatcatttttctgccgctgtagtccagtaggaaatggaaaacggccaaaaacaaccaaatcacaaacgttattcttaacccataagctcaaaacgaaaagagcaaaacttgaagcttaactaattatagtaccattcagcggcaaagtacccttgtggccttctctagtaagcttcagtctttctcctaatcttcacaggtagtccacccttcatcctcagcgtcaccgagagcacgtgctccggcacgccgccgccggcgatctccttgacgacgtcgacctcgaactcctcaagcacgtttgcaactatggacttcatctgcacgtacgccatctccttcccgaggcacatcctcggccccgcatggaacaccgtgaaccggaacgggctcgccggctggaacgcgccgtcgtcgccgagccaccgctccggcctgtactccaagcagtcctcgccccagatggcggcgagacgccccatggcgtacgcgctgtacgtcaccgaccagccggcgcggaggagcgtgccgtcggggagcgtgtcgtccgccgcgcacgactgcgagtcgatcggcgccggcgggtacagccgcattgactcggtgagcgcggcgtgaaggtagtgcatctcccggagcgcgtcgaacccgaacggctcgccggggcgcgtgccggtcgcctccctcaccgcacggacctcgtcggcgatgcgcgccacgacgtcgggccgggacgacaagaaccagaagaaccagctcagccccgacgctgtcgtctcgcggccggcgatgaggaagctgaggacgatgtcgcggaggacctcgtcgctgtgctcgtcgctcgccacgaacctcgacaagacgtcgtctctgtcttgcacggacgcgctctggcgccgtgtgcggacaatgtccatggcgaaggcatggacgtcggcgatggccttcctcaggcggtgctcggtgccgacgttgagccacttcttgatcttccaggagacctcgatgggatcaaagaagcggccgacgacgaggtcctgcgcctcgccgaaggtgtgcatgtactccgacctggcatcctccatgacactgccgtcggcgaggcagcgcgggtcgtgcccgaacgccaccatacagatggtatcaaacccgaatcgctggagcacttcctgcaagtcgaggacgacgatatcaccaccacgaccatcaccggcggcgcggcggagcagcgggaggaagcggtcggcgacctcggcctgcacgacgtcgacgacgaacctgcgcagggagcgcttgctgaactcgtagctggcgttcttgcgctgccagagccactgctcgccgtcggagttgaagaggccatgtccgaggaagtcctcgagcatgccaatggcgtgctcccccttgggatagttggcgaagttggtgcgcaggatgtgctcgacgtcggccgggttgccggtgatgatgccggtgcgcatcccggggatccagaagcccatcctcatctccgggctgccgacgatgagctccgtcgtccagtcgaggaagcggtggctgttgttgacgaacgccgggaggtggccgagcagcgggtgcgccttgaggccatgggtggtgggcttcttcttgtcggcgaggattcttgtgaggtggtaggagacgtagagtatcggagggaggaagaagagcatggaacagtagtaagagtccattgccattgatcgacttggtagcaagctggttgatggaagaggagtgttcacctggcattatatactgggacactggatctccaaagcaatttataattgcaatgtcaagtcgattaaacttctatcaatccactaattaattactttgaagatcaatgcaattcttaaattatacgtatattgtgaagaaccgtgtgcctgaccatgatagggataggcacatgagtggcaagttgtttcggcttgttagccaagacagggccttgcgttgcaggcaatactagttaaatccagtggaggataagaaatgttttaattaggaaccttctgatgatgaactgccctgctatacatcgatgagaacatgattctacttctatatcgatggcaatatgcttacaagttacaaacggatctgttggtgaaccgaaacataaatagcatcatcagcagctttgaacctgctgctgcttgggcagcgcgtagcggcagagaggacagaggcagctttcgctgagccaacggaagaggcagatctcgtggaaggagtggttacacggcatcgtcctcagcatgtctttctcctcgaagtccctgaggcacacggcgcactcctcctgcctcgcgtcgcacgccttcgtcagcgcgaggcccaggaggacatctcgcgacatcttgcatcggggcatccccgtcggcggcgcggcgacgtcgtcctagcatgggcgaaggacgaggcctgatcactcggccagcccagtacacctctccctggtacacccctcgacggaactcttgtagcatgtcgcggatgctccgggcatcgctgttggggtcgattcctaggcgttggagcgtgcggtggaatctcatcggaactcgcgctgccgccgctgccggatccatccatctcccggcgctacggactacagtgtggatactagggtcgacccccaattctcggagtaggtcttcgaatttttctgccgcgtatggatcagaaagtggcgccgccaactgcgccgccgcccgagaatccatcaatctgcgagccggcggatccatcgcctgcagcagtcagaccagcttttgcgttgttgcaacaactggatgagtaccagattttattatagtggacgatgtgaggcacaacgagattgattaggactcggaatcgatcggagtcggagtaatccattcccgcgcgcagcacagcgcggcgcgtgccacgcaatctcgaccactgtctacgtatacctgcttcatctgaacgtatatacgtccggttcctagtactcgtagtaggtatttttgtctcccgtacaactgagacccctcgcacgtatgcacggttgaatttctggcagctcaacaaatcaagcattgcatgcctcaacagattggcacgcgtacgcacacttcaaatgttaatagcaacacagctgagctagtgacatactgacatatatatacgcaagtggcggctgccgtgctatatatacatgaaccactgccaccatctatccatcacacaaaagcatcatctatctatctaaccagagtgataaaatggaggtgcaggtgaagaggagttcggtcgtgccgccgccgccgcgcgagacggaggagacgccgctcaccgtgttcgaactcgtcgcgccgacgtaccacgtcaccgtcctcttcgccttctcgccgcccaacccgaccacccgcgccctcctcgacgctctctccgccacgctcccgcacttcccgctcctcaccgcgcgcctcgaccgccgcggcgcccgtcgccgcccgttcttcgtcacgggcagaggtggcgccggcgcactcgtcgtggaggccgaggtgtcgtccgacctcgctgaccacctcccgctcgcgccgtcgccggagctcgcgcgcctccacccgccggtcaacacggacgcgccgacgccgcatgtgctgctggtgcagatcaaccgcttcgcgtgcggcggcctcgtggtcgtctcgtcggctcaccaccaggccgccgacgggttctccatgagcaccttctttcacgcctggaccgacgccgtccgtcgcaacggagctccgctgcttgaccgacctgtaccgtacggccccggcgcgctctcgccgcgccggccgccgcggtgcgagttcgagcaccgcggcaaggagttcttgccgcacgacggcgtcacgagcaggcaaggacaag

SEQ ID NO: 27356 - DNA, 15318 bp, Oryza sativa
gaaggtaccagaggacggggtggtggtggtgatttcgagcgtgatataaagtggtggggtgttggtgttcgtggctctgtgggaaaagcacgcgaatgagctcaccagcatcgcttacaccatggattagtgaaacactaaccaagatgtagctgcctaatcacgcatgtaataataacaacctatctgattactactcatgtatactactcaagtatactgctgcaattaacgaatgtgtgcgtgcgtaaataaagaaaaggttatcttagaagtaatcagcgtaattgaatccgaatccgaatccatcacgatcgacattctagttgtgcttcactcacacccgtcgtctataaattgtacaagcatctatgatctatctatctttcccaactcacagctagtaacaagattaattgatggattcaccggcatcgtccacggaggcgatggcactgggaccatctcttcctagttaacttaaccgagagaagaatcagcggcttgccaccaccaggcttccgcctaaagttgcatcgcggccagctattctgggtggctcccttcaaccaggtgtactgtgtgggacgaccagatcggcctcgttggccgacacgcatacggccgcgccgatcagggccggcgaacgacgccgatcagccgccgccgccgccgtgcaagcgcgctcgacgagtaggcacggtgtcgctcgatctcctcctgagcctggtccctacgagggcggccgacgcgagggaggagacgtgcgccgtgtgcctgagggacttcaaggagagagacttgctgaggacgacgccctgcttccacagcttccatgagcgctgcatcttccgtaggctcaaggatagcagcctctgcccaatttaccgccatgttctgcccaagccgtaatatgatgacaacgatgatatttatgttaaaattgactgataaattaatcctcagcaatgagaagaaaagaagcacattgccatgtcgatgtgtttagtgtttatttttctcttcaatgtgtataatttgtagtgtagtggagtgtgtacattgccatgtttatttcagctcacttcttatttttgtcaatgatgggtattgctaacactgtttttttattttgtcaacactagtaccagacgacgaccgctgcatgtttcgcgggctctgatgcccaatcagcagcaggatgatcatgctctaaatagaggttgaaaacagtttattacccacacacataaaaacgaaaaacatgattaacatataattaattaagtatttttagtgttagatgatttaactgtcaacaacgagacgctcgtggtgacttcataaatctcaaaatatatcggcctagtcttctgaaggtggttatagggataggatgtgtatattcaattggtgagtgtgcgcgcattgtgagcgtctgcatttgtactgtgtttctaaaaaaaataagtattaattattaaaattttaaaatgaatttgtttattttttaaaaacagtttatatagagagaaaatttgcataaaatatactatttagcagtttaaaaaaatgctaacaaaaattgaaaaagtagcaagtcaatgcctacctgcaagccacggccaacggctgatgaaccactgctcaaatgatgatttttttggggggggtctcaggctctcagctcaccaacaaatcaatcttttgcagtgggcagcagcttcttgattgctttgttttcaacagcatttgtcttcccaacaatgtaaaaatgtattcatggattgaagcgttgaacaagaacgcgttatgcatggatcaatgaagattcaagttatgattgtctcctgccttttggtttaatgtacacaaatatgctatacaattaagttccatgaaatgtacgtacgcatgcgcagcgtctacagggcgatagtaagtaattaaacaggctatcaagtcaaaggaccacatatatctgaaactgcagttttgtcaatcaccatgtaccagttttaaaactagtcatcacaatataccacatcatcgccatcatcaatttctggtgttcactttactattgctatgcacaagcaaagtttagtacagtctatcattcaatattgatcatcagcaactgtagtattttactactttagcaggatatacatctcaaaatgcttttgtttctcaaaaatctccaaaagcttgaaatggaaaatgtagtatggcagaatgcatcttcacttgattctagtcaaactagtttcatgcgcagtgcaggaatactatgctaaaccttccacacattttgcacttcccactcaattggtgatgatgtatcaaacttggagccatcagtcctactgtcctagtgtttcaaacttgaaccttagcacattctacattaaggaagtagcaagtcttcagccctctacccaaacaagatcatcatcatcatcatcatcaattgattcttgggtctccacatccagatcagccaacttatatacctctcctatattccctacaaacacattagatacaaagccaacacattaaaagataaggtgaaggttgacatgttaaaaaaacactgcaccagtgagctttccgttcaaaatattatatgactaacatttttgagaactatcatcgcaatcacataaaccaggccatatcattatctaactcaacaacaagtataagaaactaaaaaatggcggtaatatcatatacatttcaaacaatgataataaacaattacctttttataaaacgaagtcaaggggtatgtaattagattagtagaagggtcaataaaaagctagactacagctagaatggttaatgattaatattttacagaaggttgtttttttttgttgtgtgtgttttttcatgtgaaggctaatgccagttggtggttcgggtgatggtgggtgctgctcccttccccgttcctatttttctcccttactaatgaaatgacacgcaactctcatgcgtattcaagaaaaaaacaatattttacagaaaattttttggctcctatgtgaaattatagataggaacacaagttttgatcaagaaatacctgttggttgctccactttcatttcaatgccatcatcaccagagtcaccaccatcatcacgttttgatttggcacccaaccgcctctcaaactgtgcatcagaagcaaatggctggtcagaaatacatgtaaggctttcttcttgtatcatccttttgtcctcatcttcctgccttttctggatagcctcataataagcttttgcatatgcctcctacaccattaaataaaaggtgaatttatatttaacattcactcaactagctagttcttgattgtgaaacttataattgatattgaaatgcaaattttatcagctcacctgtatgctcttcatctcatctttctctgagagctgtttcttgtcactcttggcttctgaactttgatccagatctgcagtgttgctgatttctcctttatgttcccctgtgaggactgtactcttacgattcatccatgagggctgtggctttatactttccataccagattcaacaccttcctgtgctccagtacttcctaagaaattaacttcaacctggaaaggagaattggattaatcaggcagtgcaatatctagtttaaatgaagtaattagtacttacaggggcaaatcctaataatcaaaccatttgattccaatctagaaaggcatgagatgtttcaggaagtatagaagttctaacagtattcccagcataacaccatggtcatgttatatgcctcatcaatgttgcctttattggcttcacatttatctaaatttgcacctttaactactaacgtatacaactcaatgcatataccaggcttacctctgtttccccaaggaagggcattggtttactgctgtatcgcccttctgaattctgagatgaaccaactgcaccatttgcagatgcctccatagttgctctttcccaatcttgcaaactcataaaagatggaaaaggaagatcctttaccctgtcaagtactgctattaatggcttcaattgctcctgcattcatgtatgttcaatgttagagcagaaatctacaaaacgaaagcatcacaatccacactatcatcaagattccagaacatgcactttgccatccatgtttaagctaaaaactaccttgcagtcagcatcttgaggggcacgcttagccaatatgggagaacatacaccgttatatttattttatatacgagatataaacatatacaagtgatcagcgaagtgatgcttcatagatgacataaccaatctatagaaatatttccatctctgctatagatattgaaactatatatatggttcatgtcaaagaaagtccttctcacaacaatgaaatgctatattgttatcgtgctattatcacaaatgcaataatggttaaatagatgttaaattatgtattatctaagtgcaatgtaaaaaattatagaaagtttatgcacaatttactggataacaatctgattattggccaaaatgcagatacactaatttagtctttctgacaaaggcgaaacaaatttaattgttttccaatagttatagtatgtaagctgtactaaaaactgaacaattctaacatcatttatgtttgatctatgctcccaaatttggaaacaaatttctaactgaataaaaagtaataacctccattctttgctgcatatcctttagtttatcgtgcttatgctttattgcattgtcaccaccacacacaacttcatccaaagtaagcttttcactttctggaagaagttgttctttgcaatgctcacagtgaaaatagtcatccatatcgcttacaagttgcagtgcatcaaatgctgaatacctactgtcggtgacatgggaccgggagtatcatgacttagagacttgaggcagacacgatcacccacgtggcctaaccccctcggggggggggggggggtcgggcccgagggtgatacggccgcccttctctttgtctccccgaggggtcggaccgctcccgcctcggccccgagggccgaggcgccccgaccccttgtgggttttgcgccgcgtgtatgggttaggtgagcgcagcggggctcacctaaccgcatttattgcggtttgggtgagcacgtcacgccgcacgtaatgcagtacagcgcgctcgtttatccggtctgtgactggtcacagaccggtcagattgcgggttaggtggcaacaggcgatctgacacacgcctcgccccgtcccgtcaggatgagagtctctaggcactcgtccctagccagagccagcgtgctagctcctggagatggcacgttggtcctggtcaggtatatgccaggcttcatcccaaccattacaagcaagaaattgtatgaagaagggtggacatgcagattgctaaactgacgcgtggtggacaagaatgaccgatttgtgaccggtctgacactggtcatgtcgtcggcaaacagctgtgttcccacgtcgcgcctgcttccggcggaagtggaggtaggtatgggccgtcccatcagaaggtcattcggacggcaaccatacaagtctccgtctgtttaagaaaagataggataagtccccacaaaaaagagagagatggtgcatgtggtatccccttgaggtataaaaggaggaccttgcccacttagaagggggattgattttttgggggggatccagaacgatcagagagggagagagtaagagctctctggttctccagctcttttgtagcttcttcgtacatagattcaccaaaacacaggagtagggtattacgcttctcagcggcccgaacctgtatacatcgcccgtgtcttgtgtgtttccattatcgcgaaccttccacacaccgagagcttagaatctcacccagggcccccggccgaaccggcaaaggggggcctgcgcggtctcccggtgaggagccccacgctccgtcatctggcgcgccaggtagggggttctgcgtgtgttcttctaagctctcgcactctttcgtgtgcgccaagcttttcctgttcagcccaatggccgaacaagcaaaggcgcacaacctctctccgagtgttagcggtgacgacggggagccgaacccacgccgtcgagctcgtactccaccctccacgccaaagtcctaggcaggaggaggcgctcgagagggtcaaaggatccgcgacttcgacatccacgggtgatggggaagggcggcgagatggggagcgtcgcctcctcgtctacggcgacggcagcacgccccagggcgcgctccaagctgcgggcgcgctcctacgtcacccgcctattgtccctgacccggagtctccagcccaacgttggctggacgacgtggccaacttggtcatgacggcacggcagcgcctaggtgctggtgggcggtcctccgccaccaagacctctggcgctgctaccaccggctccgtatcgtcaaggcggagggcgcggcgagcggcggctgttgctcgccattcggccgccactccttcgtcagcgcctccgacccaggaagatctgcgtggggggccggatgcccgcatcagtatcgagcgccggcgtaatggccgacgtgctgcccacgcaacggagggcgcctcctcgtccggagtgtcacatcaacacggacgcggggatcagccctccgtgcccccggttggtggtgtcggctgtagagcctttgtggcgagccttcggaacgtccgttggcccccaaggttccggcccaccagcgccgaaaaatatgacgggagcgtcaaccccgccgagtttctccaggtctacacgaccgggattgaggccgccgggggtgacgacagggtcatggcgaatttttttcccatggccctgaagggacaggcacggggttggctaatgaacttgccacccgcgtccgtccactcttgggaggatttgtgccaacagttcaccatgaactttcaaggcacatatccgcgcccaggtgaagaagcggacttacatgcagtccagcgaagggatgatgagtcacttcgctcatacattcagcggttctgtcaagtccgcaacactataccatgcatccctgcacacgcggtgatctacgcgttcagggggggtgtgcggcacaaccgcatgctcgaaaagatcgcctccaaagagccccagactaccgcggagctttttcagctcgcggaccgagtggctcgtaaggaagaggcatggaactggaacccctccggttccgatgtggcagcttcggccgcccccggatccgctgctcggacagggcggcgtgacaggaggaggaagaagaggtcagcccattccgatgacgagggtcatgtcctcgccgtcgagggcgcttcgcgggccacccgaaaggggaggcctgcgagcgacaaaaagaaggaggccggcgctcccagtagggagcgcccaaccggcaagtggtgcatcgtccacaacacctcccttcatgacctcgcggactgccgcgcagtcaaaagtttggctgagcggacgaggaagtgggaggagaggaggcaggagcgccgagagggcaagtccccggcggttccttccggcaatcggcgaagtgaggccaagcagaaggaccccgccgaggacatcgatgacggcgatgatgacctaggtttccaagagcctggggccaccattgccactgtcgatgggggagcgtgtgctcacgtttctcaccggagcctcaaggccatgaagcgagagcttctggccgcggcccctactcatgaggcgacgcgccgggcgcggtggtcggaggttgccctcaccttcgaccagaccgaccacccaccgtgcgttgcccggggaggacagatcgcaatggtggtttcccccactgtttgcaacgtgaagctggggcgtgtcctcattgatgggggagcagccctcaacatcctttcccccgcagcctttgacgctatcaaggccccggggatggtgccccggccgtcccagccgattatcggtgtgacgccgggtcacacttggccgctaggtcatatcgacctcccggtcaccttcggtggatccgccaacttccgcacggaacgggtgaactttgatgtggcggacctcagtctgccctacaacgcggtcctagggaggcccgcgttggtgaagttcatggcggcggtccattacgcctacctccagatgaagatgccgggccccggtggccccatctctgtccatggcgacctcaaagtcgcgcttgcttgtatggagcagcgcgcggaccacctcaccgccgcgtccaagcccgagggaggcgacgagaggcttggcacctccgcccccgccgccccgaggcagcggatagtcacatgcgacgaggtcccggtcaaggaggttgccctgggcgacgacccgtccaagaccacacggatcggtggtcttctggacggcaaataggaagacgcgctcgtctctttcctgcgggcaaacgctgacgtcttcgcatggagaccggcggatatgcccggggtccccagggaggtgattgagcaccgtctcgccgtgcggtcgggcgcaaggccggtccggcagaaagtacggcggcaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccacagcggggtgcgaccttttgtgttttctagatgcatactctagttaccatcagattcgcatggctagggaggatgaggaaaaaactgcattcattacccccataggaacttattgttatacgacaatgcccttcgggttaaagaatgcaggtcctacttttcaacgtactactcgaatttctttgggtagccaaattggacgtaatgttgaggcttatgtcgatgacttggttgtaaagacgcgcagccaagagaccttactctcggatctagcggaaacttttgagagtctccgctccgcccgcataaaactgaaccccgataagtgcgtgttcggtgtacctgcgggcaagcttctcgggtttttggtctctgcccgaggcatcgaggccaaccccgagaagatacgagctatagagcggatgcgcccccccagcaagcttagggatgtgcaatgcgtcatcggttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagctctcccccagttctggtcgccccggagccaaatgaacccttgctactctacttagcggcgaccccgcaagtggttagtgcggcgttggttgtggagcgcgatgaggacaatcctcattccgcgcacccccaccctgtgctggcttggcctgggagagagcagggaggagaggcccccgagccgaacggtggcccaaggcccccgacgaccggagcaggccctctgcccgcttgtcagacggtgccaggtgcccccgacccccaggatggcccgagggccactgcgggaaggccgcacctatcgccctctgaccccgaggctaaccctgtgccgactcgacccgggagagagcagggagaagaggcccccgagccgaacggtggcctaaggcccctgacgaccggagttggccctttgcccgcttgtccgacgacgccaggagcccccgacccccaggacggccccgaggccactgtgggaaggccgcccctgtcgtcctccgacctcgaggtcgtcggcacagaagacgagtgcaccccgtgaggccgcttggacaaagagcgccccggggatgtggcccctggcgaagaggatcggccccaccgaaaggtgcagcggcccgtctactttgttagtgaggccctccgggatgccaagacccgataccctcaggcccagaagatgctttacgctattctgatggcttcgaggaaactgcgccattatttccaggcgcatcgggtcacggtggttacgtcttaccccctcggccaaatcttgcataatcgagagggtaatggacgggtggtgaaatgggcaatcgaactttctgagtttgatttgcactttgaaccacgccacgctatcaagagccaggccctcgccgattttgtggcagagtggaccccagctcccgagcccgtctcagtccccgaggccagctcgggcccctcgcagctgccttacaccgcccactgggtgatgcagttcgacggctccctgtctcttcagggcgccggtgcgggggtcacgttgacctcgccgagcggagacgtcctcagatatttggttcgccttgactttcgggcgaccaataatatggcagagtacgagggactccttgcgggactcagggtggcagctggactggggatccgccgcctcctggtgttaggcgactcccagctggtcgttaaccaggtctgtaaggagtaccggtgctctgacccgcagatggacgcttacgtgcgccaagtacggtgtatggagcgccattttgacgggatagagcttcggcacgtgcccagacgggataacacggttgccgacgaactctcacggctcgcttcctcgcgggcccagaccccaccgggcgcctttgaagaaaggcttgcccagccgtcggcgcgaccccaccccttaggggagacggacgcgcctgacaggcccccgatgcccgtcggagtccaggcctcgggacccgaggggagcgctcccagctcccttagattgattgcttggatcgctgagatccaagcatacctcacagataagactctacccaggaccgcgaagggagtgaacgcgtccagcgcatctccaaatgctacgtgctggtagaagggaccctctatcggcgcgcggctaacggaatcctcctgaagtgcattcctcgggaacaaggcgtcgagcttcttgccgatatccatgaaggcgaattgcggagcccactccgcctcgcgcaccttggttggcaaagcctttcgacaaggtttctattggccgacagctctcaatgatgcggtcgacctggtccggcgatgcagagcgtgtcaattccacgccaagcaaatccatcagccggcccaggccctgcagatcataccactttcatggccatttgctgtctgggggctcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacagcccggtttggagtgcctaaccgtattattacggataacggcacccaattcactagtgaacttttcggcgattactgcgaagacatgggcatcaagctctgcttcgcctcacctgcccaccccagaagcaacggccaagtggagcgcgccaatgcggaaatcctcagaggccttaaaaccaagaccttcaacatcctcaagaagcacggcgattcgtggatcgaggagttgccagcggtgctctgggcgaaccgaaccacgccaagccgagcaaccggggaaacgcctttcttcctcgtctacggcgcggaagcggttctcccatccgagctcaccctgaggtcccctcgggccaccatgtactgcgaggctgatcaagatcagcttcgcagagatgacctcgactacttggaagagcgaaggcggcgcgcggccctccgagccgcgcgctaccagcagagcctgcggcgctaccatcagcgccacgtccgggcccgatcactctgcgtcgatgacctcgtcctacgccgcgtccaaacgcgtgctggattgagcaagctctcaccaatgtgggagggtccgtatcgagtgatcggcgtcccccgggcgggctctgttcggctggccacgggcgacggcacagagctgcctaacccgtggaacatcgaacaccttcgtcgcttctacccctaaagggggatcgggtgacaggtttccggctcgggccaaccccgcacccccctcgggcgtgcagggttggccgggggctaccacatatgcatattcttatttctcttatatctatatttcaataaaagcattttcgatttcctaaaggctgtatctgtgctgttgtttccttttgaaggatcttgacttgaaataagtcactcgtgttcaatcctgccctcgggggctcgggtcggctaaaatcgctaaacggggcccagaaccgagccgtgccccggggcgtagtgaactccgggggggaatcggcaaaaacccacaatcgggtcacccataaccctcggtcaccacgctcccggcttggccagtctcgacatgtggatctccccaggcactagccccgacccgagccatttgaggactaggacctgggcacgagcccttgttcaagccaagacacaaaaggaccgtggcacagacatcctcgtctcatacacacaacaaatagaattgacacaaaaaatttcctctttatttgattgcagattaaattagtctatacaagaagggggcccgaaggcctcggaagaagaaaagaagaaactatttaaagattggcgggggcctgggggctcactccgatgcacccgggtcgccagcgtcgtcgccactgtcgcccactccgccgtcatcgtcctcctcgtcggagttgagggcgaacgcgagccgaggggccgaaccctcgaagctgtggacgatatggtcggcggcgtcccggacctgcgcgcgcgcgccatcctcggtcccgggagggaactcgtccagcgccgtccatggggagaagtcgggatccctggcttggtaactcgccagtacgagctccaccgctcctcgggcgaggtccctcgaggatgacttaatcgtcctctcgagctcctcggggagccgttggagagtcccggctatctccaagaggcgctgggcgaggcccccctggttggcggcgtacttcgcagtccgcccgccccagaggcccgcctgccggccggcgcggtctagacgggagacggcgtcccgaagcatgccgggccctacctcgcctgccaagcggagggcctcgacctccccagcggacgagtctagcgcgccctgcagatcggcgatggtgtgttcggcagctgcgaggcgggcggttaagtcgctttcgcccgcggccgccccgccactgcgcaccctcgcgtccagccccttctcccgcgcctcgagctcagcggcccgctggttcagcgcggccctctcggcgcgggcaccttccagattacgacgcgcctgctcctcccgcactgcctcgcggagggacaggctgtccgccagccgttgcgccgcggcctcggcctcctcgagagctcgctcccgctcggtgagcgcgtcctcgcggaggcggagcgcggactcctcttcggcgcaggcggcctcgtgcgcagtcagcgttgcctcccggatggcaacggcggcctcgcgatccgccaggtccctctccacggcgcaggcacgctcttccagcgccatggcacgggcctcaagggcttcttcgcgccgccgggatgccacctcggtctccgccgcccgccgttctcgggcagcggcaacgtcaaggaccccccgggcggcgtcgagcttcttccctagctccgcctcctagctcccgtattgaaggcggagggtgtcctgcgcctcgttcatcacggtggtggcaatgagggcagccccccgctcctcctccacctccttggcgatctcccccagcatcttccgacgggcttcgagctctgagacgtgccggcgatgtgccttgcggcccacctccaccatggcctccaccgagcgacgcccctcttcgacacgtgcccatgcggtgtcgagctccacccgctctgcttgcaaggcctccatctgggcacttaacccgtccaacaccggggtgtttgcgacggccaaggcctgcagaaggggttctgcgctcagtggagcaacggaaggcgtggggaagagccgcctcgaagaggatgccgcgcggcttggcccgccgatggacgtgccggactcggggatgtcccccggacctggtttgtcctgagcgtcgcacgagggagtgggcccaagcgatgcgcccgcggcctcgtcgcgagttgcctcggaagtcgtcgtcgcctcggcctggcgaagtctggcctcctcccgagcggcttcttcagcttggcgagctcggacggccacctgggcagcttcctcggcttctcgaaggcgatccgcggcctcttgccggtcagtttcacgggtcgcctcggaggatgtcgtcgcctcggcctggcggagtccggcctcctcccgagcggcttcctcggtctggcgagcccgggcggcctcccgagcggcctcctcggcttcccgaaggcgatccgcggcttctcgccgatcagattcccgcctccgggcctctgtggtcgccgggtcctcggcctcagactggccggacttggaatggcgggagggacgcgacgggatctcgctgaaacagaagaaagaccagaagacaaacaagatggatgagtgaaaactcgcgttgagggaatgaatacggccacgatgggcgtgggacgaacctgcgagggggtcggttaaacgaccaccttggaggggaaataaggtttccccgggatggttctgtcccccccatcttgcggagccgtttcttcttccgctccccctcgggctgcgacgtcggcgtggccccctccgggcgcctgctgctggcacgcgccgccccgccccctcggggaggagatgggggaggggttccttcctgcttcctcttcccccaggcgtcggcagggcggccgctccccgggcccccgtcgcggggcccagaagcacgaccccctcccggggtagattgttcccccctgcggctcccgcccgcgccattgtggcctcgaagagcccgctcctcagacgccccgaccgcctgcattatgt

SEQ ID NO: 27357 - DNA, 1732 bp, Oryza sativa
ccggtgtactcccaggcgccccgggcgcgccgctggagtggcgcgatccggcgacgaagatagtcgccgaacaccatggcccctgtgagcccctgggatcgcaggcccaccaggcggtcgaggacggcgtcgtagccatctcccagatctaccggcgcccgccagttggaggcctgcgctggaggctggctcggaagtcggaggcgcgcttcgtcggcgaggggggtgtagaaccagtcgctcttccagtcatcccacttcttgcggaggacgcagggaatgtagcggttcagcaccggcccccgcggctggaagtagcaaccaccaaccaccgacggcggcgacaccggctgtacggtgaagaaccaccggaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccatagcaaaagggaggaagaagacggaccgccccgggtagcgtggcgccgggcatccctcgcccagcgagactatctcccggccggtggcagattccggcatgaagcggcgcggcagcccggcctgtctctcgctcacgatgcgggaaggcggcagcacgctaccgtcaagcggagcggagccccgtgccatgacgccggaagaagagatgtttgagagcgagcgcgtgtggcgaaggtagggcacaggaaacaaggagttagggcgcaagcggcgaagacaaggggaataatggcgagaggaaggaagcaaatctcttcctcggcgactttatacccatgccaacgctgtgcccggctcctcgtttctcgcgcccactatcttgccccctcgtttctcgcgcccacgcttccactaatcccattcgcccgtttgcggtgcatgaggtggatatgcggctgtggcagtcgagatggaacatctcgtgcgcgcgttaattacgctcgccgaccgaagcgccatcaccatatctccaggaaaaacgaaccggcttgtcccgatttttagaccggccccacctgtcatcaggccttaggaagtggcgtcacgcccgaccgcttccctcgaggagggcgatcgccctggcataacgccgggggctactgtcggtgacatgggaccgggagtatcatgacttagagacttgaggcagacacgatcacccacgtggcctaaccccctcggggggggtcgggcccgagggtgatacggccgcccttctctttgtctccccgaggggtcggaccgctcccgcctcggccccgagggccaaggcgccccgaccccttgtgggttttgcgccgcgtgtatgggttaggtgagcgcagcggggctcacctaaccgcatttattgcggtttgggtgagcacgtcaccccgcacgtaatgcagtacagcgcgctcgtttatccggtctgtgactggtcacagaccggtcagattgcgggttaggtggcaacaggcgatttgacacacgcctcgccccgtcccgtcaggatgagagtctctaggcactcgtccctagccggagccagcgtgctagctcctggagatggcacgttggtcctggtcaggtatatgccaggcttcatcccaaccattacaagcaagaaattgtatgaagaagggtggacatgcagattg

SEQ ID NO: 27358 - DNA, 4252 bp, Oryza sativa
cctgtatacatcgcccgtgtgttgtgtgtttccattctcgggaaccttccacacacggagagcttagattctcacacagggccccgggcggaaccgggcaaaggggggcctgcgcggtctcccggtgaggagccccacgctccgtcacctacagttcaacagagacaataatgtaagcttcattttttttaatggtactatatatccagaataatcagaagtatacttagtaccttcttttacagttaggacatacataatgctgaactgtatctctgtcatctaactcatcttttaattttttcctcatgcggtgtatcctatgtcttacaacatcatatacctgtatttcagaaaaatatgcacattaaaatctatatcagattatgaccagatcaaaagacatttttggatcatgggatgggtaaggtacaagcagattttattctatgactaaagatgggtaatgttatcgctaacgctgtggtgagagagatttgtctcactttctgttcaacaaattttcagtaggattctgtcctaataattctaataaagccaagtgacttagatttgccaacctatggaagagagatcaatttaatcaaaacaaccaccatgcatgcagaaaaactgcaatgttcaattgaagattatatgagaaggtccgcttgtgtgatttttggcccatgcagttttacaatgttaaaataagtttccatgcacagagtctatatcaaatctcattgagctctgccacacgtaaaaacataagaaatagatatagcgctacatgtcccactcatgtgctttgtggataaatgtgagcggccaaatatcttgtgtatgcgaaaaatttcagctaacaagtttctctttcattttttcgccgggcaagtttctctttcattagagaagtaattcttttcctcaaacaagcaagagaattgcgtgtcatttcattaagaagagaataagaggagagaagcaattgcattgaaaattaaatgttcaatcaatgagtaacctgagcatagtccaaacaacaagtaggaatgtgtgtgcatctttgctttctctcctcctttagtaaaaggatgcacatcaccagcggtgccagagacattgttagatatgtttactccttttggtgactgctatgacataacacaacacaaggtgagaaggggcaaaaaaaaactgacaatcagattaacaaacaaagatgactaatgactggacgttcatattgattgcacctccaaccacaccacccagaaaacaaaagagttcaagcaatgttcaggtcacctcgtgctgtcactaatgatcctgtgaatgttgattgtcttaagctctttggatgcttacgttcataaagtgaacctaaagttactccttatttagcagtactgcacactcgaagtgatccagtgtaccaagcaaaatagtgtaaatagaaggctaattttttagtacataggaaaacagagccgccttcatatatgtaagaaaatggctatacatgagtgtgtggcgcaaatggtgtctaaagagacctatacaacaaccatcacaaaaaacaacaaaaattccacgggcacaaatagatagtcagatttaatgaaatatgcatattccaggaaactgtttaatatgggctatacaagagagcgtagcacacacatgtttatgcctcagcagtatcagaacacagatgaaatatacatgacataaagtttcatttattgaagtcttacctaagttctgctgaacttttctgctttgtccatgtaagattatacaagtcattaatgcaccgatatagttatgcaactaattcatttcccatgtatttccattaaccatgtacaagcttatgtgaagtaggtgctcaaaaacatatttcaggcactcattctatagtctaaagaaataaaataataacgccactgcatataaatgtggataaattgtagaatatcttgacatcttgactcagttggaaagtggtcagcattttttttactttttaggataagtggaaaatggctgagggcaaaacgggcagagagaaaatagaaatgtaaacattttgcaaaaagaccccaacgtgacaaatgctagagatgcgctctttaacagtggtgattcactactcattgggagtgggtggcatatcctacagtagtacagtgccgaggtgacaatcgttgattctcactctcctatcaggtcttgctttcagaaactactaataacctaattaacaacttctgttttaagtggagtagatggcgattccatgctaaaattaaaaaaaaaagtgctatacaaaaatgagaacaactctctctcagaaattctaatctccttccgatgacatcttctcactagcttctcttcttcaaaaaactggagaatgcggcgcagttgcttagaggaaatctttaatgctttagccaaatcttcctctcggacccactggcgccgcctgcggtaaaaaagaagggtatcacaatttgtgcattgacactacatataattagttaacacgaaaaaagatgaatattgaaacgagagaaaaaaatgttttagagagagagagggggaagataatagatttaagactaaattctttgtgatcataattggacaattgaagcagcatctccaattgctgatttccatctctagtaatcaaagttttcttatttacgaaaaggcaagggctctgcctcatgcattaaataaaggaagaagagtcatagtaagagagagtgaggagtggaaaccgccttctcacacaagcccgagcatatgcacgctaggaaaaactcaatagacttgacagatgtacactccggggtgccaaaagataggattaaaggaggagaaaaaaagaatacagaggcaagggcctagtagtcaaaactgcacgttcaaaactgagcaagcagcattataaaaataaaatgtgggacatcaacgagtaccaagtaacactacaatatgaggaggcaaaatgttctctcagcagttccacatggataatgagtcataagaaatcataaaggagtactcagtatatttgtttcataatgttgtgtacaaacttgatccagttggtgatagtgttgattaaccattatttgccatagatttgataaacgacaaaccatgagtagcagttactccaaaacagtccctcagggatcataacaaaattgctcatcactcactctaaaaaaaatcttcaaatgcttgtttgagcacttaacgggacgttgtagccaaccagcaagaaacgaaataatcaatttaaccttgaaaaataaatcctagaccatgccataaatttgaaatgcacaggcacaaaaggtctgcattaattatctcggtcactgtaaattctccttgcctaaaatcacaagaggccaagagggagcagtattcaacatggaggtttcctcattggcactagcgagtagaaactagcatcatcaatcaatcaggtgagtgaaaccaacacaatagaacaggtcatgaaacatgtacagaaacacatgcaacagggcacattgatcattgatcagtgacagcaccgaggtcaggactttggttgaggatttaggtttggtctcacctggtgagggcgtcgaggacaacgacggcaagcccacagttgtcgccgcgagcggacttggggtctctggccagcgagacgttgtcgtagaatgcgcgcgccaccatcctcaccatcctgcaatgccagccaaaaattcccaaaccaaaaccagtaaaattacacctcccgcggatgccagctatcatcaatgcatcatggatacacggaggggagcacagcgggaggatccgcaccggttcaagggctccatggaggccatggcggcgacggcggcgatggcgagcggcggttggggtttcgcgggttttcgccgcgatcaggaggttttagccgctgcagcgcagggcgcaaggcttgagggcaaagaagaaagcagcgaccgcgccgagttggttgggttgggtttcgtttcgtttcgttctcgagtgtaccgactcgtgtgggtcggacccgagcccgacacgatccccctctcgttttgagcggtttggactcgaacccgactcgaccatctttcttcttctaaccttcttgtggtggaaggaaacacgggcgactgagcagctgagtccaacatcgccgggagagagatggcggagacat

SEQ ID NO: 27359 - DNA, 16352 bp, Oryza sativa
aggatttatactgaatctacttcctccacaatagtccggaatttttgcattgtttatattgagatggcatttgaacgtctgctaagtgaggtatcctattctgcttcgtttgtttctcattttctctaggctgttttaccttttctgcaaagccaacaacatgaagttaacattctgtaacaggacaagggaagcatagcacctgatcttttaatcaacatatcaaatgttacagagcagcatcagggaatcatcttgagacttgtggtgaaggtttgtcacaatttaattaagactgctgtccaccacagagtttacacgattacacatgatcagcaaaaatatgtacattggtttaaatggtttccattgaagaattcaaggaaaggatccggcaaaattatgtagtttactaggttacacatggactggcaacaaccaaatctcacccttccagtcaaaatcataaagttgatgcacatactaaattgatcattatcagcttttttctatcatcagcccatggcattgaatttagtcaagtctataatgatttttgataagttactcatagttttcttttcttcctttggtgtatctgcatcctaaaaagcttgctagtttttctctgtttttttaaatcttgttgtcaggctattggtgaatgtaacacacataaggtgggtgacaatgttgcttcaaaatatcaatccataagtggatctaatgatgatctagtcttcgctgacttctgttttcacacagtagtgtatcaaacaccacctcaagggtaggtttccttgctaaattaggtacaagtatgaaactttttttgatttatggagagttgactgctagtattcttcagtgttggatgcccggctggactttcggttgctcaatcagatcgtgttactggaaagcagccactaaaaggtgacacacttacatcaagaaaggtaatacagaaatgcatgtatcatttattcatgctatgcctgtgtatgcaatcatgtcagcatatacattcgcacattttaagtccttgagtatagtaactgcaccttcttacagttgaatttcacttgtgatatcttcagctaggaatcttgaacgtcattgaagctatgcagttggcaccagagattgtttaccctctttatttagctgctgcttcggataggtacttttttggaattatgtttacaatccactgaaatgtttgtacggatcattaatcatgcggatcattgtttcaatgaagtcaagagtcagttactaagagaggagaggagttattaaagcgcaaagcttcagctgtgaacctagaagattccaaccttatgaagaaactgttcacactgttcaatggtatggattaaggattttgtagcatgctaactcaagcaaatttatatttcaatataatactgtcactttgttcttatgtattgtcatttttgttgggtggcatatgttattctgtccttgaggtgactaaaatgcattgttgaaatccagttccttacataaagggcaaagctaaaattaaaattatctagtataactttgcctccacttcaaaatatatatagaaggctttatagttttttcgagctttattgttgcatggtcaaaagatgggtgcggatacctttgttgcccctcatcttcataactctagcaaggtccttttggtacagcacatgtctattccatgaacatatttcctctagcctagtcccgaagcagtaggtcattgggggtacccctccaacaagtttcatttaaaatatatcactcatgagaatttactgatcctttttacaccatcttctctcaccttgtaattataactaatgttctaactaactgttctcttccgtatttttaactgagataacaaggtcatgtcctctccttctcttgttttcatacccttcttaatccttgttcccatccaaagtaagccttacattttgtaaaggtttgtgtatgttagcaggccagcatttgcacattgcactctcctgtaccaacatgtacacaatgcttctctttattttgttttgtaaaaatctctttcttgtttttatcagtgcaaatctgaatatttgtggtttctcatggtatatgatagatactgttctcttttgcctcaggtactgcaagtgcagaaaatatagctgcagagctgaaagtcgccccagcacatagttcactgcgagtccgccttatgggtgttttctgccgatcgattgctgcagcaaacgcattcccgtacacacttcagtgcatctttggctgcatctatggtattctgtttatatatatttttactttgtgtatttattttagttttcttatttgttgtcatgaccaataaaatgaaattttaataagctgtgtattaacaaatgcactcttttactagttttgattatttacatcaccaaaccgcatctttaagtagtacatagaaactgatttggtatgtttgtcattttgtacaataatctttcttttaagcatcttttagagttttatggaatggtaggagctgcagaggatgatcttctgaaaaactattaatatcaaattaacaataatgtacagcatacattacaatagaatgataaaagataaaggtgggcctagaaatttatatctggaacaagtgaaagagttgaaagatatgggctagggttcatggaggataaacaccattaggaggatagcaaggtggcagcggctccctgggatgagaagtaggcatagactgggatgcagaacattgaggaaaatggattgatattttttcttgctaacagtgacatccttatatagaggtgctagagcccaaatgatagaaactaaataaaatcataccttggatatagccatctacttccatgaaatatctaacatagaaactaataatctttatccccaaatcaattgcgcagcccataacacatatatgcatgacttcctttaaagagggaaatgcaagatgagcactccatttgctttttaagtgtctatttctatgatatggaacacattctatgatatttcttgttatgttgcattcaattcattgctaaaactactcaattgacgtttcagcaaggcaataactcaacttcagcatgccatgtatcgttactaaactcatatttgtttctgctgtgtttctatgcctgaaggaaacgggactacttcaaggctgaagcagttagggatggagttcactgtctgggttttcaaacatgtaggtgcactttgtatgttttcagttcaccaacattgattagcttctagcattctttacttgtgctcttccaattttagctttttcacttggagcagttctgttcctttctgtcaaccttgtttcatggtctcaaacttttatcaattatcattgtttccttattgatttaggcagcaaatgaccagctaaagttaattggtccagtcattctcagtggaatattacgttcacttgatggttcttccactactgaagcaggttttgcacttgtcatcgactctacttgtttaggcatgcatgtgatttatcttcacattcctttgctttgaattacttgggttttaacacttctttgacttcctattttgccatgtcaaataagttgagaaacagtgaatgatttattgatttcctttatgtccagattcttccagtagggatattaaaatatttgcataccaggcaattggtttgcttgccactcgcatgcctaatttattcaggtatgcccttttcttactcttctgctttcttgcctcatgattcatttctgttatggagactgattttttctactttttatgaacattgcagcaacaaaactgacatggctatacgactctttactgctttaagattagaggagcaatctcttcgtttgacaattcaggaggcagctactgcccttgctacagcatataaggtacttacttgtaggatatgctaatttcccccaaaatggtgctgtactgctgtcctgacctgttaaaatgttggcaaaagatggttgtgaaatgtgtttcgagggtgtagtgatttccctagggtgctgtacttctgtccttgacatttctcattattttgaatggtcagatatttttacgctgtagttgactaatgacttgatgcggaacaaacttattagttttgttgatgaagcacatgaacggatcgtgacgccccatggtccaaacatggtacaatctatccactttgctggattaaaccacatacattgcaattctttgaagcttttgatctcgtttgctgcagttgggttaacctggaattgccttcatacaccaagttttgtatgctgcattgtcacactcacacctttcacagccaacataaactgactaacccacccccatccattcacgcacacacgcatatggacctccaagttctggcttggctagatgctaaaagatgccttgtaaattgcaattttgtattcttgctattattttacggaaagaaaatcttaacatgtgacttgaaatagttattcgttgaatgtgttcttcgttctaattataacagcgtgtatctaactcatttcctgacatcaaagttagtaccgcctggagtgtaacagatacgtgctgaggaagagccttggcaagaagtagaaatatagtgctcacaagttccatgaactgagggagggagggtgggctttgcatggtatggggtagtggtaagtaggtacatgccatgattgtctagcagttgagggaggattggaggagattaccagttcagcttgcaacagagatcgacagataagtccttgggtttggttaagagataagtttaatcaggagataatcattagttgaggtattcttcttaaattgttcgggattcttgctgtctgatctataaatgcagccactagagaatgtattcggcacagagggaagatacaagaaggcaaatgttctgttgagtgttgacatttttgggttttacatacttgtgacttgtaatatttattgctttgtcctgttactgcatcatgtcttcagtcagtgtcattcatatgctgttatgttactccactttttctggaaatatatttgtgatttcctttttttcttaccagggtgcttcggttgtaatattgaaggatcttgaggcacttctcttggaaaattctcaaatggtaagttcccattcttgtcattgtagattcttaaatactcaagagcccacagctgcatcaaaattttcctatctacagttgaatttgtgggtgttacttctattatttttctcagactcatctagatatacgtgaaagcaatagtttgaaaagatggaatattttattgtttatatgttgttgattggcctgatgagaagttctattggaatacaactatatcttcttacttttgtgatagttgaaagttgaaccctactgttcgaggaatgcaagtacttttagtcatttagattttgcatacttttgtgattttacattttttatcctattttttcttcaaggagcaaagtgaggtccgattttctgctgtaagatgggcaacaacactatacgatatgaagcactgcccaagccgatacatttgcatgcttggtgcttcagatgtaaaactggacataaggtttgttagaaaagatcttgccgagttgttgacatcttgtttcctttggtttctatttattttttttaaaaaatataattatatgattatgtttgtcatcagggaaatggctttaactggtctgaatctgttaaatgatgaaagggagtcatctgcaatagcaactgattccaactatcctgatattgcagacatggtaaattatgtatacagccaacagcctcagttgctacactgtgatgagcagaggaacggaaaattgcttttcccaacaaaaacatttcttgcaatgataaagtttctaatgaagtgctttcagaaaagtgatggctcggattttcttcaagaagatctatctaattgtccagtatcaaaattgtgtatcattttagaacatgccatgtcatatgaaggatctagtgaacttcatgcattggccttgaagtcattggtcgatatttcctctcgtcaaccaaaggtttctgtcctatattatttgttaaagcaaactatgctttcttcacatgtttaaacttttccttttttaattttagttggtgtcatcgcgctatgtgaaccgtttactttggctaagaactttactgggccatgttgatgctgatgctcgtgaagcaacttcacgtctgcttggtattacttcttcagccctttcaagcactgctgcactggatcttctctctgagctcacttcaacatttgatcaaaatcgcccatcaaggtatggaagagaaatttaaaacacaaatccattttctctgtactgttatgctacttctaattcacgtggatatttgatgaattgcaccagattcgaaaattaccatggattgttatgtgcaattgggtatataactgctggttgtttaaaagaatcttatgtaagtttatgcttctttcatgatactattttttttgcagtttgtttatgtcatttctttgctacatgtgctttacatgaaagtttagtgcattcgctgttcacttgacaccgttaaacctatcttgaatataatttaatggtgttatatcagaacgacttgatggacatcccattagtaataccatccatgagaatcctttttgttattctctagtactaagaatatgatagcgaaatggactagtgtaagacggttcttgtttggagtgtcatgtgagggacagaattgcaggcagggaaagaatgagagtagtacttctctttccataagttaaatgtgttttgagattggggattcgaagaaagaaagggatgaattacattataatttacctatgccatacaatgttcagttgttcacaaaactataggacaacacaagaaactatgttgatttttatttttattctctctctgtttttttcctaatataaatctttagttaattttagggtattcccgtgctggtttcttgggcggttaatgtgccaaagtggctggggtgccccagggaagaaggcacaagggagtctgtagctaggcagttaagaattctaatccactgggttaagtttggcttgcattcctaactagagatgaactgacaaaggcgatctaccatgctggcaaaataagtccatagctcagtaaaccaacgcattacctattttgttgtgtccttcctcgtgtttagatggtggcaagaatggtgctttttcatcagtcttcgataatcctttgcactgtaaaaatatatgtaatgaatgcaactgagggctactgtgctgttattttttatgaatatgtacagataactgaagaaatagtgcagaaatcaattgatgttcttgtaaaagttgtcgagtctgagggttcagcattggcatccactgcgatggaagctcttggtcatattggtctccgttgtttattgccttctattaatcgaaattcctctcaaggtaaaatgtgtttcctcgcacttctgatagacgtgaactgtgctttctcaccagcttcctctactatgtatttgtttaagctaatttcgtttgacttgcagctgcacttttaacaatcctgaatgagaagctggctaagctgctttcagaaaatgatactaaagctaaacaaaagattttgatatcgctgggacacctatcttggaacgagttgtcatttgcacacctgaataatgcattggacttaatttttagtctttcacgctctaaggtagttcttttgataaattcaaaatttgtggttgaaaatattctatatttgacaatattctattcctaaatatcattattcaggtggaagatgttctttttgcagccggggaggccctatcttttatatggggggaagttcctgtgaccacagatgtaatactagaaacgaactttgtctccctttcccaggccacaaactatcttactggtgatgcacccctacttgtctcgagtaactctaataaaggaagtgattgtgaagaagcacacgcaatggctcgagaagaaattataaaacggttatttgatacactaatttatagcagtagaaaagaggaaaggtgcgcaggtactgtctggttggtctcacttacaatgtactgtggtcagcatccaaagatccttgaactacttccacaaattcaggtctgccaatcaataataacatatatttatcattgtagaagtactatatcttaggacaaacaagagtggtgcactccaaagtttacattagaattgatacaccataggttgtgtgaattattaatctgtcctaaaattaaaacaatgccagtatgctggacagggcacagaagccaacaactgttaataattgtgtacctttcatctaaaacatgtgcttgcttatagtataattcagagttcctcagaggtttcagctgtcaagctgtcactgaaaaatattaatttcagtactgatacaatcacctatgtttagacttgatccatgtccaagtgcacttctttttaggttttatcctcaatggtgtttacgcatttcagttgaagaaaaccagaaactttgagtatttgattctacaaattgtgcatgcatatactgatgtagtgtagtgttttcagttagtggggtccctgtcttggggtgaaagagtgtcctttaatgttgagctattctcatattcaaactttgtcttttgctgtcattatatgtttctcttctaaatgtcttctatcttgtatcattatgttcattccagcgtataacagtttgctctaggtttctgcttaccttttgaagttcattccttttataggaagcccttacccaccttcttggtgatcagaatgatcttacacaagatctggcatcccaaggcatgagtattgtatatgagcttggtgatgcatctatgaaggagcagctggttcatgctctcgtgaatacactgtctggcgcagcaaaaaagaaaagggccatcaaggtgcacactatgtttccagtttccattttgagagaacctggaatacccccgaacccgtacccaaaaaaaaaactgtaaaatgattaatgttttctctgtctgcattagctgatggaggattcagaggtttttcaagaaggaactattggcaataatcctactggaggaaagcttagcacatacaaggaactttgtagccttgccaacgagatgggccaacctgacttaatatacaagtttatggatctagctaactatcaggctgctatcaattccaagaggggtgctgcttttgggttttccaagatagccaagcaagctggtgaggcacttcagcctcatctgcataccttaattcccaggcttgtccgttaccaatatgatcctgataagaacatccaggtattgaactatacacttccattatcacatatgccgtgttttgttttctgatttttgtgtttggtttaagttcttaaagtgtttgtatgctataaccttatgatccttcattgcaccaaagtgagtatgaatcttgttagctatggcctgcaaaatttcagcaactccacagctgaggtcgtatgcatgtttgtaatcttacctagagaattattggtttgttttttccaatagtgtatagatataaaagtataatgcggtcttcttgttcatatagaatccaaggcagtcaggaagtactacagtgcatcagacagctcagattatctgattttgatcacttaactatttcaaaaatggttcttcctagctaactgacactttgtatttcattctaggattctatggcacacatatggaaattaattgttgcagatccaaaaaaaacaatagatgaacattatgatctaatagtagaagatttattggttcaatctggatcgaggctttggcgttcacgtgaagcttcatgtcttgcacttgcagacattattcaaggtcgaagatatggtcaggtagttaatttgttttgctaattttgatttttttaaaaaaaaatttatgtaactatgttgttttgcataagctatgaataactggttttggatttattttgagaataaaatattgcttatctttccctttgttaaggtttctaagcatttgagaaaaatatggattaccaccttccgagcaatggatgatattaaggaaactgtgcgaaatgctggtgacagtttgtgccgagctgtaagcttgttgacagttaggctctgtgatgtgtcacttactacttcatctgatgcaaatgaaacaatgaacattgtactgccatacttgctttctgaaggcatactcagtaaagtttcaagtgttcaaaaggcatctataagtttggttatgaagcttgctaaggtatactcattgtcaaattcaaaaaaagttatctgcattaacattttagtggcaattttttgctccactgtaattttctttatgtatgctgctgtcatgaattgaattacatgaactaactgcccgatgttcacagggggctggccctgcacttaagccacatctgtcagaacttgtcagctgtatgctcgaatgcttatcaagtctggaggatcaaagattgaactatgttgaggtatgctacttttcttggtttttgttaagcacggatgggtagtgattttccaagacaattaacagtttctatacttcactcatttctgaatttggaccaaagatgcatgcaggaaatgctggcatccaaactgaaaagcttgagagcttgcgtatagctgtggctaaagattctccgatgtgggaaacccttgatatctgtttaaaagtttttgacaaagaatcactggatcttttagttcctcgtctggctcaaatggttaaatctgctgttggtcttaatacaaggttagttttgatgctactatgaaccttgtagtataattgaaataataaattgttgcttttcatgtacttcaatcttattgtcattcattttatgtttgtcttatttcagggttggtgttgctagcttcatcaccttgttagtacagaaggtcatggttgaaatcaagccatatgcggcaacattgctgaggttactgtatagtgctgttctggaggaaaagagttctgcagctaaaagggcctttgcatcatcttgtgctgcagtcttaaaatatgccagcccttctcaggctcagaaacttattgaagataccacttctctgcatttaggtgaaaaaaatgctcagttgtctgctgcaattcttattaaatcttatttaagcaatgcagcagatattcttagtggatacaatgcagttgttctcccagtaatttttgcttcaaggtatgtgaacgcatgtagtcttatcttagccttttatcttctctaccattgctaatggtattacagatattaatgtgttttgaagttcactatcagtctatcacagaaacttgaaatgcacatgttctttgaactgtactctgcaataacaaaacttattttcagatttgatgatgacaaagacatcggtgcattgtatggagaactttgggaggatattcctagtagcgaaagagtaaccctacagttatacttaccagaaattatctctcttttgtgtgattccatgtcctcgtcatcatgggctgggaagagaaaggtgaagcctctatttcattattttactgtctatacacataaaagtatcatagcttggaatacacttacgatactgtgtgctacttgcagtcagccaaggctataaaaaaactatgtgatgctctaggagaatccctgtctgtgcaccacaataatattcttgaatcacttttgaaagaactacctggtcgattttgggaggtaagtagtactatgatttttctatctgtggcatatcagtgaatctttccttttattcatggaataaaataggatggaatgcttagagattttcaagaaacattatccatgactaggttcataattcatttttttcgccatgaattaccacagggaaaagatgctattctggatgcactcgctgcactttgttcgagctgccatactgctatgagtgcagaagactctggcatgcctagtgttattctaaatgctgtttgtgctgcatgcagtaggaagtcaaaattgtaccgtgaagcagctttctcgtgtttgcagcaagtaagtatctctcttctctaccctgatctctatgtgaaactgaaatttgtggctagtggatactctaaagcattttactgtttgtggaccagacttttctttgataaaaggatttttagctgttagatagctgtgttcttaacctagtgctcaaaaggtttatgatcttagatgcaacaaaattgatgagaaaattactttcatgcttaatactccctccgtttcatattataagtcgttttgacttttttcctagtcaaatttatttaagttagaccaagtttatagaaaaacaatattagcattttcaccacaaaacaaacatatgaccaaaatatattcaatgttagatttaatgaaactgatttggtgttttagatgttgctaaatttttctataaatttgggcaaacttaataaagtttgaataggaaaaaagtcaaaacaacttataatatgaaacggagggagtgggtatttagtttgaagatctttccggaaatattgcaaacagctctcttctcaaaatattatggggagcaatctagattgtcagtgttatattttcacaaaagacattcatcgggtttaggtgttgtgttgggatggcattttgacattttctatatattagaatttacttagttttctttttctttctttaccacttttcaggtgattacagcattcaaagatccaggattcttcaatattgtttttcctatgctgtatgaggtttctaatcgatctgtcatttgtaaaacaaggaactcatcttcactcactgcatcctctagtgctggtcagtcattaattccagcccctcactgcattcaactaatgtcaatgctggatgaaacatcttgtaaatgaatactagaacttctattttattatctcattctttatcacataaatatgatatagtactgatagttgccatcacaacacaatgtttgaaaaccttgatgggatcggcttaacaagacaactttagaactatacattgttgcccttaatgcagcatacgtgcatgacttcaaaagccacttatcctcctttattttttatgtattactgtcttctgcagagcaagatgaaactgaaggtgtttctgtttctcttgataaggtgctcaactgtgtagcatcttcaatcactgttgctttcctgcaagatattatcaaccaaaggaagaatatcctggaaattattttaaattctctatcccccgaggagagttggcagagtatgtatcttgtatgcaagatctattataattctatgcaactgtttttgaatctcacttatttgatacatcaccactatcattgatgctttttttatggatttctatgtgcagttaagttgtcatcgttcttgtgtatcaaagagttgtgctataaattccagaattcagatggtaataacacttggcctgaggaaacaacttacttggttgaggaggtacatcacatagttgtttagtcctacacaactgtactctttagttcagtatttggtttcttcattttcctgacaaatttcttttaatttgaccgttcagttatttcattcaacagcaccaaaagttgtggatgtcatacgcttagttaagattgctcaggtaatcatcagtatatctagccctcaccaattcatattatattgtgtttgctcatatttattacaatctcatatagcacttttaaagtttcaccataagataatttgttgtcttccttctaatgaataaacatattgtagtttactacttgtatgttttatggcaatgggagcatgtgaactgaaattgcactggacggagctgttgtgggtgttatactaaatttgatgattgcataacaccatttggcaccagtttttttatagattatttagagatgatacaaaattattcatcaaatattcagggaaaaataagaacttgtctttagaaaaaaaaaaggtggctagtctggtggtttgatgaaccctggtgcacatggtttacagattactgctttgcttctttatgtaacagttcatatgcttgtttttggcttcactgattttagaacaaacagttacaaggtttcttgcactgactgtaacatataatttatatcttgaaaggacgagctatccaagatttatgtaaaatataattgttacatactatgctagagtatattagactactgtatattgcacaaaccagcagtttctggatatgcaatctgagtttgaattgccccctcatgactaacttcttctcaggttcacaccgctgcttccgagtgtctccttgagttgagcaaattgtatagagactttccattggttgacagaaaagggcccaagttctcaggcgaacttgctgaactttgtgagtcggaaaaaagcgagcaagcaaaggcatttttgaagcaatgcatggatattctcaaagacttcgaagatcccactggattagccatggagatggactaagtgaagctctcgaggttaaatcggcatagtaaatatcaaaaacaaggctgcgcatgtataaagggcgcgagcaccagggaaggtgggttattctcgcaaattggaatcaccatgtaataggatgagcgtttcattactggttgcatccgaaggaaattctgaagctttgcatccgcaacccacttgtgcaacatgccctgccgctgttacgatttaatgtttttctcccagaatgtagtggtgagctaccagagattggtttcatgattctttcaagtctcaacttctcctagaccaggcccgcttacatctggcagctttcataggtcataaactgccctcacagaccaacacatgcccacacatgcttgcgcaactgcgacacacgcgcccgtgaaaactcgggaagaatttcccgatcggtcacccatccctaaattgctccaggccaagcacacactttgtccacactcgtgcacactcgggaagaaattctcggccaagcacacactttgtcctcactcgtgcacacttgggaagaatttcccgatcggtcacccatccctaaattgcttcaggccaagcacacactttgtcctcactcgtgcacactcgggaagaaattcccggccaagcacacactttgtcctcactcgtgcacacttgggaagaatttcccgatcggttacccatccctaaattgcttcaggccaagcacgcttaaccttagactctcatagttctttgaagattggcttccggaaaaaagttgcaacttgttgatatgagtattctattaattatattaagccttagaccaggatgtcaaaaaaggaaccaagaccttattatacccgagagtgatacttatgctaggaaacatatactcatcctaaagaacgatttttgtatgaagggcattgattattcaatccaagaacttaaacacaaatgtgtctatacatatatggtttctgtttactttcacccatattgggactaaattgagacggtttacaggttacaatcacatatgacttgtgtaaaaacattaaactgacgccaaccgatgtatcttcggacttcttttctgaatccctattatgatcatcagggacttaagtggttagcttgcggagagcagtggtggtcttggagcctgactgccttcccagatgcttggagatgtaatctccagcatccatgagcttgttgaggtcaacattggtctctatccccagtccatggagcatgtacacaacgtcctccgtcgcgacattgccggtggcgccctttgcatatgggcagcctcccagtcctgacactgatgagtccactatgttgatccccagctggtaatacaaaaggaaatgttagaccaacagagcatttctggttgttctgtgtctgtttttcagtaagatggtttgttcattggcattggcaggatgtgaagtgtggttgcttacttggagagagaccagtatgttggcaagggcttggccgtatgtgtcatggaaatggacggcgatcttgtccact

SEQ ID NO: 27360 - DNA, 7972 bp, Oryza sativa
gcatgttttatgattaggactgcaatgctttcaaaaaaacgtatcatcgcttttgaaagtagttttaaatgcgcaaaaatatataaaccaggaaatgacatgctgaaagcagtaaaggcaacaaaatcaatacctggtgtaccaacaccaatcgtgtctccgagtgagatctccgagcaacccatgtcataaagctccttagctacatatgctacctttgatggatgaattgtgccttcaacagggcaaccaaccacacatgaaacatacctatgacaatcaaattttgcaaattctcagatcagattgctgtctgttcattttaactttcaggctcgatagatcatcaagcttatgtgacttacccacggattcgtattccatgtttcttggcagaagttacaacatcatggtaccgaacaaggctttccttgatggtacaattaaggtttgacttagaaaaggattcagaggcagatgcgaaaactgcaacttcttttgcaccagctgcaacagcagcctcaaatccctggataagtggagataaggttgattcatcacaatagatcaaaagtcttcaaaaaacgatacgtatagatagtctattggtgctatggtgctagtatattgtagagtctcccaataatagaacagaaccagacatactctgaggttaggagttaacactggaaaccgcacatctggcacatgcttaatcccttcaaccacatcctttgcatctgctagctgcaactccaaattgagtgataaaggttagctatttgaacttgaactgctaccaattttatcgtgtttttgttctgcaatgaattttgcaatacaagttttacaagctaatgtcccaattttaacattttttgttatgtaataaattttgcggtacaagttttacaaactaatgtcatacaaaaaattgatagtgaaagaagttagatggaattatcagtaacaacttctgatgagaaattaagtgctaccagatatgcatgagtttctcatgcagcatgacatgctaaattcttagaaaaggcggttcgtttcttcacctaatctgagtaaatactgacaaaaaacaaatcaagagctatcgtgacaatctctcaaatgtctgtgatttaaattaatgtatgatactagtacacgccttcacctaatctaagtaattacctgtggcacccattttggggacacaaaacttgtggcttcaactactgatagaccagaagccaccaatttgtgtatcagttcaatctttacagatgtgggtacagtattcttctcattttgcagaccgtcccgtggtccaacttcaactatcttcacaaaccttggaaggtcccataaaacctgaaaaccagttaatcatcaattgagaaaaggagtaacttgtggtaatacattacgatcactatacttcatcagcggccattttcacttatttagttataaaggtaaatagagaagactgacatgttgcattgccacagtcataatgctacatgtgagttcattccttctatttgaggtggtctgatgaaacctataacaaggaaatgaaattgaatacacccaatcacccatgagccatttcagttacacatgatcaaactaccttccgtggaagagctctgaactccatatccaccccattgcaggatgaatcagtatattggccttgcatatgccatgaatgagcactgctgtgaaagatcgtctgattgttgccaccattgcgatgcttgtaactgaaagtaagttcacatggtcatatcatacgagtttcagggcatacttcagtaataaaattctactgtcactaaagtaaactaacaagttcctgaagaaaaatagaagtgttgcaaaggtggaaatgtacatgatttgcttaaacctctggaaatactggaaaaacattccgcgtcaaagtaaaaataccgacaaagcaacaactaggaaaggaagaaatgtagcacggtaaagtttgcaacagtagaacactagaacttacttgttggtgttgctgtcatcaacacttgctctgcaggcacttggagagaacctttcaagtctgttaatactcaactttggcaggtccccaagaccaagtggctcctcgaggcttgacattctgtgaagcaggaggcgttacaattttaacaactatgttgagatgaatcttgatatgttaatatataaaggacacgcccggggtgggggagttgaggaacatagtcagaaatggtgcactagtccgcatggaaaggaacgtttgaaatccaatccaatgggactcgcaaaccatgtccattctcccggcatggtcaatgtgcagtgtgcaatgcttgcttgcacaccggaactcgaacttggccagacttcttctttagatattgaattgcacatgagatactcaccctaattaattatccatcaagcaggtctctttaaccattcaatcatgaaatgccatgcttgatgaactaatatatgatgatgcccagtaactagcagcaaaaatggaacagcgccaactgctctgtattaattcattttttttccttgtaaatactcaaagcaaaccaagatactacaaacccacactgcaacctctccatgaaaccaaatcaagcaggccaatcggcaacatacttgctacgaagaacagggaacagaaaggggaaagaaccaagaagaaacaagaaatcacatacctcaatcgaacgacgaattcgaagcaaacccgatcgaatcgcacccgagattgagggatatggggcaccgaactcaacaagccttacttgaatccgacgcaaaggagagagcagagcgccgaaaatggaggccgcggcttgcgcctccgcgtctccgccaagggaaaggaactggtcggcgaggtcgcgcgtggacccggttcacggtgagatccgtggtgcagcgccctgggccccaggtgtcagtgggagttggctcacgggacccggtccagggagttgagtctggcgggctgtgcggacgcagtggcgttggtggtaggtctcgttcccgttttctagttcggtgagcggccagccgaccacctaaaaaccccggactccttatcggattcggtttttggataattgtgcattacccgttaacacttagcagagcctggcattgcatttgcatggtcatgaacccatggtcttcatatgtagtagtagtagatttgtagcgaagaataatgatgatggtgattatgaaaaatattcatggttgtctatatgttcagatcagaatgaatcaatcagctgatacgatctggatttgtggtcttgtctcatgacagcaacgagacccgattcgcaaatttgtatttaatgatctctgttagtgcagacgtggtcagctgagttccagaagaaaaatcggattggaaggagtggtggccatgattttgttgatgtatttcctcctcgtgttttataagagtaaccatcatccgtcctattcaattcaatttatggttgaaatagcaatcgtcattatagcactagataaattatacatacgtgttttgcaacaaatataaaaaaaggacaaataatatcaacgtatatataaaaaaaaggaaaaaaatcaaattgaggccgaaaactttacacacctcaactattattctaaataacgcccctcaactttaaaaccaggatacccaatacccgtcaactattaaaattgtctggctgatttaccctctcaaggttgttttcactagattaaaggggccttcatgcatgaccagtcagccaaatcaaaattaaaaaaataatatggatcccacattcatgcgttggaggagcaattagttatctacatgatttgaaagagctcaagcaataaatctcattgtgcaaattacaattgctgtggaggaagattttcagcgattcgagcattgtcgccagggagaagataagaggacactaccagggaagaaaattacacaggacttctttgcgtgacagctgtataatacgaatctcaaagcaacatgttttcttccctgatttccccagagacttgacgagtaaacgtgttctcctgctgtcgccgcacgccggtcccaagtggtctcactgcgtcccctgcaatccttggcggtgccccctcactctggcccttccttgtgtccttgtgggctgtggccctccgtgcctctcgtcgcgtggccaacggtgctagctgcagctcagtggcttgcacgtgtcgaccagctgactctttgttagactgactatgcaggtggtggggattatcacttagttctcgccaacacttacgttgtctcagatgaggcggaccaggaggttttttcggagctgtcaattggaaagaagttcgacacctaaaagataatagagtaggcatacctataagacttcaccatggtcttggtgatgtgctaagcaatggtggttgcagggctagagattggctcatggcggagccaagagcatctcactaacactagtatcgacaattacgagtttgcgacgatgccaagattgtgcacaccttatcgacaaaatcatcacttgggtgcttgatagagctctcgacactttaatttcctcatccttgtggcatcatttttgcagtttcgtccatgtccgacgtggaggataaggcaaaaataccaaaatgaccttgtagccacctataaggtggtagcgctcttgttgttgctagtccagtctaacttccatgttgctagaggcccaaagggcacctccgcataaacaaagctagagcacagctctgcatggcatcctccctatggctctagttgcctagagtttggtaggtaatctttcctgcacgcccccctgactttgcattgcatccttcggtgagctccgtcccctgcttttgacgtggcatccacctttgagctctccaccgttgtttgcatactcccactgtcccacatctcatcgtcctcgacgtatccaagaataattacatcatgccaaaaatatctacacaaattagatgagttagcaagcttgtcctctaatttgatatgcataagttgatataaatgaaattggatggatgccaaacttttgagctaatctaattacatagtagtagaagggaaaaaaaaagaaataacaccataaagaaatcatcatacttgtttctggtttcaatacaaacttttttcctctaaacttatacttcctccgtctaaaaatgttgctaactaggatgagattctgaacggttaaattcgaggacctatattttcaattttctgcgcttgagaaaataaaagggaaaatgtcatgtctcctcccgttaaaccctagcttaagcccccttcctcttctccgcgcctccgcctccgcctccgcctccggtctcccctcttctcacacgctccggctccgacggacgattcccacccagtaatggcgatggatttggacgagccgctcgacgcggagaagggcgaggcggcgctgcggcggctgcgcgacgccgacccggtcctctacctctccccctccgacgacctcgccgccgccgcccgtgaggcctccaagcacctctacgcctcgctcgtccccttctcccccgcgcagccgcccccgctctccaacctcctcgcaggccccgccttcgacgccgagcagatttggtcccagattgagctgctctcccgccccctcatcccccagctgcgccgccagctccgccgcctcgagaagcaacccccgtctcagccgccgcctcgtacggaatcgaagtccgctgatgccgaagagaagtcagaggaggaggacgaggaggatggtgaaggtgacgaagaattggaggagttggacgatgtagatgatgaagaggagtcagaggaggaggaagaggaagaggaagaagacaaagaaggattggaggataaagcagggaatcaagtggaggacgagttcttcaagataaaggatctcgataagttcatggtaaagggggaggaggcggaatatggtgggggtgccaagcaagggaagaagaagaagaaaacagagaactggatggaagaagatagtgatgaggaggaagaggaggaccttgatgaggatgaggacaatgaggatgaagaagatgacgatgaacacttggacgtaagcatttcgtaatcacatcccttgttaaattcttagagaccagtattagctctcataaagaagattgatatatagaaccactgatctagaagtatctcaggagtagacaccggaatttctgtagtcgcaaaagatagtatctgtattacctcaggaaattgagcatatggattaagttttaaaacagtttcccgcttgagctaataggcttatattgggagctagcattgggtatggtttaatgcaagatgcatgcttgctaaatgtgattcttaagtatcgttttttattaatatagttggaagactttgacgatgaagaagaagaagaagagggtgcagttggagatataatgtaagcctttatgctattttctgaaaatgctcatatcatgattgatagaatcacagaatgcgaaacagttcgggtttccgcacagtgtttttttatctttaagtgattatatactgggatatcaaatggttttaactacatttgaattgcttttttgaagatcggtatgatattcgtagaaatggaaatggtagtcatttataaatttgaattgtagaatcacttgaataattcttcacaaccttttcctattttatcattttcatgctcgacacataatttgatctgtttaagttaactgtcatacaatatgacctgtttagctcagagaagggcatacaaaggcaaatggagtaggaaaacaatgggctccaaataatggcatggaatggactcaattaaattagaaaacattaagtatgtaagacaaacatattacattttcatgtaaattgttaaaaaaatgatgatagcacaagaaaatggatttatgaaaaaacaattagattaagcataaggcaaagaagaagtttgttgaacactaaaatataggtataaccacgtgtggcaatgtgggaatagaatgctgtgaaaaaaactgccacattcgcataactcataggataatagcaaaggatacctacaagtttatatgtcatgtacaaaaaggttgagacacaatatcaccctaaaaaacacagctttttagcatataacctaggcaaaactgagctgtaagttctgtctacttcttagccactgcaaatgtccctggaaggataagagatctgattagacaattccaagatctcaccatgcacataaatgcattacatcattctttcctgccttgtatttgtccagtggagcctttacagaagtttccatatgttgtattgactcagcaaagcttaatcgttatgcccagacttcggttgtatttaatatttgttcatttatagtattatgctttgaccagcaaagatgatttttccaggtataaggatttttttgaggaagctgatgaccaaaaagtaaggaagaaaggtggctccaagaaagttcaattcaaggatgaaccagatgaaccagaagttgatgacaaaaatgatgatggaaatgttagtcaagtactacacttactcacttcaatataaacaagttaggcacatgtatattatcagcatattcttccaattctgcaggatgaacagggtttgtcaactcacgagaaggcgcgcctgaagatgcatgctaaaatagaggaaatggagaaagctaatcttgaacctagtatgtggaccatgcagggagaggtaatatataatatgtttatccattcattagtttctagaacaaaacagatttttaactttgaaactgttctggtattaaatcatcagctcatggtaaagaaaccacttgaa

SEQ ID NO: 27361 - DNA, 2585 bp, Oryza sativa
  unsure (1)..(2585): unsure at all n locations
ctgtttctattgttaaggactttttttttcttttgtttaattgctgtgtgattgcatgtcatttgtttttagttaaaagcaagctgcaaaaagaagaaatcctacatgtcaaagaggaaatcttgagttcttctcattgaatacatgtcattctattatgacctccccccaccacacacacacactcacatgtaaaaaaaaaaaaaagaaatcttgtatcaatgcttgtcttgattgctagtgttgctactttattcaatattttcttctgtgtgtggtgatggtggcaaaggtacttgcaatgtctttgagaaagatcttttgaaaggaattgataatgctgtacctcatgagcatgcaattgattaaagtttgttttttttatggtagaagcagacatcgatttcttttgaaaaatagagaagtgattacttgtgatcacattgttgttaacttagtactaactatgtagcaataagcatgcaaatgggtcataccgtcatactcggtgatttttaaaactgtaattttttgaggtaccattatcaacttggtggtctttataaatttgttcccaccatttcattggtgctttatgcatattttttcccctgtaatgatattggaggcttgctgcattgacctaacttttgtttccacttaggcaaataccttatttaagagaatatgcttgaagttggatgcactatctcatttccactttgctccaaagccggtatggaatagtgacaagatattttacttacatttgtaatttctttcagcgaagttaactaacaaggtaaatattcacttttcaggtcattgaagatatgtctatacaagcaaatgtaccagctctagcaatggaggaggtaaataaaatccttcatttctccatgatgtttatacggtgagcatttcatgtcatgatttctctctctttttgcagattgcacctgtagctgtttcagatgctgcaatgcttgctcctgaagaaatttttgaaggaaaaggtgatgttaaagaagaagcagaacttacacaagctgagcgcagaagaagaagagctaacaagaaaaggagatatgcaggtaaatgtccttatgttttttaagatacattccttctagcttttagtataaatattctgacctgacatggataatgctcctacttcctcattcaaaacatttcattgttcattcaaacatggaagtagtttgagcaacccaaattcaattatagctagcaatatttccaattgcaaagttgggtacgagaatagattgaggcctgctagtttttcatacttttgtaccatacaggatcgcataaggagaggccagccaagatgcagaaagattaactcaatactggggaaacgcttacattatgaacaagtagtcagccatttttactgttcagcattacctcctgacccaaggatccattcatgatgagtattgtgcaaatggcaacgcagcattgacagacatggaggcagagagcaggctaggaaaggtagggtgaagggttgggctccaatgcttttgatcacaggatctgtactctggtggcacaacagacagacagctgttccaggtcaaagaccctgacgtaacccatctcccgtcccacaagaaaaggcgagcgaacgtattggaatgtgggatgggtaaaagaaatcttttgtttcttgttacactagtcgtagtagtagtgtagtaatgcaattttacaatatcattttttacactatagagtatcaatggagtgcatgtattcagaggcatatgttctgtttttgatacgttagggcattggtttgcagatgtctgaaatttgcgtgcggtgtattagtatcattttgatcctttgctttttttgccacattgagggattagattgatctaataaaggtgatgcagctatagactatagcatggcaagaaagcaaaataaacatgggttatgggggattgtactatcagctacagtagcaggtagagatgcctgtacgcaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 27362 - DNA, 686 bp, Oryza sativa
  unsure (1)..(686): unsure at all n locations
nnnnnnnnnnnnnnnnnnnnnnnnnnnnnnnnnnnnnnnnnnnnnnnnnnnnnnnnnnnnnnactttattatattctacaattgtcctcctcttatcgcatcctaagctttggctgcgatgagcaggtccggtatgaaccgtccatatccgaacatgtcaccaagatgaaagatgtacggtcatattcgttttggatgaatttcaaacgatttggtttcctaagaattaatttctataaaagccattcaattcattaaatgtagatacagaaaaataaaacaaattccttttctacaatgtgtagagagaaaacataggaaattttccattcactcaaacctcttgaaatatgcatacattcatattctttcaccatttctattcgtaatttctgtgttaaaatttcttcaaaacgaataggccctacatgatttatgagaggaggaagctgaattccaaaccttagagattagagaacgtagtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 27363 - DNA, 692 bp, Oryza sativa
tggattttgcccaccgtctagtttcacaattgggaattttatcatcttttttgcatgaaaagaaacatgttttttttatccagtgtaaccgtagttaattatttgtatttccacctttagtaagctatatatatgaaccagtattattggtcacacatcaatcagtgttacaagaatttttgttggaaagaaagggagggttcgttgaaagactgtacagaaatattttctctagtgtagccattgtttattatatgtttttgtagcgcttgatgagtgtgctatatatgaaattaagtttttttttctgtcgtactgtccactgaaagcataacaagatatttccttggaaagaaagggttatgcacagagatagcacacaggaaattgatgactattctggtgtattaaaaaccgagtaccgaaccttggcgccactcttctcaattttattggtttatcattatttagttcatattcatgagttgtttgtcggccagccagctgaataatgtcacactgcatgcatgtgccaagttacctgtgaggataaaaatctctccctagtttcaaatggaagtgacacacttggtaaatctatttgaacttgcaaaggcagaggataggccgtaaagttccaggtcatgtgtttttctgttcctgtttccaacctgaagctgaaagatggagca

SEQ ID NO: 27364 - DNA, 764 bp, Oryza sativa
  unsure (1)..(764): unsure at all n locations
tacagatctacaatagcaagcaaaaatatcgcagcaaaccaaaaacttatcacaattcccaaaattgcagaaacctaggcctagactatggataagtgggcagaacccacaatgctcttcttgccgctgggacttccatgaattctacccctccatctttcacattggatatcttcaaacacgccttatccccgggataaaacatgtagacgcaatccgcctccagtccacgatcgtcggccgaacacgatgcaccgaaatacccaggagctagcaggaaagcacggccaccaaggtcatcggctctgcaccaccgctgctcagagaaatccatcttatggacttgggtttcaccgtcaatcatgtcgcagccaaagccatagaccaggctgaccatgtagagctcctcctcggatcccaccaagaacaccttcgccctgttcgcagcctcgagctctccaccgagctcgagcgagctgaacgccggcgtgggggagaactctgagcacaccgatgtcggtgaggctctcgctgttgaagtagaacttgccccggcaagcggcgatcgggcatatcggcaccttctcgtgcaggtcactgactggatccaagagctgcgttccaatgtcgtactcgtgtctcgcccacttcttgccgtcgacgccacagtgccagatgacattggcattgggctcgacaaggnnnnnnnnnnnnnnnnnnnnnnnnnnnnnnnnnnnnnnnnnnnnnnnnnnnnnnnnnnnnnn

SEQ ID NO: 27365 - DNA, 707 bp, Oryza sativa
  unsure (1)..(707): unsure at all n locations
nnnnnnnnnnnnnnnnnnnnnnnnnnnnnnnnnnnnnnnnnnnnnnnnnnnnnnnncatgccgtgttttcgtgtaggccccacctccggacatccagtcattgcagtttcttagcagcaatcctcaactgggtcaccaagccacggatcaaagccagtacaccattccagtctgggatttcctgtgatgtacgctgtgatatactagcatgtaccatagtactagcaatctagctgtaaattatgtaatggcaataatgtagaaactaaattatgccagcttgagcagcttttctatgttagtggaacaattgagcgcggctaagtctcggattcagccttgtgcgcaggtcaaaagagtgccatcaagaatgtcagcagctggatactcgaatggacttgtgtagtcaagttgtagtgttgtacaggatatgtcaaatgcaagagaaaggaggaagcaaaacaaggctgaactgaagtttatattcctctgaaacgaacattctttaagcttagcagaaacaaatcagtctactgagtacaacatcaaaacacaatcctttcacgagcaagtgacaggttaacaagaagcgtatttctcacggtggtcgtcagctcccaacaaccaagcaacagagaaccgtgcaggttgttggatgaaatgccattgttcagttaactaagtacggcaagggatttctgatcaag

SEQ ID NO: 27366 - DNA, 1235 bp, Oryza sativa
tgtgagtttctcctaaatctccaatccctccaaagaactgccccttttcagaggttttttttttttgactgataactttacagagtttcagtatttaaaatatttggtgcattagacatctttgagacaaataagtaatttatgttttgtgataagtaatttataaaccattaaaattcagataactggtgttcactcttcagaagttctggttgcaatgcgctgctactatcaggttcttgcgttctcttcttttccaagtccaattctgaattctgaattctgaagcgacttggtctgatgtcctcacctctcggtgctgatcatcaacaagtaggttgcagctcttccatcaagtaggacaactaatgctctaatctttcggcttcagggtggaaacaagaacaaattaacatacataactgtttacctggaatttcacaagctatccctcttctacaagttcaaatatatttaccaagtgtgttactttcatttggaactagggagagaatttcatcctcacatgtaactgggcacatgcagtgtgacattatccaagaaaagtgttttaatcccttaatgggacatcaacttatttcttgcatgtgcactaaaatattaaaaaccaattaacaagatagtttaatataagatattttacagcacaaatatacaagttaaagtaacaaatatgactgaatgtatatatttaatttgttatttttatcacaacctgtaaatgtcgaatttgaccttatatgcttgtggacaatgtgcctcatattaatctattttgttaatttttttaaaaaaaattatggttatttgggtgacataaaaaaacgagtattcagctacgtgcagtattttctttcccctgaatccactacttggatgttttcgatagacatgcatcttaggaatatgaactaaataatgctaagtcattactacaattgagatgagtggcgccaaggttcactactcagtttttaataaaccaaaataaaggtcatcaattttccgtgtgttctctctgtacatagtcccctcttttaacgaaatatcttctcatgctttcaatagatagtacgatggaaaaaaatataaaaatgttaatttcatgagatttgttacggtccagcagatggtacatcaggtaccaaatgaaatccaaccgttcaattaccgtgggcatgattggaaacattgtcaggtcgacttaacattca

SEQ ID NO: 27367 - DNA, 692 bp, Oryza sativa
  unsure (1)..(692): unsure at all n locations
nnnnnnnnnnnnnnnnnnnnnnnnnnnnnnnnnnnnnnnnnnnnnnnnnnnnnnntcatatagctctactcttttgtccattaatttttgccatgtttgagctccgggagtaccatttctggaatggtgatacaccagttacattatcatgctcaggctgttacattttcacggtgtaatggaatattttcttttaatatgcctttttcccccttatcctggaggtgaaaattgggtttgatattgaaatgcgaaatgtgtgaacaagacatttttggtacttcctccgtccccctaatataagagattttggcatttgcttgcactgtttgactattcgtcttattaaaaaatttagaattattatttattttatttgtgacttactttattatccaaagtactttaagcacaactttttgttttttatatttacacaaattttttgaataagacgagtggtcaaacagtgcaagcaaaatgtcaaaatccgttatatttggggacggagggagtagttggtggcagcgtgacttaaactgggattgctgtgtcatgctagatatctcaggagacggtattgttttggtcagagttaggggaaaagacaaatttcttgatgtactgatggttccttttgcaggatttgcccaataaggttggaagcgttaatgtcttttcttggataagct

SEQ ID NO: 27368 - DNA, 618 bp, Oryza sativa
attgtgtgactgaagagacccttgaaaagggctcattttcatgatgtgtttctcttctttcctgcatggtaggatggcttatgtcttaatgtgatccgagtggcttttccaagcagagatgttgacctgcagaacatcttagaaggaacacacctatatgagttcgactgctagtcacagtctatgagatttgggtgatctctagatactcatgaaaggcctggagtatgacttataagctccaacccgagggaatactaatggttgcctagtatcagttatggaattgagtgaaacctaactgcacaagactgacaattcaaggcatagtccattgttcagttgtggtcaggtgtagctccttttctaggtgaaagttcaacttaacagtcttcaccgaaacactggtatataaaagctgctatggaatagagagcattctcatgagccttgaaatttggtggggattgttagatttaattgggtaattaatccatttaaatcaattaaatcaaataaattccaaggctcattatgctaggaattcatgtgaattcattcttctatgggatatcaatgggatgaagagttttgagaattaatccatttgattaagga

SEQ ID NO: 27369 - DNA, 793 bp, Oryza sativa
  unsure (1)..(793): unsure at all n locations
ttggttttgaattttgtcaaccatcacctcataacatcattatattgcccatgtatatactctttccgtctcaaaatataagcatttttttagatcctgacacggtcaccgagatgctactttaaccaacaatatctataaaagtaagatgttttaaataaaaagagttgcatattatgatagtttgtttaatgataaatttaggaacgtcaattttacatgattggtttttttaattttgttgctattaatggttaaagttaaaattgtttaacttgtcaccatgctaaaaatgttaatattttaaaacagagaggggacatgccagcatacatacatatatatatatatatatatatatatatatatatatatatatatatatatatatatatatatatatatatatatatattcccacttccctgtagcccacgctgctcctctttggacatggtcgctacagaaaataacacattacaattcagtagtggtcttgctttctcactctctctctcttaaaaaaaaaacgttttggcctcagaaatgggatgtgtcaggaaaacacattcgacgacataggcaaatctgacgactaacaaggatggtcaaggctcctgagtgggtatatgtgcagtggctcttctagattggccatgcggataggtgtcctcctcgtctttgctctattgatgtggagtattagcagccttttaacttctggcaactannnnnnnnnnnnnnnnnnnnnnnnnnnnnnnnnnnnnnnnnnnnnnnnnnnnnnnnnnnnnnn

SEQ ID NO: 27370 - DNA, 1242 bp, Oryza sativa
  unsure (1)..(1242): unsure at all n locations
cgcgcacatgcatggccacatgaagcataattaacttcgctgtgcagcacacaacattcactgcttatttctgatatgcatcacaatatatgctaagagagtaagagtctatgttcttcttctacaatgagagcatccatagtttgggaatgagcgacaccaggaaagtatttttgtcgatttggcatggttgtagttcaggtttgctcaccgttagcaccagttcgtgaaagcccagtgtaagtgtgatttcttcggaagtgggtgtgcccgtgaggcaactcaacatcctgatccctcgtagaggtgcaatgcatcgtcgcggtgtggtagcatctgatacaaccgtgttggaatggagaagtaccgggtacacgggctaaattttctcatgttgcgcgaaaacttcagtatacgttttgttgtcaatcatttgagctattctagtcataggactagtagtcagacatgctggaaaaggttgaggggataagcggataatcccacatcgaaaaactaatgaaatgtattaacttttcacattattaattgtctctagtgggctagcctccatccaagcacacaatgaagcgaaagtgaaattctatttatttcttacttttaactaagcaggctaaaagctaatctatgagtcccatccaccatctcatgatcacatctattgatgagagcacactgtccgtgttgatatatgtaccctgatacccacgtttctgtgctcactctcgagtcttgatatagccattatagcatatccggtgaaaacaggtaaagtgatagaaactcatgaaaatcatatctaaatattttgtaaatcataaaaaattactaaagataagtgtagatataaaataaattcttaccaaatctcatgtacaaacttaacttcatttgggactaaaaatataaaactaattttgggtgaataataacaattaatatgacactattcacctgagatttgtcatttttgtttctctcaaatgaaattaagtttgtacttaagatttggtgagaatgtatttcatatctagacctatttttagtaggcttttttataaattcataaaatttctagatatgatcatttccacgagtttttaacacttactcgttttcacgtaatatttccccttatatatgggggctcangtcagccatgcatgaacgatgaggaagattagttcgataccaagtaaactggtacatatatcgatcaag

SEQ ID NO: 27371 - DNA, 22564 bp, Oryza sativa
  unsure (1)..(22564): unsure at all n locations
agggcgaattcgagctcggtacccatctatgagtcccatccaccatctcatgatcacatctattgatgagagcacactgtccgtgttgatatatgtaccctgatacccacgtttctgtgctcactctcgagtcttgatatagccattatagcatatccggtgaaaacaggtaaagtgatagaaactcatgaaaatcatatctaaatattttgtaaatcataaaaaattactaaagataagtgtagatataaaataaattcttaccaaatctcatgtacaaacttaacttcatttgggactaaaaatataaaactaattttgggtgaataataacaattaatatgacactattcacctgagatttgtcatttttgtttctctcaaatgaaattaagtttgtacttaagatttggtgagaatgtatttcatatctagacctatttttagtaggcttttttataaattcataaaatttctagatatgatcatttccacgagtttttaacacttactcgttttcacgtaatatttccccttatatatgggggctcaggtcagccatgcatgaacgatgaggaagattagttcgataccaagtaaactggtacatatatcgatcaagtgatagcctcggaatgagagatgtcgagaaaacatctagatcgacaagatcatctgctacatatggtggttaccgtgcttgtgggtatattccaacctcgatgtgattcaaaggtttatatggttgtagtcacggttctcgggggtgacgaggtaggaagtttcagttcttgccgtcatagtaaattcgtgtctgctacctggattgaaagctcactgtttcactttgatgggagtcttcgcccatatgcaacgatttttcatgtgactggtgcctggtggacgatcccgtcaaaatacggcttctagttttgtccagctctcattaatttgttccatccgtcttgtttttcacctaacaaattataaataatttttagaacgttgctagcaacgttatccactcgtccagtgagtgttaattagctttgaaatattcattaacagaatgtcaaccaaagccacaccggctcacattgccggatgaacttccaatcccacgctgttcgtcggtgctacacgccccagctaaatgggctaccattgcccgggccgcgcctagttatcgtgcgtggcccgtgaaactgaagaagtcaccggcccacatgcgggtatcgttctgactgtcagtcggaggctccgatctttagcacggagaaactcaccgttttcttcccacccacagcggtagagaaagaacattataaaagtagacaataggcataggtgtagggaccagggtgaaactctctctgttatagatttaatctcgagtacaagctaacctcaaatgtctcagtctaatcatgtatatatagggatcttagaagaagataaatcttatctttactccggttcggattgactcacaagaaatttatttgctagagatttgtttcacgatactgatgatgtgcttttggattttgtcaatcaccaccagctcacaaccacattacattgcccatctgtttacaaaccagcgtacaaatatatttccggctactcacttccttggagtccactcacgctactcctctttggagctggccactacagaaaagaacattacaattcgatgacaatgatgcaaggttgcggccgggggccttggtttccccagataaagatagtttgggcattgaaatgggaggcgccaggagaatacatttgactaagcagttggatactctttcgactaacagggataggagatgcttttggtgataaaacggtaagaagcgtgtggtttcaaccctaaagttccgtgtggaattctcgacgagaatagtcagagctcttgagtgggtacaagcacagtggctcagcttgatcggccacggtgtcatcttaccgcctcgatcctctttggccttaggctgtatgtttgttctgatagtttgtgcgtttaatcttcttccatccgtgatctacttgataatgcgtctttaagtttatatactcccagtaacacagtgtctgggacgagtattttggataacagggaaatacaacaagtatacaaagcatgacggtatattgtgcgaggtgttggtttgtgtatgtatctaatcatcttatcatctccttaatttcttccattgtcacactatctcatgtttcacctggttttctggtagactagagcacataccatcccgatgcctatttttttaatggataaaatctggcttttgctttaaagaaggtacggccatttattataaaatttgttagcttatagatagaatgaagacataaaaaacaccctactaccaataaaaaccaccctaccaacaaaagtagagatacatatatttagatagaaattcccgatgcccatagttgctctatcagaatgaggggcacaaggaccgtgagacatgtactacggcccagtttagatggcaaaaattttttgttttagggtatcacataggatataccccaaaagtgtgaggaagatagtgagcttttaaaggctgcatgccgtattcttgaaacaacggttatgcaactttttgtcaattttggatggaggttcaaattcaataattgtgtactctttatcttgggttggcagtctttaagttgtttcttcttgatggttggtttcatcttttaagtttctttgaacttcactcattttgagtgtgagattgtaataattggctgtaactctttgagcaaaggccggaatgctctattccattatctaaaaaaatcacataggatatacgggcacacatttaaagtattaaatgttgtctaataacaaaacaaattacagattccgccagaaaactgcgagacaaatttattaagcctaattaatccgtcattagcaaatgtttactgtagcaccacattgtcaaatcatggcgcaattaggcttaaaatattcgtctcgcaattcacacgcaaactgtgtaattggttttttttccacatttaatactctatgtatgtgtttaaacatttgatgtgatgggtgaaaattttttgttttggaaactaaatagggcctacatacaaatcaagaggactggaagttaactattgtacccttcctcggttccttctacttcctccgttttacaatgtaaatcattttagtatttttcacatttataatgatgttaatgaatctagatagatatatatgtctagattcactaatattaatatgaatatgagaaatgatagaatgacttacattgtgaaacggagggagtatttaactgaccatccattcatccaggcatccagttttgatcttttggcggttaaacaatgcatgcatgtttcacattaatgtagtgggtgcctagctagaaatgggtggcatccggaagcacacggagcaggcggtggccatcgtccatctgccatggtccatgagctcaagtgttccccaagctggcagagacgccagaaagggagtgctaacgtcggaggatcctggtagatttttgacctcacccatccatcaactgtgctgttacaacaaaacgggcatgtatagtatgacccatggatgaattgtggcagccacttattgtgtatttcctgtgttgcaaagagacggccgaagtacatgggaattctgagctgttcatcatagaaagtttggcaaattccatcaacctgaacgcctgtgcgtggtagatcttttttgaaggctgtgtattaattttatgattttctttatcatagactgggaaacaatcaacttaacagagaattaggagtcaactcacaactggaaccccccgtccccagagatggcatgcttggaccattgtgttccaactggcgttacagtttttggatagagatcgatgcaattcttcagatttcgcttagcctgcaagcacaggaccgtgaggcgaaagcataagtggcactttaattttttgaggtaaaagtggcacttcaattatcaatagaaatgtacctcaactagcttagagaataaaaaaacttgaaatccatttgcattgaattacagttattaatgttttagcgttgttaacaaaccatttgcattgaatttagaaaaaaaaatggaatatacgaggagaaccaaacaagcaaaccgttttttttaaaagcctcttaaaatctataaatattcatgtattattaagccaaactttgagtaatctttttaggtgggttgcagctagaacttcacccatagggaggcttaaaagccaccaatttataaatcgtacaaaaataagaaatttggcttaaaagttaatttatgtcaaaaagttgggccataataaagcgacattacatatcacctagaacccattatatctcgtctacttattatacttatatataaagaatccaccgtgagctaacttctctctaacaaatttcagtagtgcagatctcttgcccaaactgatagttacaattacgggctcagaccagccatgcttgaacgatgaggaagattagttcgatactaagaaaggtagtacatacatcaagtgatggtctcggaatgagaggtgtcgagaaagtatgttgaactagaggtctgcatctctgatccgatcggcctccccggagccgacgagcgcgccgccaacgccgatccgaagccgacggccgcgccagtttgaggaacctgtgactggggctaaggatctggactgtctgaacataaattttgttgagaacctgaacatgttatccagcacaaggtttctaatgatcaacagtcatgttacatacctaagcctgcgaaggcctatgcatatgcgtcttcttacagtttgagctgtaaactggtatctgtgcttaaagttttgtcactttcactgcaggaactttgattactctgaagagtcgatgaaccaacatgtactccctccgtcctaaaaaaacaaactctggtttccgtgtctaacgtttgaccgtccgtcttatttgaaaaaattatgaaaaaaattaaaaagacaagtgacgcataaaatattaatcatgttttatcatctaacaacaatgaaaatacaaattataaaaaaatttcatataagacggacaatcaaaattgaacacggaaactcagagttttttttttttgggacgaagggagtatattatagtttatttttttatacaaaatgctgaatcacaatgtatagttgacgccagcccgagtaaacagtcgtggttcaatcctttgcagttcatgggggatcaaaggcgattcatgggggagtcgatcatccgctactctacaaattcgtgaaccccgttaaaatggccaaaatcattcagaaattcagccttgtctttctcgttgaacccatcgcagtacggacccaaaattagttgctctgcttccgaagtaatctcactgttgagactataaatatactctgcattgttcttgaacatctcgaaccagcgagtcatctcagcatggtcacgctctttctcgtaagcctcgcaccagcgctcgtacaaggcccatatggcttcgtccgactctaagtcttttcccgagatatccttacctggctcaggatcatctatatcacaaaatacaacaacattgatacagtcaaacaacagcgaaattggaggcttgtaagttgcaatttggttggttgcgagcacaaagaaacgaaaaattcagatctactgtttagccttcggcttataaacacaattggacacgtgaattttgaagtttttcttcttaatttacttttcgtaatacacatataaaagttttacctacaaattatttttaatcactattgaaccaagattcaagacttcaagtactccttgcgaattgcaaactctccagaagggtatgggcagcagtgcaacattgggatagcatagaccttggatgctacacacgccgcgtaaccccataagatctctaaaatccctaataatcctaatagcctgagaactttggtgtgagagaaatgctaggatttttcgccgtatcgccgccactccagccaccatcgtcgcaaaaatcaagaaagagaccatgacctaggccaaggcgggagcctcaaagtttgctgagttaactcttttggaagagtccccgtaatttctttgttcgggctcccgtttctattgacatagccttataaatagacctttgttatggttgttttcttctaccctattaatatatgcgaggtaaagcttttgcctttttttcaaaaaaaaaaagaaaaaaaaaaagagattcaagcactaccagaaaagagagactgagtgaggggattggtttacatgatggcaatgggcgggtagcatggtcgtcgtcatcatcgtcgtcgacgaggtaatatgggacgcatgaggctacgcgggcggcgcgagacgccgcggcgcggcgagacgcgagcgcggcggctgccaggcgtgcgggacgacgacgacgagacggggcggccgcctaggagcgcgcggcacgagatacggcggccgcggctacgcgggcggcgtcgcgcgcggccgccgcgtcgcgtacgagccgcgccagcatcgacgacgccctaggtggcattgcgtatcaacgaggagggttttggtttgtctcgtcggcactcgatagaacccgtgccctggctgactgcgccgattggacgtggatcaggtgatcgtgtggctcatttccgttaggcctcgttttcaagcccatattggattggcgcatatttggagcccaaacttcgccaccgatggaatcaaggcccagctcttctctctcgggccgaataaagatgcatttggcacagaattgctaattagcacgtacgtgccatgtacttaactcgcgcgcatttttggcccataactctgcatgcggcccacgccctcatgcgcagcccattaatcttcgtcgcgcgtggcaaccgtcgttcctcttctttttttggtcgcgaagacgctgcatgtgcacaggaatcatgagaaaaaacagtgattagctgcgctttacgtgattagatctaataatcacggtcaatcaagatatatttctttttttcacacaacattattttccttttttacttaaagattcaaaacctatcaacttgaattttaaaaactttcaactacaaatttaaatttttaattcaatttgaaaacattcaagtcagattttgaaaaattttaactcaatttttaaaactttcaactcgaaatttgaattttttttgaagtcaaattttgaaaactttcaactttcatctcaaatttgaaaaacttttaacccagatttgaaaactttcaaattaaatttaaaaactttcaactcaaattagaaaactttcaacataaaattagaaaactttcaagtaaagatttaataacttttaattcaaaaataaaaactttcaattctacattcgtaaagaggtgtgcgaaagattgaaaaaaatcggaaagaaacaggaaaaaaaacatgctcagaggcgatcggaaaaagtgcgaataggaaaataaaaaaaaaaaggcacgggaggcggccgagctgacgcgcgccagctaaattgctgacgcgtacgcgcccattagcgccccccccccccccccatttggcaggccgtgtattgacgtccatcgcggcccaaaccccgtcgaccccggcactcaaacccagcattccaataactgccttctcaaaaacataaaaaaaagaaagaaaagaaaattccaacaactgtttccggtgcaacttcttcttctcctcctcctcctcctcctgtagtacgttctctaatctctaaggtttggaattcagcttcctcctctcataaatcatgtagggcctattcgttttgaagaaattttaacacagaaattacgaatagaaatggtgaaagaatatgaatgtatgcatatttcaagaggtttgagtgaatggaaaatttcctatgttttctctctacacattgtagaaaaggaatttgttttatttttctgtatctacatttaatgaattgaatggcttttatagaaattaattcttaggaaaccaaatcgtttgaaattcatccaaaacgaatatgaccgtacatctttcatcttggtgacatgttcggatatggacggttcataccggacctgctcatcgcagccaaagcttaggatgcgataagaggaggacaattgtagaatataataaagttaatggtaacaaaagagattaagagtggatcaaatgctaccaaattaacccaaaagatatataggatatgcatgctaccaatttgagacgttgagagaaaaaaaggacaatattaatgtcgtggagagatatactaggatatataacagttaaatgcattctaaatgatattaggaatggatcatccaatttctctatataaacacctaggagaggatcaccaaacatagggaactaaggataggctagctaccaccactcattagaaagctaattccctctaaatctgaatatggctcttcttggcaagactagttgcaaggctgccgtgttcttggcagctctagtggtcatggctactgctttttcatcctctcatgctgcccaaggacaaggtaacgataatacaattttcgttctgcaatcaacaaattaactataaatgatttactcgcagacaacaaataaatgatttaaataaatgattttgatcatgaatttattttgtctgcgatgagcatataattcgtttttggtctactatgctttaatttattttgatcatgaattatatattcttacggtttactatttgttctgcaatcaccgagtactattaattatgagcaattttaccatccaccatttgatatctcgagatatcacaaatttttattatctcaagatactttctaatataaaaattagtacctcgagataccattatgtggtaccttgaggtatcaaatgttgaatggtaaaattgctcattaattatatgttctgcgagtatatctttttaattactattgatatttatgcacgaatcaaacatattcatggcctaactactagctgcacattgcaattttttgtttaggcaatgtaggcgaagagaaaatggcgtgtaagccgctacaaggatgcaacacagaaatgtgcatgggctactgccaaatgctcagctaccaaggaggcacctgcatacacaacgatcctgatatgtgctgctgcccgtactaaggtctcgtgtccaatcacacggattaattgttagatttaattgggtaattaatccatttaaattaattaaatcaaataaattccaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggctagttgatgacaattagttgctatattcctcttcctattccattggtaacttacatcaattactcttaattgattgttggttgatggttgtgtagtggaggatggttcatggctagttgatgacaattagttgctccattcctcttcctattccatgactcttactcttcatcttccattcctcttataaaatgggaatggatttgatctcccgcgagaagaagaagacacacttttatccattttcaaaagctgttgctgctacggtaatcccatcccgacgaatgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggaccattcttggggtataaccttattacattatttcaattagaagttttactgttaatgttcatcgcaatgtcaacattgtgtcattatgtgattgttgatgcttattcaacattaagcatgctcatgttgattacattcaccactatcactggatcaaatcctattgtaaatatcatgattattatcttgttattttggattaaaatatgccgaattatgaccaaatttccaacattccaaaaaccttataggtcattttcggtagttggctttgctgctgcactgaaaccacatgcttttgatggttcaaactataagagatggaaagcacgtgcactattgtggttgacagcgatgcagtgcttctatgtttcacggggcaaacgaagtgaaccacctctttctcctgaggaagaggctaagttcgaggcttcggattgcctgtttcgtggagcattgatcagtgtactcgctgacaacatagtggacgtgtacatgcacatgccttctgggaaggacatgtgggatgcacttgaggccaagttcggaatttctgacgccggcagtgagctgtatgttatggagcagttctatgattacaagatggtcgatgaccgttctgtagttgaacaagctcatgagattcagatgctggctaaggaacttgagaacaacaactgtgagttgccggacaagtttgtggcaggtgacattattgccaaactaccaccttcttggtcggactttgccacttctctaaagcacaagagacaagagttcagtgttcctgatctcattggctctttgggtgttgaggagaaggcgagggcaaaggacgtccggggcaaaaaggttgagggaggttctagtgccaatatggtacagaagaagaaccctcatgcatcccacaacaacaagaaagtcaagcctgatgtcaaacccaaggctgcaaccaattttaagaagaaaagcaagggaaaggcaaagggagactgctttgtgtgtggcaagtctgggcattgggccaaggactgtcctgagcgcaaagacaggaagtctgccaacatgatcattagcgagggcggaggaacatcggggtacggtaaaatattacctagagttctctctgtttttcattcacctgattggtgggtggacactggtgctaatattcatgtatgtgctgacatttctctattttcttcttatcaggtcgggagaggttcctccttgttgatgggaaacgggtcgcttgcggctgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgtcgtatctaaatatgggacttttgttggaaaaggttatgacagcggaggcttgttccgcttttctttgaatgacatgtgtaataatcataatgttgtgaaccatattagcgagaatgatgagtctaatgtgtggcattcgcgactctgtcatgtgaatttcggttgtatgacgcgcttagctaacatgagtttaattccaaaattcactttggtaaaaggttccaagtgccatacttgtgttcaatcgaaacaacctcgcaagcctcacaaggcatctgaggcgaggaatttggcacctctagaacttgttcattccgatttgtgcgaaatgaacggcgtgttgactaaagggggaaagaaatatttcatgacgctgatagatgattgcactagattttgctatgtgtatctattgaaaacaaaggatgaggcattgcatttctttaaaatctataaagctgaggtagaaaaccaacttgaaaggaaaatcaaacggttgaggtctgatagaggtggggagtatttttccaatgagtttgcatccttttgcgaagagtttggaattattcatgagatgacgcctccctattcaccccaatcaaatggggtggccgaaagaaagaaccgtactctaactgagatggtgaatgccatgttagacactgcggggctttccaaggaatggtggggtgagacagttttgactgcgtgtcatgtcctgaataaaattccaatgaagcataaggaagtaacaccattcgaggaatgggaaaggaagaaattaaatctctcatacctacgaacatggggctgtttggccaaggtaaatgtacctatagccaaaaagcggaaacttggaccaaaaactgttgattgtgtgtttcttggttatgctatccacagtgtgggttatagattcttaatagtaaactctggagtacccgacatgcatgttggtacaattcttgagtccagagatgctacattctttgagaatgaatttcctatgaaatatacacctagcacttctagtaaagaaactgtcatgccccatgagcactttacaccgatagaacataatgatcaaacgcctgaggaaaatcctgaggaggacaacattgtagatactcgcaagagtaagagacaaagggttgtaaaatcctttggagatgactacattgtatacctcgtggatgacaccccaagaaccatagaagaggcatattcatctcctgacgctgactactggaaggaagcagtacgcagtgaaatggactcgattatgtctaatggtacttgggaaatcgttgagcgtccatatgggtgcaagcccgtaggatgcaaatgggttttcaagaaaaagcttaggcctgatggtacaatcgaaaagtacaaggcaaggcttgtggccaagggttatacccaaaaggaaggcgaggacttcttcgacacatactcaccagttgctcgcttgaccacgattcgagtactacttgctctggcagcctctcatggtcttctcgtccatcagatggacgttaagacagctttcctaaacggagagctggaggaggagatctatatggatcaaccagacgggtatgtactagaaggtcaggagggaatggtgtgtaaactattgaaatccttatatggcctcaagcaagcacctaagcaatggcatgagaagtttgacaccacgcttacatctgcaggctttgttgtgaacgaagctgacaaatgtgtatactatcgctatggtgggggagaaggggtgatcttgtgcttatatgtcgatgacatactgatctttgggaccagccttaatgtgattgaggaggtcaaagactatctgtccaagagttttgaaatgaaggatttgggagaggctgatgttattcttaacatcaaactacaaagaggagatgagggtgggattacacttgtgcaatcccactatgtggacaaggttttgagtcgctttggatatagtgactgcaagccagctcctactccttatgatcccagcgtgctattaaggaaaaaccgaagaatagcaagggatcagctgagatactctcaaatcattggttcattgatgtacttggctagcgcaacgaggcctgacatctcatttgctgtaagcaagctgagccggtttgtctcaaatccgggagatgatcattggcaggctctggaaagagtaatgcgctatctaaagggtactatgagctatggaattcactataccgggtatccaaaagtactagaagggtatagtgactcaaactggatatctgatgctgatgagataaaagccacaagtggatatgtgttcacacttggaggtggcgctgtttcctggaagtcttgcaagcagaccatcttaacgaggtcaacaatggaagcagaacttacagcactagatactgcgatagttgaggccgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggagtgatagcattggactatgtccaaacggctagaaatctggcagatcagtttaccaaggggctaccacgtaatgtgatagacagtgcatcgagggaaatgggcttgatacccacctaaggttgcataatagtggaaacctgtccattatgatcggagatcccgtgaatttggatggtgaaacaaactattgtgtgactgaagagacccttgaaaagggctcattttcatgatgtgtttctcttctttcctgcatggtaggatggcttatgtcttaatgtgatccgagtggcttttccaagcagagatgttgacctgcagaacatcttagaaggaacacacctatatgagttcgactgctagtcacagtctatgagatttgggtgatctctagatactcatgaaaggcctggagtatgacttataagctccaacccgagggaatactaatggttgcctagtatcagttatggaattgagtgaaacctaactgcacaagactgacaattcaaggcatagtccattgttcagttgtggtcaggtgtagctccttttctaggtgaaagttcaacttaacagtcttcaccgaaacactggtatataaaagctgctatggaatagagagcattctcatgagccttgaaatttggtggggattgttagatttaattgggtaattaatccatttaaatcaattaaatcaaataaattccaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggctagttgatgacaattagttgctctattcctcttcctattccattggtaacttacatcaattactcttaattgattgttggttgatggttgtgtagtggaggatggttcatggctagttgatgacaattagttgctccattcctcttcctattccatgactcttactcttcatcttccattcctcttataaaatgggaatggatttgatctcccgcgagaagaagaagacacacttttatccattttcaaaagctgttgctgctacggtaatcccatcccaacgaatgtgtgcacacgcgttgggagaataggcctccgaaaccacgcgttgctgcgacgtttgcacagacgggcgagcgatcaggtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggaccattcttggggtataaccttattacattatttcaattagaagttttactgttaatgttcatcgcaatgtcaacattgtgtcattatgtgattgttgatgcttattcaacgttaagcatgctcatgttgattacattcaccactatcactggatcaaatcctattgtaaatatcatgattattatcttgttattttggattaaaatatgccgaattatgaccaaatttccaacattaataccatgatcaacggcgtatacattgtaaactagctcttgcggttgcttttatcagataataaaacctaatggattttgcacgttttgtctcgtatggatggaagcacaattccatggcaaccctgctacttcatccgtttcatcatgtaaattattctagcatttcttatatccatatctatttagattcattaacatcaatataaatatgagaaatactgaaatgacttacattataaaatggagggagtagaaacatatcttcacaccctatcggcaatcctgttctgacggtcatggacattttgtgtgctgcatatggcagctgttgtcgctgccatgacattaggagtttatgactattttaaaaaaaacatttttacagataattatattgtattttcacatgcggatggatgaaccgtctctaacttagaggcatgtggaaaacctcaagttttgcaggtttgttggaaattctcgatttttataggatagtctcttttatgggaccgcatgtgaaaagatttttttggcaaaaaaaaatgaaaaaaaaacaccaatcaggtccatttatagttttcaattcacaaattcacgatacaattccataataacatattcaaaagaggtttacgacagagcaaaagaacaaattacatctggatggagaggactacaaattaattagtaattaataactttagtgcactccaaaccatatgaagtatttcatccgtcctaaaataagtgtagtttttcattgttcatgtctaacgtttaaccgttcgccttagttgaaaattttgtatgatcagtatttttattattattagatgataaaacatgaaaagtaacttatgtgtggctatttttttagtttttttcataaattttacaaataagatggacggttaaatattagacacggatatatacccatggctgcacttattttgggattgaggtagtaattaattgagatgcatgcatcctctcgtttgccgcttccttcgatctactccctctgtcctataatgtaagggattttaggtggatgtaacatattatagtatagtgaatctgggcatacactttaggatgtgtcacatcaaaccaaaatctattgtattatgaaacggagggagtatatatattaaccatccagctttgcctccacggcggttaaacaatgcaatgcgtgcgtcgagtgtggggagtcgaggtagaaatgggcggcatgcgcacgcggagcaggcggtggccatcgtccatctgccattgtccatgagctcaagtattcctgatgaccacggagactccacaaggggtgtgctaacggctgtcggatttcttcatcgatttgaggcctcacccgtccatcgactgtgctgctataacgaaacaaaacggccgtggagtgtggactagagatcggtttgcccatggtagtaacctgaatgtttcttttagaaagttaattttccaatctggaaaattactattaattaccaacatgaatcaggactcctctgcgtgttagaattttttttccaaggctatgtatttattttaattttatgattttccatataattctcagattggaaaattaacaaaatttagagcactgtgttccaattagaacacggaagcgttacatttctgagcatgaacaccgcaacattacacgtcaccacctaccaacccattacatctcgactactcattgtactcataatataaggaatccaccgtgagctgacttctttaacaattttcaattgtgcagatctctagcccaaactgatcaatttatttcttctctatccgaactgtagatttctagtgcggattcaatgggaatgagcggcattgagaaaacatttctaacaatatccaatccactgtccactgatcataggactgtcacaagtcgcgcacccaagacattttcaagcccaatttatgttgtagcataagtttagaggtgggggatcgatgatgggccaaaaatattacagatgacacaattttctttcaaggatttaataaagatttaaaatgtgttgattgttttactcggccaccttccttaagaaaaatgtatgtaacacaaaatcatgatggccaaatgttttcatctaagattaaagcactgttagatcgatattatctcttccattttaattgcaagatctttgcatctttgacatacataactggcctagagtgatcatgccccatcctgtgttaagctcatactgtagcaagattgtaattctattacgagatcaataaagctctcttttccctaaaaaaagagaaaaaaaacggccttcaaagattgcttgttgaggcatttacgagtttaattcacatgcatgcaggaaggaagtggcccttgtctctctcgaggaatatccactcgttttacctatgtcatgtaattaaaaagccatattttttctttgacagtataggtcaatatgagatatcactgtacatgcaagtccaaatttaacgtatacaagtttaataaaataacaaatatactattattttttttctttgagaaacacagtaggaacataggcgcacacactcatctctatgaatacacaaaggcacaccttatttttatgagcacgtgcactcacctctattaatatgactattaatagtgtgtactgttttgagtcatatttgtgatttataagaaaagattatagctttctaggtgacatgtaaaaacatcccctgagagaaaaaaaaaaccttccccatgccgtatgatccatgtcaagtcatcctagctagtttttgcatattaacttgttagcatgccacatgtacatatatatccaccttttgctcttcagtatatgtatatttctcataatctcttctcttcttccatgacatatctccccttctttttttttctccatatcatactaagtactctctcacttgtccttttccttgagaccaagcacaagcacagtccagcagatcgatggtagtggtgcattgtaggataatatataagcgcttaaaaaggcctagcaaaaaaattggatgatacatcgaacatgttcatcagttgctctctatcggaatgagcggcaccgggaaggattccatgaaggtggcagcaatatactgtacatcacttcctcgaaatgctgcggcgaatgctatcgaagtagaatggccacgatttttatgacttcccatggaaatggaagaatggaattgtgtttagtttagttccatgtcgtctcgatctcgtgatcggcacacggagcaccagtgcttagtctatgaggtgaatgcagaatcgtctatgaagagaatgaagaatcgacttgcttaattcaagcttagtctctcaactaaattcagtataagtgctaaatgttggcctcttattatatatctggttaaactgaaagctcaaataattaactcaactatatgtcttgtactacaagctgatactgaaacgatgagactgtttgttatctaagagtaggaacagacggataattttaccatccataataaaggtactaagagatagtgtaaaaatttagatacctcgaggtattttctcaaatactataaaattttctcggaatcagttagtgaaaaatatacacactgctgcgaatgctcaatttcagtacaagtttttatattctgacgaactagccatcagcacatctcttatttatgttccttgaatcggttcctggacgccaattaatttccatgtgaagtttctggcacgtgtgttgatcgatgtttaccatgcatgtaaatgcacatctctctccattattgatgattcgccacacatatatatgcaggcaccaacccaacccctgtgtgtatatcttgtactgtacaccctgccgccatcacccaccgttccacatctccacattatattttattgcttctgtgtatctcttggctggccggtgcacgacgacgatatgatgaaaaccgattggaatgagcggtattgggaagcatgctaactaataaggcttattcccgggttgaactcgaactgcctacacaagagcattctcatcaaccgcctgccgttagcgctgatcaattggtcggttggatcgagaatgtagcgacaagtgatggacgagatacttttttggagtgaaagtattcaaatgttgtaaattattagctgcgattggggttctttccactgccagcaactgaatgttgtaaattagctgtggtgaatattgtagtagcagtggagtggtgcaatgctgcaagactgttgtactacaatcttgttcactgtcatgcaaagttccagattcaattttcctaacaaattaaaaagataaatcaaaattttacattctggctagctagcctttccctttgtcctatatgttcatctttttttttttaactaaaccgaacaggagaactgccaattaaggtttcaataagatccacccttgaactggtaactaataactaccctctcattcattgattgcccagcataagtgcatagtaactgagtttctccgtaatataatgttaggaggcattagtttttccacccaaaaagattgtcgcttcctccgaaggatatatatgttgaccatccacctccaccttggcctctctgcggggttaagattagcactagcttattgcgcacaggaacgtgcgcgagcatcaagcgagcaagcatgcactactagagaactgatcttttctcgatgggccaaaatcacaaaactacatgttcacgcggtttagaaatgggtggcgtatggaactgggtggtgaagggtgtacattcgccggtgtctacgagctaacttgatcttatagaccttagagtggctagattattgggagtgctagtagcaaaatagctacgggcttgactagtggttcaagtcttatacttaagactggtgctcgtatttatggttaattaatttttcagtggtaagcgacgtacctctcgacaatgaggtgctcgtggtgacttcatcaacctcaagatatgctagcctaatcttctaaaaatgttcataggcatagggtggacatgtgtgcgttcttatggataagtgtgtgcgcgttttgagtgtttgcttttgtaacatgtttctaaaaaagagtcgatactacatagtgcacatgagatcatggattcgtggccatgctaacataaatccaaattttagttttcgtatcaacaacccagattttacttttttttgcgagccttttacttcatctcctacacatgatcccccacccccccccccctaaaaaaaatgttttcttttaattttgaggaggatgagaggatccattcgttaattcgtccggtttgatatattacccagcacatacaagtatacagcaataactaactgtctgtcttgcaaaagaaataaaattgagcgcattcttttatttcccacacacggccacatcctcaaatatattgaccatccggttttgcctcgcggcagttgtaattagctcaagtgtcaaaccattagtagaagtatgcgcgtgtatggcagtgcgagcgtaccatacggggtagaaatgggtggcatccggaagcacggggatcctccagaggccgttttccatacgcttacgtccattggctgaagcaccaaagtggagatgagaaccgacggaagtgctcggctaacgacatagagagaactcgttggtttcggagctcgtccatccatcagcagctgtgttgcggcgctgctatacagcaaaaccgagacgggcgagttgcgtggacgagcagtacatgctgtgtggttcatggatgaaatgtgtcggctacatgttacttgatagtttgtacaaaaattctgagttttgtccaaactcaacttctcacacattgagataaaaaaaattcagcgtatgaatatatagtaacataccattcacactcgaatttgtcttattttgtttccaatgtatagatcaaatctaaacttgatttttgatgaactaatagatgccactatactctattgttttctttagagtttttcacgagggaacatccccagggcagttgaattctaagttaacatgttactaagaaagagaaaggtaaaatttgctgatgttctagttttactagttgaatgacgtgcttggatacggataagagaaaatacattaatgtgttacctatctttttgtcatagaaattcacctcgatgtaatattattatttgtgatcatccatttatatttagttatttttaatatcaagaagtttaaggggtagcaccaaatctacattggaatagatggggtggcatatttgctgacaccatcgttactcttttttaaaggagttgaatagttgtttggcaaaagacattccaaccactattttaatatatcttggaaattttgcaaaggataattttacccttgggcgaccatgtgcaagactctaatggaaacaaatatttgttgaatttaaacatactttacaaaattcaaaacttgtcaccaattatacaaatcaaaaaaaattgcaaatggttgtttaagtttagcaaaatctgtttagtttttaattttttttggcaatttctgtttttgcaatttcgagcaaattttgagttttctaaatgtttgaattcaactaaaatttgttcagatttatctnnnnnnnnnnnnnnnnnnnnnnnnnnnnnnnnnnnnnnnnnnnnnnnnnnnnnnnnnnnnnnnnn

SEQ ID NO: 27372 - DNA, 1546 bp, Oryza sativa
  unsure (1)..(1546): unsure at all n locations
aacatccccagggcagttgaattctaagttaacatgttactaagaaagagaaaggtaaaatttgctgatgttctagttttactagttgaatgacgtgcttggatacggataagagaaaatacattaatgtgttacctatctttttgtcatagaaattcacctcgatgtaatattattatttgtgatcatccatttatatttagttatttttaatatcaagaagtttaaggggtagcaccaaatctacattggaatagatggggtggcatatttgctgacaccatcgttactcttttttaaaggagttgaatagttgtttggcaaaagacattccaaccactattttaatatatcttggaaattttgcaaaggataattttacccttgggcgaccatgtgcaagactctaatggaaacaaatatttgttgaatttaaacatactttacaaaattcaaaacttgtcaccaattatacaaatcaaaaaaaattgcaaatggttgtttaagtttagcaaaatctgtttagtttttaattttttttggcaatttctgtttttgcaatttcgagcaaattttgagttttctaaatgtttgaattcaactaaaatttgttcagatttatcttgcacagtggacaagtgttgaaccgtcttttgtaaagctttatctcttcttcgaaagaggctggcattaaaataatgatcgaaatatcttttggcaacaaccatataactagagctttatctattctctttcccttgttggaatgagaacacagtaaacaaatcctaaacgagattttgcatatatatggcgagtcttcttttcttctcacacatcgccacttcctctggtatattggccatctggtttcgcctcacggcggttaaattttccagtagctagtgtgcccgggtagaaatgggtggcatcaggaaatacgcggagcgggcacaagtgtccatgggctccagtattactccagctgagagatccacagatagcgctcggttgaagccactgaagtgcatcgatttcagatgccacccacccatcggcagctcggctctgctgctagagcgaaacctcgcgagacagccttgcgaaccgtacagtccatggatgaaatgttattggtacttcttgagttcttgtgtttgtgagatcgaataacacgacccagctggtatgcgcgcgggggcttcaggtttcgcgtagcgtgcaggcgcagaacgggtgtggtactacgctactgtgtgaaatagtggattaagggtgtgtttagttggggaaaaggaaatttttgggtgtcatatcggacgtttgaccagatgttggaaggggttttcggacacgaatgaaaaaactaattttagaactcgcctggaaaccgcgagacgaatcttttgatactaattaagccgtcattagcacatgtgggttactgtagcattatggctaatcacggactaattaggcttaaaagattcgnnnnnnnnnnnnnnnnnnnnnnnnnnnnnnnnnnnnnnnnnnnnnnnnnnnnnnn

SEQ ID NO: 27373 - DNA, 859 bp, Oryza sativa
  unsure (1)..(859): unsure at all n locations
agtacatctgcgatgtcactgttcataagatggatttctccaagcatcaatggtgcacagccgaggacatcggtggtcgtacgttcttgatagctccatgttatttcggtgcttcacgttcggccaatgagtgtgggctggagaaggattgtgtctacgctatttttgtgcgttataaatattttgaggtatccaaggtagaggatggagaaaccgaagagtatgatctcatcgaagctccaaattcagatatagggatgtggattttgcccaccgtctagtttcacaattgggaattttatcatcttttttgcatggaaagaaacatgttttttttatccagtgtaaccgtagttaattatttgtatttccaactttagtaagctatatatatgaaacagtattattggtcacacatcaatcagtgttacaagaatttttgttggaaagaaagggagggttcgttgaaagactgtacagaaatattttctctagtgtagccattgtttattatatgtttttgtagcgcttgatgagtgtgctatatatgaaattaagtttttttttctgtcgtactgtccactgaaagcataacaagatatttccttggaaagaaagggttatgcacagagatagcacacaggaaattgatgactattctggtgtattaaaaaccgagtaccgaaccttggcgccactcttctcaattttattggtttatcattatttagttcatattcatgagttgtttgtcggccagccagctgaataatgtcacactgcatnnnnnnnnnnnnnnnnnnnnnnnnnnnnnnnnnnnnnnnnnnnnnnnnnnnnnnnnnnnnnnnnnnnnnnnnnn

SEQ ID NO: 27374 - DNA, 1068 bp, Oryza sativa
ggcgaattcgagctcggtaccctcttattcctgatcatgtcatgatcaatggccaacctgttcccgtgtctccaaaaaatgatgccagtcattccatacaagccaacccaacatgctttaatcaccagattgcacttgaaggtcttttatatattcattatgatccatacaaaatcctagtcatttcattttactcaagattcaagtcgttgcgtaattaggtcagggacatcgatttcaacagcagaatggattttcagcagtacacgtatttactccatacaatgttgctggaacttccacacaactaaaagagccgttgcaacagtatccttatgaacaaagtatgcatgaaggtcaatactactccctccgtttcatattgtaagactttctagcattgcccacgttcatatagatgttaatggatctagagatatatatgtgtctagattcattaagatctatatgaatgtggacaatgctagaaagtcttacattgtgaaacggatgaagtatatacctgcttaattttcactgaacaccctccaagttactataactgttcatagtttcaacttgcttcagaatctggtcgggagggtccttctatgcagcataatggaacttcttactctctgactgaggaaaacatcttgaacggtctaggctctggcttagtacaatcaactatcctatctcaaaatactgcagtagtaagtaaaaacgaaattgaaatattaggacatgatattttgtcgtgtccatctctttctaaatgaagattgaaattctttagttggtaatttctcgtttatgacttgaaatgtttctgtatataggtcccaggtgcagatccacggcacagtggatatgccagcacctctacagctgacgctgctggtacttcttgtcctgtaacaggtgtgcagctacactgaaactcttatagttcaacagtacatttgcagtgaactcgatcaactcaaaccacttttctacattatgtatttgctgggtgatgaaatgttgatgttggaatttcctcagatggagttggtccatggg

SEQ ID NO: 27375 - DNA, 704 bp, Oryza sativa
cagaagttttggtgctgttgagtttctatttgtatgcttcttttaaactgctttgacatgttattttcaactaaatatagttccaatttcctaaagtgtgcaaaataatgtcttatattcataataaattgggtgaactcaatatgttattaacaataacagaattgcttcgcccccttttgataccagcaacctgaaacagtatattattcgttacgagaaactgctagaacaggttatacatctagatctaggactgggagggaactattactccagttcatggcactctgaatttgacacgctcttttcagcaatactacgagcatctgctttagctttcctcaaaatgaatagaagttgaattgtgcgattaccaaattgctgatgtacttactggctacttaagaattttttgacacaatactagccacttaagattaggattgaatttaatatcaacctttcgtttcgtgccatgacagtgtgtttctcatttcagaactggcaaatgccgacaaccaatttactggaggtaatgatgatagtgctccatttgactgaaatcaccgcaacaagttattgtctactctcaaccatactaaagtgttcagtacttccagtgtgattataagtgtgtagtagttcgtaaatatagtagggacatattatgtcagctattctttaatttgttccgctcacgt

SEQ ID NO: 27376 - DNA, 1144 bp, Oryza sativa
gacctcctcagaaggtggacgcgctgcgccgcgccaagagcttgcgcgtcgaggccaaggccggcgccggcggcgaaaggcccaagcgctgggcggccagggacctcgccgtcttcctcctcttcggcgccgcctgcggcgtcctcgtgctcaccaggtacttgctctgcaattagcccacccaaccgcaagaggaggaaggaggagatcggatcgcagttgcgccttcttggcgttgatctaatcccacgctgctcgttcgtgcagaactgtctgttctgcgaattttgatgttggttactcacttcgttcagtttgtaataaggacaaggattcgatacattttattttgctttttgtgattgtgattatttcagagagcaaatttactctccaaatgtgcactaatttaagtagcctctcatctgaatttctccaatccccaatcactccattattcagaggtagtgatgttcagaattatttaccttgggacaaggattttttgcttgaacaaaaggttgggatggctagaaggagctagccatccaatggaattaagataggaggagtcacatatttccaacccttcatttaatccaggcggaaggtgaggagttcaggaatcgaaccctggcttgaacaaactttggacaaaatttaaaccgttaaaattgatatttttttgaacggaattaaaattgatatataactggtaaaatatgtattcactcttcagattgtaatgcactactaccaatcagtttcaggacctgggctgtcgacgagtgcaaatttcttgtagctgtcaccgtctgaattctgaaattagatgtgctgaattctgaagttggatatgctgaattctgaactctgaagtagatgaccaaaaaaaaaaagaggaaaattgctgctttgcttgtccagtagacacacctaatgtcctaatgctcaaaccattcagggggaacaggaacaaacacatagcagcatgactataattttaaggcctatgcatgtttacaaattagtacaggttcaagtggatatgttaattttgttacttcaacatggaagttggatctcgacagataattccatcgacacttggaagttgacactgctaggtacagtggagtacttt

SEQ ID NO: 27377 - DNA, 1152 bp, Oryza sativa
caacggcgtcatctattaaaaaacggagggagtaataaactagagttaaactagaaaaaaagattttatagtatttcaactagggttgtgtcacgccccgaactagccccgagcggaactagcccgtgacgctccaaattaacctgttaatcgataccagtcccaggaaacagtgctggtatcacaggatgacagtatatcacagcaacagaggtctctttattatagagtaggagtacagtcatgttgggctgcggacagatcccgagctcacaattgcattacaaaagggaaagtggaagccaagacttggaccaaacatgacagacgcgacttgggaactaggccgaaaccctaaaactcatcgtagccgacttgctcctggaagaactcctcgtcagcaggggccacatcatcttctttagcaactggggggggggaattatttatatagagcaagggtgagtacaggggtactcagcaagccatgggaaataagtgtttaatgtaggcttcaaggggaaggctgttgtttttacaattgattttatttaaactcctttttgaaacaactaagtgagtacttctcaaacgacacggatgggacagtgcgtctcgtccgatcggagtatgtgcgatgtatcagtcttttgaattgatcaaggttggcacccggccaacagctttcaaacggccacccgggcctggctgatcccatcagccgtagattttccaaacatcgaacccattccacaacagcaatttcacaaagcagtagtcaaacaaaactacgctaggaatcacctcacatccgcccatgaccgtgggcacggctgttcgaacagtttgttaacctctacagagggagtacactttacccacacgacattactaacccggatcatccagcccatgcagaacggccacgtctggtgacctaagggctttcatgacaaggcatttcgagagcagacacaggttcaccatatgccaacgagaggggtcccagaccaacaccagattaggtcccagaccatactgtgccaggaaacctgggggttctccccgacaccaccccattgaatccacatgtctcttggcatcatggctcccccgattagctagttactcagccaggggtgtcccattcca

SEQ ID NO: 27378 - DNA, 550 bp, Oryza sativa
gtcaggccgcagttcatgaaatcgtcgcccccgccgtccgactagaagctggcggtgttgagctcgaagtcccccgacggtggggctttgacggtcaccgtcgccggcggcctccaggcctgctgctgctgctgcttcctgtaggtgatgcttctcttgaagattctgcagatggtccagacctcctgcatttttttcagtcagaagtgcacaagttagaggtcaatgctattaggaggctgtactcttatcggttagaaatggcaatcggtagaatactagaaacacgtcagaacgtgagaggatgtccagtactcctttaaaacgtgggaatttcagtaggactttcacatggattagttcaatttttgtagaattttcgcaaaatttcttcgttcaaaaggaggcctgtaatctcgaaagaactgctgaacttagcttgaaaaaaaatattaagacgatttggtgatgtaaagtattgcagatgatattgtactccacactatcaaattgtacgtagttgtgatctgtcacagatgaggagaaccgg

SEQ ID NO: 27379 - DNA, 886 bp, Oryza sativa
cttgccatcactcatctcagttttattggtttagcattagtcagttcattttcacaagttgtctgtcgaccagaaccaagtagtggatttattggggaaactctaataatcccttaacgcgatatccccttatttttcgcgtcgcttaaaaatcatgaaaaaaattaaaaaaaagttagagcaacatgtgatatatcacttcacaagcatgcatgttcaaattaaacttatataattaaaataaaaacaacaaatttgacaatgaatagaatgcgcaattcactattaaatttgttatttttgtttcgaattgtataagtcgaattttaattgtgaaaagatatatcatatattgatctatcttaacagttttttataatttttttgatgactttcaaatatcatgcacaaaatgaggggatgtcccctcgagtgataaaaaaatccatctcgatttattgaaaacaaaatactgtacctagccgaataatgtcgcactgcatttgcccagttgcctctgaggatgaaattctttcactagttccaaatgaaagtgacacacttggtaaatctatttgaacttgtaaaagcagaggataggccgtaaaattccaggtaaacagtcatgtgtttttttatttcctgtttccaacctgaaaccgaaagattagagcattgttcctacctgatgaacaaagctggtatgcctgcttttactgaagtcctcgtctcggcgcgttccatggccgcctcctcctttctccgcagctaagctcaatccttctccgctgcgctcgtgctcacgggcgatcgcctccatggccgccaccgctagccgttgccccctctatgtcaccgcttcggttcgcggcgtgggggtggagga

SEQ ID NO: 27380 - DNA, 4998 bp, Oryza sativa
atagggcgaattcgagctcggtacccacctatccgcatggccaatctagaagagccactgcacatatacccactcaggaccctggaccatccttgttagtcgtcagatttgcctatgtcgtcgaatgtgttttcctgacacatcccatttctgaggccaaaacgttttttttttaagagagagagagtagaaagcaagaccactactgaattgtaatgtgttattttctgtagcgaccatgtccaaagaggagcagcgtgggctacagggaagtgggagtaggcgtatatatatatatatatatatgtatgtatgctggcatgtcccctctctgttttaaaatattaacatttttagcatggtgacaagttaaacaattttaactttaaccattaatagcaacaaaattaaaaaaaccaatcatgtaaaattgacgttcctaaatttatcattaaacaaactatcataatatgcaactctttttatttaaaacatcttacttttatagatattgttggttaaagtagcatctcggtgaccgtgtcaggatctaaaaaaatgcttatattttgagacggaaagagtatatacatgggcaatataatgatgttatgaggtgatggttgacaaaattcaaaaccaaatcattagcaaaccgtctgctaagagacaatcatgagtttatccacgcgagagatcggaggctctgactgacagtaatcactcagagcgatggtcgatggtttcttcagcttgatatgccacaaacaacaagaaggacgaaaacggcccaaagttgctgcgtcgcccgggcacgtgcaccacacagtcgaacgtacggcgtgggattggatgcccatatatacggacgtgtgagccggtggcttggttgccaaacgttgacattgtgttaatgaattgctaagctaatattacctccgttttttaatagataacgtcgttgactttttttcttacatgtttgaccattcgtcttatttaaaaattttatacaaatgtataagatataaatccacttaaagtattatgagtgataaaacaactcataacaaaataaattataattacgtaaatttttttaataagacgaatggtcaaacatgtgagaaaaagtcaacggcgtcatctattaaaaaacggagggagtataattaacattgtgttgccgaattctctctttgatattcatcttccatccagggtttataattccgatcgattttggtaaaactgttagggttcggtttgtaaaaaccagacaattttacctggttttcatataaataagttaacagaaagtcatggtttttttttatcaatttctattggtttttcttggttttcggtgaattgatagggaccggttttcaactcgaaatcagaaatgtgaaacctgatcgggacatgtcagccaagaaacgatgacactcactggatgaagttaatagctacgttctggtatctatactgacttttcattgcactgctaaggcccatgtttaggttccacctcaaaatttttcaccgtatcacatcgaacgtttaaacacatgtataaagtattaaatatagacaaaaaaataactaattgtatagattcgcggctaatttgtgagacgaatcttttaagtctaattgctccatgatttgataatgtagtgctacagtaaacatttgctaatgatggattaattaggcttaataaattcatctcgcggtttactagcggatttcgtatttttttattagtatccaaacactctatacgataccctatataatacccgatgtgacacgttaaaactttacactcctggataagaaaaccggaggtgccagcgaaaactatctaatggacgaaccaaacggaaattggacaaaccatattcaaaatagtcagaagccgtatttcaacttcaacgttagttcaccagccacatgaacagttgttgcatggaggctcccaaacacgaatattagggtatgacctataataataaataattagagggggtgagacttcgaacctagatcagctagcccaccattttgtaaagctagccataagacccttaggcgttactaaggggcttaggatgagtgtaacaatgaggtcctatgccgatgagctatactatgcgcaaaaactgtatggagcggatgcaattcgaaatccccaaggtcaaagatattttctcgacacctcccattccgatcgagcccatcacttgatgtatatgccagttttcttggtgtcgaactgattttcctcatcgttcatgcatggctgatttgagcccgtaccttaaggaccatgtcaacatgagagtgagaacaatgttgatatatatatgcacacgggcaagtgaatcagtagatgtgaccgttagatggtgggtgggattcataaattagcttcaagcctgcttgattaagacacgaaaagattttacctacaaaattacattggtgtatagtatagtatttgtggcttatgtataaaaaaaaggaaaggtaactaaatagaatttccatatataacaaaaagaaacccatctaaatagaatttgaaatttccaagtgcactttaatggcatttccaagcttggatggggactagcttgacaacaatagtgttaaaagaaaggacaaaaggccatttcattagtgcatttttattgcgaggttatccttttaagcccttcaaccttacccaacatgtccgactctacagccatgtgaatcaaatagctcaactaattgacaactaaaggtgtgccaaagttttctcgcagcatgagagaatgtggcccatttacctggtgatctttcgcacacagttcaatcatatgctactagatgctaccacaccgtcgagaattagagaatttaccatcaaattcgtgtgccttaatttttttacctcttaactcgcataccctctataatatattattaggattctttcttggtattattagtttgaggcacacggatttgatgataaattatctaaattctcccacaccgtcacttcttgatgcgtcctctctgaggaaatcacgcttataacccacctggtgaaatcaccaagctggaggagtattagtctcatacgaactggggctagacgtgagtataccttaacgacaaccacggcaaatcgacaaaaacattttccttggtgtcactcaatcccaaaactatatgcattctctcgttgtagatggatatggcacgattaattgtcgtcctaatggtagcaatttgatgttttggggcgagaagagagcatgggctctcagcatatattgtgatgcaaagtaggacggacagaagcaatggattttgagaggcgcatgcagtgaaggccatgcatgcactgctgcctagtatttgcttctacaaactaatgaaagcaatatcaatgtgtattgcttcttaaacttaggccatccccaacccaaaaactatctagtagtttctatactagctatgtcatatagacactatgtatagaaaatatatatccaatggatggtgtcttcaaattaaattatcatccaatcacctttcttctctctccttttatccacctatccccttgttttcattcttgattcttgtagagatagtttctttatctttttatctctctcctcattaactttcttgccacatcagatttttacttatgtggcaatatattaaatgctatgaaactagatgacatggagggttaggatggccttagagcaagtttaatagtatagcccactgctaactccaatttatctatagccaatctaataatcaattcatacaatagatatttactgtactattaatatatggtcccacctgtcatacacacactgtgtcttggagtccgtgctgcagctggctacagatctgtagcccattgctcttctttctcatcttttatctcattaaaatatgtttatagctagctaatagcctgctattgtacctgctcttatgcaaggtggagaattcaaagagcatcactcttaggatgcgttctgagatgctaaaggccaggtttctaataaatggtgtgttttttcaaatactttatatacaaaagtttcttaaaaaattaaataaatttggttgatgcacggcctgccaaatgcatgttttattgtcgttatagcgtattattataccgtcttcgcatttgaattctttacatgtacgtacaattatagctcgaattacttcggatctttctagaggcatttaggacactgcgtctttgattacagcaataataacatcaccaatacgagcatatcgctgattactagcagctcctatgactcgaatacacatcaattttcgagctccactgttatctgctacatttaaaagggtctgaggttgaatcatattattttgattttaatttgttatttcaatgctcgggaaaaaaaagaaataagtatctaattagagctcgctcctttagtatttaatagggaaattcccaccgaaaaagctatgaaatcacgttgaaaataaggcaagcaattagagtattacgtaaggaaaaatacctcgcagagggtcttatggccgcttattcctattccttttgcgagcacaatactaattgaatccactccccatgtgtgtgcttctgcacctatccgggaaagaagagtggtgagattctttagcccgagaggggacctgggccggattcacaccaatccatggcccaccaacacgtgccgccgacgagacaaaccaaaccctcgttaattcgcgatgccaagtagggtaaatactattatggtatttgaatcttctaaagataaagatgaatataaagattaagtgtttcataaaaataaggttgtagtactgtgtaattaattaagttttaattattataaatttgagaaatggattaatctgatatttataaacaatctaagcataagcacacag

SEQ ID NO: 27381 - DNA, 4553 bp, Oryza sativa
  unsure (1)..(4553): unsure at all n locations
actccccatgtgtgtgcttctgcacctatccgggaaagaagagtggtgagattctttagcccgagaggggacctgggccggattcacaccaatccatggcccaccaacacgtgccgccgacgagacaaaccaaaccctcgttaattcgcgatgccaagtagggtaaatactattatggtatttgaatcttctaaagataaagatgaatataaagattaagtgtttcataaaaataaggttgtagtactgtgtaattaattaagttttaattattataaatttgagaaatggattaatctgatatttataaacaatctaagcataagcacacagatcagtgatgatttaaacacatagcctaattaaggtcaaaaaggaggaggggacacctatcctcatggccgatcgaactgagccactgcactttgacccactcaaggcccatgactatcaagcctattcttggtagctgtaggagaattgtctaacattgtcgaacgtgttttcctgacgtctcccatttctaagtccaaaactatttttcaagagggaggggagtgagaaaccaaagccatatcaaccttgtcaccagattgtaccccccctttttttttttgacaatgtccgaagagtagtgtgaatggactccaggccagggaagtgagtacgcggatatatatgctggcatgcgtacacatgggcaatgtaaatgaggttatgagatggtggttgacaaaattcaaaagcacatcatcatcagaggggggtttcctccccacgcttgagatcagaggccccgacaatcaagaccacaaatttgataaattcctataagattttatatggcgtacatttgatttatgtattttttttcttatttctacgattttcattgacgcgtttcataggagccctaaattaacctccgagggttgatcgcaattcgcaacgggtggtaattgctaaacccagggatgtaattcccaagtgcatagcacgctagaagtacgcattggccttgatcggccgcgattgctaccatacggcttcagtagttgaaagccgctgcaagtgcaagcagacattttgatgagaatcggagaagctagataactatggagatggtccgttgagccttactactgttgcccaaagaggcaaatatctatgcatgagccatgacaacgctggcgagctgtactagcggcctacactgtcgaaggtgtttttcctgacgcccccatttcctatgccaaaacttggatacttgagagagagtgtgtgtgcacgaacttcaagtatgtatggttaattgtacgtacagatgttgcttgacattgagttgttctcagtcttagtgagatgatgtgatgtccaaagaggaggagatatatatgcattaaggactactccagtacatagatagaagtgagtaggtggatacttacagtggtggagccagaaatttaaatctgtgaggtcaattactagtggtttgtatttaagtggggtcatttctctaaattcttttggatttatacatgaaaattaagatttataagatgtttttcaaaaagctgtggggtcagccgaccccacagaaatggcctaaatccgccattggatacttatacatactgatatgagaacacatgagcaaacaaatgagattatgagttggtggttgacaatattcatcaaaagcatagacggggaatttgtcatgataattgggaaaatatatactgcaaaccatatatgtagtgaaaattactgttgaatcgaaaaatgaacgtctaagattcgtccacatcaccactcactaaaatttttactcgtgagtaaatctactagtaaaattcctcgtgatgacatggactgatattttccctgataatcagagcgacgctcgtaggcgctccataggcctcgtcatcttcacagtcacacaccgaacgcgacaagcagaccgaaagcccaaaatcgcctctcgcgacgcggcccaataactcgtagcccatttagccgggcgcgtgcacccgattcgaccaccgccaagcccgaatgattccaccacacgccaccgattcgattccgaccgttgcgtccgcctcaggtgcgcgcccgcttttccaccccgaccgttgccagccagccaccctcgattccgcccaaaattcccccttcaaatccaccccccacaaacacgccaaaaccgcaaccaaatcccctcacccccacgacgcacgcgaaaccacctcgacgaatccatggcggccgacgcgctcgtcgtggcggggcaggcgaaggcgaggcacccgctgagccagatcgcggagagcgggacgcaccggctgctgctgaagcagtggctcaaggaggaggacctgctcgcccgccgcgtcgccctgcgggaggcccgcctcgacggcgcccgcaaggagatcgccttcctctactgcgccttcttcgccttccacgccgcctccatcctcctcctcttcctctccgcctccgcctccacctccgcggcgtgccggcgctcgtggatcccctgcctcgtgtcgctgctctcgtcgctggccatgctgtgggcgctgcggtacaaggcggacacggaggcggtgctggagcggctgctggcgcgggagcgggaggacgcgctgctgctcggcaagtgcgtcgccgagctcaagcggaaggggctcgagttcgacctcctcaaggaggtggacgcgctgcgccgcgccaagagcctgcgcgtcgaggccaagggcggcgccggcggcgagaggcccaagcgctgggcggccagggacctcgccgtcttcctcctcttcggcgccgcctgcggcgtcctcgtgctcaccaggtacttgctctgcaattagcccacccaaccgcaagaggaggaaggaggagatcggatcgcagttgcgccttcttggcgttgatctaatcccacgctgctcgttcgtgcagaactgtctgttctgcgaattttgatgttggttactcacttcgttcagtttgtaataaggacaaggattcgatacattttattttgctttttgtgattgtgattatttcagagagcaaatttactctccaaatgtgcactaatttaagtagcctctcatctgaatttctccaatccccaatcactccattattcagaggtagtgatgttcagaattatttaccttgggacaaggattttttgcttgaacaaaaggttgggatggctagaaggagctagccatccaatggaattaagataggaggagtcacatatttccaacccttcatttaatccaggcggaaggtgaggagttcaggaatcgaaccgtggcttgagcataactttggacaaaatttaaaccgttaaaattgatatttttttgaacggaattaaaattgatatataactggtaaaatatgtattcactcttcagattgtaatgcactactaccaatcagtttcaggacctgggctgtcgacgagtgcaaatttcttgtagctgtcaccgtctgaattctgaaattagatgtgctgaattctgaagttggatatgctgaattctgaactctgaagtagatgaccaaaaaaaaaaagaggaaaattgctgctttgcttgtccagtagacacacctaatgtcctaatgctcaaaccattcagggggaacaggaacaaacacatagcagcatgactataattttaaggcctatgcatgtttacaaattagtacaggttcaagtggatatgttaattttgttacttcaacatggaagttggatctcgacagataattccatcgacacttggaagttgacactgctaggtacagtggagtactttgtttccacataatcaagcatttggttattctaacagaacttacaaactaaacaatgctgaatcagtagacttgatataagtggcgcccaggttcactcatgctttgagtaaggtcatcaagttcatgtgtcttgtcttccctctgcctacaaaaatctgcctcggcaacatgagaaataataacgaaccgtttctttccaacaaattttcttgtggtgctccatttaatgtggcattattctgctaggttcattattttgtttgcgctgaatccactacttggttcgtcgacagacaatttatgaatatgaaccaaataatgctaaaccattaaacctgagatgagtggcaccaaggttcactactcactttttaatacaacagaataggatcatcaattgtacataaccctttctttccaatgaaatatcttgttatgctttcagtagacaatacgatgcaaaaaggagaaatgttaatttcatagatagtgcactcattaagcgctgcaaaaacaaatactacctccattttttaatagatgacgctgttgactttttctcacatgattgaccattcgtcttattcaaaaattttatgtaaatgcataagatataaatcacacttnnnnnnnnnnnnnnnnnnnnnnnnnnnnnnnnnnnnnnnnnnnnnnnnnnnnnnnnnnnnnnnnnn

SEQ ID NO: 27382 - DNA, 3020 bp, Oryza sativa
tttatttaaaactcccttttgaaacaactaagtgagtactctcaaccgacacggatgggacagtgcgtctcgtccgatcaaagtatgtgcaatgtatcagtcttttaaattgatcaaggttggcacccggccaacagctttcaaacgcccacccgggcctggctgatcccatcagccgtagattttccaaacatcgaacccattccacaacagcaatttcacaaagcagtagtcaaacaaaactacgctaggaatcacctcacatccgcccatgaccgtgggcacggctgttcgaacagtttgttaacctctacagagggagtacactttacccacacgacattactaacccggatcatccagcccatgcagaacggccacgtctggtgacctaagggctttcatgacaaggcatttcgagagcagacacaggttcaccatatgccaacgagaggggtcccagaccaacaccagattaggtcccagaccatactgtgccaggaaacctgggggttctccccgacaccaccccattgaatccacatgtctcttggcatcatggctcccccgattagctagttactcagccaggggtgtcccattccacccatgtggtcgcacttgtcttatgttcggatgaaattccaaggaaacggtccttaagtgcaagagcaggaaactgtactcccggtacgttccctggtccgcgattttggaaaaattcatttagttcgcaagcaccgacccaggtgtcgggttttccaagtcttttgtaaaacccaagttttacccatcgttggatattttaaatttgagggaaggtgttccgatgcgcgtgcccgaaggcccatacatcgaagcacaacagttgacaaaggagggttaagtgttcaataattcacggagggtaattgcagcaatttaggtttgggggccggcgggctatctcgcaagccgcggccgaattacttgtgttaatcctattcatgcaatatttgcaaaaagaaatacttagatttaatttataggtgcaagctgatcaaaggtgacttgccttgctcgagatcttgagcttgatcctcgaaatcctcgcactgcgggtcttcaggctccgaaactacacgccgaacgggataactcaacaaacagcgaaaataaagccctattattgacctctaagcgtgccattagatagatctcaagatttgaggaattttggaagttgaacggagtcaaacggacatacggttgaggagatattgaatttctaagattattagatttttgatctaaagaaagaggatttatttaaatcctttttgagaaaagaaaagaaaagaaagagggaagggaattagacttccctcgggcggctagggcgcggcccgagagaaaggggcggctcgaccgagcttaatgggccggccggcccgagaaggcggcccaaggcgcgcgcgcgggcggggaggagagagagagagagagccggtgggtcgggtccatcccgcgtggtcccgagtgggacccgcttgtcggcaacttggctcaccgtgagcgaggtgcacgtggggcgtgctagggtttggggagggaggcgcggtgcatgcgcgcggttcgtggtggacgcggatgcggcaggcccacgcgcagcctcatggctcgcggtggaccgcgcgcgcgagcggggccggaggaagcggctgaccggggtcagccgatccggtcgtgccgaggtggcaccgacgtggcgcctacgtggctgccacgcgggccggctggaggaagacgaaggcgccggctgcgaatggacggcgggcagcggcggtttctccgggacaccgtgcgacgacgaggggcgacggggtgtacaccggaatgatgagggagaacgagagggagcgagccaacggcttggattcaccggatggagttcgacggcggcggattgcggcggcggcatccggcggcgagagaagatggaaacggcgacggtgcgacgggagatcagttcgggcgagctagagcatctacgtgactccgggaatccatcccttgcgccggattaggaggaaacacgccgtgggaggccggcgatgagaggtggctaccggactcgggcggcgacggcggcgagcccactgcgagcgacggcagcagtcggggcggcgccagctagctacggggaggctacacaagcttctaccgaaagctaagaggaagagggggggcaaggagggagaacgggaagatgcactaccgtgcgggcgggcgcagtgacgacggccgacggcgcggggcgtgatcgctccggcctcgggccggggaacaggaaagagagggtgcacccggagtccccttcacgcgttcttcgcacgcaccggctctcccggcgcttggcaatgaacggcagaggcgagacagaggggcggcaatggcgcggtggtggcgagcgaaacgggggggaggaatcgatgggaggtcgccttggttaaataggaggcgatgttggtttgggaactgacctaaggcggtcaagggagcgagtagcgctcggtccaagggagggtgacgccagcgatgggaggaaaaagaagaaaggaagagggaaatggggcttgcctccttgcttctttgggaaaagaaggagggagagagaacgacgcggcagagggaggaggggctctacctccgtcccttggaagctagcgcgcggtggtggcggggccgggtcgatgacgacggcgatgacggcggaccggtttggagcggagcggcgacacgggcggcaaacgcggggcaggcgcggcaggtgctgacagcggcggcgactggccggtcggccaccacggcgtgcgcgcgcgggaagcaacgggcggcgcggcgatttgggcggcgtcggcgggaagcggcagtgagggctctccgcgctcggctccgcgcggctcacgcgcacgcgcgcgcggcgcacgggcagagcgagggagagagggagagagagagagaggggggagagagagatg

SEQ ID NO: 27383 - DNA, 1165 bp, Oryza sativa
  unsure (1)..(1165): unsure at all n locations
ttttcttacatgtttgaccattcgtcttatttaaaaattttatacaaatgtataagatataaatccacttaaagtattatgagtgataaaacaactcataacaaaataaattataattacgtaaatttttttaataagacgaatggtcaaacatgtgagaaaaagtcaacggcgtcatctattaaaaaacggagggagtataattaacattgtgttgccgaattctctctttgatattcatcttccatccagggtttataattccgatcgattttggtaaaactgttagggttcggtttggtaaaaccagacaattttacctggttttcataataaatagttaacagaaaagcatgggttttttttatcaatttctaatggtttttcttggttttcggtgaattgatagggaccggttttcaactcgaaatcagaaatgtgaaacctgatcgggacatgtcagccaagaaacgatgacactcactggatgaagttaatagctacgttctggtatctatactgacttttcattgcactgctaaggcccatgtttaggttccacctcaaaatttttcaccgtatcacatcgaacgtttaaacacatgtataaagtattaaatatagacaaaaaaataactaattgtatagattcgcggctaatttgtgagacgaatcttttaagtctaattgctccatgatttgataatgtagtgctacagtaaacatttgctaatgatggattaattaggcttaataaattcatctcgcggtttactagcggatttcgtatttttttattagtatccaaacactctatacgataccctatataatacccgatgtgacacgttaaaactttacactcctggataagaaaaccggaggtgccagcgaaaactatctaatggacgaaccaaacggaaattggacaaaccatattcaaaatagtcagaagccgtatttcaacttcaacgttagttcaccagccacatgaacagttgttgcatggaggctcccaaacacgaatattagggtatgacctataataataaataattagagggggtgagacttcgaacctagatcagctagcccaccattttgggaagctagccatnnnnnnnnnnnnnnnnnnnnnnnnnnnnnnnnnnnnnnnnnnnnnnnn

SEQ ID NO: 27384 - DNA, 756 bp, Oryza sativa
  unsure (1)..(756): unsure at all n locations
nnnnnnnnnnnnnnnnnnnnnnnnnnnnnnnnnnnnnnnnnnnnnnnnnnnnnnnnnnnnnnaaccttatttttatgaaacacttaatctttatattcatctttatctttagaagattcaaataccataatagtatttaccctacttggcatcgcgaattaacgagggtttggtttgtctcgtcggcggcacgtgttggtgggccatggattggtgtgaatccggcccaggtcccctctcgggctaaagaatctcaccactcttctttcccggataggtgcagaagcacacacatggggagtggattcaattagtattgtgctcgcaaaaggaataggaataagcggccataagaccctctgcgaggtatttttccttacgtaatactctaattgcttgccttattttcaacgtgatttcatagctttttcggtgggaatttccctattaaatactaaaggagcgagctctaattagatacttatttcttttttttcccgagcattgaaataacaaattaaaatcaaaataatatgattcaacctcagacccttttaaatgtagcagataacagtggagctcgaaaattgatgtgtattcgagtcataggagctgctagtaatcagcgatatgctcgtattggtgatgttattattgctgtaatcaaagacgcagtgtcctaaatgcctctagaaagatcccaagtaattcgagctataatngtacgtacatgtaaaagaatcaaatgcgaagacg

SEQ ID NO: 27385 - DNA, 509 bp, Oryza sativa
cgtcttaatattttttttcaagctaagttcagcagttctttcgagattacaggcctccttttgaacgaagaaattttgcgaaaattctacaaaaattgaactaatccatgtgaaagtcctactgaaattcccacgttttaaaggagtactggacatcctctcacgttctgacgtgtttctagtattctaccgattgccatttctaaccgataagagtacagcctcctaatagcattgacctctaacttgtgcacttctgactgaaaaaaatgcaggaggtctggaccatctgcagaatcttcaagagaagcatcacctacaggaagcagcagcagcagcaggcctggaggccgccggcgacggtgaccgtcaaggccccaccgccgggggactcgagctccaacaccggcagcttcgagtcggacggcggcggcgacgagttcatgaactgcggcctgactccggccatctcccagcagcagcagcacggcggccgtcatcagatgatg

SEQ ID NO: 27386 - DNA, 602 bp, Oryza sativa
  unsure (1)..(602): unsure at all n locations
catgctcagtttgttacattttcaaggtgtaatggcatattttcttttaatatgcctctttccccctaatcctgtaggtgcgattgcgtttgatattataatgcgcagtgtgtgaacaacacatttttggtacttcctccgtccccctaatataaaagattttggcattagcatgcactgtttgactattcgtcttattaggaaatttagcattattattatttttatttgtcacttactttattatccatagtcctttaagcacagctttttgttttttatattcacacttattttttgcataataggagtggtcaatcagtgcaagcctaatgtcaaaatccgttatatttgggaacggagggagtagttggtgacagcgtaacttaaactggtatttttgtgtcatggtacatatctcaggagccggtattgttttggtcacagttagggttaaagacaaatttcttgatgcattgatggtcccttttgcagaattggcccaatcaggttgtaagcgttaatgtcttttcttggatannnnnnnnnnnnnnnnnnnnnnnnnnnnnnnnnnnnnnnnnnnnnnnnnnnnnnnnnnnnnn

SEQ ID NO: 27387 - DNA, 596 bp, Oryza sativa
  unsure (1)..(596): unsure at all n locations
acgcnnnnnnnnnnnnnnnnnnnnnnnnnnnnnnnnnnnnnnnnnnnnnnnnnnnnnnnntgattatctgtaaaactatattaaccatacttttagagactcacctctgttgcgatcacaatcaaaggccgaaaaggaacagaagacatcaaatccgtttccttgttaccaaaaactgaaccacatgaccgctgttataggaaggcgatcgatcttcttgtgactagttgtgagttgcgaaccgactctgaagccgactcgcctagtgcgatgcaacacggcactgaatcggagtcttcgcctacagtatgtatgtaagagagccaaaagcgttgctacctgcatagatccaacgccacatactcacatctatcaccatgatggacaacacgagacatgtccctgtgccttgcaacgcctctgaagcactgatccgattcatacaagccggcgctatacatcatctcggagaaaaaggccatcgatgcctacatacccgggatgactaacagaaacgcctggccgacgcagctaggatggatcctgatccgcgacgacgccaccatgtttctgcagaacccacaggatcctgacga

SEQ ID NO: 27388 - DNA, 305 bp, Oryza sativa
  unsure (1)..(305): unsure at all n locations
aggacgacgcagccgccgtcgccgccggccggcttgccggagaggaggcaggtgcacctcctcggcggcaagtcgtcttggggcagatgcgggagaggaatcgtgtcgtaggagtcgcgagggttctgcaggaacgtggcggcgacggcgtcgcgcactaggatccagccctgcggcgtcgcccaggcgttggcattggtcagcccagggatgnnntcgccgccgtcgatgaccttcctctccgagatgctgaacagcaccggcttgtcggagccgccgccggcgtgctccagggcgaggcaggg

SEQ ID NO: 27389 - DNA, 677 bp, Oryza sativa
ccccctatagcaatgtacttcctccgtttcacaatgtaagactttatagtattgcccatattcatatatatgctaatgaatctaattagcatctatattaatatggacaatgctagaaagtcttacattgtaaaacggaggaagtactaaccaagagcaagaacaatatagtgtatgatatcggcgttttggagagaatgtcacattatgagcgaggatatatttatataccattcaataaaatatttaatacactatttataccatttcgtacaatacatctgttctaaaatatagcaacttttggctatacatagagatatactcttgtttaaattaaatgtactgtggaagttgtaatattaaaagaccctcattgttatttaacaaaatagaatacaaagaaaacaaaattttggttttattaagggtagcgcagtaatcgtacaaaatacaaggacttgtgtgcaaaatattcttctctccggctctcccacaccaaattcttgaccccccacctgcgccccgagcctcttgacggcggcggcggcggggacgacgaatttcttgcacccgcattccccttcttctagcaagctagccgacgggaacgccctccggttccccctatgaactgacgtcgagaccttattaccgggcggcaccagcgccaacgc

SEQ ID NO: 27390 - DNA, 682 bp, Oryza sativa
ggtcgactctagaggatccccgactccgcccgatcctggctccacggactacctcgtggcacgatcggatcatgggcggaacttcgtgatcacttcatcgccaacttccagggcacctttgaacgccccggcacacagttcgatctctacaacgtcgttcagaagtctggagaatcccttcgagattacatccgacgcttctctgaactacgcaacaagatctccgacatcaccgacgacgtcatcatcgccgccttaactaaaggcattcgccacgaggacctagttggcaagttcggacgtaaacctcccaggacggttaagcagatgttcaaaaaagccaacgagtatgccaaagccgaagatgctattaccgcgtccaaacagtcgggcaccacttggaagccaaagaaggacacgccgaccgcaggagggagtggaagtaacaaccacaaggatcgcaagcgtaagcctgaagaacttgtggcgaccacctcttcaccttcccgacaacgttcccgcgtcaacaccttcgacaagataatgaactcccaatgtccgcatcattccaacttcaaccacgtgggcaaagattgcttcgtctacaaacaggttgcggagcaatatgtaagaacgcgcgtaagccctcagacggagatcaaggcgcatcaattagaacgat

SEQ ID NO: 27391 - DNA, 989 bp, Oryza sativa
  unsure (1)..(989): unsure at all n locations
aggcacacgaaagtttcgtcttcaacacgacaacccccacatttttcctcttccttccacttcggccaatcccctcataaaagcgtgtgcaagccatcccactcagaatccatcgcccaccccgccattcgctgctgctgttgtttttgttaccactactacccccaccaccacctccgtttgggtttctcccaaccctcccanaacctcccaaaaatccgcgcgcgatgtcacgnaagcgcgagcgcccgctcgaggtcgtcgcgccgccgncgacnccgctctccccgagcaagcgctgcgnncggncggggctcgtcgttatgtgnctgtgagttcccgctctcgtccctcccccgttttttggttccttccccctcccccttggaatagcgactcaccagtgccggttgcgtttggttcgcgtgggatctgtgctcttgcaggcgcaggaagccgaagccggtcggcgtggagcagatggcggcgcgcctgattcggcaggtgggttgtggtctctgcatttgggatcgtctcccaattagttttctgggtgatggttcatgttagttgattcagtttttttttctttggggggtgaagttggttttgatttaattaatttctactacttcattcgtgcaatagatgcaagtgcagatggtcaaattgtttatgcttctcatgtttctcgtcgcgcgccttggcaacgtggagaggctgcttctcgagcaaccgtatctgatccgaaggttgcttgaggagcactttggtatttttcagaggtttgcttctgtttactcgagtggaacacatacattttttttacaagcatgaaattcgagattcattgtcgggtttagatgttaccagtgaacgctgccagctcgttgtcgacaatgcatcggtaatcattatgggggcgtgacttgggggaagtggaggaggttggattgggggtatagtatagggtctcaacacgctcacaa

SEQ ID NO: 27392 - DNA, 102 bp, Oryza sativa
  unsure (1)..(102): unsure at all n locations
nnnnnnnnnnnnnnnnnnnnnnnnnnnnnnnnnnnnnnnnnnnnnataataataataataataataataataataataataataataataataataataata
